United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 5

SEQ ID NO: 13119 - DNA, 1197 bp, Artificial Sequence
  chemically treated genomic DNA (Homo sapiens) CpG-island No: 13119
attttaaatgtaattattttagcgatagtgtatttaattcgttagtggttcgagtagtttcgtgtaagtgttatatagcgcgcgaggtcgtgttttgttacgatcgttttttcgtgcgttgcgcgcgtttggtttatagtagcgatgtggtagcgtgcgatacgcgcggagacgatgcgcgtatattcgtagtaatattagacgttagtcgtgtcgcgtgtagttttagagtattcgaatgaaatggggcggtttcgatgttttttcgatttttttcgggtgcgtaggtttatcgttacgttttggttttgttcgtcgtttatcggtttgattattagcgaatcgtgttcggcgaggaacgcggcgttttttttcgcgttgtcggttaggcgttgttgtagttgacgtaggtcggcgtgttgtagggcgcggtgggtgaggattttgttttggtagagggttatgtttatcgtcgtggttaggtcggagagcgatttacggtagcggatttgtcggtcgttttgggttagggtgaataggtcgttttcggcgtcgtcgacgcgtatttcgatgtcgcgtcggtgggtttcgtcgacgatgattcgggcgtaggggttgaggttttttttcgggtcggggtcgaggaatagcgattggttgatgtcgtttttgcgtttgatggtgaaggtcgttagttcgcggaagtcgagtttgcggtagagcgttttggtttgttggttgttgtgtagtatcgagaggtcgaggtaagttagttcgcggtttatgaagtgttcgattaggtgtcgtattagcgtttcgtcgacgttcggtcggttgtattgcgggtttatcgttaggtattagaggttggagtcgtttttcggattttggaacgttttggcgtggttgaggtttattatcgtgtttatcgcgacgttagtgtcggcgttttcggttagttagtagatcggttcgttttggtgtcgcgggttgaggcgttcggtttgtatcggaagtatgtcgcgcgttaggtataggcggttgatcgtcgtttagtttttttcggtatgtattcggcggatgcggaaatcgcgtggcggacggcgcgtcgggcggtagtcggtgaattataggcgtagggtattcgagggatgggaacgtattttatttgcggaacgggaagttaaaggtagttag

SEQ ID NO: 13120 - DNA, 1197 bp, Artificial Sequence
  chemically treated genomic DNA (Homo sapiens) CpG-island No: 13120
ctaactacctttaacttcccgttccgcaaataaaatacgttcccatccctcgaataccctacgcctataattcaccgactaccgcccgacgcgccgtccgccacgcgatttccgcatccgccgaatacataccgaaaaaaactaaacgacgatcaaccgcctatacctaacgcgcgacatacttccgatacaaaccgaacgcctcaacccgcgacaccaaaacgaaccgatctactaactaaccgaaaacgccgacactaacgtcgcgataaacacgataataaacctcaaccacgccaaaacgttccaaaatccgaaaaacgactccaacctctaatacctaacgataaacccgcaatacaaccgaccgaacgtcgacgaaacgctaatacgacacctaatcgaacacttcataaaccgcgaactaacttacctcgacctctcgatactacacaacaaccaacaaaccaaaacgctctaccgcaaactcgacttccgcgaactaacgaccttcaccatcaaacgcaaaaacgacatcaaccaatcgctattcctcgaccccgacccgaaaaaaaacctcaacccctacgcccgaatcatcgtcgacgaaacccaccgacgcgacatcgaaatacgcgtcgacgacgccgaaaacgacctattcaccctaacccaaaacgaccgacaaatccgctaccgtaaatcgctctccgacctaaccacgacgataaacataaccctctaccaaaacaaaatcctcacccaccgcgccctacaacacgccgacctacgtcaactacaacaacgcctaaccgacaacgcgaaaaaaaacgccgcgttcctcgccgaacacgattcgctaataatcaaaccgataaacgacgaacaaaaccaaaacgtaacgataaacctacgcacccgaaaaaaatcgaaaaaacatcgaaaccgccccatttcattcgaatactctaaaactacacgcgacacgactaacgtctaatattactacgaatatacgcgcatcgtctccgcgcgtatcgcacgctaccacatcgctactataaaccaaacgcgcgcaacgcacgaaaaaacgatcgtaacaaaacacgacctcgcgcgctatataacacttacacgaaactactcgaaccactaacgaattaaatacactatcgctaaaataattacatttaaaat

SEQ ID NO: 13121 - DNA, 775 bp, Artificial Sequence
  chemically treated genomic DNA (Homo sapiens) CpG-island No: 13121
ttaatcgtcgtacgcgacgaatggtagtattacgcggtatggttgtaggaggcgttttgtaatgtgagtgacgaagtcgggttaatgcgcgattgcggttatttcggcggcgtattatggtgcgtatcgtttgggcgtaaacgttggtattggttattgaagagagtatattgtagtagtttagttatttggcggagacgttgattgttgcggcgcgtgattggttgtatgacgtttgttgtcgcgagtggggaacgtcgtgtaatgcgtagggcgaacgtatatcgttgttgattttaggtatgggtaagttgggcggtggggagttgaattttttttttgatatcgatttgatttttgtttggtcggaatatggttgtacgtagggtggacgtcgggaattggataacgcgtagttttttattcgtatggggtagcggttgattaaagtgttggattaattaacgtaggatggtttcgtttatcgcgtggatatgcggttgcgttcgtttggcgaaagtggttcgttggtgttgagttttgtcgcgttggaagattattattaggagtaggggcgcgattgggaacgttacgcgatggttaaggcgcggattatcggcgatacgaaggcgtttattttaacgagttgcgtttattttgcgttcgtttgttttcggtcgtatatcgattttagcgttatttacgacgtagacgattttagaagattttttaggtttataggtgtatcgtattcggtaaattatatttatattaa

SEQ ID NO: 13122 - DNA, 775 bp, Artificial Sequence
  chemically treated genomic DNA (Homo sapiens) CpG-island No: 13122
ttaatataaatataatttaccgaatacgatacacctataaacctaaaaaatcttctaaaatcgtctacgtcgtaaataacgctaaaatcgatatacgaccgaaaacaaacgaacgcaaaataaacgcaactcgttaaaataaacgccttcgtatcgccgataatccgcgccttaaccatcgcgtaacgttcccaatcgcgcccctactcctaataataatcttccaacgcgacaaaactcaacaccaacgaaccactttcgccaaacgaacgcaaccgcatatccacgcgataaacgaaaccatcctacgttaattaatccaacactttaatcaaccgctaccccatacgaataaaaaactacgcgttatccaattcccgacgtccaccctacgtacaaccatattccgaccaaacaaaaatcaaatcgatatcaaaaaaaaaattcaactccccaccgcccaacttacccatacctaaaatcaacaacgatatacgttcgccctacgcattacacgacgttccccactcgcgacaacaaacgtcatacaaccaatcacgcgccgcaacaatcaacgtctccgccaaataactaaactactacaatatactctcttcaataaccaataccaacgtttacgcccaaacgatacgcaccataatacgccgccgaaataaccgcaatcgcgcattaacccgacttcgtcactcacattacaaaacgcctcctacaaccataccgcgtaatactaccattcgtcgcgtacgacgattaa

SEQ ID NO: 13123 - DNA, 775 bp, Artificial Sequence
  chemically treated genomic DNA (Homo sapiens) CpG-island No: 13123
ttgatgtgagtatggtttgtcggatacggtgtatttgtaggtttgggggattttttagagtcgtttgcgtcgtaaataacgttgaaatcgatgtacgatcgaagatagacgggcgtagaatggacgtaattcgttagaatagacgttttcgtatcgtcgataattcgcgttttgattatcgcgtaacgtttttagtcgcgtttttgtttttggtaataattttttaacgcggtaaagtttagtattagcgggttattttcgttaaacggacgtagtcgtatatttacgcgatagacgaagttattttgcgttggttgatttagtattttaattagtcgttgttttatgcgggtaaaaaattgcgcgttatttagttttcggcgtttattttgcgtataattatgtttcggttaggtaaaaattagatcgatattagaggagaaatttagttttttatcgtttagtttatttatgtttaaaattagtagcggtatgcgttcgttttgcgtattgtacggcgttttttattcgcggtagtaggcgttatatagttagttacgcgtcgtaataattagcgttttcgttagatagttgagttgttgtaatatgttttttttagtaattagtgttagcgtttgcgtttaggcgatgcgtattataatgcgtcgtcggaatagtcgtagtcgcgtattaattcggtttcgttatttatattatagagcgttttttgtaattatgtcgcgtaatgttgttattcgtcgcgtgcggcggttgg

SEQ ID NO: 13124 - DNA, 775 bp, Artificial Sequence
  chemically treated genomic DNA (Homo sapiens) CpG-island No: 13124
ccaaccgccgcacgcgacgaataacaacattacgcgacataattacaaaaaacgctctataatataaataacgaaaccgaattaatacgcgactacgactattccgacgacgcattataatacgcatcgcctaaacgcaaacgctaacactaattactaaaaaaaacatattacaacaactcaactatctaacgaaaacgctaattattacgacgcgtaactaactatataacgcctactaccgcgaataaaaaacgccgtacaatacgcaaaacgaacgcataccgctactaattttaaacataaataaactaaacgataaaaaactaaatttctcctctaatatcgatctaatttttacctaaccgaaacataattatacgcaaaataaacgccgaaaactaaataacgcgcaattttttacccgcataaaacaacgactaattaaaatactaaatcaaccaacgcaaaataacttcgtctatcgcgtaaatatacgactacgtccgtttaacgaaaataacccgctaatactaaactttaccgcgttaaaaaattattaccaaaaacaaaaacgcgactaaaaacgttacgcgataatcaaaacgcgaattatcgacgatacgaaaacgtctattctaacgaattacgtccattctacgcccgtctatcttcgatcgtacatcgatttcaacgttatttacgacgcaaacgactctaaaaaatcccccaaacctacaaatacaccgtatccgacaaaccatactcacatcaa

SEQ ID NO: 13125 - DNA, 795 bp, Artificial Sequence
  chemically treated genomic DNA (Homo sapiens) CpG-island No: 13125
tggtcgaagatttgcgggtttttattagtttggtcggttagtttattattttgttttttttcggtttcgttttcgtcgtatcgttgttcggttggttgattcggcgtatcgaacgtcgtcgtttgttgttggcgattttgttgttgttcgtttttagtaacgcgttcgtcgttttcgtttcgggttatttcggtttgtttttggttcgtttgggaatgtcggtttgttgcgggttgttgatcgttttcgttagtttgttcgtcgtcgagttggtcgtttcggtttagcgcggtcgggcgatcggtttgatttttatgggtattagcggttcgttggtgttcggcgtgttattgggcgtatagattagcgattggttcggttggcgttggattttcgtcggtatcgcggtttattcgttgtttttgtgtttgttgttttggcgttatttgtcgtaacgttaggtcggcgatttgttcggtcgcgaaggttatttgcggtagttgcgttagatcgcgttgtggttcgcgtaattggtatcgattttgttgttcggcgggtattttattttgttcgtttattttatttcgtatttggcgagtatggtcggtattcgttcgtttagcgagattagtttgatatttttgttgatcggttggtacgttgagcgcggttatatcggcggtgtttgcgatattcggtacgcgtgttcgttgtgcgcgtttgttggttggcgtcgtattggaatggtttcgatatgttattatataattcggtaatttttaatttttttaatcg

SEQ ID NO: 13126 - DNA, 795 bp, Artificial Sequence
  chemically treated genomic DNA (Homo sapiens) CpG-island No: 13126
cgattaaaaaaattaaaaattaccgaattatataataacatatcgaaaccattccaatacgacgccaaccaacaaacgcgcacaacgaacacgcgtaccgaatatcgcaaacaccgccgatataaccgcgctcaacgtaccaaccgatcaacaaaaatatcaaactaatctcgctaaacgaacgaataccgaccatactcgccaaatacgaaataaaataaacgaacaaaataaaatacccgccgaacaacaaaatcgataccaattacgcgaaccacaacgcgatctaacgcaactaccgcaaataaccttcgcgaccgaacaaatcgccgacctaacgttacgacaaataacgccaaaacaacaaacacaaaaacaacgaataaaccgcgataccgacgaaaatccaacgccaaccgaaccaatcgctaatctatacgcccaataacacgccgaacaccaacgaaccgctaatacccataaaaatcaaaccgatcgcccgaccgcgctaaaccgaaacgaccaactcgacgacgaacaaactaacgaaaacgatcaacaacccgcaacaaaccgacattcccaaacgaaccaaaaacaaaccgaaataacccgaaacgaaaacgacgaacgcgttactaaaaacgaacaacaacaaaatcgccaacaacaaacgacgacgttcgatacgccgaatcaaccaaccgaacaacgatacgacgaaaacgaaaccgaaaaaaaacaaaataataaactaaccgaccaaactaataaaaacccgcaaatcttcgacca

SEQ ID NO: 13127 - DNA, 795 bp, Artificial Sequence
  chemically treated genomic DNA (Homo sapiens) CpG-island No: 13127
cgattgagaggattgaagattatcgaattatatggtagtatatcgagattattttagtacgacgttagttagtaagcgcgtataacgagtacgcgtgtcgagtgtcgtaagtatcgtcgatatagtcgcgtttagcgtgttagtcgattagtaggagtattaggttgatttcgttgggcgagcgaatatcggttatgttcgttaggtacggggtgaaataggcgaatagggtgaagtgttcgtcgagtaataggatcgatattagttgcgcgagttatagcgcggtttggcgtaattgtcgtaggtagttttcgcggtcgggtaggtcgtcggtttggcgttgcggtaggtagcgttagagtagtaggtataagggtagcgaatagatcgcgatgtcggcgaagatttagcgttagtcgaattagtcgttgatttgtacgtttagtggtacgtcgaatattagcgaatcgttgatgtttatgaagattaggtcgatcgttcggtcgcgttgggtcggggcggttagttcggcggcgagtaggttggcgaggacgattagtagttcgtaataggtcgatatttttaggcgagttaggagtaggtcgagatagttcggagcgagggcggcgagcgcgttgttgagggcgaatagtagtagggtcgttagtagtaggcggcggcgttcgatgcgtcgggttagttagtcgagtagcggtgcggcgagggcgaagtcgagggagaatagggtggtgagttggtcggttaggttgatggagattcgtaggttttcggtta

SEQ ID NO: 13128 - DNA, 795 bp, Artificial Sequence
  chemically treated genomic DNA (Homo sapiens) CpG-island No: 13128
taaccgaaaacctacgaatctccatcaacctaaccgaccaactcaccaccctattctccctcgacttcgccctcgccgcaccgctactcgactaactaacccgacgcatcgaacgccgccgcctactactaacgaccctactactattcgccctcaacaacgcgctcgccgccctcgctccgaactatctcgacctactcctaactcgcctaaaaatatcgacctattacgaactactaatcgtcctcgccaacctactcgccgccgaactaaccgccccgacccaacgcgaccgaacgatcgacctaatcttcataaacatcaacgattcgctaatattcgacgtaccactaaacgtacaaatcaacgactaattcgactaacgctaaatcttcgccgacatcgcgatctattcgctacccttatacctactactctaacgctacctaccgcaacgccaaaccgacgacctacccgaccgcgaaaactacctacgacaattacgccaaaccgcgctataactcgcgcaactaatatcgatcctattactcgacgaacacttcaccctattcgcctatttcaccccgtacctaacgaacataaccgatattcgctcgcccaacgaaatcaacctaatactcctactaatcgactaacacgctaaacgcgactatatcgacgatacttacgacactcgacacgcgtactcgttatacgcgcttactaactaacgtcgtactaaaataatctcgatatactaccatataattcgataatcttcaatcctctcaatcg

SEQ ID NO: 13129 - DNA, 770 bp, Artificial Sequence
  chemically treated genomic DNA (Homo sapiens) CpG-island No: 13129
cgtatattagggcgcgtttgcgcggtttttatttttttggcgacggcgagtaaaatcgttattttcggtgtggtgatgcgtttgtttttttacgtatcggtgggtgatagcgacggattcgcgtggtgttggcgattatcgtttttgtttttattattttcggtaatttgatggcgttgagtagattaatattaaacgtttgttcggttatttatttattttttatttcggttatttgttggtagcgttgattgcgttgtaaatcggcgagatgtcgatggaagcggtaggggtttatttggtcggttatttgtttagtagtttcggcgcgttcggcgtggttagtttgatgtttagttcgtatcgtggttcggatgttgattttttgtttttttatcgcggtttgttttggtatcgttcgattttcgcggtagtgatgacggtgatgatgttgtttttggtcggtatttcgatgacgttgggttttatcggtaagttttacgtgttggcggtcggtgtttaggtatatttgtggtggttggtgggtgtcgtggttgtcggttcggtaatcggtttttattattatttgcgcgtggcggtgagtttgtatttttacgtttcggaataatcgggtcgcgatgtattattaaattggtagtatagcgcgggcggtatcgttgtgttgatttttgtattgttggtattggtgttgggtgtatggttataatcgttgattagtattgtgcgtttggtaatgtcgttgatgtaat

SEQ ID NO: 13130 - DNA, 770 bp, Artificial Sequence
  chemically treated genomic DNA (Homo sapiens) CpG-island No: 13130
attacatcaacgacattaccaaacgcacaatactaatcaacgattataaccatacacccaacaccaataccaacaatacaaaaatcaacacaacgataccgcccgcgctatactaccaatttaataatacatcgcgacccgattattccgaaacgtaaaaatacaaactcaccgccacgcgcaaataataataaaaaccgattaccgaaccgacaaccacgacacccaccaaccaccacaaatatacctaaacaccgaccgccaacacgtaaaacttaccgataaaacccaacgtcatcgaaataccgaccaaaaacaacatcatcaccgtcatcactaccgcgaaaatcgaacgataccaaaacaaaccgcgataaaaaaacaaaaaatcaacatccgaaccacgatacgaactaaacatcaaactaaccacgccgaacgcgccgaaactactaaacaaataaccgaccaaataaacccctaccgcttccatcgacatctcgccgatttacaacgcaatcaacgctaccaacaaataaccgaaataaaaaataaataaataaccgaacaaacgtttaatattaatctactcaacgccatcaaattaccgaaaataataaaaacaaaaacgataatcgccaacaccacgcgaatccgtcgctatcacccaccgatacgtaaaaaaacaaacgcatcaccacaccgaaaataacgattttactcgccgtcgccaaaaaaataaaaaccgcgcaaacgcgccctaatatacg

SEQ ID NO: 13131 - DNA, 770 bp, Artificial Sequence
  chemically treated genomic DNA (Homo sapiens) CpG-island No: 13131
attatattagcggtattgttaaacgtataatgttaattagcggttgtggttatatatttagtattagtattaatagtgtagagattagtataacgatatcgttcgcgttgtattgttagtttgatggtgtatcgcgattcggttgtttcggggcgtgaagatataggtttatcgttacgcgtaggtagtagtagaggtcgattgtcgaatcgataattacggtatttattagttattataagtgtgtttggatatcgatcgttagtacgtagaatttatcgataaagtttagcgttatcgggatatcggttagagatagtattattatcgttattattgtcgcgaggatcggacgatgttagaatagatcgcggtaagagaatagggaattagtattcgggttacgatacgggttggatattaggttgattacgtcgaacgcgtcgaggttgttgaatagataatcggttaggtaaatttttatcgtttttatcgatatttcgtcggtttgtagcgtaattagcgttattagtagatagtcgaggtgagagatagatgagtaatcgagtagacgtttgatattggtttgtttagcgttattaggttatcgaagatgatggaggtaaaggcgataatcgttagtattacgcgaattcgtcgttgttatttatcggtgcgtagaggaatagacgtattattatatcgaagatagcgattttgttcgtcgtcgttaggaaagtggaaatcgcgtaggcgcgttttggtatacg

SEQ ID NO: 13132 - DNA, 770 bp, Artificial Sequence
  chemically treated genomic DNA (Homo sapiens) CpG-island No: 13132
cgtataccaaaacgcgcctacgcgatttccactttcctaacgacgacgaacaaaatcgctatcttcgatataataatacgtctattcctctacgcaccgataaataacaacgacgaattcgcgtaatactaacgattatcgcctttacctccatcatcttcgataacctaataacgctaaacaaaccaatatcaaacgtctactcgattactcatctatctctcacctcgactatctactaataacgctaattacgctacaaaccgacgaaatatcgataaaaacgataaaaatttacctaaccgattatctattcaacaacctcgacgcgttcgacgtaatcaacctaatatccaacccgtatcgtaacccgaatactaattccctattctcttaccgcgatctattctaacatcgtccgatcctcgcgacaataataacgataataatactatctctaaccgatatcccgataacgctaaactttatcgataaattctacgtactaacgatcgatatccaaacacacttataataactaataaataccgtaattatcgattcgacaatcgacctctactactacctacgcgtaacgataaacctatatcttcacgccccgaaacaaccgaatcgcgatacaccatcaaactaacaatacaacgcgaacgatatcgttatactaatctctacactattaatactaatactaaatatataaccacaaccgctaattaacattatacgtttaacaataccgctaatataat

SEQ ID NO: 13133 - DNA, 842 bp, Artificial Sequence
  chemically treated genomic DNA (Homo sapiens) CpG-island No: 13133
cgttcggatgttgagtaggcggatgtgtttattattgaagcgtacgttatcgggattgttagtgtagaatagttgatcgaaattattaaataagcgggttatgacgtatttgtaagttatttaaaggttaaatcgttggcggagttattaatttcgtcggaagtattgatagcggtttttgaggcgttttcggtagcgatcgtcgatgacgatgatagttagtagttgttgttgagcggtatgagttgcgttagttgtgttattcgcgtataaaatgcgttgtaaagcgtatcgggcgttatttaggtacgggtaaatttggcggacgtattgcgttggtgatgggtagtgtttttttataagatttagtgtaggcggtggaaaaagcgggttacggcgcggaagcgattgaagatgacgttaaacgtcgcgagcgttataagaaatcgtcgtcgttacgatgaagcgttttcgttggtaggtaattgtcgtattggcggtgggtatttcggtgatggtttgggggatgatcggcgataatatgatggttatcgttgataatcgtagtttgtggttggttatcggtttgataattttggtagtgatggttttcgtcggcggttatttttatcgtagtgtatggaaaagtttgttgaacggtgcggcgacgatggatacgttggtggcgttgggtattggcgtggcgtggttttattcgacgaaatatttgtttacgagtaaaatcgaacgtcgtcgtcgtttcgatatgttttttcggtattgttataaaagtattacggaacgtttcggtaaaataagtatcgtagataaaatcgagagtg

SEQ ID NO: 13134 - DNA, 842 bp, Artificial Sequence
  chemically treated genomic DNA (Homo sapiens) CpG-island No: 13134
cactctcgattttatctacgatacttattttaccgaaacgttccgtaatacttttataacaataccgaaaaaacatatcgaaacgacgacgacgttcgattttactcgtaaacaaatatttcgtcgaataaaaccacgccacgccaatacccaacgccaccaacgtatccatcgtcgccgcaccgttcaacaaacttttccatacactacgataaaaataaccgccgacgaaaaccatcactaccaaaattatcaaaccgataaccaaccacaaactacgattatcaacgataaccatcatattatcgccgatcatcccccaaaccatcaccgaaatacccaccgccaatacgacaattacctaccaacgaaaacgcttcatcgtaacgacgacgatttcttataacgctcgcgacgtttaacgtcatcttcaatcgcttccgcgccgtaacccgctttttccaccgcctacactaaatcttataaaaaaacactacccatcaccaacgcaatacgtccgccaaatttacccgtacctaaataacgcccgatacgctttacaacgcattttatacgcgaataacacaactaacgcaactcataccgctcaacaacaactactaactatcatcgtcatcgacgatcgctaccgaaaacgcctcaaaaaccgctatcaatacttccgacgaaattaataactccgccaacgatttaacctttaaataacttacaaatacgtcataacccgcttatttaataatttcgatcaactattctacactaacaatcccgataacgtacgcttcaataataaacacatccgcctactcaacatccgaacg

SEQ ID NO: 13135 - DNA, 842 bp, Artificial Sequence
  chemically treated genomic DNA (Homo sapiens) CpG-island No: 13135
tattttcggttttatttacggtgtttattttatcgaaacgtttcgtggtgtttttatggtagtgtcgaaaggatatatcgaggcggcgacggcgttcggttttattcgtgggtaagtgtttcgtcgaataaagttacgttacgttagtatttagcgttattagcgtatttatcgtcgtcgtatcgtttagtaagtttttttatgtattgcggtaaaaatggtcgtcggcgaaaattattattgttagggttattaggtcgataattaattataggttgcggttgttagcggtgattattatgttatcgtcgattattttttagattattatcgggatatttatcgttagtgcgataattgtttgttagcggaagcgttttatcgtagcgacggcggttttttgtggcgttcgcggcgtttagcgttatttttaatcgttttcgcgtcgtagttcgttttttttatcgtttgtattaaattttgtggggaggtattgtttattattagcgtagtacgttcgttaggtttattcgtgtttgagtgacgttcggtacgttttgtagcgtattttgtacgcgggtgatatagttggcgtagtttatgtcgtttagtagtaattgttggttgttatcgttatcggcggtcgttgtcggaagcgttttagaaatcgttgttagtgttttcgacgggattgatgatttcgttagcggtttagtttttgggtggtttatagatgcgttataattcgtttgtttgatggtttcgattagttgttttgtattggtagtttcggtaacgtgcgttttagtgatagatatattcgtttgtttaatattcggacg

SEQ ID NO: 13136 - DNA, 842 bp, Artificial Sequence
  chemically treated genomic DNA (Homo sapiens) CpG-island No: 13136
cgtccgaatattaaacaaacgaatatatctatcactaaaacgcacgttaccgaaactaccaatacaaaacaactaatcgaaaccatcaaacaaacgaattataacgcatctataaaccacccaaaaactaaaccgctaacgaaatcatcaatcccgtcgaaaacactaacaacgatttctaaaacgcttccgacaacgaccgccgataacgataacaaccaacaattactactaaacgacataaactacgccaactatatcacccgcgtacaaaatacgctacaaaacgtaccgaacgtcactcaaacacgaataaacctaacgaacgtactacgctaataataaacaatacctccccacaaaatttaatacaaacgataaaaaaaacgaactacgacgcgaaaacgattaaaaataacgctaaacgccgcgaacgccacaaaaaaccgccgtcgctacgataaaacgcttccgctaacaaacaattatcgcactaacgataaatatcccgataataatctaaaaaataatcgacgataacataataatcaccgctaacaaccgcaacctataattaattatcgacctaataaccctaacaataataattttcgccgacgaccatttttaccgcaatacataaaaaaacttactaaacgatacgacgacgataaatacgctaataacgctaaatactaacgtaacgtaactttattcgacgaaacacttacccacgaataaaaccgaacgccgtcgccgcctcgatatatcctttcgacactaccataaaaacaccacgaaacgtttcgataaaataaacaccgtaaataaaaccgaaaata

SEQ ID NO: 13137 - DNA, 500 bp, Artificial Sequence
  chemically treated genomic DNA (Homo sapiens) CpG-island No: 13137
gtcgttttttgattcggttacgcgcgtggtgttgacgatatcggtttttgtcgatgttaatagcgaagaagtgacggaaattttgtttatcgtagcgcgtcgttgttcgttggtgatcgataattcggtatcggaagtttttttggtggatttgtaataggggatttagattttcgagttgcgtatttacgtcgttgagatgggttatcgtatgtcgttacgttatgagattttatagttgattttggttggtttttatgtttacggtatcgatatgttattttcgttttttagatgcgtttggaaagttttaacggtaaataaacggggagacggagaacgtcgttcgtttttttgggtggttggcgattagggcgtttatcgcgttaatatgtaattagagcgcgaattaagcgcggtgaacgtattgtcgtaattaatttgcgtatatttgacgagatttaatttgcgtttgtcggtaaagggattttttttcgttt

SEQ ID NO: 13138 - DNA, 500 bp, Artificial Sequence
  chemically treated genomic DNA (Homo sapiens) CpG-island No: 13138
aaacgaaaaaaaatccctttaccgacaaacgcaaattaaatctcgtcaaatatacgcaaattaattacgacaatacgttcaccgcgcttaattcgcgctctaattacatattaacgcgataaacgccctaatcgccaaccacccaaaaaaacgaacgacgttctccgtctccccgtttatttaccgttaaaactttccaaacgcatctaaaaaacgaaaataacatatcgataccgtaaacataaaaaccaaccaaaatcaactataaaatctcataacgtaacgacatacgataacccatctcaacgacgtaaatacgcaactcgaaaatctaaatcccctattacaaatccaccaaaaaaacttccgataccgaattatcgatcaccaacgaacaacgacgcgctacgataaacaaaatttccgtcacttcttcgctattaacatcgacaaaaaccgatatcgtcaacaccacgcgcgtaaccgaatcaaaaaacgac

SEQ ID NO: 13139 - DNA, 500 bp, Artificial Sequence
  chemically treated genomic DNA (Homo sapiens) CpG-island No: 13139
aagcgaagaaaaatttttttgtcgataggcgtaaattaaatttcgttaggtgtacgtaggttagttacggtaatgcgtttatcgcgtttggttcgcgttttgattgtatattggcgcgataaacgttttgatcgttaattatttaggagagcggacgacgtttttcgttttttcgtttgtttatcgttgaggttttttagacgtatttgaagggcggaaatggtatatcgatatcgtgggtatggaagttagttagaattagttgtgggattttatggcgtagcggtatacggtgatttattttagcggcgtaaatacgtagttcgaaaatttgaattttttgttgtagatttattaggaagattttcggtgtcgggttgtcgattattagcgagtagcgacgcgttgcggtgagtaggattttcgttattttttcgttattggtatcggtaggggtcggtatcgttaatattacgcgcgtgatcgagttagagagcgat

SEQ ID NO: 13140 - DNA, 500 bp, Artificial Sequence
  chemically treated genomic DNA (Homo sapiens) CpG-island No: 13140
atcgctctctaactcgatcacgcgcgtaatattaacgataccgacccctaccgataccaataacgaaaaaataacgaaaatcctactcaccgcaacgcgtcgctactcgctaataatcgacaacccgacaccgaaaatcttcctaataaatctacaacaaaaaattcaaattttcgaactacgtatttacgccgctaaaataaatcaccgtataccgctacgccataaaatcccacaactaattctaactaacttccatacccacgatatcgatataccatttccgcccttcaaatacgtctaaaaaacctcaacgataaacaaacgaaaaaacgaaaaacgtcgtccgctctcctaaataattaacgatcaaaacgtttatcgcgccaatatacaatcaaaacgcgaaccaaacgcgataaacgcattaccgtaactaacctacgtacacctaacgaaatttaatttacgcctatcgacaaaaaaatttttcttcgctt

SEQ ID NO: 13141 - DNA, 806 bp, Artificial Sequence
  chemically treated genomic DNA (Homo sapiens) CpG-island No: 13141
  misc_feature (692)..(692): n is either a, c, g or t
tggttggttcgcgcgggcgaaaaaacgtcgtcggatgcgttggaaaaatttatcgattttttgatgttcgtcgtagtaatggttagcgtcggtaaagcggatgtttgtatcgcgggtaattttttttttacggtaaatgtgttgcgtgtcggattacgtattatcggtttgtagttaggttgtaaaacgtttttttttatttttttgatgttgttatagtatagcggttcggcgttgggttttgtcgattgtagcgtggtgttatagtcgacggcggcgtagttggcggatatcgcgtttgttagtgtcgaaatttggcgcgttattatcggagaagagtcgcgcgtggcgatgttgtcgttttttagtaatggtagcgttcgttatttttgtgttgttaacgtttagtaggcgatagaaatcgttcgtgagcgcgtattaaagttggtggtggatggcgagttatagtttgacgtcgttttcgtgtcggaagtggcggcgtaaaaagcgtttgttagttcgttatagggtaaggttaatgtgatggttttttcgtcgttggaagtcggaaatattggttataaaatcgtataacgattcggcggatatcgtgtcgtcgggttattgatataaggatttgtcgcgtcgatgtacgatttttttcgtggttgtagcgtgtaggaaattatcgnagtggcgttggtggtagttgtgtcgcgttagatagaagtgaatcgcgaaagtagtttataaatattggttgaatgaacggtttcgttttggattttgataaagaggaaagtata

SEQ ID NO: 13142 - DNA, 806 bp, Artificial Sequence
  chemically treated genomic DNA (Homo sapiens) CpG-island No: 13142
  misc_feature (115)..(115): n is either a, c, g or t
tatactttcctctttatcaaaatccaaaacgaaaccgttcattcaaccaatatttataaactactttcgcgattcacttctatctaacgcgacacaactaccaccaacgccactncgataatttcctacacgctacaaccacgaaaaaaatcgtacatcgacgcgacaaatccttatatcaataacccgacgacacgatatccgccgaatcgttatacgattttataaccaatatttccgacttccaacgacgaaaaaaccatcacattaaccttaccctataacgaactaacaaacgctttttacgccgccacttccgacacgaaaacgacgtcaaactataactcgccatccaccaccaactttaatacgcgctcacgaacgatttctatcgcctactaaacgttaacaacacaaaaataacgaacgctaccattactaaaaaacgacaacatcgccacgcgcgactcttctccgataataacgcgccaaatttcgacactaacaaacgcgatatccgccaactacgccgccgtcgactataacaccacgctacaatcgacaaaacccaacgccgaaccgctatactataacaacatcaaaaaaataaaaaaaaacgttttacaacctaactacaaaccgataatacgtaatccgacacgcaacacatttaccgtaaaaaaaaaattacccgcgatacaaacatccgctttaccgacgctaaccattactacgacgaacatcaaaaaatcgataaatttttccaacgcatccgacgacgttttttcgcccgcgcgaaccaacca

SEQ ID NO: 13143 - DNA, 806 bp, Artificial Sequence
  chemically treated genomic DNA (Homo sapiens) CpG-island No: 13143
  misc_feature (115)..(115): n is either a, c, g or t
tgtgtttttttttttattagggtttagaacgggatcgtttatttaattagtgtttgtaaattgttttcgcggtttatttttgtttgacgcggtatagttgttattagcgttattncgataattttttgtacgttataattacgagagagatcgtgtatcggcgcggtaagtttttgtattagtggttcgacggtacgatattcgtcgagtcgttgtgcgattttgtaattaatattttcggtttttagcgacggaaaaattattatattggttttgttttgtagcgggttggtaggcgttttttgcgtcgttattttcggtacgaaggcggcgttaaattgtaattcgttatttattattagttttggtgcgcgtttacggacgatttttgtcgtttgttggacgttagtaatataggggtgacgggcgttattattgttggaaaacgatagtatcgttacgcgcggttttttttcggtgatggcgcgttaggtttcggtattggtaagcgcgatattcgttagttgcgtcgtcgtcggttgtggtattacgttgtaatcggtaaagtttaacgtcgggtcgttgtattgtggtaatattaggaaaatggaagagagcgttttatagtttggttgtaagtcgataatgcgtaattcggtacgtagtatatttgtcgtggaagagaggttgttcgcgatatagatattcgttttatcggcgttgattattgttgcggcgaatattagagggtcggtaagtttttttagcgtattcggcggcgttttttcgttcgcgcgggttagtta

SEQ ID NO: 13144 - DNA, 806 bp, Artificial Sequence
  chemically treated genomic DNA (Homo sapiens) CpG-island No: 13144
  misc_feature (692)..(692): n is either a, c, g or t
taactaacccgcgcgaacgaaaaaacgccgccgaatacgctaaaaaaacttaccgaccctctaatattcgccgcaacaataatcaacgccgataaaacgaatatctatatcgcgaacaacctctcttccacgacaaatatactacgtaccgaattacgcattatcgacttacaaccaaactataaaacgctctcttccattttcctaatattaccacaatacaacgacccgacgttaaactttaccgattacaacgtaataccacaaccgacgacgacgcaactaacgaatatcgcgcttaccaataccgaaacctaacgcgccatcaccgaaaaaaaaccgcgcgtaacgatactatcgttttccaacaataataacgcccgtcacccctatattactaacgtccaacaaacgacaaaaatcgtccgtaaacgcgcaccaaaactaataataaataacgaattacaatttaacgccgccttcgtaccgaaaataacgacgcaaaaaacgcctaccaacccgctacaaaacaaaaccaatataataatttttccgtcgctaaaaaccgaaaatattaattacaaaatcgcacaacgactcgacgaatatcgtaccgtcgaaccactaatacaaaaacttaccgcgccgatacacgatctctctcgtaattataacgtacaaaaaattatcgnaataacgctaataacaactataccgcgtcaaacaaaaataaaccgcgaaaacaatttacaaacactaattaaataaacgatcccgttctaaaccctaataaaaaaaaaaacaca

SEQ ID NO: 13145 - DNA, 507 bp, Artificial Sequence
  chemically treated genomic DNA (Homo sapiens) CpG-island No: 13145
gttcggttcggtattggtgggtagagaaaatcgtcggggatattttagttcgttacggcgtaaaaatgggttagtaacgttttattgagcgtttttatcgttagcggattggtaaagtttacgtttgtttttcggcgggtgtaagcgtgaggaattgatagatagcgggttaaagaacgcgtattttagtagtacgttttgtgtttcgttatttacgttagagtgttcgttatcgaagatgtcgtttatcgttagcgttttgttgtggtcggcgatgattagagtgttagtatttagtttcgttttagtatcgtcgagtagtattagcgtttcgttttttttcgttattcgtagtataatgtcgtttttaatgcgatttttatcgaaagcgtgtatcggttggtttagttcgagtagtatatagttggtgacgttaataattgtatcgatagaacggatttcgtaacgacgtagttttttttttatttatagcggagttggcgtttt

SEQ ID NO: 13146 - DNA, 507 bp, Artificial Sequence
  chemically treated genomic DNA (Homo sapiens) CpG-island No: 13146
aaaacgccaactccgctataaataaaaaaaaaactacgtcgttacgaaatccgttctatcgatacaattattaacgtcaccaactatatactactcgaactaaaccaaccgatacacgctttcgataaaaatcgcattaaaaacgacattatactacgaataacgaaaaaaaacgaaacgctaatactactcgacgatactaaaacgaaactaaatactaacactctaatcatcgccgaccacaacaaaacgctaacgataaacgacatcttcgataacgaacactctaacgtaaataacgaaacacaaaacgtactactaaaatacgcgttctttaacccgctatctatcaattcctcacgcttacacccgccgaaaaacaaacgtaaactttaccaatccgctaacgataaaaacgctcaataaaacgttactaacccatttttacgccgtaacgaactaaaatatccccgacgattttctctacccaccaataccgaaccgaac

SEQ ID NO: 13147 - DNA, 507 bp, Artificial Sequence
  chemically treated genomic DNA (Homo sapiens) CpG-island No: 13147
aaagcgttaatttcgttgtggatgaaagaaaaattgcgtcgttgcgggattcgttttatcgatgtagttgttgacgttattaattatgtgttgttcgaattgggttagtcgatgtacgttttcgataaagatcgtattgaaggcggtattgtgttgcggatggcgaaagagggcgaaacgttggtgttgttcgacggtattgaagcgaagttgaatgttgatattttggttatcgtcgattataataaggcgttggcgatgggcggtattttcggtggcgaatattttggcgtgaatgacgaaatataaaacgtgttgttggaatgcgcgttttttagttcgttgtttattaattttttacgtttatattcgtcggggagtaaacgtagattttgttaattcgttggcggtgaaggcgtttaataaggcgttgttggtttatttttacgtcgtagcgaattgggatattttcgacggttttttttgtttattagtatcgggtcgggt

SEQ ID NO: 13148 - DNA, 507 bp, Artificial Sequence
  chemically treated genomic DNA (Homo sapiens) CpG-island No: 13148
acccgacccgatactaataaacaaaaaaaaccgtcgaaaatatcccaattcgctacgacgtaaaaataaaccaacaacgccttattaaacgccttcaccgccaacgaattaacaaaatctacgtttactccccgacgaatataaacgtaaaaaattaataaacaacgaactaaaaaacgcgcattccaacaacacgttttatatttcgtcattcacgccaaaatattcgccaccgaaaataccgcccatcgccaacgccttattataatcgacgataaccaaaatatcaacattcaacttcgcttcaataccgtcgaacaacaccaacgtttcgccctctttcgccatccgcaacacaataccgccttcaatacgatctttatcgaaaacgtacatcgactaacccaattcgaacaacacataattaataacgtcaacaactacatcgataaaacgaatcccgcaacgacgcaatttttctttcatccacaacgaaattaacgcttt

SEQ ID NO: 13149 - DNA, 536 bp, Artificial Sequence
  chemically treated genomic DNA (Homo sapiens) CpG-island No: 13149
gtttatattagtttgttatatgtagatattttttcgttcggtttcgtcgatgagtatatcgagacggagaaaatgttggttgattttggtatcgtttatattttgttgcgtaacggttggtatagcgaaaattatttcgttagcgtttcggtagtattggaatacggcgtatttatcggtgcggcgggcgatggtaaaatcgttttagtaacgcgggtagattatgcggtagttgcggtacgcgtgattagcgaacgcggttacgaaggtaaggtttacgaattggcgggcgatagtgtttggacgttgatatagttagcggtagagttgattaaatagagcggtaaataggttatttattaaaatttgagcgaacgcgatttcgtcgcggtattgaaaagcgtcggattgttcgacggattggcggatatgttggcggattttgacgttggcgtatcgaaaggcggtttgtttgatgatagtaaaatatttagtatattgattggtttattaacgataacgttagtcgaaagcgt

SEQ ID NO: 13150 - DNA, 536 bp, Artificial Sequence
  chemically treated genomic DNA (Homo sapiens) CpG-island No: 13150
acgctttcgactaacgttatcgttaataaaccaatcaatatactaaatattttactatcatcaaacaaaccgcctttcgatacgccaacgtcaaaatccgccaacatatccgccaatccgtcgaacaatccgacgcttttcaataccgcgacgaaatcgcgttcgctcaaattttaataaataacctatttaccgctctatttaatcaactctaccgctaactatatcaacgtccaaacactatcgcccgccaattcgtaaaccttaccttcgtaaccgcgttcgctaatcacgcgtaccgcaactaccgcataatctacccgcgttactaaaacgattttaccatcgcccgccgcaccgataaatacgccgtattccaatactaccgaaacgctaacgaaataattttcgctataccaaccgttacgcaacaaaatataaacgataccaaaatcaaccaacattttctccgtctcgatatactcatcgacgaaaccgaacgaaaaaatatctacatataacaaactaatataaac

SEQ ID NO: 13151 - DNA, 536 bp, Artificial Sequence
  chemically treated genomic DNA (Homo sapiens) CpG-island No: 13151
acgttttcggttaacgttgtcgttggtgggttaattaatgtgttaagtgttttgttgttattaaatagatcgtttttcgatgcgttaacgttagaattcgttagtatattcgttagttcgtcgggtagttcgacgttttttagtgtcgcggcgaaatcgcgttcgtttagattttgataggtaatttgtttgtcgttttgtttggttagttttgtcgttaattgtgttaacgtttaagtattatcgttcgttagttcgtaaattttgttttcgtgatcgcgttcgttaattacgcgtgtcgtagttgtcgtataatttgttcgcgttgttgaggcgattttgttatcgttcgtcgtatcgataaatacgtcgtgttttagtgttgtcggggcgttggcgaggtagttttcgttgtattagtcgttgcgtagtagggtgtaaacgatgttagaattagttagtatttttttcgtttcgatgtgtttatcggcgaggtcgagcggggaggtatttgtatgtagtaggttggtataagt

SEQ ID NO: 13152 - DNA, 536 bp, Artificial Sequence
  chemically treated genomic DNA (Homo sapiens) CpG-island No: 13152
acttataccaacctactacatacaaatacctccccgctcgacctcgccgataaacacatcgaaacgaaaaaaatactaactaattctaacatcgtttacaccctactacgcaacgactaatacaacgaaaactacctcgccaacgccccgacaacactaaaacacgacgtatttatcgatacgacgaacgataacaaaatcgcctcaacaacgcgaacaaattatacgacaactacgacacgcgtaattaacgaacgcgatcacgaaaacaaaatttacgaactaacgaacgataatacttaaacgttaacacaattaacgacaaaactaaccaaacaaaacgacaaacaaattacctatcaaaatctaaacgaacgcgatttcgccgcgacactaaaaaacgtcgaactacccgacgaactaacgaatatactaacgaattctaacgttaacgcatcgaaaaacgatctatttaataacaacaaaacacttaacacattaattaacccaccaacgacaacgttaaccgaaaacgt

SEQ ID NO: 13153 - DNA, 1402 bp, Artificial Sequence
  chemically treated genomic DNA (Homo sapiens) CpG-island No: 13153
cggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaatcgtcggtgaatttagcggcgaaattatcggcgtgacggatggtgtcgggcgttattttcggttggtattgattacgtatgcgtacgaggtagaagaagttcggtagtaggttattttcggcgggacggaatcgttcgttttttttgatattttgtcgggttatatcgaatatggtcgggataacggtattcgtttgtttgtcgtgtggttgacgtacgattcggaatattcggagaatttattttgcgcgtcgttggtgcgttatggttggacgtttcgcggcgaattggcggtggtgtatgatcgtagtggtaaataggtgcgtagttttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttattgtagtcggaaaattatgacgtggagtcgttacggttagttgttgagttttatcgattgtttcggttatgtaattcgttatgtttatgattgtttcgggtagatgatcggtcggttatcgcgaggaagggtttaattagtatcgcgtatacgaaagtcgttgatcgtatattgtcgttaaagatacgtagggttattaaaattcggtttgaa

SEQ ID NO: 13154 - DNA, 1402 bp, Artificial Sequence
  chemically treated genomic DNA (Homo sapiens) CpG-island No: 13154
ttcaaaccgaattttaataaccctacgtatctttaacgacaatatacgatcaacgactttcgtatacgcgatactaattaaacccttcctcgcgataaccgaccgatcatctacccgaaacaatcataaacataacgaattacataaccgaaacaatcgataaaactcaacaactaaccgtaacgactccacgtcataattttccgactacaataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaaactacgcacctatttaccactacgatcatacaccaccgccaattcgccgcgaaacgtccaaccataacgcaccaacgacgcgcaaaataaattctccgaatattccgaatcgtacgtcaaccacacgacaaacaaacgaataccgttatcccgaccatattcgatataacccgacaaaatatcaaaaaaaacgaacgattccgtcccgccgaaaataacctactaccgaacttcttctacctcgtacgcatacgtaatcaataccaaccgaaaataacgcccgacaccatccgtcacgccgataatttcgccgctaaattcaccgacgattcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccg

SEQ ID NO: 13155 - DNA, 1402 bp, Artificial Sequence
  chemically treated genomic DNA (Homo sapiens) CpG-island No: 13155
tttaaatcgggttttaatggttttgcgtgtttttaacggtaatatacggttaacggttttcgtatgcgcggtattgattaagttttttttcgcggtgatcggtcggttatttgttcgaagtagttatgggtataacgggttatataatcggaatagtcggtgaagtttagtaattgatcgtaacggttttacgttatggtttttcggttgtagtggtatttttcgttgcgtagggtaagttattgtgtggattattataacggtagcgagtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaagttgcgtatttgtttgttattacggttatatattatcgttagttcgtcgcggggcgtttagttatagcgtattagcggcgcgtagggtaaatttttcgggtatttcgggtcgtgcgttagttatacggtagatagacggatgtcgttgtttcggttatattcggtgtaattcggtagggtattaggaaaagcggacggtttcgtttcgtcggaaatggtttgttgtcgggttttttttgtttcgtgcgtatgcgtggttagtattagtcggaagtgacgttcggtattattcgttacgtcggtgatttcgtcgttgaatttatcggcggttcgcggtggaacgtttgtgtgcgttcgaagcggtttattagttcggttagtattcggtacggcggtagcggcgtaggtagtattttattcgttttcggtattcgtttatattagtcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcg

SEQ ID NO: 13156 - DNA, 1402 bp, Artificial Sequence
  chemically treated genomic DNA (Homo sapiens) CpG-island No: 13156
cgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgactaatataaacgaataccgaaaacgaataaaatactacctacgccgctaccgccgtaccgaatactaaccgaactaataaaccgcttcgaacgcacacaaacgttccaccgcgaaccgccgataaattcaacgacgaaatcaccgacgtaacgaataataccgaacgtcacttccgactaatactaaccacgcatacgcacgaaacaaaaaaaacccgacaacaaaccatttccgacgaaacgaaaccgtccgcttttcctaataccctaccgaattacaccgaatataaccgaaacaacgacatccgtctatctaccgtataactaacgcacgacccgaaatacccgaaaaatttaccctacgcgccgctaatacgctataactaaacgccccgcgacgaactaacgataatatataaccgtaataacaaacaaatacgcaactttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcactcgctaccgttataataatccacacaataacttaccctacgcaacgaaaaataccactacaaccgaaaaaccataacgtaaaaccgttacgatcaattactaaacttcaccgactattccgattatataacccgttatacccataactacttcgaacaaataaccgaccgatcaccgcgaaaaaaaacttaatcaataccgcgcatacgaaaaccgttaaccgtatattaccgttaaaaacacgcaaaaccattaaaacccgatttaaa

SEQ ID NO: 13157 - DNA, 557 bp, Artificial Sequence
  chemically treated genomic DNA (Homo sapiens) CpG-island No: 13157
atttagtagcggacgtagtagaaaatcgtcgaggcgtagggtttgtattttcgttatatagtgtgaacgattggttttttttatacgttcgttaaatcgcgtttgttgacgaaattgttggataacgtttatgttattgatgatttcgttaaagtcgtcgttgatattcgttaaataggcgcgtatacgacggataatcggcgtgttgtaacgttggtatattattattattattagtattatcgggaaaattattatcgttattagtgttattcgttagtcgaggttgaatatcgttattagtatcgcgtttattagcgcggtattgcgtaggatagtttgtattacggtaacgtagagatcgcggattattttagtgttattagtgacgcggggaattatttgttcgacgggttgggtattaaattcgtttaaatgttggcgtaatttagattattggtaggcgaaaaagttgattatcgatgttttcgaatgggaagttttgttggatggcgaaaaagtgggcgaagtgaaatggtcgttggtaggcgaatata

SEQ ID NO: 13158 - DNA, 557 bp, Artificial Sequence
  chemically treated genomic DNA (Homo sapiens) CpG-island No: 13158
tatattcgcctaccaacgaccatttcacttcgcccactttttcgccatccaacaaaacttcccattcgaaaacatcgataatcaactttttcgcctaccaataatctaaattacgccaacatttaaacgaatttaatacccaacccgtcgaacaaataattccccgcgtcactaataacactaaaataatccgcgatctctacgttaccgtaatacaaactatcctacgcaataccgcgctaataaacgcgatactaataacgatattcaacctcgactaacgaataacactaataacgataataattttcccgataatactaataataataataatataccaacgttacaacacgccgattatccgtcgtatacgcgcctatttaacgaatatcaacgacgactttaacgaaatcatcaataacataaacgttatccaacaatttcgtcaacaaacgcgatttaacgaacgtataaaaaaaaccaatcgttcacactatataacgaaaatacaaaccctacgcctcgacgattttctactacgtccgctactaaat

SEQ ID NO: 13159 - DNA, 557 bp, Artificial Sequence
  chemically treated genomic DNA (Homo sapiens) CpG-island No: 13159
tatgttcgtttattagcgattattttatttcgtttattttttcgttatttagtaaaattttttattcggaagtatcggtggttagttttttcgtttgttagtgatttgggttacgttagtatttaagcgagtttgatatttaattcgtcgggtaggtgatttttcgcgttattaatgatattgaagtgattcgcgatttttacgttatcgtagtgtaaattgttttgcgtagtgtcgcgttggtgggcgcgatgttggtggcgatgtttagtttcgattggcgaatggtattggtggcgataatgattttttcggtggtgttggtggtaatggtgatatattagcgttatagtacgtcgattgttcgtcgtgtgcgcgtttatttggcggatattaacgacggttttaacgaaattattaatggtatgagcgttatttagtagtttcgttagtaggcgcgatttggcgaacgtatgggggaggttagtcgtttatattatatggcgaggatgtaaattttgcgtttcgacggttttttgttgcgttcgttgttgagt

SEQ ID NO: 13160 - DNA, 557 bp, Artificial Sequence
  chemically treated genomic DNA (Homo sapiens) CpG-island No: 13160
actcaacaacgaacgcaacaaaaaaccgtcgaaacgcaaaatttacatcctcgccatataatataaacgactaacctcccccatacgttcgccaaatcgcgcctactaacgaaactactaaataacgctcataccattaataatttcgttaaaaccgtcgttaatatccgccaaataaacgcgcacacgacgaacaatcgacgtactataacgctaatatatcaccattaccaccaacaccaccgaaaaaatcattatcgccaccaataccattcgccaatcgaaactaaacatcgccaccaacatcgcgcccaccaacgcgacactacgcaaaacaatttacactacgataacgtaaaaatcgcgaatcacttcaatatcattaataacgcgaaaaatcacctacccgacgaattaaatatcaaactcgcttaaatactaacgtaacccaaatcactaacaaacgaaaaaactaaccaccgatacttccgaataaaaaattttactaaataacgaaaaaataaacgaaataaaataatcgctaataaacgaacata

SEQ ID NO: 13161 - DNA, 502 bp, Artificial Sequence
  chemically treated genomic DNA (Homo sapiens) CpG-island No: 13161
gttggatgtcgggtaatcgttcgtatttatgggcgttggttttaatacgatttttcgttatttaaaaaatttaggtcgtagtcggtaatttcgcgtatatagtcgggtagtgacgttatcgtttgcgcggaaatggacgaatagtggggatacgtcggggttaaatcgcgttagtattggttgttttacgcgtatgataggtttcggaagacggttgttgcgtacgtattcggtgaacgtattatggcgacgttggggcgttttatgaagttgttgttattttttgacgtggtgatatggatgacggatggttggtcgttgtatgaatttcgtttgaagggaaagttgtacgtaattagtaagcgatatacgtagcgaattgagcggtataatttgaatttgaggtagtatttggtacggttgggacggaagtcgttgtcgtttttaaaatcggtggagttgtatgataaagttatcgggtattatttgaatataaaatatt

SEQ ID NO: 13162 - DNA, 502 bp, Artificial Sequence
  chemically treated genomic DNA (Homo sapiens) CpG-island No: 13162
aatattttatattcaaataatacccgataactttatcatacaactccaccgattttaaaaacgacaacgacttccgtcccaaccgtaccaaatactacctcaaattcaaattataccgctcaattcgctacgtatatcgcttactaattacgtacaactttcccttcaaacgaaattcatacaacgaccaaccatccgtcatccatatcaccacgtcaaaaaataacaacaacttcataaaacgccccaacgtcgccataatacgttcaccgaatacgtacgcaacaaccgtcttccgaaacctatcatacgcgtaaaacaaccaatactaacgcgatttaaccccgacgtatccccactattcgtccatttccgcgcaaacgataacgtcactacccgactatatacgcgaaattaccgactacgacctaaattttttaaataacgaaaaatcgtattaaaaccaacgcccataaatacgaacgattacccgacatccaac

SEQ ID NO: 13163 - DNA, 502 bp, Artificial Sequence
  chemically treated genomic DNA (Homo sapiens) CpG-island No: 13163
agtgttttatgtttagataatgttcgatgattttgttatgtagttttatcgattttgagaacgatagcgattttcgttttagtcgtgttaggtgttgttttagatttaggttatgtcgtttaattcgttgcgtatatcgtttgttgattacgtgtagttttttttttaggcgggatttatatagcggttagttattcgttatttatattattacgttaaagggtgatagtagttttataagacgttttagcgtcgttatagtgcgtttatcgaatacgtgcgtaataatcgtttttcggagtttgttatacgcgtaaaatagttagtgttggcgcgatttagtttcgacgtatttttattgttcgtttattttcgcgtagacgatgacgttattgttcggttgtatgcgcgaggttatcgattgcggtttgagttttttaaatggcggaaaatcgtgttgaggttaacgtttataagtgcgggcggttgttcggtatttaat

SEQ ID NO: 13164 - DNA, 502 bp, Artificial Sequence
  chemically treated genomic DNA (Homo sapiens) CpG-island No: 13164
attaaataccgaacaaccgcccgcacttataaacgttaacctcaacacgattttccgccatttaaaaaactcaaaccgcaatcgataacctcgcgcatacaaccgaacaataacgtcatcgtctacgcgaaaataaacgaacaataaaaatacgtcgaaactaaatcgcgccaacactaactattttacgcgtataacaaactccgaaaaacgattattacgcacgtattcgataaacgcactataacgacgctaaaacgtcttataaaactactatcaccctttaacgtaataatataaataacgaataactaaccgctatataaatcccgcctaaaaaaaaaactacacgtaatcaacaaacgatatacgcaacgaattaaacgacataacctaaatctaaaacaacacctaacacgactaaaacgaaaatcgctatcgttctcaaaatcgataaaactacataacaaaatcatcgaacattatctaaacataaaacact

SEQ ID NO: 13165 - DNA, 752 bp, Artificial Sequence
  chemically treated genomic DNA (Homo sapiens) CpG-island No: 13165
  misc_feature (153)..(153): n is either a, c, g or t
  misc_feature (694)..(694): n is either a, c, g or t
  misc_feature (726)..(726): n is either a, c, g or t
gtcgtaggtcgtcgtttagttgtcgtagttgttcgttttgttcgcggttatggtcgattagtcgtaggtttttttcgtttagggcgtggatgcgttcgttgtgcgagcgaatttcgtcgatcgtttggttttgttgggtcgagttttcggtantgcgttcggttattacgtcgatggtatggatcgcggcgattatttcgtttagcgcgtttttcgtcgcgtcggttttgttcggcggtgcgttcggtatgttcgatttggttgcgtatggtttttatcgattgtcgcgcggtttgttgtaggcggtcgatgagttgttggattttttcggtggcgtcggcggtgcgttgggttagcgagcggattttttcggcgattacggcgaacgttggtttttggtcgtcggcgcgggcggtttcgatggcggtattgagggcgagtaggttggtttgttcggcgatcgagcggattatcgttagtacgttgtcgatggtcgtcgatttttcggttaggcgttcgatcgattgggcgttgtatttatttcgtcgattagttcgcgtagtcgtttaggttttcgtcgattattcgttggttatgtttaattgtatggtttgcgttgcgattggcgttagcggtttggttggcgttttcggcgaaattgttgatcgcgtttttatgttagcgaggcgtcgtngatttgtaggtatcgttagttgcgttgatttngcgttaagcgttgttatttcgtagta

SEQ ID NO: 13166 - DNA, 752 bp, Artificial Sequence
  chemically treated genomic DNA (Homo sapiens) CpG-island No: 13166
  misc_feature (27)..(27): n is either a, c, g or t
  misc_feature (59)..(59): n is either a, c, g or t
  misc_feature (600)..(600): n is either a, c, g or t
tactacgaaataacaacgcttaacgcnaaatcaacgcaactaacgatacctacaaatcnacgacgcctcgctaacataaaaacgcgatcaacaatttcgccgaaaacgccaaccaaaccgctaacgccaatcgcaacgcaaaccatacaattaaacataaccaacgaataatcgacgaaaacctaaacgactacgcgaactaatcgacgaaataaatacaacgcccaatcgatcgaacgcctaaccgaaaaatcgacgaccatcgacaacgtactaacgataatccgctcgatcgccgaacaaaccaacctactcgccctcaataccgccatcgaaaccgcccgcgccgacgaccaaaaaccaacgttcgccgtaatcgccgaaaaaatccgctcgctaacccaacgcaccgccgacgccaccgaaaaaatccaacaactcatcgaccgcctacaacaaaccgcgcgacaatcgataaaaaccatacgcaaccaaatcgaacataccgaacgcaccgccgaacaaaaccgacgcgacgaaaaacgcgctaaacgaaataatcgccgcgatccataccatcgacgtaataaccgaacgcantaccgaaaactcgacccaacaaaaccaaacgatcgacgaaattcgctcgcacaacgaacgcatccacgccctaaacgaaaaaaacctacgactaatcgaccataaccgcgaacaaaacgaacaactacgacaactaaacgacgacctacgac

SEQ ID NO: 13167 - DNA, 752 bp, Artificial Sequence
  chemically treated genomic DNA (Homo sapiens) CpG-island No: 13167
  misc_feature (27)..(27): n is either a, c, g or t
  misc_feature (59)..(59): n is either a, c, g or t
  misc_feature (600)..(600): n is either a, c, g or t
tgttgcgaagtagtagcgtttgacgtnaggttagcgtagttagcgatatttgtagattngcgacgtttcgttgatatgaaagcgcgattagtagtttcgtcggagacgttagttagatcgttgacgttagtcgtagcgtaggttatgtagttgagtatggttagcgggtgatcggcgagagtttgggcggttgcgcgagttggtcgacgaggtgaatgtaacgtttagtcgatcgagcgtttagtcgaggagtcggcgattatcggtagcgtgttgacggtgattcgttcgatcgtcgaatagattaatttgttcgtttttaatgtcgttatcgaggtcgttcgcgtcggcgattaagggttagcgttcgtcgtggtcgtcgaggaagttcgttcgttggtttagcgtatcgtcggcgttatcgaggagatttagtagtttatcggtcgtttgtaataggtcgcgcggtaatcggtggaggttatgcgtagttaggtcgagtatgtcgaacgtatcgtcgaataaggtcggcgcggcggaaggcgcgttggacgaagtggtcgtcgcgatttatattatcggcgtgatggtcgaacgtantgtcgaaggttcgatttagtagagttaggcggtcggcgagattcgttcgtatagcgaacgtatttacgttttgggcggggaaaatttgcggttgatcggttatagtcgcgaatagggcgagtaattgcggtaattgggcggcgatttgcgat

SEQ ID NO: 13168 - DNA, 752 bp, Artificial Sequence
  chemically treated genomic DNA (Homo sapiens) CpG-island No: 13168
  misc_feature (153)..(153): n is either a, c, g or t
  misc_feature (694)..(694): n is either a, c, g or t
  misc_feature (726)..(726): n is either a, c, g or t
atcgcaaatcgccgcccaattaccgcaattactcgccctattcgcgactataaccgatcaaccgcaaattttccccgcccaaaacgtaaatacgttcgctatacgaacgaatctcgccgaccgcctaactctactaaatcgaaccttcgacantacgttcgaccatcacgccgataatataaatcgcgacgaccacttcgtccaacgcgccttccgccgcgccgaccttattcgacgatacgttcgacatactcgacctaactacgcataacctccaccgattaccgcgcgacctattacaaacgaccgataaactactaaatctcctcgataacgccgacgatacgctaaaccaacgaacgaacttcctcgacgaccacgacgaacgctaacccttaatcgccgacgcgaacgacctcgataacgacattaaaaacgaacaaattaatctattcgacgatcgaacgaatcaccgtcaacacgctaccgataatcgccgactcctcgactaaacgctcgatcgactaaacgttacattcacctcgtcgaccaactcgcgcaaccgcccaaactctcgccgatcacccgctaaccatactcaactacataacctacgctacgactaacgtcaacgatctaactaacgtctccgacgaaactactaatcgcgctttcatatcaacgaaacgtcgcnaatctacaaatatcgctaactacgctaacctnacgtcaaacgctactacttcgcaaca

SEQ ID NO: 13169 - DNA, 767 bp, Artificial Sequence
  chemically treated genomic DNA (Homo sapiens) CpG-island No: 13169
tcggcgtcgatagtaatgacgaggtcggttagttgtagcgggcgttgggcgagatgtaggagaatttgcggtagatggttattattattcgttaggaaagcgaagaattttacgatattttttagtttatcggttagatttcgtagtcgatcgtttacggcgttagtaataggtcgatagcgttattagtatggtcgcgagtatggaagagatgattattaatatttcgtagattttcgattacgtcgataacgttagggtgatttcggttaagttcgaggagttggttagtagtggcgggtaggtgatttttaacgtggtggaagggatgagtcgtatcgtcgacgtggttaattagttttttattagtattatcgttttcggttagtcgtcggacgagatttattcgattatttaggtgattaaggggatcgtcgagtagattaatttgttggcgttgaacgtcgttatcgaggttgcgcgggtcggagaggtcgggcgcggtttcgtcgtggtcgtcgacgaggtacgcgggttggcggcgcggattatttagtcgatttaggagattatcgcgatgatcgagcgtattcgcgttagtatcggggtaagcgattaatagtatggaggttggcgtgagaggttttaaacgagggggtgtcgttcgttcgttagtaaggggtgtcgattaacgagattttcgatggaattcgttatgtcgcgtcggtggtcgattagatttttagataatcgcgagtagttgtcgt

SEQ ID NO: 13170 - DNA, 767 bp, Artificial Sequence
  chemically treated genomic DNA (Homo sapiens) CpG-island No: 13170
acgacaactactcgcgattatctaaaaatctaatcgaccaccgacgcgacataacgaattccatcgaaaatctcgttaatcgacaccccttactaacgaacgaacgacaccccctcgtttaaaacctctcacgccaacctccatactattaatcgcttaccccgatactaacgcgaatacgctcgatcatcgcgataatctcctaaatcgactaaataatccgcgccgccaacccgcgtacctcgtcgacgaccacgacgaaaccgcgcccgacctctccgacccgcgcaacctcgataacgacgttcaacgccaacaaattaatctactcgacgatccccttaatcacctaaataatcgaataaatctcgtccgacgactaaccgaaaacgataatactaataaaaaactaattaaccacgtcgacgatacgactcatcccttccaccacgttaaaaatcacctacccgccactactaaccaactcctcgaacttaaccgaaatcaccctaacgttatcgacgtaatcgaaaatctacgaaatattaataatcatctcttccatactcgcgaccatactaataacgctatcgacctattactaacgccgtaaacgatcgactacgaaatctaaccgataaactaaaaaatatcgtaaaattcttcgctttcctaacgaataataataaccatctaccgcaaattctcctacatctcgcccaacgcccgctacaactaaccgacctcgtcattactatcgacgccga

SEQ ID NO: 13171 - DNA, 767 bp, Artificial Sequence
  chemically treated genomic DNA (Homo sapiens) CpG-island No: 13171
gcggtaattgttcgcgattgtttgggaatttaatcgattatcgacgcggtatgacgggttttatcgagaatttcgttgatcgatattttttgttggcgggcgaacgatattttttcgtttagaattttttacgttagtttttatgttgttgatcgtttgtttcgatgttggcgcggatgcgttcgattatcgcggtgattttttgggtcgattgggtggttcgcgtcgttagttcgcgtatttcgtcggcgattacggcgaaatcgcgttcggttttttcggttcgcgtagtttcgatggcggcgtttaacgttagtaggttggtttgttcggcgatttttttgattatttggatgatcgaatggatttcgttcgacgattggtcgagagcggtgatgttggtggaggattggttgattacgtcggcgatgcggtttattttttttattacgttgaggattatttgttcgttattgttggttagtttttcggatttggtcgagattattttggcgttgtcggcgtggtcggaaatttgcgagatattggtgattattttttttatgttcgcggttatgttggtggcgttgtcggtttgttgttggcgtcgtggacgatcgattgcgaggtttggtcgatggattgggaggtgtcgtggagtttttcgtttttttggcggatgatggtgattatttgtcgtaggtttttttgtatttcgtttaacgttcgttgtaattggtcggtttcgttattgttgtcgacgtcga

SEQ ID NO: 13172 - DNA, 767 bp, Artificial Sequence
  chemically treated genomic DNA (Homo sapiens) CpG-island No: 13172
tcgacgtcgacaacaataacgaaaccgaccaattacaacgaacgttaaacgaaatacaaaaaaacctacgacaaataatcaccatcatccgccaaaaaaacgaaaaactccacgacacctcccaatccatcgaccaaacctcgcaatcgatcgtccacgacgccaacaacaaaccgacaacgccaccaacataaccgcgaacataaaaaaaataatcaccaatatctcgcaaatttccgaccacgccgacaacgccaaaataatctcgaccaaatccgaaaaactaaccaacaataacgaacaaataatcctcaacgtaataaaaaaaataaaccgcatcgccgacgtaatcaaccaatcctccaccaacatcaccgctctcgaccaatcgtcgaacgaaatccattcgatcatccaaataatcaaaaaaatcgccgaacaaaccaacctactaacgttaaacgccgccatcgaaactacgcgaaccgaaaaaaccgaacgcgatttcgccgtaatcgccgacgaaatacgcgaactaacgacgcgaaccacccaatcgacccaaaaaatcaccgcgataatcgaacgcatccgcgccaacatcgaaacaaacgatcaacaacataaaaactaacgtaaaaaattctaaacgaaaaaatatcgttcgcccgccaacaaaaaatatcgatcaacgaaattctcgataaaacccgtcataccgcgtcgataatcgattaaattcccaaacaatcgcgaacaattaccgc

SEQ ID NO: 13173 - DNA, 677 bp, Artificial Sequence
  chemically treated genomic DNA (Homo sapiens) CpG-island No: 13173
taaatgggtttgggttcgggtgcgggttgtagtttttggtcgggtgagcgtcgagggtttcgtttaggtttcgcgtagggagcgtagagcgtcgacggcggtcgtcgtaatcgggagtggtttaggattcgggggcggtttttttgcgcgagtgtggaacgtagaagttgagtttgcggagtcgcgggtagtggtagttaggttttttcgttttgtgttatttgcggttcggttttttttcgcgtttttattcgcgttgcgatgacgcgtttattgtttaagggaaatttttgggtaagtcgtggggtcgatagcggatcgcggggtttaggattcggttcgggcgggaggttaacgcggcgggcgtggggggttttttagtttcggcgttattcggtgatcgcgcgttcgggggtttggcggagttcgcgcgtgaagggatcggggttttagttttattgttcgaggggtagatttggagcggacgtcgggttgttgttttttttttgtttttcgttatttatcgcgtgttcgcgagtttcgggggttcggattttagggtttattttttgtcgttcgcgtttttagtagcgcgtgtttttgaggacgtagagagtcgagatattttagagttaggatattaatttttttttttataggcgaagtagagattttta

SEQ ID NO: 13174 - DNA, 677 bp, Artificial Sequence
  chemically treated genomic DNA (Homo sapiens) CpG-island No: 13174
taaaaatctctacttcgcctataaaaaaaaaaattaatatcctaactctaaaatatctcgactctctacgtcctcaaaaacacgcgctactaaaaacgcgaacgacaaaaaataaaccctaaaatccgaacccccgaaactcgcgaacacgcgataaataacgaaaaacaaaaaaaaaacaacaacccgacgtccgctccaaatctacccctcgaacaataaaactaaaaccccgatcccttcacgcgcgaactccgccaaacccccgaacgcgcgatcaccgaataacgccgaaactaaaaaaccccccacgcccgccgcgttaacctcccgcccgaaccgaatcctaaaccccgcgatccgctatcgaccccacgacttacccaaaaatttcccttaaacaataaacgcgtcatcgcaacgcgaataaaaacgcgaaaaaaaaccgaaccgcaaataacacaaaacgaaaaaacctaactaccactacccgcgactccgcaaactcaacttctacgttccacactcgcgcaaaaaaaccgcccccgaatcctaaaccactcccgattacgacgaccgccgtcgacgctctacgctccctacgcgaaacctaaacgaaaccctcgacgctcacccgaccaaaaactacaacccgcacccgaacccaaacccattta

SEQ ID NO: 13175 - DNA, 677 bp, Artificial Sequence
  chemically treated genomic DNA (Homo sapiens) CpG-island No: 13175
taagggtttttgtttcgtttgtgagaggaggggttgatgttttgattttaaggtgtttcggttttttgcgtttttaggagtacgcgttgttgggggcgcgggcggtagagggtgggttttggagttcgagttttcgggattcgcgggtacgcggtgggtagcgggggatagagagggaatagtagttcggcgttcgttttaagtttgtttttcgagtagtggggttggggtttcgatttttttacgcgcgagtttcgttaagttttcgggcgcgcggttatcgagtggcgtcggagttggggagttttttacgttcgtcgcgttggtttttcgttcgggtcgggttttgagtttcgcgattcgttgtcggttttacgatttatttaaaagttttttttgaatagtgagcgcgttatcgtagcgcgagtgggggcgcggaggagagtcgggtcgtaggtagtatagagcggggaggtttgattgttattgttcgcggtttcgtagatttaatttttgcgttttatattcgcgtagggaagtcgttttcgggttttaaattattttcgattgcgacggtcgtcgtcggcgttttgcgttttttgcgcgagatttgggcgggattttcggcgtttattcggttaggggttgtagttcgtattcggatttaggtttattta

SEQ ID NO: 13176 - DNA, 677 bp, Artificial Sequence
  chemically treated genomic DNA (Homo sapiens) CpG-island No: 13176
taaataaacctaaatccgaatacgaactacaacccctaaccgaataaacgccgaaaatcccgcccaaatctcgcgcaaaaaacgcaaaacgccgacgacgaccgtcgcaatcgaaaataatttaaaacccgaaaacgacttccctacgcgaatataaaacgcaaaaattaaatctacgaaaccgcgaacaataacaatcaaacctccccgctctatactacctacgacccgactctcctccgcgcccccactcgcgctacgataacgcgctcactattcaaaaaaaacttttaaataaatcgtaaaaccgacaacgaatcgcgaaactcaaaacccgacccgaacgaaaaaccaacgcgacgaacgtaaaaaactccccaactccgacgccactcgataaccgcgcgcccgaaaacttaacgaaactcgcgcgtaaaaaaatcgaaaccccaaccccactactcgaaaaacaaacttaaaacgaacgccgaactactattccctctctatcccccgctacccaccgcgtacccgcgaatcccgaaaactcgaactccaaaacccaccctctaccgcccgcgcccccaacaacgcgtactcctaaaaacgcaaaaaaccgaaacaccttaaaatcaaaacatcaacccctcctctcacaaacgaaacaaaaaccctta

SEQ ID NO: 13177 - DNA, 832 bp, Artificial Sequence
  chemically treated genomic DNA (Homo sapiens) CpG-island No: 13177
ttacgcgttttagttattgcggggtacgttagtatgagaagtaggtgagtttttcgcgtgttcgttttattaatttcgatttttagcgttggtttgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggttcgttgtatcgggatagggtatggtcgtttcgatttttagcgttggtttgttgtatcgggatagggtatggtcgtttcgatttttagcgttggtttgttgtatcgggatagggtatggtcgtttcgatttttagcgttggtttgttgtatcgggatagggtatggtcgtttcgatttttagcgttggtttgttgtatcgggatagggtatggtcgtttcgatttttagcgttggtttgttgtatcgggatagggtatggtcgtttcgtttattttttgtgattttgttgatatcgttgcgttttgtattattttta

SEQ ID NO: 13178 - DNA, 832 bp, Artificial Sequence
  chemically treated genomic DNA (Homo sapiens) CpG-island No: 13178
taaaaataatacaaaacgcaacgatatcaacaaaatcacaaaaaataaacgaaacgaccataccctatcccgatacaacaaaccaacgctaaaaatcgaaacgaccataccctatcccgatacaacaaaccaacgctaaaaatcgaaacgaccataccctatcccgatacaacaaaccaacgctaaaaatcgaaacgaccataccctatcccgatacaacaaaccaacgctaaaaatcgaaacgaccataccctatcccgatacaacaaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacgaaccaacgctaaaaatcgaaacgaccataccctatcccgatacaacaaaccaacgctaaaaatcgaaattaataaaacgaacacgcgaaaaactcacctacttctcatactaacgtaccccgcaataactaaaacgcgtaa

SEQ ID NO: 13179 - DNA, 832 bp, Artificial Sequence
  chemically treated genomic DNA (Homo sapiens) CpG-island No: 13179
tggaggtggtgtagggcgtagcggtgttagtagagttataagaggtgggcgagacggttatgttttgtttcggtatagtaggttagcgttaaggatcgagacggttatgttttgtttcggtatagtaggttagcgttaaggatcgagacggttatgttttgtttcggtatagtaggttagcgttaaggatcgagacggttatgttttgtttcggtatagtaggttagcgttaaggatcgagacggttatgttttgtttcggtatagtaggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagcgggttagcgttaaggatcgagacggttatgttttgtttcggtatagtaggttagcgttaaggatcgaggttaatgagacgggtacgcgaggggtttatttgttttttatgttaacgtgtttcgtagtggttggaacgcgtga

SEQ ID NO: 13180 - DNA, 832 bp, Artificial Sequence
  chemically treated genomic DNA (Homo sapiens) CpG-island No: 13180
tcacgcgttccaaccactacgaaacacgttaacataaaaaacaaataaacccctcgcgtacccgtctcattaacctcgatccttaacgctaacctactataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacccgctataccgaaacaaaacataaccgtctcgatccttaacgctaacctactataccgaaacaaaacataaccgtctcgatccttaacgctaacctactataccgaaacaaaacataaccgtctcgatccttaacgctaacctactataccgaaacaaaacataaccgtctcgatccttaacgctaacctactataccgaaacaaaacataaccgtctcgatccttaacgctaacctactataccgaaacaaaacataaccgtctcgcccacctcttataactctactaacaccgctacgccctacaccacctcca

SEQ ID NO: 13181 - DNA, 609 bp, Artificial Sequence
  chemically treated genomic DNA (Homo sapiens) CpG-island No: 13181
atttcgtcgcgtagtgggatagagagttgtagttcggcgtaggttcgatttcgtagggaatcgcgattcggggataggtagttttggattgtattgatttgggattttgtcggttttatagatatatatacgcgcgcgtatatatatatatatgtatatacgtacgtatatatatacgtacgtatagtcgttaggtttagagtttatttttttaggggttggtggggatttcgttttcgcggcgggcggcggtattggaatgttaattgaaacggagttggcgagcgcggcgtagataagcgtcgtttagtagcgttttcgtttgcggtttttcgaattagcgattcgggaaggtttcgtcgtttttttggtcgttgagggtttttttttttacgttgaaggagtggaacgcgcgcggaggtagttcggcgttcgtaaattttcggagttagttttcgacggtttgttttagaattaaacggttttcgttatttaaagtcgagaagttaagaggtcggttgggggagggtgatacggagaaatggagaagtttatttagcggttatatatcggtagatttttattttttttaattggttggttttttta

SEQ ID NO: 13182 - DNA, 609 bp, Artificial Sequence
  chemically treated genomic DNA (Homo sapiens) CpG-island No: 13182
taaaaaaaccaaccaattaaaaaaaataaaaatctaccgatatataaccgctaaataaacttctccatttctccgtatcaccctcccccaaccgacctcttaacttctcgactttaaataacgaaaaccgtttaattctaaaacaaaccgtcgaaaactaactccgaaaatttacgaacgccgaactacctccgcgcgcgttccactccttcaacgtaaaaaaaaaaaccctcaacgaccaaaaaaacgacgaaaccttcccgaatcgctaattcgaaaaaccgcaaacgaaaacgctactaaacgacgcttatctacgccgcgctcgccaactccgtttcaattaacattccaataccgccgcccgccgcgaaaacgaaatccccaccaacccctaaaaaaataaactctaaacctaacgactatacgtacgtatatatatacgtacgtatatacatatatatatatatacgcgcgcgtatatatatctataaaaccgacaaaatcccaaatcaatacaatccaaaactacctatccccgaatcgcgattccctacgaaatcgaacctacgccgaactacaactctctatcccactacgcgacgaaat

SEQ ID NO: 13183 - DNA, 609 bp, Artificial Sequence
  chemically treated genomic DNA (Homo sapiens) CpG-island No: 13183
tagaagaattaattagttaaaggaaataaaaatttgtcggtatgtaatcgttgggtgggtttttttattttttcgtgttatttttttttagtcggttttttagtttttcggttttgggtggcggagatcgtttagttttgggatagatcgtcgggggttgatttcgggggtttgcgggcgtcgagttgttttcgcgcgcgttttatttttttagcgtggaaaagaaaatttttagcggttagagaggcggcggggttttttcggatcgttgattcggggagtcgtaggcggggacgttgttgggcgacgtttatttgcgtcgcgttcgttagtttcgttttaattaatattttagtgtcgtcgttcgtcgcgggagcggagtttttattagtttttggaaaaataaattttaggtttagcggttgtgcgtgcgtgtgtgtgtgcgtgcgtgtgtgtatgtgtgtgtgtgtgcgcgcgcgtgtgtgtgtttgtagagtcgatagagttttagattagtgtagtttagagttgtttattttcgggtcgcggttttttgcggggtcgagtttgcgtcgggttgtagttttttgttttattgcgcggcgggat

SEQ ID NO: 13184 - DNA, 609 bp, Artificial Sequence
  chemically treated genomic DNA (Homo sapiens) CpG-island No: 13184
atcccgccgcgcaataaaacaaaaaactacaacccgacgcaaactcgaccccgcaaaaaaccgcgacccgaaaataaacaactctaaactacactaatctaaaactctatcgactctacaaacacacacacgcgcgcgcacacacacacacatacacacacgcacgcacacacacacgcacgcacaaccgctaaacctaaaatttatttttccaaaaactaataaaaactccgctcccgcgacgaacgacgacactaaaatattaattaaaacgaaactaacgaacgcgacgcaaataaacgtcgcccaacaacgtccccgcctacgactccccgaatcaacgatccgaaaaaaccccgccgcctctctaaccgctaaaaattttcttttccacgctaaaaaaataaaacgcgcgcgaaaacaactcgacgcccgcaaacccccgaaatcaacccccgacgatctatcccaaaactaaacgatctccgccacccaaaaccgaaaaactaaaaaaccgactaaaaaaaaataacacgaaaaaataaaaaaacccacccaacgattacataccgacaaatttttatttcctttaactaattaattcttcta

SEQ ID NO: 13185 - DNA, 816 bp, Artificial Sequence
  chemically treated genomic DNA (Homo sapiens) CpG-island No: 13185
ggcgtcgatcgcgggtggcgcggggcgggattcgtttttgggacggtggagggcggtggcgttgtagtcgcgtcggtttttgagttttagggagcggagggtacggagtcgggcgagttttgcggtgttagaattttgcgtcgttttgacgttggggtttagggtttatttcgggggcgcgcgcgtggttgcggaggcgggaaggtttttttgtttgtcgtcgcggagtttcgcgtttttgtatttcgagttttgggggttcgttttgggttgtttttttttttcggtttcgtcgtttatttggttcggtttttgttagcgtttcggtttttttcggcgcggcgcggggttcggtgtttagttggtcgttttgcgtttcggcgcggttgcgttttttttttggttttggttttggtttcggtttcgggtcgcgttgtttttggttgttcgtgcggtcgttttgtcgttgcgcgtcgtttcgtaggatgttttggatgaggaaggacgtgagcggtttggacggggtcggcggcgcggtttttttcgttttcgttttttcgggtcgcggtttcggaattttgagtatttcggcggtttcgttttggtttgaatgtattcgttcggttcgtatcgtttttatttttcgtttttcggttcgtttatagtttaggggagcgggtcgcgtcgtttttttattggtcgcgggacgggtcgcgtcgcggattggtcgttttgagttttaggtgatttcgtcgatttgcgagttttgagtattgtttcgtttcgtttttttttaggggattttttttttagttt

SEQ ID NO: 13186 - DNA, 816 bp, Artificial Sequence
  chemically treated genomic DNA (Homo sapiens) CpG-island No: 13186
aaactaaaaaaaaaatcccctaaaaaaaaacgaaacgaaacaatactcaaaactcgcaaatcgacgaaatcacctaaaactcaaaacgaccaatccgcgacgcgacccgtcccgcgaccaataaaaaaacgacgcgacccgctcccctaaactataaacgaaccgaaaaacgaaaaataaaaacgatacgaaccgaacgaatacattcaaaccaaaacgaaaccgccgaaatactcaaaattccgaaaccgcgacccgaaaaaacgaaaacgaaaaaaaccgcgccgccgaccccgtccaaaccgctcacgtccttcctcatccaaaacatcctacgaaacgacgcgcaacgacaaaacgaccgcacgaacaaccaaaaacaacgcgacccgaaaccgaaaccaaaaccaaaaccaaaaaaaaaacgcaaccgcgccgaaacgcaaaacgaccaactaaacaccgaaccccgcgccgcgccgaaaaaaaccgaaacgctaacaaaaaccgaaccaaataaacgacgaaaccgaaaaaaaaaaacaacccaaaacgaacccccaaaactcgaaatacaaaaacgcgaaactccgcgacgacaaacaaaaaaaccttcccgcctccgcaaccacgcgcgcgcccccgaaataaaccctaaaccccaacgtcaaaacgacgcaaaattctaacaccgcaaaactcgcccgactccgtaccctccgctccctaaaactcaaaaaccgacgcgactacaacgccaccgccctccaccgtcccaaaaacgaatcccgccccgcgccacccgcgatcgacgcc

SEQ ID NO: 13187 - DNA, 816 bp, Artificial Sequence
  chemically treated genomic DNA (Homo sapiens) CpG-island No: 13187
gaattggggaaggaattttttagggaggagcggagcggggtagtgtttagggttcgtagatcggcggggttatttggggtttagggcggttaattcgcggcgcggttcgtttcgcggttaatgggagggcggcgcggttcgtttttttgggttataagcgagtcgggaggcggaaagtgaaagcggtgcgggtcgggcgggtgtatttaggttaaggcggggtcgtcgggatgtttagggtttcggagtcgcggttcggggaggcgaaagcggagggggtcgcgtcgtcgatttcgtttaagtcgtttacgtttttttttatttaggatattttgcgggacggcgcgtagcggtaaggcggtcgtacgagtagttagagatagcgcgattcggagtcggagttagagttagagttagagggaggacgtagtcgcgtcggggcgtagaacgattagttgagtatcgggtttcgcgtcgcgtcggaggaggtcgagacgttggtagagatcgagttaggtaagcggcgaggtcggggaaggggggtagtttaaggcggatttttagagttcggggtgtagggacgcggggtttcgcggcgataggtagagggattttttcgttttcgtagttacgcgcgcgttttcggaatgaattttgagttttagcgttagggcggcgtaggattttgatatcgtaggattcgttcggtttcgtgtttttcgttttttggggtttagaagtcggcgcgattgtagcgttatcgttttttatcgttttaggagcggatttcgtttcgcgttattcgcgatcggcgtt

SEQ ID NO: 13188 - DNA, 816 bp, Artificial Sequence
  chemically treated genomic DNA (Homo sapiens) CpG-island No: 13188
aacgccgatcgcgaataacgcgaaacgaaatccgctcctaaaacgataaaaaacgataacgctacaatcgcgccgacttctaaaccccaaaaaacgaaaaacacgaaaccgaacgaatcctacgatatcaaaatcctacgccgccctaacgctaaaactcaaaattcattccgaaaacgcgcgcgtaactacgaaaacgaaaaaatccctctacctatcgccgcgaaaccccgcgtccctacaccccgaactctaaaaatccgccttaaactaccccccttccccgacctcgccgcttacctaactcgatctctaccaacgtctcgacctcctccgacgcgacgcgaaacccgatactcaactaatcgttctacgccccgacgcgactacgtcctccctctaactctaactctaactccgactccgaatcgcgctatctctaactactcgtacgaccgccttaccgctacgcgccgtcccgcaaaatatcctaaataaaaaaaaacgtaaacgacttaaacgaaatcgacgacgcgaccccctccgctttcgcctccccgaaccgcgactccgaaaccctaaacatcccgacgaccccgccttaacctaaatacacccgcccgacccgcaccgctttcactttccgcctcccgactcgcttataacccaaaaaaacgaaccgcgccgccctcccattaaccgcgaaacgaaccgcgccgcgaattaaccgccctaaaccccaaataaccccgccgatctacgaaccctaaacactaccccgctccgctcctccctaaaaaattccttccccaattc

SEQ ID NO: 13189 - DNA, 678 bp, Artificial Sequence
  chemically treated genomic DNA (Homo sapiens) CpG-island No: 13189
tagcggagcggggcgtcgggtcgtacgtcggggttgtttacgatcgtttatacgtcgtcgtgtacgaattcgttttgtagggagcggtcgtagtataggtagtttgtttcggttagtagcgtcgcggtttcggtcggcgcgagttcgtagtttagtcgtcgggagggtgtgcggttttcgtcgtcgtttcgggtagaggtggttattattatcgcgtcgtcgtcgtcgttgttgttttggtttttttcgggcgtttggtatttttttttatcggggtttcggcggcgcgcggcgtttgttcggaggggggttcgggtatggtgttgtagtagttggattcgtcgcgagtttttcgcgtttcgtcgtcgtttgcgtcgcggagttggtttagttgtaaataaatagtagttttttcgtttttttcggttatcgttattttttgcgttttaattgcgtatgttcgttcgtttttttttttatcgttttttaatttcgggacgcgggtcggttttttcgtatagttcggcgttttttgttttcggttcgttttgtttgtaggtggatcggggttcgcggcgcgcggttgttcgggagttgcggggaaggatattttaggtttttatttgcggtgttcggttgtgtttatttttacgttttcgtttttatttttttttttcg

SEQ ID NO: 13190 - DNA, 678 bp, Artificial Sequence
  chemically treated genomic DNA (Homo sapiens) CpG-island No: 13190
cgaaaaaaaaaaataaaaacgaaaacgtaaaaataaacacaaccgaacaccgcaaataaaaacctaaaatatccttccccgcaactcccgaacaaccgcgcgccgcgaaccccgatccacctacaaacaaaacgaaccgaaaacaaaaaacgccgaactatacgaaaaaaccgacccgcgtcccgaaattaaaaaacgataaaaaaaaaaacgaacgaacatacgcaattaaaacgcaaaaaataacgataaccgaaaaaaacgaaaaaactactatttatttacaactaaaccaactccgcgacgcaaacgacgacgaaacgcgaaaaactcgcgacgaatccaactactacaacaccatacccgaacccccctccgaacaaacgccgcgcgccgccgaaaccccgataaaaaaaaataccaaacgcccgaaaaaaaccaaaacaacaacgacgacgacgacgcgataataataaccacctctacccgaaacgacgacgaaaaccgcacaccctcccgacgactaaactacgaactcgcgccgaccgaaaccgcgacgctactaaccgaaacaaactacctatactacgaccgctccctacaaaacgaattcgtacacgacgacgtataaacgatcgtaaacaaccccgacgtacgacccgacgccccgctccgcta

SEQ ID NO: 13191 - DNA, 678 bp, Artificial Sequence
  chemically treated genomic DNA (Homo sapiens) CpG-island No: 13191
cgggggagaaggatgggggcgggggcgtgggggtgagtatagtcggatatcgtaagtgggaatttggggtgttttttttcgtagttttcgggtagtcgcgcgtcgcgaatttcggtttatttgtaagtaaggcgggtcgggggtagagggcgtcgggttgtgcgggggaatcggttcgcgtttcgggattggggggcggtggaagagagagcgagcgggtatgcgtagttggggcgtaggaggtggcgatggtcgggggaggcggggggattgttgtttatttgtagttgggttaatttcgcggcgtaggcggcggcggagcgcggggagttcgcggcgggtttagttgttgtagtattatgttcgagttttttttcgggtagacgtcgcgcgtcgtcggggtttcggtaggggaggatgttagacgttcgggagaggttagggtagtagcggcggcggcggcgcgatggtggtgattatttttgttcgaggcggcggcggggatcgtatattttttcggcggttgggttgcgggttcgcgtcggtcggggtcgcggcgttgttggtcggggtaagttgtttgtgttacggtcgttttttgtagggcgagttcgtgtacgacgacgtgtgggcgatcgtgaataatttcgacgtgcggttcggcgtttcgtttcgttg

SEQ ID NO: 13192 - DNA, 678 bp, Artificial Sequence
  chemically treated genomic DNA (Homo sapiens) CpG-island No: 13192
caacgaaacgaaacgccgaaccgcacgtcgaaattattcacgatcgcccacacgtcgtcgtacacgaactcgccctacaaaaaacgaccgtaacacaaacaacttaccccgaccaacaacgccgcgaccccgaccgacgcgaacccgcaacccaaccgccgaaaaaatatacgatccccgccgccgcctcgaacaaaaataatcaccaccatcgcgccgccgccgccgctactaccctaacctctcccgaacgtctaacatcctcccctaccgaaaccccgacgacgcgcgacgtctacccgaaaaaaaactcgaacataatactacaacaactaaacccgccgcgaactccccgcgctccgccgccgcctacgccgcgaaattaacccaactacaaataaacaacaatccccccgcctcccccgaccatcgccacctcctacgccccaactacgcatacccgctcgctctctcttccaccgccccccaatcccgaaacgcgaaccgattcccccgcacaacccgacgccctctacccccgacccgccttacttacaaataaaccgaaattcgcgacgcgcgactacccgaaaactacgaaaaaaaacaccccaaattcccacttacgatatccgactatactcacccccacgcccccgcccccatccttctcccccg

SEQ ID NO: 13193 - DNA, 1083 bp, Artificial Sequence
  chemically treated genomic DNA (Homo sapiens) CpG-island No: 13193
  misc_feature (887)..(887): n is either a, c, g or t
agaattacggcgcggtagtagcggtagcggtagttttaatattgcggtagcggtaatttgcgtttggttattggcgtttttttagttttcgtagcggtgtagtgtattattattaagacgagtgattgttatatcgttatcggtaaagatcgcgggatcgtaggtgcggtaagttttattaatgataatgttattggtagtattaaggttggtttcgcgagttagttgttcgttggcgttgatagatttagaggatttcgttgacgcgtattttacgtatcgtaacggtattaaagtcgtcgtcgttgcgggcgtgatttgcgtaatttagtttggcggttttattcgtaatgacgaattgattgtagtcgtcgacgagtacggtattgcgatgttttttatcgatatgcgttattttcgttattaatggagtaatagatgaaagtattagtgattggtaacggcgggcgcgagtacgcgttggtttggaaagcggtttagtcgtcgttggttgagattgtttttgttgtttcgggtaatgtaggtattgtattggaattcgcgttgtaaaacgttgttattggcgtgatcgatatttcggcgttgttggatttcgtataaaacgaaaagattgatttgattatcgtcggttcggaagcgtcgttggtgaaaggcgtggtcgatatttttcgcgtcgtcgggttgaaaattttcggtttaatcgtagtgcggtttaattggaaggtttaaaagcgtttattaaagattttttggttcgttataagatttttacggcggaatattagaattttatcgaggtagaatttgcgttggcgtatttgcgtgagaaacgcgcgttaatcgttattagagttgatagtttggtntgtagggaacgcgttatcgtggcgatgacgtttgaagaagcgaaacgtttgtttacgatatgttggcgggtaatttttttcgcgacgcgcgttatcgtatcggtatcgaagagtttttcgatggttaagatacgtagttttatcgtgatggtggatcggtagtatgtattggcgaatgttattagttaggattata

SEQ ID NO: 13194 - DNA, 1083 bp, Artificial Sequence
  chemically treated genomic DNA (Homo sapiens) CpG-island No: 13194
  misc_feature (197)..(197): n is either a, c, g or t
tataatcctaactaataacattcgccaatacatactaccgatccaccatcacgataaaactacgtatcttaaccatcgaaaaactcttcgataccgatacgataacgcgcgtcgcgaaaaaaattacccgccaacatatcgtaaacaaacgtttcgcttcttcaaacgtcatcgccacgataacgcgttccctacanaccaaactatcaactctaataacgattaacgcgcgtttctcacgcaaatacgccaacgcaaattctacctcgataaaattctaatattccgccgtaaaaatcttataacgaaccaaaaaatctttaataaacgcttttaaaccttccaattaaaccgcactacgattaaaccgaaaattttcaacccgacgacgcgaaaaatatcgaccacgcctttcaccaacgacgcttccgaaccgacgataatcaaatcaatcttttcgttttatacgaaatccaacaacgccgaaatatcgatcacgccaataacaacgttttacaacgcgaattccaatacaatacctacattacccgaaacaacaaaaacaatctcaaccaacgacgactaaaccgctttccaaaccaacgcgtactcgcgcccgccgttaccaatcactaatactttcatctattactccattaataacgaaaataacgcatatcgataaaaaacatcgcaataccgtactcgtcgacgactacaatcaattcgtcattacgaataaaaccgccaaactaaattacgcaaatcacgcccgcaacgacgacgactttaataccgttacgatacgtaaaatacgcgtcaacgaaatcctctaaatctatcaacgccaacgaacaactaactcgcgaaaccaaccttaatactaccaataacattatcattaataaaacttaccgcacctacgatcccgcgatctttaccgataacgatataacaatcactcgtcttaataataatacactacaccgctacgaaaactaaaaaaacgccaataaccaaacgcaaattaccgctaccgcaatattaaaactaccgctaccgctactaccgcgccgtaattct

SEQ ID NO: 13195 - DNA, 1083 bp, Artificial Sequence
  chemically treated genomic DNA (Homo sapiens) CpG-island No: 13195
  misc_feature (197)..(197): n is either a, c, g or t
tgtaattttggttggtagtattcgttagtatatgttgtcggtttattattacgataaagttgcgtattttagttatcgagaaatttttcgatatcgatgcgatgacgcgcgtcgcgaaaaaggttgttcgttagtatatcgtgaatagacgtttcgtttttttaagcgttatcgttacgataacgcgttttttgtangttagattgttagttttaatgacgattagcgcgcgttttttacgtagatacgttagcgtaggttttatttcggtgaagttttggtatttcgtcgtagggattttatggcgggttaggaaatttttggtaaacgtttttgagttttttagttgggtcgtattgcggttgggtcgaagatttttagttcggcggcgcggaaggtatcgattacgttttttattagcggcgttttcgggtcgacgatggttagattaattttttcgttttgtgcgaaatttaatagcgtcgggatatcggttacgttaatagtaacgttttgtagcgcgggttttagtgtagtgtttgtattattcggagtaataaaaatagttttaattagcggcgattgggtcgttttttaggttagcgcgtgttcgcgttcgtcgttattaattattaatatttttatttattgttttattaatggcggaagtggcgtatgtcggtgaagagtatcgtaatatcgtgttcgtcggcggttgtaattagttcgttattacggatagaatcgttaggttggattacgtaggttacgttcgtagcggcggcggttttaatatcgttgcggtacgtgaagtacgcgttagcgggattttttgagtttattagcgttaacgagtaattggttcgcgaggttaattttgatattgttaatggtattgttattgatgaggtttgtcgtatttgcgatttcgcgatttttgtcggtggcgatgtggtaattattcgttttgataatggtgtattatatcgttgcgaaagttgggaaaacgttaataattaggcgtaaattgtcgttgtcgtaatgttagggttatcgttatcgttattgtcgcgtcgtggtttt

SEQ ID NO: 13196 - DNA, 1083 bp, Artificial Sequence
  chemically treated genomic DNA (Homo sapiens) CpG-island No: 13196
  misc_feature (887)..(887): n is either a, c, g or t
aaaaccacgacgcgacaataacgataacgataaccctaacattacgacaacgacaatttacgcctaattattaacgttttcccaactttcgcaacgatataatacaccattatcaaaacgaataattaccacatcgccaccgacaaaaatcgcgaaatcgcaaatacgacaaacctcatcaataacaataccattaacaatatcaaaattaacctcgcgaaccaattactcgttaacgctaataaactcaaaaaatcccgctaacgcgtacttcacgtaccgcaacgatattaaaaccgccgccgctacgaacgtaacctacgtaatccaacctaacgattctatccgtaataacgaactaattacaaccgccgacgaacacgatattacgatactcttcaccgacatacgccacttccgccattaataaaacaataaataaaaatattaataattaataacgacgaacgcgaacacgcgctaacctaaaaaacgacccaatcgccgctaattaaaactatttttattactccgaataatacaaacactacactaaaacccgcgctacaaaacgttactattaacgtaaccgatatcccgacgctattaaatttcgcacaaaacgaaaaaattaatctaaccatcgtcgacccgaaaacgccgctaataaaaaacgtaatcgataccttccgcgccgccgaactaaaaatcttcgacccaaccgcaatacgacccaactaaaaaactcaaaaacgtttaccaaaaatttcctaacccgccataaaatccctacgacgaaataccaaaacttcaccgaaataaaacctacgctaacgtatctacgtaaaaaacgcgcgctaatcgtcattaaaactaacaatctaacntacaaaaaacgcgttatcgtaacgataacgcttaaaaaaacgaaacgtctattcacgatatactaacgaacaacctttttcgcgacgcgcgtcatcgcatcgatatcgaaaaatttctcgataactaaaatacgcaactttatcgtaataataaaccgacaacatatactaacgaatactaccaaccaaaattaca

SEQ ID NO: 13197 - DNA, 1364 bp, Artificial Sequence
  chemically treated genomic DNA (Homo sapiens) CpG-island No: 13197
atttcgcgggaatacgaaatttttattcgcgaagacgcgacgttttcgtcgtattttcgcgtaggtgaagattcggttttttagtttcgcgtgtgcggtagtatgatatttagagtgcgtcggcgtttagcgcgagcgtattttacgataatttcgtttttcgttggggttcgtagttcgcggatttcggggttttttcgtttaaatgcggcggcgcgatcgtttcgtttcgcggttagggcgtttcgcgtttgtttcggttattttagtttattcgcgtagcgcggacgttaacgtattttattttcgttgggcgttaggggcgcggggtttagtggggtcgcggttttcgtattcggttgggattcgagggcggggtggtcgcggttgacgtgggttttgcggtttcgggttagagagtagtttgggggacggtgggttttttttcggtttgggagggaacgggggcgttcgcgcgggaggacggtaggcgagggacggcggtcgcgggcgatttagattcggggcgggcgggtatacgtcggagcgcggcggttatacgttcgttcggggagcgttattgtgcgttttagtcggcgttttttttcgtttgttcgcgtcggttggagaaaggaaggacggcgattttcgcgttcggttcgcgttattagttcgtttcggcgtcgagcgcgggttatatttagcgtttcgggaggcggcggaggttgggcggttcgggttgcggaatgttcggtttagtcgagttttcgtttcggtcgcgtaggttttttcgcgttcgttcgcgttttgtatttttagtcggttcggcgtggagggggttttgggtttatttttgtgtcgagcgtcggttttttcgtttcgggtcggagtcggggttcgggggcgcggtcgttaggggaggcgtcgcggcggtggcggtttttgcggttcggagggcgggtcgagcgggagtcgttgtttgggtcgcgcgtcgttcggagttcgtttcgcgttgtcggcgtttgtagcggagggcgtagttagttcggttttcggattggatttttttattgatataatttcggttcggtcgttttacgtagggatattttcgtttttcgtaggttgttttcgttcgtcgattcgttcgtttttttttcggtgttatttattaggagtatatattttagtcggcgtttttcgttttcgttcgtaaatatagcgttgtttacgtttttttcgggttttgtattcgtttatacgtacgttttgatatagatttcgtttttttatacgttttttttagttttttttttattttattttttagaagaattttagtatagttttcgtattttgtttgt

SEQ ID NO: 13198 - DNA, 1364 bp, Artificial Sequence
  chemically treated genomic DNA (Homo sapiens) CpG-island No: 13198
acaaacaaaatacgaaaactatactaaaattcttctaaaaaataaaataaaaaaaaaactaaaaaaaacgtataaaaaaacgaaatctatatcaaaacgtacgtataaacgaatacaaaacccgaaaaaaacgtaaacaacgctatatttacgaacgaaaacgaaaaacgccgactaaaatatatactcctaataaataacaccgaaaaaaaaacgaacgaatcgacgaacgaaaacaacctacgaaaaacgaaaatatccctacgtaaaacgaccgaaccgaaattatatcaataaaaaaatccaatccgaaaaccgaactaactacgccctccgctacaaacgccgacaacgcgaaacgaactccgaacgacgcgcgacccaaacaacgactcccgctcgacccgccctccgaaccgcaaaaaccgccaccgccgcgacgcctcccctaacgaccgcgcccccgaaccccgactccgacccgaaacgaaaaaaccgacgctcgacacaaaaataaacccaaaaccccctccacgccgaaccgactaaaaatacaaaacgcgaacgaacgcgaaaaaacctacgcgaccgaaacgaaaactcgactaaaccgaacattccgcaacccgaaccgcccaacctccgccgcctcccgaaacgctaaatataacccgcgctcgacgccgaaacgaactaataacgcgaaccgaacgcgaaaatcgccgtccttcctttctccaaccgacgcgaacaaacgaaaaaaaacgccgactaaaacgcacaataacgctccccgaacgaacgtataaccgccgcgctccgacgtatacccgcccgccccgaatctaaatcgcccgcgaccgccgtccctcgcctaccgtcctcccgcgcgaacgcccccgttccctcccaaaccgaaaaaaaacccaccgtcccccaaactactctctaacccgaaaccgcaaaacccacgtcaaccgcgaccaccccgccctcgaatcccaaccgaatacgaaaaccgcgaccccactaaaccccgcgcccctaacgcccaacgaaaataaaatacgttaacgtccgcgctacgcgaataaactaaaataaccgaaacaaacgcgaaacgccctaaccgcgaaacgaaacgatcgcgccgccgcatttaaacgaaaaaaccccgaaatccgcgaactacgaaccccaacgaaaaacgaaattatcgtaaaatacgctcgcgctaaacgccgacgcactctaaatatcatactaccgcacacgcgaaactaaaaaaccgaatcttcacctacgcgaaaatacgacgaaaacgtcgcgtcttcgcgaataaaaatttcgtattcccgcgaaat

SEQ ID NO: 13199 - DNA, 1364 bp, Artificial Sequence
  chemically treated genomic DNA (Homo sapiens) CpG-island No: 13199
gtaagtaaagtgcggaagttgtattgggatttttttagaaagtggggtgggaaaggagttagggagggcgtgtggagggacgagatttgtgttagaacgtgcgtgtgagcggatataaaattcgagagaggcgtgagtagcgttgtgtttgcgagcgggagcgaggggcgtcggttggggtgtgtgtttttggtgagtgatatcgaggggaaggcgggcgggtcggcgggcgggggtagtttgcgaggggcgggagtgtttttgcgtggggcggtcgagtcggagttgtgttagtgaaggaatttagttcgggggtcgagttggttgcgtttttcgttgtaagcgtcggtagcgcggggcgagtttcggacggcgcgcggtttaggtagcggttttcgttcggttcgtttttcgagtcgtaggggtcgttatcgtcgcggcgttttttttggcgatcgcgttttcgggtttcggtttcggttcgggacggaggagtcggcgttcgatatagaggtaagtttaggattttttttacgtcgggtcggttggggatgtagggcgcgggcggacgcggaggggtttgcgcggtcgggacggagattcggttgggtcgagtatttcgtagttcgggtcgtttagttttcgtcgtttttcggagcgttgggtgtggttcgcgttcggcgtcgaggcgggttggtggcgcggatcggacgcgaaggtcgtcgttttttttttttttagtcggcgcgggtaagcgggaggaggcgtcggttgggacgtatagtggcgtttttcgggcgagcgtgtggtcgtcgcgtttcgacgtgtattcgttcgtttcggatttgaatcgttcgcggtcgtcgtttttcgtttgtcgttttttcgcgcgggcgttttcgtttttttttaagtcggaaagagatttatcgttttttaggttgttttttggttcggagtcgtaaagtttacgttagtcgcgattatttcgttttcggattttagtcgggtgcgggggtcgcggttttattgaatttcgcgtttttggcgtttagcgggagtgggatgcgttggcgttcgcgttgcgcgggtgggttggggtggtcggagtagacgcggagcgttttggtcgcgggacgaagcggtcgcgtcgtcgtatttgggcggggggatttcggagttcgcgggttgcggattttagcgggagacggggttgtcgtaggatgcgttcgcgttggacgtcggcgtattttgaatattatgttgtcgtatacgcggggttgaagggtcgagtttttatttgcgcggggatgcggcggaagcgtcgcgttttcgcgagtggaggtttcgtgttttcgcggggt

SEQ ID NO: 13200 - DNA, 1364 bp, Artificial Sequence
  chemically treated genomic DNA (Homo sapiens) CpG-island No: 13200
accccgcgaaaacacgaaacctccactcgcgaaaacgcgacgcttccgccgcatccccgcgcaaataaaaactcgacccttcaaccccgcgtatacgacaacataatattcaaaatacgccgacgtccaacgcgaacgcatcctacgacaaccccgtctcccgctaaaatccgcaacccgcgaactccgaaatccccccgcccaaatacgacgacgcgaccgcttcgtcccgcgaccaaaacgctccgcgtctactccgaccaccccaacccacccgcgcaacgcgaacgccaacgcatcccactcccgctaaacgccaaaaacgcgaaattcaataaaaccgcgacccccgcacccgactaaaatccgaaaacgaaataatcgcgactaacgtaaactttacgactccgaaccaaaaaacaacctaaaaaacgataaatctctttccgacttaaaaaaaaacgaaaacgcccgcgcgaaaaaacgacaaacgaaaaacgacgaccgcgaacgattcaaatccgaaacgaacgaatacacgtcgaaacgcgacgaccacacgctcgcccgaaaaacgccactatacgtcccaaccgacgcctcctcccgcttacccgcgccgactaaaaaaaaaaaaaacgacgaccttcgcgtccgatccgcgccaccaacccgcctcgacgccgaacgcgaaccacacccaacgctccgaaaaacgacgaaaactaaacgacccgaactacgaaatactcgacccaaccgaatctccgtcccgaccgcgcaaacccctccgcgtccgcccgcgccctacatccccaaccgacccgacgtaaaaaaaatcctaaacttacctctatatcgaacgccgactcctccgtcccgaaccgaaaccgaaacccgaaaacgcgatcgccaaaaaaaacgccgcgacgataacgacccctacgactcgaaaaacgaaccgaacgaaaaccgctacctaaaccgcgcgccgtccgaaactcgccccgcgctaccgacgcttacaacgaaaaacgcaaccaactcgacccccgaactaaattccttcactaacacaactccgactcgaccgccccacgcaaaaacactcccgcccctcgcaaactacccccgcccgccgacccgcccgccttcccctcgatatcactcaccaaaaacacacaccccaaccgacgcccctcgctcccgctcgcaaacacaacgctactcacgcctctctcgaattttatatccgctcacacgcacgttctaacacaaatctcgtccctccacacgccctccctaactcctttcccaccccactttctaaaaaaatcccaatacaacttccgcactttacttac

SEQ ID NO: 13201 - DNA, 786 bp, Artificial Sequence
  chemically treated genomic DNA (Homo sapiens) CpG-island No: 13201
  misc_feature (585)..(585): n is either a, c, g or t
  misc_feature (665)..(665): n is either a, c, g or t
  misc_feature (670)..(670): n is either a, c, g or t
  misc_feature (678)..(678): n is either a, c, g or t
  misc_feature (702)..(702): n is either a, c, g or t
  misc_feature (726)..(726): n is either a, c, g or t
gttggagtagggttttaatatcgttcgtaacgcggcgttgttggtagaagtattatattttgtttcggcggttatcgttaatcgtttgtgtggtttatttatgtaggtattgtatgacgtagtacgaatgattatgattggcgatgcgtaggtatgtttggttggcggcgtggagtatatgggttatgtgtcgatgagttacggcgtcgatttttatttcggtttgagtcgtaatgtcgttaaagcggcgggtatgatgggtttaacggtagaaatgttggcgcgtatgtacggtattagtcgtgaaatgtaggatgtttttgtcgcgcggttatacgttcgcgtttgggtcgttacgtagtcggtcgtatttaaaaatgaaattatttcgatcggtggttacgatgtcgacggcgttttgaagtagtttaattacgacgaagtgattcgttcggaaattatcgtggaagttttcgttacgttgcgttcggcgtttgatttagtaaacggtatggtaacggcgggtatattttttgtatttttcgatggcgtagttgttatgttggtgatgagtgaaagttgcgnttatgaattaggttttaaagcgcgcgttcgtgtgcgttcgatggcggtcgttggttgtgatcgatcgattatgggttatngtttnggtttcgnttcgaaattggtcgttgaaaaagncggggttttttgttagcgatattngcgtggttgaaaataatcgaagtttttggcgcgtagaatttgttatgtattaaagatttg

SEQ ID NO: 13202 - DNA, 786 bp, Artificial Sequence
  chemically treated genomic DNA (Homo sapiens) CpG-island No: 13202
  misc_feature (61)..(61): n is either a, c, g or t
  misc_feature (85)..(85): n is either a, c, g or t
  misc_feature (109)..(109): n is either a, c, g or t
  misc_feature (117)..(117): n is either a, c, g or t
  misc_feature (122)..(122): n is either a, c, g or t
  misc_feature (202)..(202): n is either a, c, g or t
caaatctttaatacataacaaattctacgcgccaaaaacttcgattattttcaaccacgcnaatatcgctaacaaaaaaccccgnctttttcaacgaccaatttcgaancgaaaccnaaacnataacccataatcgatcgatcacaaccaacgaccgccatcgaacgcacacgaacgcgcgctttaaaacctaattcataancgcaactttcactcatcaccaacataacaactacgccatcgaaaaatacaaaaaatatacccgccgttaccataccgtttactaaatcaaacgccgaacgcaacgtaacgaaaacttccacgataatttccgaacgaatcacttcgtcgtaattaaactacttcaaaacgccgtcgacatcgtaaccaccgatcgaaataatttcatttttaaatacgaccgactacgtaacgacccaaacgcgaacgtataaccgcgcgacaaaaacatcctacatttcacgactaataccgtacatacgcgccaacatttctaccgttaaacccatcatacccgccgctttaacgacattacgactcaaaccgaaataaaaatcgacgccgtaactcatcgacacataacccatatactccacgccgccaaccaaacatacctacgcatcgccaatcataatcattcgtactacgtcatacaatacctacataaataaaccacacaaacgattaacgataaccgccgaaacaaaatataatacttctaccaacaacgccgcgttacgaacgatattaaaaccctactccaac

SEQ ID NO: 13203 - DNA, 786 bp, Artificial Sequence
  chemically treated genomic DNA (Homo sapiens) CpG-island No: 13203
  misc_feature (61)..(61): n is either a, c, g or t
  misc_feature (85)..(85): n is either a, c, g or t
  misc_feature (109)..(109): n is either a, c, g or t
  misc_feature (117)..(117): n is either a, c, g or t
  misc_feature (122)..(122): n is either a, c, g or t
  misc_feature (202)..(202): n is either a, c, g or t
tagatttttaatatatggtagattttgcgcgttaaaggtttcggttatttttaattacgtngatatcgttggtaggaagtttcgntttttttagcggttagtttcgagncggaattngggtngtaatttataatcgatcggttataattaacgatcgttatcgaacgtatacgagcgcgcgttttaagatttaatttatggncgtagtttttatttattattagtatggtagttgcgttatcggaaagtgtagaagatgtgttcgtcgttattatatcgtttattggattaaacgtcggacgtagcgtggcgagggtttttacggtggttttcgggcgaattatttcgtcgtaattaaattgttttaggacgtcgtcggtatcgtgattatcggtcgggatgattttatttttaaatgcggtcgattgcgtggcggtttaggcgcgggcgtgtgatcgcgcggtaaaggtattttgtattttacggttgatatcgtgtatacgcgttagtatttttgtcgttaagtttattatgttcgtcgttttggcgatattgcggtttaggtcggggtgaaaatcgacgtcgtgatttatcggtatatggtttatatgttttacgtcgttaattagatatgtttgcgtatcgttagttatgattattcgtgttgcgttatgtagtgtttgtatggatgaattatataagcgattaacggtaatcgtcgggatagagtgtggtatttttgttagtagcgtcgcgttacgggcgatattaaaattttgttttagt

SEQ ID NO: 13204 - DNA, 786 bp, Artificial Sequence
  chemically treated genomic DNA (Homo sapiens) CpG-island No: 13204
  misc_feature (585)..(585): n is either a, c, g or t
  misc_feature (665)..(665): n is either a, c, g or t
  misc_feature (670)..(670): n is either a, c, g or t
  misc_feature (678)..(678): n is either a, c, g or t
  misc_feature (702)..(702): n is either a, c, g or t
  misc_feature (726)..(726): n is either a, c, g or t
actaaaacaaaattttaatatcgcccgtaacgcgacgctactaacaaaaataccacactctatcccgacgattaccgttaatcgcttatataattcatccatacaaacactacataacgcaacacgaataatcataactaacgatacgcaaacatatctaattaacgacgtaaaacatataaaccatataccgataaatcacgacgtcgattttcaccccgacctaaaccgcaatatcgccaaaacgacgaacataataaacttaacgacaaaaatactaacgcgtatacacgatatcaaccgtaaaatacaaaatacctttaccgcgcgatcacacgcccgcgcctaaaccgccacgcaatcgaccgcatttaaaaataaaatcatcccgaccgataatcacgataccgacgacgtcctaaaacaatttaattacgacgaaataattcgcccgaaaaccaccgtaaaaaccctcgccacgctacgtccgacgtttaatccaataaacgatataataacgacgaacacatcttctacactttccgataacgcaactaccatactaataataaataaaaactacgnccataaattaaatcttaaaacgcgcgctcgtatacgttcgataacgatcgttaattataaccgatcgattataaattacnacccnaattccgnctcgaaactaaccgctaaaaaaancgaaacttcctaccaacgatatcnacgtaattaaaaataaccgaaacctttaacgcgcaaaatctaccatatattaaaaatcta

SEQ ID NO: 13205 - DNA, 577 bp, Artificial Sequence
  chemically treated genomic DNA (Homo sapiens) CpG-island No: 13205
  misc_feature (561)..(561): n is either a, c, g or t
ttcgttcgttattttgcgggcggtatagtattaacgaggtatatcgtggtaaaagttttaaaacgcgtttttgtttgtaatgaatgcggggtcgattattcgcgttggtaggggtagtgtagtgtttgttatgtttggaatattattatcgaggtgcgttttgttgcgtcgttaatggtggcgcgtaacgagcgttttagcggttatgtcggtagcgtcggggtggtaaaagtttagaaatttttcgatattagttttgaagagttgtcgcgtttttttatcggatttaaagagttcgatcgcgtattaggcggcggcgtggtgttaggaagtgttattttgattggcggtaattttggtgcggggaaatttacgttgttattgtaaacgttgtgtaaattggtttagtagatgaatacgttgtatgttatcggcgaagagtcgttgtaataagtggtaatgcgcgtttatcgttttgggttgtcgattgataattttaatatgtggtcggaaattagtatcgaatagatttgttttgattgtttcgaagaagagtaacgngaagttggaatgggaa

SEQ ID NO: 13206 - DNA, 577 bp, Artificial Sequence
  chemically treated genomic DNA (Homo sapiens) CpG-island No: 13206
  misc_feature (17)..(17): n is either a, c, g or t
ttcccattccaacttcncgttactcttcttcgaaacaatcaaaacaaatctattcgatactaatttccgaccacatattaaaattatcaatcgacaacccaaaacgataaacgcgcattaccacttattacaacgactcttcgccgataacatacaacgtattcatctactaaaccaatttacacaacgtttacaataacaacgtaaatttccccgcaccaaaattaccgccaatcaaaataacacttcctaacaccacgccgccgcctaatacgcgatcgaactctttaaatccgataaaaaaacgcgacaactcttcaaaactaatatcgaaaaatttctaaacttttaccaccccgacgctaccgacataaccgctaaaacgctcgttacgcgccaccattaacgacgcaacaaaacgcacctcgataataatattccaaacataacaaacactacactacccctaccaacgcgaataatcgaccccgcattcattacaaacaaaaacgcgttttaaaacttttaccacgatatacctcgttaatactataccgcccgcaaaataacgaacgaa

SEQ ID NO: 13207 - DNA, 577 bp, Artificial Sequence
  chemically treated genomic DNA (Homo sapiens) CpG-island No: 13207
  misc_feature (17)..(17): n is either a, c, g or t
tttttattttagttttncgttgttttttttcggggtaattagggtagatttgttcgatgttggttttcgattatatattgagattgttagtcggtagtttaaggcgatgagcgcgtattgttatttgttgtagcgatttttcgtcggtgatatatagcgtatttatttgttgggttagtttgtatagcgtttgtagtagtagcgtggattttttcgtattagggttatcgttaattagaatggtattttttggtattacgtcgtcgtttagtacgcggtcgaattttttaaattcggtggaaaaacgcggtagttttttaaggttgatatcggagagtttttggatttttgttatttcggcgttatcggtatagtcgttgagacgttcgttacgcgttattattggcgacgtagtaagacgtatttcggtgatggtgttttaggtatgataggtattgtattgtttttgttagcgcggataatcggtttcgtatttattataaataaaggcgcgttttggagtttttgttacggtgtatttcgttaatgttgtgtcgttcgtaggatggcgggcgag

SEQ ID NO: 13208 - DNA, 577 bp, Artificial Sequence
  chemically treated genomic DNA (Homo sapiens) CpG-island No: 13208
  misc_feature (561)..(561): n is either a, c, g or t
ctcgcccgccatcctacgaacgacacaacattaacgaaatacaccgtaacaaaaactccaaaacgcgcctttatttataataaatacgaaaccgattatccgcgctaacaaaaacaatacaatacctatcatacctaaaacaccatcaccgaaatacgtcttactacgtcgccaataataacgcgtaacgaacgtctcaacgactataccgataacgccgaaataacaaaaatccaaaaactctccgatatcaaccttaaaaaactaccgcgtttttccaccgaatttaaaaaattcgaccgcgtactaaacgacgacgtaataccaaaaaataccattctaattaacgataaccctaatacgaaaaaatccacgctactactacaaacgctatacaaactaacccaacaaataaatacgctatatatcaccgacgaaaaatcgctacaacaaataacaatacgcgctcatcgccttaaactaccgactaacaatctcaatatataatcgaaaaccaacatcgaacaaatctaccctaattaccccgaaaaaaaacaacgnaaaactaaaataaaaa

SEQ ID NO: 13209 - DNA, 942 bp, Artificial Sequence
  chemically treated genomic DNA (Homo sapiens) CpG-island No: 13209
ttgttatcgttttgcggtttcgttatttacggtgcggtgcgtgaggcggtttgtttcgttatagtgttagtgggtgattagttttttattttcgttgcggataagtttgtcggttaggtcgtggtgataacgttgtgtgcggtcgttaaagtcggttttttgtattagtcggtcgagtatatcgtaacggaaggtggtgtggttgtcgtttttattggttaggcggatgattcgttcggtagtatcgtattttatattgcgcgttagatcgttttgcgtggtatagatggtttttttttacgtatcgtattgtgtttcgtttttgttgtcgttcggggtaatgacggtggttaggttatcggcggcgttgtatttatatcgcgttttatggttttgcgtgttttttacggtaattaattgtttacggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgtattcggcgtggttatgcgcgtgatgaggttcgttattatattcgggttgtattttgttgatatttgcggtattcgtttgtgttttgagtttgtttacggcgttaaattgattttgcgtgacgttgtcgttcgggggattttttagtagagtttcgtttcgtttttt

SEQ ID NO: 13210 - DNA, 942 bp, Artificial Sequence
  chemically treated genomic DNA (Homo sapiens) CpG-island No: 13210
aaaaaacgaaacgaaactctactaaaaaatcccccgaacgacaacgtcacgcaaaatcaatttaacgccgtaaacaaactcaaaacacaaacgaataccgcaaatatcaacaaaatacaacccgaatataataacgaacctcatcacgcgcataaccacgccgaatacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccgtaaacaattaattaccgtaaaaaacacgcaaaaccataaaacgcgatataaatacaacgccgccgataacctaaccaccgtcattaccccgaacgacaacaaaaacgaaacacaatacgatacgtaaaaaaaaaccatctataccacgcaaaacgatctaacgcgcaatataaaatacgatactaccgaacgaatcatccgcctaaccaataaaaacgacaaccacaccaccttccgttacgatatactcgaccgactaatacaaaaaaccgactttaacgaccgcacacaacgttatcaccacgacctaaccgacaaacttatccgcaacgaaaataaaaaactaatcacccactaacactataacgaaacaaaccgcctcacgcaccgcaccgtaaataacgaaaccgcaaaacgataacaa

SEQ ID NO: 13211 - DNA, 942 bp, Artificial Sequence
  chemically treated genomic DNA (Homo sapiens) CpG-island No: 13211
gggggacggagcgagattttgttagaggatttttcggacggtagcgttacgtagagttagtttgacgtcgtgggtaggtttagggtatagacggatgtcgtaggtattaatagagtatagttcggatgtggtgacgggttttattacgcgtataattacgtcggatgtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcgtggatagttaattgtcgtgaaagatacgtagggttatgaaacgcggtatgaatataacgtcgtcggtgatttgattatcgttattgtttcggacggtagtagaaacgggatatagtacgatgcgtggggaaaagttatttgtattacgtagggcggtttgacgcgtagtatggaatacgatgttgtcggacgggttattcgtttgattagtgaaaacggtagttatattatttttcgttacgatgtattcgatcggttgatataggaaatcggttttgacggtcgtatatagcgttattattacgatttgatcggtaaatttattcgtagcgaggatgaggggttggttatttattggtattatgacgaagtagatcgttttacgtatcgtatcgtgaatggcgaaatcgtagagcggtggtag

SEQ ID NO: 13212 - DNA, 942 bp, Artificial Sequence
  chemically treated genomic DNA (Homo sapiens) CpG-island No: 13212
ctaccaccgctctacgatttcgccattcacgatacgatacgtaaaacgatctacttcgtcataataccaataaataaccaacccctcatcctcgctacgaataaatttaccgatcaaatcgtaataataacgctatatacgaccgtcaaaaccgatttcctatatcaaccgatcgaatacatcgtaacgaaaaataatataactaccgttttcactaatcaaacgaataacccgtccgacaacatcgtattccatactacgcgtcaaaccgccctacgtaatacaaataacttttccccacgcatcgtactatatcccgtttctactaccgtccgaaacaataacgataatcaaatcaccgacgacgttatattcataccgcgtttcataaccctacgtatctttcacgacaattaactatccacgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctacatccgacgtaattatacgcgtaataaaacccgtcaccacatccgaactatactctattaatacctacgacatccgtctataccctaaacctacccacgacgtcaaactaactctacgtaacgctaccgtccgaaaaatcctctaacaaaatctcgctccgtccccc

SEQ ID NO: 13213 - DNA, 538 bp, Artificial Sequence
  chemically treated genomic DNA (Homo sapiens) CpG-island No: 13213
taattagcgtcggttcgttgtttagacgtttttcgtatggcgggttgtttaatattgtgtcgtacggttttttcggtagcggattggttagttgcgcgatattttttattttaaaggtgattagtttattaattttcgtaagacgggcgttagtgcgtgtacgttgaattattcgtgcgtcgttgttcgaatcgtaaaaatgagagttatatttagttaggtttttacgggcgcgagtttgcgttttcgtttttattttttgttagatagttttattatgttgcgtttagtcgttaaagttttaacgtttacggtgtaagtttggtgcgcgatcggtcgttagtatcgttgttttaattagtaacgtatcggaattatatatcggatcgagtagcggtgtttttggttgttagtcggatcgtattataatagcggttgttagggtttttttgatcggcgtaatattagtacgatcgcgatagttacgtagatgtaaattattattatttagattaagagcgatattggcggttttttt

SEQ ID NO: 13214 - DNA, 538 bp, Artificial Sequence
  chemically treated genomic DNA (Homo sapiens) CpG-island No: 13214
aaaaaaaccgccaatatcgctcttaatctaaataataataatttacatctacgtaactatcgcgatcgtactaatattacgccgatcaaaaaaaccctaacaaccgctattataatacgatccgactaacaaccaaaaacaccgctactcgatccgatatataattccgatacgttactaattaaaacaacgatactaacgaccgatcgcgcaccaaacttacaccgtaaacgttaaaactttaacgactaaacgcaacataataaaactatctaacaaaaaataaaaacgaaaacgcaaactcgcgcccgtaaaaacctaactaaatataactctcatttttacgattcgaacaacgacgcacgaataattcaacgtacacgcactaacgcccgtcttacgaaaattaataaactaatcacctttaaaataaaaaatatcgcgcaactaaccaatccgctaccgaaaaaaccgtacgacacaatattaaacaacccgccatacgaaaaacgtctaaacaacgaaccgacgctaatta

SEQ ID NO: 13215 - DNA, 538 bp, Artificial Sequence
  chemically treated genomic DNA (Homo sapiens) CpG-island No: 13215
aaagaaatcgttagtatcgtttttgatttgagtggtgatggtttatatttgcgtggttatcgcgatcgtgttggtattgcgtcgattaaagaaattttggtagtcgttattgtgatgcgattcggttggtagttaggaatatcgttgttcgattcgatgtgtggtttcggtacgttgttgattgaagtagcgatgttggcgatcgatcgcgtattaggtttgtatcgtgggcgttggggttttagcggttgggcgtagtatgatgaagttatttggtaggaagtgaaagcggaagcgtaaattcgcgttcgtaaaggtttggttgagtatagtttttatttttacggttcggatagcgacgtacgggtgatttaacgtgtacgtattaacgttcgttttgcggggattggtgaattgattatttttgaggtgaaagatgtcgcgtaattgattaattcgttgtcgaaagggtcgtacggtatagtgttgagtaattcgttatacggggaacgtttggatagcgaatcggcgttgattg

SEQ ID NO: 13216 - DNA, 538 bp, Artificial Sequence
  chemically treated genomic DNA (Homo sapiens) CpG-island No: 13216
caatcaacgccgattcgctatccaaacgttccccgtataacgaattactcaacactataccgtacgaccctttcgacaacgaattaatcaattacgcgacatctttcacctcaaaaataatcaattcaccaatccccgcaaaacgaacgttaatacgtacacgttaaatcacccgtacgtcgctatccgaaccgtaaaaataaaaactatactcaaccaaacctttacgaacgcgaatttacgcttccgctttcacttcctaccaaataacttcatcatactacgcccaaccgctaaaaccccaacgcccacgatacaaacctaatacgcgatcgatcgccaacatcgctacttcaatcaacaacgtaccgaaaccacacatcgaatcgaacaacgatattcctaactaccaaccgaatcgcatcacaataacgactaccaaaatttctttaatcgacgcaataccaacacgatcgcgataaccacgcaaatataaaccatcaccactcaaatcaaaaacgatactaacgatttcttt

SEQ ID NO: 13217 - DNA, 758 bp, Artificial Sequence
  chemically treated genomic DNA (Homo sapiens) CpG-island No: 13217
gttggaaaaatagtgcgagcgcggtttgttggcgaaagatttttttttatttattgtgattcgtattagcgcggtattcgatgcgcgtatgggcggcgttacgttttcggttatgagtaatttcggttcgggtaattaggggattatcgtaataatgtttgtggtggtggtagtagaatatttcggagcggatgatgaacggttggcgcgtgcgttgatgttttcgtatttgagcgtaatttatatttataattagttatcgcgtttgtttgcgttgtgtgtcgtaacgatcgtagtaatgggggtcgtcgtcgggatggtatggttggtggatgggcgttatgaaattatttcgatggcgattagtagtatgatcggcgatgttagcggtatgatttgcgatggtgcgtcgaatagttgcgcgatgaaggtttcgattagtgtttcggttgcgtggatcgcggtgttaatggcgttggatgatatcgtcgtgatcggtaatgaagggattgtggcgtatgatgttgagtagtcgattgttaatttgtgtgcgttagtaagttattcgatgtagtaaacggatcggcgagattatcgagattatggcgagtaaggttagataaacgttaggttttggggatcgtgtcggatgcgatgttggcgtattttgttcggtttacgggttgtttaattcgttaatgttgttggattttgtaggtcggataaggcgttttcgtcgtattcggtaatttgttttt

SEQ ID NO: 13218 - DNA, 758 bp, Artificial Sequence
  chemically treated genomic DNA (Homo sapiens) CpG-island No: 13218
aaaaacaaattaccgaatacgacgaaaacgccttatccgacctacaaaatccaacaacattaacgaattaaacaacccgtaaaccgaacaaaatacgccaacatcgcatccgacacgatccccaaaacctaacgtttatctaaccttactcgccataatctcgataatctcgccgatccgtttactacatcgaataacttactaacgcacacaaattaacaatcgactactcaacatcatacgccacaatcccttcattaccgatcacgacgatatcatccaacgccattaacaccgcgatccacgcaaccgaaacactaatcgaaaccttcatcgcgcaactattcgacgcaccatcgcaaatcataccgctaacatcgccgatcatactactaatcgccatcgaaataatttcataacgcccatccaccaaccataccatcccgacgacgacccccattactacgatcgttacgacacacaacgcaaacaaacgcgataactaattataaatataaattacgctcaaatacgaaaacatcaacgcacgcgccaaccgttcatcatccgctccgaaatattctactaccaccaccacaaacattattacgataatcccctaattacccgaaccgaaattactcataaccgaaaacgtaacgccgcccatacgcgcatcgaataccgcgctaatacgaatcacaataaataaaaaaaaatctttcgccaacaaaccgcgctcgcactatttttccaac

SEQ ID NO: 13219 - DNA, 758 bp, Artificial Sequence
  chemically treated genomic DNA (Homo sapiens) CpG-island No: 13219
aaagataggttgtcggatgcggcgaaaacgttttattcggtttataaaatttaataatattaacgaattaaataattcgtaggtcggataagatgcgttagtatcgtattcggtacgatttttaaaatttggcgtttatttggttttgttcgttataatttcgataatttcgtcgattcgtttgttgtatcgaatggtttgttaacgtatataggttggtaatcgattgtttaatattatgcgttataatttttttattgtcggttacggcggtattatttagcgttattaatatcgcggtttacgtagtcgaagtattggtcgaaatttttatcgcgtagttgttcgacgtattatcgtaaattatgtcgttgatatcgtcgattatattgttgatcgttatcgagatggttttataacgtttatttattagttatgttatttcggcggcggtttttattgttgcggtcgttgcggtatatagcgtagataaacgcggtaattggttatggatgtaaattgcgtttaaatgcgaaagtattagcgtacgcgttagtcgtttattattcgtttcgaagtgttttgttattattattataggtattgttgcggtaattttttggttattcgagtcggagttatttatagtcggaagcgtagcgtcgtttatacgcgtatcggatgtcgcgttggtacgaattataatggatgaagagagatttttcgttagtaaatcgcgttcgtattgtttttttagt

SEQ ID NO: 13220 - DNA, 758 bp, Artificial Sequence
  chemically treated genomic DNA (Homo sapiens) CpG-island No: 13220
actaaaaaaacaatacgaacgcgatttactaacgaaaaatctctcttcatccattataattcgtaccaacgcgacatccgatacgcgtataaacgacgctacgcttccgactataaataactccgactcgaataaccaaaaaattaccgcaacaatacctataataataataacaaaacacttcgaaacgaataataaacgactaacgcgtacgctaatactttcgcatttaaacgcaatttacatccataaccaattaccgcgtttatctacgctatataccgcaacgaccgcaacaataaaaaccgccgccgaaataacataactaataaataaacgttataaaaccatctcgataacgatcaacaatataatcgacgatatcaacgacataatttacgataatacgtcgaacaactacgcgataaaaatttcgaccaatacttcgactacgtaaaccgcgatattaataacgctaaataataccgccgtaaccgacaataaaaaaattataacgcataatattaaacaatcgattaccaacctatatacgttaacaaaccattcgatacaacaaacgaatcgacgaaattatcgaaattataacgaacaaaaccaaataaacgccaaattttaaaaatcgtaccgaatacgatactaacgcatcttatccgacctacgaattatttaattcgttaatattattaaattttataaaccgaataaaacgttttcgccgcatccgacaacctatcttt

SEQ ID NO: 13221 - DNA, 665 bp, Artificial Sequence
  chemically treated genomic DNA (Homo sapiens) CpG-island No: 13221
ttgttgttatcggggttttttaattcggagataagcgtaagcggttattattacgtatagtaatattatattcgaagacgattaggtagttattttcgtttggtggttcgtgatattgaaggtcggatggtttggcgggtatggaattttgagtcggatgtcggtgaaggttttaatcgttatattcgtattttaggtattcgtatagatacggttattcgttgatcgcgaagtatttattcgtatttattttttcgaatatattttatatttttatacgttagttatcgtcgttggcgtttttattgacggagatatatttatgataatatagacgtagtacgatttcgtattcgttaattaattcgaatttgaattgatcgttacgtcggttttcgatgaatagcgtatcgatttttggttatagtattttggcgttatttcgtagtggttatttttggagtcgtatattttcgtttggatggatcgtttttgtgagggttatagcggtggtatttggtcgttttatatttttagtaatggcggcgtatttatgtttttcgagtttgataacgatgagatatggcgtttgtttaattgtttgaacggtaacgatgtttaaatgagtgtagaagtagtaggtattgttgtttgtttgattgcgt

SEQ ID NO: 13222 - DNA, 665 bp, Artificial Sequence
  chemically treated genomic DNA (Homo sapiens) CpG-island No: 13222
acgcaatcaaacaaacaacaatacctactacttctacactcatttaaacatcgttaccgttcaaacaattaaacaaacgccatatctcatcgttatcaaactcgaaaaacataaatacgccgccattactaaaaatataaaacgaccaaataccaccgctataaccctcacaaaaacgatccatccaaacgaaaatatacgactccaaaaataaccactacgaaataacgccaaaatactataaccaaaaatcgatacgctattcatcgaaaaccgacgtaacgatcaattcaaattcgaattaattaacgaatacgaaatcgtactacgtctatattatcataaatatatctccgtcaataaaaacgccaacgacgataactaacgtataaaaatataaaatatattcgaaaaaataaatacgaataaatacttcgcgatcaacgaataaccgtatctatacgaatacctaaaatacgaatataacgattaaaaccttcaccgacatccgactcaaaattccatacccgccaaaccatccgaccttcaatatcacgaaccaccaaacgaaaataactacctaatcgtcttcgaatataatattactatacgtaataataaccgcttacgcttatctccgaattaaaaaaccccgataacaacaa

SEQ ID NO: 13223 - DNA, 665 bp, Artificial Sequence
  chemically treated genomic DNA (Homo sapiens) CpG-island No: 13223
acgtaattaggtagatagtaatatttgttgtttttgtatttatttgggtatcgttatcgtttaggtagttaaatagacgttatgttttatcgttgttaggttcgggggatataaatgcgtcgttattgttgagggtgtagaacgattagatattatcgttgtagtttttatagaagcggtttatttaggcgaagatatgcggttttaggagtagttattgcgggatagcgttaaagtattgtggttagaaatcgatacgttgtttatcggggatcggcgtgacggttagtttaaattcgggttggttagcgggtgcgaggtcgtgttgcgtttgtgttgttatgggtatgttttcgttaataaaaacgttagcggcgatggttggcgtatggggatataaagtgtgttcggggaggtgaatgcgggtaaatgtttcgcgattagcgggtggtcgtgtttgtacggatgtttgaggtgcggatatagcggttaagatttttatcggtattcggtttaaagttttatgttcgttagattattcggtttttagtattacgaattattagacggaagtgattgtttggtcgttttcgagtgtgatattgttgtacgtggtagtgatcgtttgcgtttgttttcgggttgaaaggtttcggtggtagtaa

SEQ ID NO: 13224 - DNA, 665 bp, Artificial Sequence
  chemically treated genomic DNA (Homo sapiens) CpG-island No: 13224
ttactaccaccgaaacctttcaacccgaaaacaaacgcaaacgatcactaccacgtacaacaatatcacactcgaaaacgaccaaacaatcacttccgtctaataattcgtaatactaaaaaccgaataatctaacgaacataaaactttaaaccgaataccgataaaaatcttaaccgctatatccgcacctcaaacatccgtacaaacacgaccacccgctaatcgcgaaacatttacccgcattcacctccccgaacacactttatatccccatacgccaaccatcgccgctaacgtttttattaacgaaaacatacccataacaacacaaacgcaacacgacctcgcacccgctaaccaacccgaatttaaactaaccgtcacgccgatccccgataaacaacgtatcgatttctaaccacaatactttaacgctatcccgcaataactactcctaaaaccgcatatcttcgcctaaataaaccgcttctataaaaactacaacgataatatctaatcgttctacaccctcaacaataacgacgcatttatatcccccgaacctaacaacgataaaacataacgtctatttaactacctaaacgataacgatacccaaataaatacaaaaacaacaaatattactatctacctaattacgt

SEQ ID NO: 13225 - DNA, 510 bp, Artificial Sequence
  chemically treated genomic DNA (Homo sapiens) CpG-island No: 13225
  misc_feature (125)..(125): n is either a, c, g or t
  misc_feature (138)..(138): n is either a, c, g or t
  misc_feature (140)..(141): n is either a, c, g or t
  misc_feature (149)..(151): n is either a, c, g or t
  misc_feature (172)..(173): n is either a, c, g or t
  misc_feature (190)..(191): n is either a, c, g or t
  misc_feature (203)..(203): n is either a, c, g or t
ttcgcgttgggatcggattttcgaaaaattcggaagcggcgggcgagggatttcgcgggtttgttcggtttggggtcgttcggatagatttttcgttcgttcgtggtagtttcggcgtttttcgngtttggtttattntnntttttagnnntattttgttttcgggtagtanngcgttttttagtcgtgnngggtcgacgatnattcgcgagattttcggtttcgagtgcgaatggtggtgatggtggtgaggggtcgtcgggggtatttgcgtttgggattgaggtggttgcgatttttcggggggttgcggcggtcgtttttttttcgagttcgtttcgtaatttttgtttagcgtttgttcgtatattttggtgttggcggttggttggtaggtgatagttcgtaaaagttttatggtcgttttggcgtttcgtattgttcgttgttattttttaagcgcggttatacgttcgagtcgggcgtggttttcgcgattttgtttttggt

SEQ ID NO: 13226 - DNA, 510 bp, Artificial Sequence
  chemically treated genomic DNA (Homo sapiens) CpG-island No: 13226
  misc_feature (308)..(308): n is either a, c, g or t
  misc_feature (320)..(321): n is either a, c, g or t
  misc_feature (338)..(339): n is either a, c, g or t
  misc_feature (360)..(362): n is either a, c, g or t
  misc_feature (370)..(371): n is either a, c, g or t
  misc_feature (373)..(373): n is either a, c, g or t
  misc_feature (386)..(386): n is either a, c, g or t
accaaaaacaaaatcgcgaaaaccacgcccgactcgaacgtataaccgcgcttaaaaaataacaacgaacaatacgaaacgccaaaacgaccataaaacttttacgaactatcacctaccaaccaaccgccaacaccaaaatatacgaacaaacgctaaacaaaaattacgaaacgaactcgaaaaaaaaacgaccgccgcaaccccccgaaaaatcgcaaccacctcaatcccaaacgcaaatacccccgacgacccctcaccaccatcaccaccattcgcactcgaaaccgaaaatctcgcgaatnatcgtcgacccnncacgactaaaaaacgcnntactacccgaaaacaaaatannnctaaaaannanaataaaccaaacncgaaaaacgccgaaactaccacgaacgaacgaaaaatctatccgaacgaccccaaaccgaacaaacccgcgaaatccctcgcccgccgcttccgaatttttcgaaaatccgatcccaacgcgaa

SEQ ID NO: 13227 - DNA, 510 bp, Artificial Sequence
  chemically treated genomic DNA (Homo sapiens) CpG-island No: 13227
  misc_feature (308)..(308): n is either a, c, g or t
  misc_feature (320)..(321): n is either a, c, g or t
  misc_feature (338)..(339): n is either a, c, g or t
  misc_feature (360)..(362): n is either a, c, g or t
  misc_feature (370)..(371): n is either a, c, g or t
  misc_feature (373)..(373): n is either a, c, g or t
  misc_feature (386)..(386): n is either a, c, g or t
attagagataaggtcgcgaggattacgttcggttcgaacgtgtgatcgcgtttagggggtgatagcggatagtgcggggcgttaaggcgattatggagtttttgcggattattatttattagttagtcgttagtattaaaatgtgcgagtaggcgttgggtaagggttgcggagcggattcgaagaagaagcggtcgtcgtagtttttcgaggaatcgtagttattttagttttaggcgtaagtgttttcggcggttttttattattattattattattcgtattcggggtcggagatttcgcggatnatcgtcgatttnntacgattgggaagcgtnntattgttcggaggtaaagtgnnnttgggaannanggtgaattaagtncggagggcgtcgaggttgttacgggcgggcgggaggtttgttcgggcgattttaagtcgggtaagttcgcggggtttttcgttcgtcgttttcgggtttttcgggggttcgattttagcgcgag

SEQ ID NO: 13228 - DNA, 510 bp, Artificial Sequence
  chemically treated genomic DNA (Homo sapiens) CpG-island No: 13228
  misc_feature (125)..(125): n is either a, c, g or t
  misc_feature (138)..(138): n is either a, c, g or t
  misc_feature (140)..(141): n is either a, c, g or t
  misc_feature (149)..(151): n is either a, c, g or t
  misc_feature (172)..(173): n is either a, c, g or t
  misc_feature (190)..(191): n is either a, c, g or t
  misc_feature (203)..(203): n is either a, c, g or t
ctcgcgctaaaatcgaacccccgaaaaacccgaaaacgacgaacgaaaaaccccgcgaacttacccgacttaaaatcgcccgaacaaacctcccgcccgcccgtaacaacctcgacgccctccgnacttaattcaccntnnttcccaannncactttacctccgaacaatannacgcttcccaatcgtannaaatcgacgatnatccgcgaaatctccgaccccgaatacgaataataataataataataaaaaaccgccgaaaacacttacgcctaaaactaaaataactacgattcctcgaaaaactacgacgaccgcttcttcttcgaatccgctccgcaacccttacccaacgcctactcgcacattttaatactaacgactaactaataaataataatccgcaaaaactccataatcgccttaacgccccgcactatccgctatcaccccctaaacgcgatcacacgttcgaaccgaacgtaatcctcgcgaccttatctctaat

SEQ ID NO: 13229 - DNA, 580 bp, Artificial Sequence
  chemically treated genomic DNA (Homo sapiens) CpG-island No: 13229
ttttgcgtatcgttaatacgtcgaagcgagagattggttcggttacgttgaaaaagttgggtgagtgggcgatgacgcgtaataaaagtatgtttatcgttagttttgatatgggtttgagttagacgtttagcggacgtggttatgaagtattgattcgttttatttattggttggtagaaatttagcgtttggcggagcgggagtcgattgtcgcggtgcgtgatttgatttatggtatggattatgaattttggttgtacgaaatatcgtttagttcgaaagtcgtcgaaatgcgtatgaagaacgttaattaattgtttagttggatgacggagatgttggaaggtagtgaattgggatgagtcgatgacgtttatttaggggtgttgacgcgttttatttgtgcgcgatatgatggagcgtgttgatcggagtatattgttagaaggttttatcggtggcgtagtcgtgtgttttcggatagcgttttgttagtatatcgtttagacgttgttcgttaattagtgttcgtatttgggaaagtagttgttcgggataattttgaagataagtaaga

SEQ ID NO: 13230 - DNA, 580 bp, Artificial Sequence
  chemically treated genomic DNA (Homo sapiens) CpG-island No: 13230
tcttacttatcttcaaaattatcccgaacaactactttcccaaatacgaacactaattaacgaacaacgtctaaacgatatactaacaaaacgctatccgaaaacacacgactacgccaccgataaaaccttctaacaatatactccgatcaacacgctccatcatatcgcgcacaaataaaacgcgtcaacacccctaaataaacgtcatcgactcatcccaattcactaccttccaacatctccgtcatccaactaaacaattaattaacgttcttcatacgcatttcgacgactttcgaactaaacgatatttcgtacaaccaaaattcataatccataccataaatcaaatcacgcaccgcgacaatcgactcccgctccgccaaacgctaaatttctaccaaccaataaataaaacgaatcaatacttcataaccacgtccgctaaacgtctaactcaaacccatatcaaaactaacgataaacatacttttattacgcgtcatcgcccactcacccaactttttcaacgtaaccgaaccaatctctcgcttcgacgtattaacgatacgcaaaa

SEQ ID NO: 13231 - DNA, 580 bp, Artificial Sequence
  chemically treated genomic DNA (Homo sapiens) CpG-island No: 13231
ttttatttatttttagggttatttcgagtagttatttttttaggtgcgaatattgattaacgaatagcgtttgggcgatgtgttggtaaaacgttattcgggaatatacgattacgttatcgataaagttttttggtaatatatttcggttaatacgttttattatgtcgcgtataagtaaagcgcgttaatatttttgggtgagcgttatcggtttattttagtttattgttttttagtattttcgttatttagttaaatagttggttgacgttttttatgcgtatttcggcggttttcgggttgggcgatgtttcgtatagttaggatttataatttatgttatggattagattacgtatcgcggtaatcggttttcgtttcgttagacgttggatttttgttaattagtgagtgaagcgggttaatgttttataattacgttcgttaagcgtttgatttaggtttatattaaagttggcggtaaatatgtttttattgcgcgttatcgtttatttatttagtttttttagcgtagtcgggttaatttttcgtttcggcgtgttaacgatacgtagaa

SEQ ID NO: 13232 - DNA, 580 bp, Artificial Sequence
  chemically treated genomic DNA (Homo sapiens) CpG-island No: 13232
ttctacgtatcgttaacacgccgaaacgaaaaattaacccgactacgctaaaaaaactaaataaataaacgataacgcgcaataaaaacatatttaccgccaactttaatataaacctaaatcaaacgcttaacgaacgtaattataaaacattaacccgcttcactcactaattaacaaaaatccaacgtctaacgaaacgaaaaccgattaccgcgatacgtaatctaatccataacataaattataaatcctaactatacgaaacatcgcccaacccgaaaaccgccgaaatacgcataaaaaacgtcaaccaactatttaactaaataacgaaaatactaaaaaacaataaactaaaataaaccgataacgctcacccaaaaatattaacgcgctttacttatacgcgacataataaaacgtattaaccgaaatatattaccaaaaaactttatcgataacgtaatcgtatattcccgaataacgttttaccaacacatcgcccaaacgctattcgttaatcaatattcgcacctaaaaaaataactactcgaaataaccctaaaaataaataaaa

SEQ ID NO: 13233 - DNA, 612 bp, Artificial Sequence
  chemically treated genomic DNA (Homo sapiens) CpG-island No: 13233
  misc_feature (386)..(386): n is either a, c, g or t
  misc_feature (413)..(413): n is either a, c, g or t
  misc_feature (493)..(493): n is either a, c, g or t
  misc_feature (593)..(593): n is either a, c, g or t
ttataggcgtgggaagcggcggatgaatatttgttgtaatagttggacgatatagaaattcgcggttcggtgttgattttgaatgatgtttttggtgcgttaagttgcgtattggcggaatataagtcgtatagtattggcgatttatatattagtgaattggcgacgcgcgagaatttacgttttaacgggattgatgagtcgagcgtgaagtttttcgatagtatcgtcgattattcgtaatagtcgggtgtggtgttgattaaagtgtcgaaaatattggtattgttggaatataatttgcgtgcgttgcgtaaagtggttacgtcggatatacgtattattgtcggtgttaaggttcgtgatatttatacgtttacgttggnattgttcgaaaaagtgttcggtataantttatatacgttggtatggaaatagcgcgtttgattaattgtatttttaatgatcgtagttggtcgatgcgcgtagattngtattggagttggaaggattgattgattattataatatgcgatgttttttttgattggttgaatcgcgcgttttttattaaattgtagaattcgaggganatttattcggtcgtatgcg

SEQ ID NO: 13234 - DNA, 612 bp, Artificial Sequence
  chemically treated genomic DNA (Homo sapiens) CpG-island No: 13234
  misc_feature (20)..(20): n is either a, c, g or t
  misc_feature (120)..(120): n is either a, c, g or t
  misc_feature (200)..(200): n is either a, c, g or t
  misc_feature (227)..(227): n is either a, c, g or t
cgcatacgaccgaataaatntccctcgaattctacaatttaataaaaaacgcgcgattcaaccaatcaaaaaaaacatcgcatattataataatcaatcaatccttccaactccaatacnaatctacgcgcatcgaccaactacgatcattaaaaatacaattaatcaaacgcgctatttccataccaacgtatataaanttataccgaacactttttcgaacaatnccaacgtaaacgtataaatatcacgaaccttaacaccgacaataatacgtatatccgacgtaaccactttacgcaacgcacgcaaattatattccaacaataccaatattttcgacactttaatcaacaccacacccgactattacgaataatcgacgatactatcgaaaaacttcacgctcgactcatcaatcccgttaaaacgtaaattctcgcgcgtcgccaattcactaatatataaatcgccaatactatacgacttatattccgccaatacgcaacttaacgcaccaaaaacatcattcaaaatcaacaccgaaccgcgaatttctatatcgtccaactattacaacaaatattcatccgccgcttcccacgcctataa

SEQ ID NO: 13235 - DNA, 612 bp, Artificial Sequence
  chemically treated genomic DNA (Homo sapiens) CpG-island No: 13235
  misc_feature (20)..(20): n is either a, c, g or t
  misc_feature (120)..(120): n is either a, c, g or t
  misc_feature (200)..(200): n is either a, c, g or t
  misc_feature (227)..(227): n is either a, c, g or t
cgtatacgatcggatgaatntttttcggattttgtagtttgataagaggcgcgcgatttagttagttagagaagatatcgtatgttgtggtagttagttagtttttttagttttagtatnggtttgcgcgtatcggttagttgcggttattgaaagtgtaattaattaggcgcgttgtttttatgttagcgtgtgtaggnttgtgtcgagtattttttcgaatagtnttagcgtggacgtgtgaatgttacgggttttggtatcggtaataatacgtgtattcgacgtgattattttgcgtagcgtacgtaagttgtgttttagtaatgttagtgttttcggtattttgattagtattatattcggttgttgcgggtagtcggcggtgttgtcgagaaattttacgttcgatttattaatttcgttgaggcgtaaattttcgcgcgtcgttagtttattgatgtatgagtcgttaatgttgtacggtttatgtttcgttagtgcgtagtttaacgtattaaaggtattatttaggattaatatcgggtcgcggatttttgtgtcgtttaattgttgtagtaaatatttattcgtcgttttttacgtttgtag

SEQ ID NO: 13236 - DNA, 612 bp, Artificial Sequence
  chemically treated genomic DNA (Homo sapiens) CpG-island No: 13236
  misc_feature (386)..(386): n is either a, c, g or t
  misc_feature (413)..(413): n is either a, c, g or t
  misc_feature (493)..(493): n is either a, c, g or t
  misc_feature (593)..(593): n is either a, c, g or t
ctacaaacgtaaaaaacgacgaataaatatttactacaacaattaaacgacacaaaaatccgcgacccgatattaatcctaaataatacctttaatacgttaaactacgcactaacgaaacataaaccgtacaacattaacgactcatacatcaataaactaacgacgcgcgaaaatttacgcctcaacgaaattaataaatcgaacgtaaaatttctcgacaacaccgccgactacccgcaacaaccgaatataatactaatcaaaataccgaaaacactaacattactaaaacacaacttacgtacgctacgcaaaataatcacgtcgaatacacgtattattaccgataccaaaacccgtaacattcacacgtccacgctaanactattcgaaaaaatactcgacacaancctacacacgctaacataaaaacaacgcgcctaattaattacactttcaataaccgcaactaaccgatacgcgcaaaccnatactaaaactaaaaaaactaactaactaccacaacatacgatatcttctctaactaactaaatcgcgcgcctcttatcaaactacaaaatccgaaaaanattcatccgatcgtatacg

SEQ ID NO: 13237 - DNA, 666 bp, Artificial Sequence
  chemically treated genomic DNA (Homo sapiens) CpG-island No: 13237
  misc_feature (562)..(563): n is either a, c, g or t
acgttggttttagaaaattcggatgaagtcgggcgttatagtatggacgttgagtacggttagtatagcgttattttgttggtggaaggattttcgtcgttatatgtcgggattattatcgtgtatgaagatttttaattcggtacgttgaatgattttttcggtgttatgacggaggatgatgttcgttcggaggtattgcgtcgttttgaattgatggtggaagaggtggcgcgtaacgcgttcgcggtggtatagaatacggtagtcgcgaagaagttagttagtgatgttagtatattagttcgtgaggcggtaatttatgcggttgatgttgcggatttagtacgcgtacgtagtacgttagtcggataggtcgcgtcgtcggtttagttagcgttttttagcgtaggaacggtattaataaaggttattgaagtattaaaaagtgttgtcgttgtagagtttttaaaaagcgcggcggttattagtgtcggtgcggcgaaaacgttagaaacgaatgttttagcgttattataattagtagttatatttgtatttnnacgcgatacgagagtattagaagttgcgatttcggttcgggatgcggcggttttaaaagaagcggtaaaattatttagaattttaaatatattaattggtata

SEQ ID NO: 13238 - DNA, 666 bp, Artificial Sequence
  chemically treated genomic DNA (Homo sapiens) CpG-island No: 13238
  misc_feature (104)..(105): n is either a, c, g or t
tataccaattaatatatttaaaattctaaataattttaccgcttcttttaaaaccgccgcatcccgaaccgaaatcgcaacttctaatactctcgtatcgcgtnnaaatacaaatataactactaattataataacgctaaaacattcgtttctaacgttttcgccgcaccgacactaataaccgccgcgctttttaaaaactctacaacgacaacactttttaatacttcaataacctttattaataccgttcctacgctaaaaaacgctaactaaaccgacgacgcgacctatccgactaacgtactacgtacgcgtactaaatccgcaacatcaaccgcataaattaccgcctcacgaactaatatactaacatcactaactaacttcttcgcgactaccgtattctataccaccgcgaacgcgttacgcgccacctcttccaccatcaattcaaaacgacgcaatacctccgaacgaacatcatcctccgtcataacaccgaaaaaatcattcaacgtaccgaattaaaaatcttcatacacgataataatcccgacatataacgacgaaaatccttccaccaacaaaataacgctatactaaccgtactcaacgtccatactataacgcccgacttcatccgaattttctaaaaccaacgt

SEQ ID NO: 13239 - DNA, 666 bp, Artificial Sequence
  chemically treated genomic DNA (Homo sapiens) CpG-island No: 13239
  misc_feature (104)..(105): n is either a, c, g or t
tatgttagttgatgtatttgaaattttgaatgattttgtcgttttttttgaggtcgtcgtatttcgggtcgaggtcgtagtttttgatgttttcgtgtcgcgtnnggatgtagatgtagttgttgattgtagtgacgttgaagtattcgtttttgacgttttcgtcgtatcggtattggtggtcgtcgcgttttttgaggattttgtagcggtagtattttttgatgttttagtggtttttgttgatgtcgtttttgcgttggaagacgttgattgagtcgacgacgcggtttgttcggttgacgtgttgcgtgcgcgtgttgagttcgtagtattagtcgtatgggttgtcgttttacgggttgatgtgttggtattattggttgattttttcgcggttgtcgtgttttgtgttatcgcggacgcgttacgcgttattttttttattattagtttaaaacggcgtagtgttttcggacgggtattatttttcgttatggtatcgagaaaattatttagcgtatcgggttgagaatttttatatacggtaatggtttcggtatgtgacggcgggaatttttttattaatagaataacgttgtattgatcgtatttaacgtttatgttgtaacgttcggttttattcggattttttgaggttagcgt

SEQ ID NO: 13240 - DNA, 666 bp, Artificial Sequence
  chemically treated genomic DNA (Homo sapiens) CpG-island No: 13240
  misc_feature (562)..(563): n is either a, c, g or t
acgctaacctcaaaaaatccgaataaaaccgaacgttacaacataaacgttaaatacgatcaatacaacgttattctattaataaaaaaattcccgccgtcacataccgaaaccattaccgtatataaaaattctcaacccgatacgctaaataattttctcgataccataacgaaaaataatacccgtccgaaaacactacgccgttttaaactaataataaaaaaaataacgcgtaacgcgtccgcgataacacaaaacacgacaaccgcgaaaaaatcaaccaataataccaacacatcaacccgtaaaacgacaacccatacgactaatactacgaactcaacacgcgcacgcaacacgtcaaccgaacaaaccgcgtcgtcgactcaatcaacgtcttccaacgcaaaaacgacatcaacaaaaaccactaaaacatcaaaaaatactaccgctacaaaatcctcaaaaaacgcgacgaccaccaataccgatacgacgaaaacgtcaaaaacgaatacttcaacgtcactacaatcaacaactacatctacatccnnacgcgacacgaaaacatcaaaaactacgacctcgacccgaaatacgacgacctcaaaaaaaacgacaaaatcattcaaaatttcaaatacatcaactaacata

SEQ ID NO: 13241 - DNA, 959 bp, Artificial Sequence
  chemically treated genomic DNA (Homo sapiens) CpG-island No: 13241
  misc_feature (20)..(20): n is either a, c, g or t
  misc_feature (55)..(55): n is either a, c, g or t
tttcgcgtgagattttcgangtatgtgttatttattcgcgttgtggtttcgtgtnggtttttttttttttaaaggggtgcgtggcgggggcggttattatttacgggggggcgtgtgaatggcgttgtggttttatttttttcgttaagcgtttataatttgtttttttttataacgttttgttttttttaacgataaatcgtcgttagcggtttttgtcgtttttcgtgtttttatttttcgagtgcgtatcgggcgtttcgttcgggcgggggtgtgtttttttttttagttaggggtttttttacgtcgcggcgatagagattacgtttaatgcgcgttaaattaggttttggtttacgcggttcgtttaggtttgttaggataatttttagtatacgttttgcgatatcgcggtgacgttgagttattgttagtatcggatattgtaagaagtcgagtagttcgttatcgttaaaggtggtaattgttaggttagaaggtagtttgtcgtcgcgacgtagcgtgatatttattattttttgtaataacgtaaacgacgttgtgaatagcgtttgcggtatcggatgcgtttttagttatttttcgaataattgggtagtcgtttttcgtttatagttgttggtatataggaaatgtatttcgcgcggattatttttttaggtagtacggaaattttgtttacgtaggaagttgatagaaagtttcggtagcgtattaagataaagtatcgtttcggcgggaaatttacgtaattttttcgttagtatttcggtattattttgatcggtattaattacgttggtgaagtgtttacgatcgagggcgcggtttagcgcgataatcgggaacgggtcgttagtttagcgttgataaaaaggatgtttaggaggtaacgacgtcgaaataataatggtattaatttgacgttgtaaaag

SEQ ID NO: 13242 - DNA, 959 bp, Artificial Sequence
  chemically treated genomic DNA (Homo sapiens) CpG-island No: 13242
  misc_feature (905)..(905): n is either a, c, g or t
  misc_feature (940)..(940): n is either a, c, g or t
cttttacaacgtcaaattaataccattattatttcgacgtcgttacctcctaaacatcctttttatcaacgctaaactaacgacccgttcccgattatcgcgctaaaccgcgccctcgatcgtaaacacttcaccaacgtaattaataccgatcaaaataataccgaaatactaacgaaaaaattacgtaaatttcccgccgaaacgatactttatcttaatacgctaccgaaactttctatcaacttcctacgtaaacaaaatttccgtactacctaaaaaaataatccgcgcgaaatacatttcctatataccaacaactataaacgaaaaacgactacccaattattcgaaaaataactaaaaacgcatccgataccgcaaacgctattcacaacgtcgtttacgttattacaaaaaataataaatatcacgctacgtcgcgacgacaaactaccttctaacctaacaattaccacctttaacgataacgaactactcgacttcttacaatatccgatactaacaataactcaacgtcaccgcgatatcgcaaaacgtatactaaaaattatcctaacaaacctaaacgaaccgcgtaaaccaaaacctaatttaacgcgcattaaacgtaatctctatcgccgcgacgtaaaaaaacccctaactaaaaaaaaaaacacacccccgcccgaacgaaacgcccgatacgcactcgaaaaataaaaacacgaaaaacgacaaaaaccgctaacgacgatttatcgttaaaaaaaacaaaacgttataaaaaaaaacaaattataaacgcttaacgaaaaaaataaaaccacaacgccattcacacgcccccccgtaaataataaccgcccccgccacgcacccctttaaaaaaaaaaaaaccnacacgaaaccacaacgcgaataaataacacatacntcgaaaatctcacgcgaaa

SEQ ID NO: 13243 - DNA, 959 bp, Artificial Sequence
  chemically treated genomic DNA (Homo sapiens) CpG-island No: 13243
  misc_feature (905)..(905): n is either a, c, g or t
  misc_feature (940)..(940): n is either a, c, g or t
tttttatagcgttaggttgatgttattattgtttcgacgtcgttgttttttgagtattttttttattaacgttgggttaacgattcgttttcgattgtcgcgttggatcgcgttttcgatcgtgaatattttattagcgtggttggtgtcgattaggatgatgtcgaaatgttggcggaagagttacgtaagtttttcgtcgagacggtgttttattttggtgcgttatcggagttttttgttagttttttgcgtgaataaggttttcgtattgtttggaaagatgattcgcgcgaagtgtattttttgtatgttaatagttatgagcgggaggcggttgtttagttattcgaaaaatggttggaaacgtattcgatgtcgtaggcgttgtttataacgtcgtttgcgttgttgtaaggagtgatggatgttacgttgcgtcgcgacggtaaattgttttttgatttggtaattgttatttttggcgataacgaattgttcgattttttatagtgttcggtgttggtagtggtttaacgttatcgcgatgtcgtagagcgtgtgttggagattgttttggtaagtttggacgaatcgcgtaagttaaaatttggtttaacgcgtattaaacgtaatttttatcgtcgcggcgtggggaggtttttaattggaggggggggtatattttcgttcgggcgaaacgttcgatgcgtattcggggggtaaaaatacggagggcggtagaaatcgttggcgacggtttgtcgttggggaaagtagaacgttatagaggaggataggttatgggcgtttggcgggaagagtggggttatagcgttatttatacgttttttcgtggatgatagtcgttttcgttacgtatttttttggggagaggagggttnatacgggattatagcgcgggtgagtaatatatatntcgagggttttacgcgaga

SEQ ID NO: 13244 - DNA, 959 bp, Artificial Sequence
  chemically treated genomic DNA (Homo sapiens) CpG-island No: 13244
  misc_feature (20)..(20): n is either a, c, g or t
  misc_feature (55)..(55): n is either a, c, g or t
tctcgcgtaaaaccctcganatatatattactcacccgcgctataatcccgtatnaaccctcctctccccaaaaaaatacgtaacgaaaacgactatcatccacgaaaaaacgtataaataacgctataaccccactcttcccgccaaacgcccataacctatcctcctctataacgttctactttccccaacgacaaaccgtcgccaacgatttctaccgccctccgtatttttaccccccgaatacgcatcgaacgtttcgcccgaacgaaaatatacccccccctccaattaaaaacctccccacgccgcgacgataaaaattacgtttaatacgcgttaaaccaaattttaacttacgcgattcgtccaaacttaccaaaacaatctccaacacacgctctacgacatcgcgataacgttaaaccactaccaacaccgaacactataaaaaatcgaacaattcgttatcgccaaaaataacaattaccaaatcaaaaaacaatttaccgtcgcgacgcaacgtaacatccatcactccttacaacaacgcaaacgacgttataaacaacgcctacgacatcgaatacgtttccaaccatttttcgaataactaaacaaccgcctcccgctcataactattaacatacaaaaaatacacttcgcgcgaatcatctttccaaacaatacgaaaaccttattcacgcaaaaaactaacaaaaaactccgataacgcaccaaaataaaacaccgtctcgacgaaaaacttacgtaactcttccgccaacatttcgacatcatcctaatcgacaccaaccacgctaataaaatattcacgatcgaaaacgcgatccaacgcgacaatcgaaaacgaatcgttaacccaacgttaataaaaaaaatactcaaaaaacaacgacgtcgaaacaataataacatcaacctaacgctataaaaa

SEQ ID NO: 13245 - DNA, 520 bp, Artificial Sequence
  chemically treated genomic DNA (Homo sapiens) CpG-island No: 13245
cgcgttgggggtttttttacgtagttttcggtgtataaattattttcgtattttttttttgggggggagagttttttttagagtgtcgtgcgcggatatcgtacgataagagttttttagcgagagatatcgtacgagatttattattttcgcggttgatattttagcgcgttgggaataattttttttatttttttttatattagaagaaatatatattcgtacgtaagaaatatatatatttcgcggcgcgtttgttgtgtgtgcgcgggcgcgcgcgtcgtgtagatgttttttttacgtgtatatgtcggcggagagcgttgtagagttacgagcgagagaaaatgagcgcgtggaaatattcggggagagcgcgggagagatttgcgtataaggagacgtcggaggattttgcgcgcgttttcgcgtaaaattttacgtcgggcgttattagagagggggagatttcgcgtgtttttaaaaaaaaaaaataaaaaaaaaaaatgtaattgttttg

SEQ ID NO: 13246 - DNA, 520 bp, Artificial Sequence
  chemically treated genomic DNA (Homo sapiens) CpG-island No: 13246
caaaacaattacattttttttttttattttttttttttaaaaacacgcgaaatctccccctctctaataacgcccgacgtaaaattttacgcgaaaacgcgcgcaaaatcctccgacgtctccttatacgcaaatctctcccgcgctctccccgaatatttccacgcgctcattttctctcgctcgtaactctacaacgctctccgccgacatatacacgtaaaaaaaacatctacacgacgcgcgcgcccgcgcacacacaacaaacgcgccgcgaaatatatatatttcttacgtacgaatatatatttcttctaatataaaaaaaaataaaaaaaattattcccaacgcgctaaaatatcaaccgcgaaaataataaatctcgtacgatatctctcgctaaaaaactcttatcgtacgatatccgcgcacgacactctaaaaaaaactctcccccccaaaaaaaaaatacgaaaataatttatacaccgaaaactacgtaaaaaaacccccaacgcg

SEQ ID NO: 13247 - DNA, 520 bp, Artificial Sequence
  chemically treated genomic DNA (Homo sapiens) CpG-island No: 13247
taaaataattatattttttttttttgttttttttttttgggagtacgcggggtttttttttttttggtggcgttcggcgtggggttttgcgcgggggcgcgcgtaagatttttcggcgtttttttgtgcgtaaatttttttcgcgtttttttcgggtgtttttacgcgtttattttttttcgttcgtggttttatagcgtttttcgtcgatatgtatacgtgagggggatatttatacggcgcgcgcgttcgcgtatatataatagacgcgtcgcggggtgtatatattttttgcgtgcgggtatgtattttttttaatgtaaggagagatggggggggttgtttttagcgcgttggggtgttagtcgcgaggatgatgggtttcgtgcgatatttttcgttgagaaatttttgtcgtgcgatattcgcgtacgatattttaaagagggtttttttttttagaggaggggtgcgggggtggtttgtatatcgaggattgcgtgggagagtttttaacgcg

SEQ ID NO: 13248 - DNA, 520 bp, Artificial Sequence
  chemically treated genomic DNA (Homo sapiens) CpG-island No: 13248
cgcgttaaaaactctcccacgcaatcctcgatatacaaaccacccccgcacccctcctctaaaaaaaaaaaccctctttaaaatatcgtacgcgaatatcgcacgacaaaaatttctcaacgaaaaatatcgcacgaaacccatcatcctcgcgactaacaccccaacgcgctaaaaacaaccccccccatctctccttacattaaaaaaaatacatacccgcacgcaaaaaatatatacaccccgcgacgcgtctattatatatacgcgaacgcgcgcgccgtataaatatccccctcacgtatacatatcgacgaaaaacgctataaaaccacgaacgaaaaaaaataaacgcgtaaaaacacccgaaaaaaacgcgaaaaaaatttacgcacaaaaaaacgccgaaaaatcttacgcgcgcccccgcgcaaaaccccacgccgaacgccaccaaaaaaaaaaaaaccccgcgtactcccaaaaaaaaaaaacaaaaaaaaaaaatataattatttta

SEQ ID NO: 13249 - DNA, 959 bp, Artificial Sequence
  chemically treated genomic DNA (Homo sapiens) CpG-island No: 13249
gattacggttgcggatagcgttttttttttcgggtgtatttatcgttcggattgcgaatagttgtatcggtttagtaagttgagtttgtagagatgtaggttatcgtagggtttttggtagtatttgcgacggtagattcgggttcgagtggtggttattatcgatcgggtgatttcggtttcgtcgtcggtttttaatattataaagcggtcgggttcggttatttgtagtattttatagagttgcggtttagatagcgcgattttttggagtagcgcgtttagggttatgcggttttcgtgggcgtataggattttggtgatgaagtagtatattttcgggttcgttatggcgcgttggttgtgttggttttgtcgcggcgcgggattcggtttcgcggaaatcggaaatcgaaatttataagtgtttaggggcgggcgcgggcggtgttattgttgggcgcgttcggagttagcgagggcgcgtttttcgtcgtcgttagtttagtttagcgatttattttcggtttttaggttaagaggttagattttatcgatcgggttttagtggtaggtttatagtcggtcgtaagggtaattgggtggaaagaaagagaacgcgcgggtaaatttgttggtgatcgtttggggtggttttttttcggttttaggttcggtcgagggtgaggttttttagtcgggtttcgcgagtattttttagaaagaagagaaattagaagcgattttggggttttggtcggtgttttataatttagtcgattgaggcgtgtgacgtaagttttgagagttttgttgaggagtgcgtattttacgttattttcggaaagagtagattttagcgagcgttttttgcgagtcgtgcgttttgtttttgttggtagtgaatttttttagtaattttatatggtagatattattatttttattttgaatttgag

SEQ ID NO: 13250 - DNA, 959 bp, Artificial Sequence
  chemically treated genomic DNA (Homo sapiens) CpG-island No: 13250
ctcaaattcaaaataaaaataataatatctaccatataaaattactaaaaaaattcactaccaacaaaaacaaaacgcacgactcgcaaaaaacgctcgctaaaatctactctttccgaaaataacgtaaaatacgcactcctcaacaaaactctcaaaacttacgtcacacgcctcaatcgactaaattataaaacaccgaccaaaaccccaaaatcgcttctaatttctcttctttctaaaaaatactcgcgaaacccgactaaaaaacctcaccctcgaccgaacctaaaaccgaaaaaaaaccaccccaaacgatcaccaacaaatttacccgcgcgttctctttctttccacccaattacccttacgaccgactataaacctaccactaaaacccgatcgataaaatctaacctcttaacctaaaaaccgaaaataaatcgctaaactaaactaacgacgacgaaaaacgcgccctcgctaactccgaacgcgcccaacaataacaccgcccgcgcccgcccctaaacacttataaatttcgatttccgatttccgcgaaaccgaatcccgcgccgcgacaaaaccaacacaaccaacgcgccataacgaacccgaaaatatactacttcatcaccaaaatcctatacgcccacgaaaaccgcataaccctaaacgcgctactccaaaaaatcgcgctatctaaaccgcaactctataaaatactacaaataaccgaacccgaccgctttataatattaaaaaccgacgacgaaaccgaaatcacccgatcgataataaccaccactcgaacccgaatctaccgtcgcaaatactaccaaaaaccctacgataacctacatctctacaaactcaacttactaaaccgatacaactattcgcaatccgaacgataaatacacccgaaaaaaaaaacgctatccgcaaccgtaatc

SEQ ID NO: 13251 - DNA, 959 bp, Artificial Sequence
  chemically treated genomic DNA (Homo sapiens) CpG-island No: 13251
tttaagtttagggtgaggataataatatttattatgtggagttgttgggaagatttattattaatagaggtagagcgtacggttcgtaggaagcgttcgttagggtttgtttttttcgggaatggcgtggggtgcgtattttttaatagggtttttaggatttgcgttatacgttttagtcggttggattataaaatatcggttagagttttaagatcgtttttagttttttttttttttaaagaatgttcgcggagttcggttggagaattttattttcgatcgagtttagaatcgagagggggttattttaggcggttattagtagatttgttcgcgcgttttttttttttttatttagttgtttttgcggtcggttgtaaatttgttattaggattcggtcggtgagatttagttttttgatttgagagtcgagagtggatcgttgggttgggttaacggcgacggagagcgcgttttcgttgatttcgggcgcgtttagtagtagtatcgttcgcgttcgtttttggatatttgtaagtttcgattttcgattttcgcggaatcgagtttcgcgtcgcggtagagttagtatagttagcgcgttatggcggattcggaggtgtgttgttttattattaaaattttgtgcgtttacgggggtcgtatggttttggacgcgttgttttaggagatcgcgttgtttgagtcgtagttttgtgaggtgttgtaggtggtcgggttcgatcgttttgtggtgttggagatcggcggcgaggtcgggattattcgatcggtggtggttattattcgagttcgggtttgtcgtcgtaagtattgttagagattttgcgataatttgtatttttgtaaatttaatttgttgggtcggtgtaattattcgtagttcgagcggtgagtgtattcggagggaggggcgttgttcgtagtcgtggtt

SEQ ID NO: 13252 - DNA, 959 bp, Artificial Sequence
  chemically treated genomic DNA (Homo sapiens) CpG-island No: 13252
aaccacgactacgaacaacgcccctccctccgaatacactcaccgctcgaactacgaataattacaccgacccaacaaattaaatttacaaaaatacaaattatcgcaaaatctctaacaatacttacgacgacaaacccgaactcgaataataaccaccaccgatcgaataatcccgacctcgccgccgatctccaacaccacaaaacgatcgaacccgaccacctacaacacctcacaaaactacgactcaaacaacgcgatctcctaaaacaacgcgtccaaaaccatacgacccccgtaaacgcacaaaattttaataataaaacaacacacctccgaatccgccataacgcgctaactatactaactctaccgcgacgcgaaactcgattccgcgaaaatcgaaaatcgaaacttacaaatatccaaaaacgaacgcgaacgatactactactaaacgcgcccgaaatcaacgaaaacgcgctctccgtcgccgttaacccaacccaacgatccactctcgactctcaaatcaaaaaactaaatctcaccgaccgaatcctaataacaaatttacaaccgaccgcaaaaacaactaaataaaaaaaaaaaaaacgcgcgaacaaatctactaataaccgcctaaaataaccccctctcgattctaaactcgatcgaaaataaaattctccaaccgaactccgcgaacattctttaaaaaaaaaaaaaactaaaaacgatcttaaaactctaaccgatattttataatccaaccgactaaaacgtataacgcaaatcctaaaaaccctattaaaaaatacgcaccccacgccattcccgaaaaaaacaaaccctaacgaacgcttcctacgaaccgtacgctctacctctattaataataaatcttcccaacaactccacataataaatattattatcctcaccctaaacttaaa

SEQ ID NO: 13253 - DNA, 565 bp, Artificial Sequence
  chemically treated genomic DNA (Homo sapiens) CpG-island No: 13253
gagggagtcgtagtaggttttatcggtgtagtcgttggtattatcgaatttattataggacgggacgtcgaggaaagttacgtcgatatttagttcgtcgttttgtattagatgtatacgatcgtcgtgagagtggatttgtatcggttttgttagtagattacgggagatttttttcgttagtggattacgtaggtcggaggtataaatgcgggtaattacgttttggcgaatgtgttttattagcggcgtatggtaattatttagggagttggacgttagggttaggtttttaaagtttattttcgcgatgacgtttattattatattgacggttaggttatcgttacggaaagcgtgatggaaggaaatcgttatgtcgttttgtaaattagagcgacgaatcgttttttttaggttggcgtatagtttgcgatcgcgcgtttttttagtttggtaggtttgttttggcgagttttggaaagcggtaagatcgtatttagcgcgacgattttaggtcgttattcgtttttgtcgttgagattgtttaattttttgcgttatt

SEQ ID NO: 13254 - DNA, 565 bp, Artificial Sequence
  chemically treated genomic DNA (Homo sapiens) CpG-island No: 13254
aataacgcaaaaaattaaacaatctcaacgacaaaaacgaataacgacctaaaatcgtcgcgctaaatacgatcttaccgctttccaaaactcgccaaaacaaacctaccaaactaaaaaaacgcgcgatcgcaaactatacgccaacctaaaaaaaacgattcgtcgctctaatttacaaaacgacataacgatttccttccatcacgctttccgtaacgataacctaaccgtcaatataataataaacgtcatcgcgaaaataaactttaaaaacctaaccctaacgtccaactccctaaataattaccatacgccgctaataaaacacattcgccaaaacgtaattacccgcatttatacctccgacctacgtaatccactaacgaaaaaaatctcccgtaatctactaacaaaaccgatacaaatccactctcacgacgatcgtatacatctaatacaaaacgacgaactaaatatcgacgtaactttcctcgacgtcccgtcctataataaattcgataataccaacgactacaccgataaaacctactacgactccctc

SEQ ID NO: 13255 - DNA, 565 bp, Artificial Sequence
  chemically treated genomic DNA (Homo sapiens) CpG-island No: 13255
aatgacgtagaaaattgaataattttaacgataagaacgggtagcggtttggaatcgtcgcgttgaatgcgattttgtcgttttttagaattcgttaaagtaaatttattaggttgaaaaagcgcgcgatcgtaaattgtgcgttaatttggaagaagcgattcgtcgttttggtttataggacggtatgacggtttttttttattacgtttttcgtggcggtgatttgatcgttaatatggtgatggacgttatcgcgaagatgggttttaaaaatttgattttggcgtttagttttttgagtgattgttatgcgtcgttggtagaatatattcgttagggcgtggttattcgtatttatattttcggtttgcgtggtttattggcggaagagatttttcgtggtttgttggtagaatcggtgtagatttatttttacggcggtcgtgtgtatttggtatagagcggcgaattgaatatcgacgtggtttttttcggcgtttcgttttgtgatgaattcggtaatgttaacggttatatcggtaaagtttgttgcggttttttt

SEQ ID NO: 13256 - DNA, 565 bp, Artificial Sequence
  chemically treated genomic DNA (Homo sapiens) CpG-island No: 13256
aaaaaaaccgcaacaaactttaccgatataaccgttaacattaccgaattcatcacaaaacgaaacgccgaaaaaaaccacgtcgatattcaattcgccgctctataccaaatacacacgaccgccgtaaaaataaatctacaccgattctaccaacaaaccacgaaaaatctcttccgccaataaaccacgcaaaccgaaaatataaatacgaataaccacgccctaacgaatatattctaccaacgacgcataacaatcactcaaaaaactaaacgccaaaatcaaatttttaaaacccatcttcgcgataacgtccatcaccatattaacgatcaaatcaccgccacgaaaaacgtaataaaaaaaaaccgtcataccgtcctataaaccaaaacgacgaatcgcttcttccaaattaacgcacaatttacgatcgcgcgctttttcaacctaataaatttactttaacgaattctaaaaaacgacaaaatcgcattcaacgcgacgattccaaaccgctacccgttcttatcgttaaaattattcaattttctacgtcatt

SEQ ID NO: 13257 - DNA, 1478 bp, Artificial Sequence
  chemically treated genomic DNA (Homo sapiens) CpG-island No: 13257
  misc_feature (1336)..(1336): n is either a, c, g or t
ttcgttacgggtacgtagtcgcgtcgtaatattttgcgttacgtatcgttaagggaatattttagtaggtaataagggttatgcggttgttgtttaagtaacgttgttagatgcgtttcgtagattttatttaggtttgtcgtcgtttgtatggggttattggggcgcggtgattgaatgtcgataatcgattattgtggatcgagataacgcgagagtacgttgaattgttaggtaaaatcggacgtaggatggaaataaaatagcgtcgggttattatttttacgtaacggtagaatggtttcgaattttatacgtcgggtgttgttttttttagtattaataatcgttgttagtttggcgatagttgacgcgattattatttgtttcggcgttatttggcgggtaatttgtcgatttaattgcgttgttagttttattgttagtagcgaatgatcgttaagcgcgaagaaattagtatcggtattttgtacgttatattttagtaacgacgagaatgtcgcggcgataatcgttttattgttcgttttcggcgtacgttttggcgtttgtgtttttagtttaggtaacggtaaggttttgcgatttagtttgtcgttggcgttaagtggtaattgtggaagttgtagtagaattatcggtattatatgtggtggtaatgttttacgaagttgcgtttgtaatgcgttggtatttaacggtaggttcgattgcgatattagatagtttattaattgacgcgtattattatcggtggtagtcgtttggttaattatataggcgtgggtaacggtttgttcgatattcggtagcgtttgtattacgcgatcgatttcgtttagttcgatacgttgttcgcgaatttttagttgattattattgcgttcgaggtattttatcgcgtcgttatttagttagcgggtaacgttttcggtacgtatattcgtttatttggggtaaaaggatcggtaataaagcggttggcggttagatcggggcgttcgagatagttttgcgttagttgaatgttagtgagatagagattattcgttatattcggcggtatcggatgtattatcgtattaagaatacgtagattcgtattttatatcggataattaatcggtatattgttgtcgcgtatttgtgttagtttttcgttaaaagtcggatattagttgatatttatcgtcgttttcgtcgggttatatagattatgtaacggcgcgttagttaattgttgttattcgcggtataaattagtcggtaaggttttatattatagaaaattgttttacgtcgcgtattttggcgnacggttgtcgcgtacgaggtaataatgttgtatatcgacgtataagtcgtggtcgtacgtatattcgtataatgttgtatacgacggttcggttttttcgttagtatatagtttgtttcgataacgtagaaaattatacgga

SEQ ID NO: 13258 - DNA, 1478 bp, Artificial Sequence
  chemically treated genomic DNA (Homo sapiens) CpG-island No: 13258
  misc_feature (143)..(143): n is either a, c, g or t
tccgtataattttctacgttatcgaaacaaactatatactaacgaaaaaaccgaaccgtcgtatacaacattatacgaatatacgtacgaccacgacttatacgtcgatatacaacattattacctcgtacgcgacaaccgtncgccaaaatacgcgacgtaaaacaattttctataatataaaaccttaccgactaatttataccgcgaataacaacaattaactaacgcgccgttacataatctatataacccgacgaaaacgacgataaatatcaactaatatccgacttttaacgaaaaactaacacaaatacgcgacaacaatataccgattaattatccgatataaaatacgaatctacgtattcttaatacgataatacatccgataccgccgaatataacgaataatctctatctcactaacattcaactaacgcaaaactatctcgaacgccccgatctaaccgccaaccgctttattaccgatccttttaccccaaataaacgaatatacgtaccgaaaacgttacccgctaactaaataacgacgcgataaaatacctcgaacgcaataataatcaactaaaaattcgcgaacaacgtatcgaactaaacgaaatcgatcgcgtaatacaaacgctaccgaatatcgaacaaaccgttacccacgcctatataattaaccaaacgactaccaccgataataatacgcgtcaattaataaactatctaatatcgcaatcgaacctaccgttaaataccaacgcattacaaacgcaacttcgtaaaacattaccaccacatataataccgataattctactacaacttccacaattaccacttaacgccaacgacaaactaaatcgcaaaaccttaccgttacctaaactaaaaacacaaacgccaaaacgtacgccgaaaacgaacaataaaacgattatcgccgcgacattctcgtcgttactaaaatataacgtacaaaataccgatactaatttcttcgcgcttaacgatcattcgctactaacaataaaactaacaacgcaattaaatcgacaaattacccgccaaataacgccgaaacaaataataatcgcgtcaactatcgccaaactaacaacgattattaatactaaaaaaaacaacacccgacgtataaaattcgaaaccattctaccgttacgtaaaaataataacccgacgctattttatttccatcctacgtccgattttacctaacaattcaacgtactctcgcgttatctcgatccacaataatcgattatcgacattcaatcaccgcgccccaataaccccatacaaacgacgacaaacctaaataaaatctacgaaacgcatctaacaacgttacttaaacaacaaccgcataacccttattacctactaaaatattcccttaacgatacgtaacgcaaaatattacgacgcgactacgtacccgtaacgaa

SEQ ID NO: 13259 - DNA, 1478 bp, Artificial Sequence
  chemically treated genomic DNA (Homo sapiens) CpG-island No: 13259
  misc_feature (143)..(143): n is either a, c, g or t
ttcgtgtgattttttgcgttatcgaggtaaattgtatgttgacggaaggatcggatcgtcgtatgtagtattatgcgaatatgcgtacgattacgatttgtgcgtcgatgtgtagtattgttgtttcgtacgcgataatcgtncgttagagtgcgcgacgtgaaatagttttttgtagtgtgaggttttatcggttgatttatgtcgcgaatggtaatagttaattggcgcgtcgttgtataatttatatggttcgacggaagcggcggtagatgttagttggtattcggtttttggcgaggaattggtataggtgcgcggtagtagtgtgtcgattggttattcggtatggaatacgggtttgcgtatttttgatgcgatgatgtattcggtgtcgtcgggtgtggcgggtgatttttattttattggtatttaattggcgtagggttatttcggacgtttcgatttgatcgttagtcgttttattgtcgatttttttgttttaggtgaacggatgtacgtatcggagacgttgttcgttggttggataacggcgcggtggagtatttcgggcgtagtgatgattagttaaaaattcgcgggtagcgtatcgaattgggcgaaatcgatcgcgtgatgtaggcgttgtcggatgtcgaataagtcgttatttacgtttgtgtgattaattaggcggttgttatcggtggtgatgcgcgttaattggtgggttatttggtgtcgtaatcgggtttgtcgttggatattagcgtattgtaggcgtagtttcgtgaaatattgttattatatatggtatcggtggttttgttgtaatttttatagttattatttagcgttaacggtaagttggatcgtaaagttttatcgttgtttgaattgaaggtataagcgttagggcgtgcgtcgaaagcgggtagtgaaacgattatcgtcgcggtattttcgtcgttgttggggtgtgacgtgtaggatgtcgatgttgattttttcgcgtttggcggttattcgttattggtaatgaaattggtagcgtagttaagtcggtaggttgttcgttaggtgacgtcggggtaagtgatggtcgcgttaattgtcgttaaattggtaacgattattgatgttgaagaagatagtattcggcgtatgggattcgaaattattttgtcgttgcgtgaaggtaatggttcgacgttgttttgtttttattttgcgttcggttttgtttggtagtttagcgtgttttcgcgttatttcgatttataatggtcgattatcggtatttagttatcgcgttttaatggttttatgtagacggcggtaaatttggatgaagtttgcgaagcgtatttggtaacgttatttgaataataatcgtatggtttttattatttgttggggtatttttttggcggtacgtggcgtagggtattgcggcgcgattgcgtgttcgtggcgaa

SEQ ID NO: 13260 - DNA, 1478 bp, Artificial Sequence
  chemically treated genomic DNA (Homo sapiens) CpG-island No: 13260
  misc_feature (1336)..(1336): n is either a, c, g or t
ttcgccacgaacacgcaatcgcgccgcaataccctacgccacgtaccgccaaaaaaataccccaacaaataataaaaaccatacgattattattcaaataacgttaccaaatacgcttcgcaaacttcatccaaatttaccgccgtctacataaaaccattaaaacgcgataactaaataccgataatcgaccattataaatcgaaataacgcgaaaacacgctaaactaccaaacaaaaccgaacgcaaaataaaaacaaaacaacgtcgaaccattaccttcacgcaacgacaaaataatttcgaatcccatacgccgaatactatcttcttcaacatcaataatcgttaccaatttaacgacaattaacgcgaccatcacttaccccgacgtcacctaacgaacaacctaccgacttaactacgctaccaatttcattaccaataacgaataaccgccaaacgcgaaaaaatcaacatcgacatcctacacgtcacaccccaacaacgacgaaaataccgcgacgataatcgtttcactacccgctttcgacgcacgccctaacgcttataccttcaattcaaacaacgataaaactttacgatccaacttaccgttaacgctaaataataactataaaaattacaacaaaaccaccgataccatatataataacaatatttcacgaaactacgcctacaatacgctaatatccaacgacaaacccgattacgacaccaaataacccaccaattaacgcgcatcaccaccgataacaaccgcctaattaatcacacaaacgtaaataacgacttattcgacatccgacaacgcctacatcacgcgatcgatttcgcccaattcgatacgctacccgcgaatttttaactaatcatcactacgcccgaaatactccaccgcgccgttatccaaccaacgaacaacgtctccgatacgtacatccgttcacctaaaacaaaaaaatcgacaataaaacgactaacgatcaaatcgaaacgtccgaaataaccctacgccaattaaataccaataaaataaaaatcacccgccacacccgacgacaccgaatacatcatcgcatcaaaaatacgcaaacccgtattccataccgaataaccaatcgacacactactaccgcgcacctataccaattcctcgccaaaaaccgaataccaactaacatctaccgccgcttccgtcgaaccatataaattatacaacgacgcgccaattaactattaccattcgcgacataaatcaaccgataaaacctcacactacaaaaaactatttcacgtcgcgcactctaacgnacgattatcgcgtacgaaacaacaatactacacatcgacgcacaaatcgtaatcgtacgcatattcgcataatactacatacgacgatccgatccttccgtcaacatacaatttacctcgataacgcaaaaaatcacacgaa

SEQ ID NO: 13261 - DNA, 518 bp, Artificial Sequence
  chemically treated genomic DNA (Homo sapiens) CpG-island No: 13261
tggttatgacggatggattggcgattttatcgaagagcgtcgttttaatggtttaaaatagatcgagcgtattttcgaagcgttggtagaagtggggcggtaaaggtatcgtcgtttcggttgcgtggggtatgtttatttttcgtttatcgtcgatgatttcgtcgatatgggcgcgatatagtagttattcgtttttatcggtagttagacgtttagtttggttaacggtaatatcgtaattacgcgtttaattttttgtcgttttgttcggtttgtttttagcgtcgaacgtttgggtaatcgtcgggtcgcgtttttcgattttacgattcggttgcgttttcgttaggttagttatttttagcgttagacgacgcggatagtaaattattgaacggtgtcgtgtgcgaggttagcgttatttagtttcgtagtaaagttcgtagtaaaggatttagttaggttgcgtagtgtttttggtggtagttttttagtgtcgatttttattagaaaag

SEQ ID NO: 13262 - DNA, 518 bp, Artificial Sequence
  chemically treated genomic DNA (Homo sapiens) CpG-island No: 13262
cttttctaataaaaatcgacactaaaaaactaccaccaaaaacactacgcaacctaactaaatcctttactacgaactttactacgaaactaaataacgctaacctcgcacacgacaccgttcaataatttactatccgcgtcgtctaacgctaaaaataactaacctaacgaaaacgcaaccgaatcgtaaaatcgaaaaacgcgacccgacgattacccaaacgttcgacgctaaaaacaaaccgaacaaaacgacaaaaaattaaacgcgtaattacgatattaccgttaaccaaactaaacgtctaactaccgataaaaacgaataactactatatcgcgcccatatcgacgaaatcatcgacgataaacgaaaaataaacataccccacgcaaccgaaacgacgatacctttaccgccccacttctaccaacgcttcgaaaatacgctcgatctattttaaaccattaaaacgacgctcttcgataaaatcgccaatccatccgtcataacca

SEQ ID NO: 13263 - DNA, 518 bp, Artificial Sequence
  chemically treated genomic DNA (Homo sapiens) CpG-island No: 13263
tttttttggtggaaatcggtattgaagagttgttattaaaagtattgcgtagtttggttgagttttttgttgcgaattttattgcggagttggataacgttggtttcgtatacggtatcgtttaatggtttgttgttcgcgtcgtttggcgttgaaagtagttaatttggcggaagcgtaatcggatcgtgaaatcgaaaaacgcggttcggcgattgtttaggcgttcgacgttgaaggtaaatcgagtaaagcggtagaaggttgggcgcgtggttgcggtattatcgttgattaggttgagcgtttgattatcgataaaggcgaatggttgttgtatcgcgtttatgtcggcgaggttatcggcggtaagcggaaggtaaatatgttttacgtagtcggaacgacgatgtttttatcgttttatttttgttagcgtttcgagaatgcgttcgatttgttttaagttattaagacgacgtttttcgataaagtcgttaatttattcgttatagtta

SEQ ID NO: 13264 - DNA, 518 bp, Artificial Sequence
  chemically treated genomic DNA (Homo sapiens) CpG-island No: 13264
taactataacgaataaattaacgactttatcgaaaaacgtcgtcttaataacttaaaacaaatcgaacgcattctcgaaacgctaacaaaaataaaacgataaaaacatcgtcgttccgactacgtaaaacatatttaccttccgcttaccgccgataacctcgccgacataaacgcgatacaacaaccattcgcctttatcgataatcaaacgctcaacctaatcaacgataataccgcaaccacgcgcccaaccttctaccgctttactcgatttaccttcaacgtcgaacgcctaaacaatcgccgaaccgcgtttttcgatttcacgatccgattacgcttccgccaaattaactactttcaacgccaaacgacgcgaacaacaaaccattaaacgataccgtatacgaaaccaacgttatccaactccgcaataaaattcgcaacaaaaaactcaaccaaactacgcaatacttttaataacaactcttcaataccgatttccaccaaaaaaa

SEQ ID NO: 13265 - DNA, 559 bp, Artificial Sequence
  chemically treated genomic DNA (Homo sapiens) CpG-island No: 13265
tcgtagcgttatgtagttgtcgttagaaatcgtttacgtttagacgttgtattaaattggcgcgttggtaacgattgttcgtgcgtaaggcggcgtaatgcgttatgttaaatcgtacggtatgttgtataattaggcggcgaaagaagtataattggtagacgttatcgttagagcggtatacgtttgcgatttagtattgattttcgtcgggttggcgggaagcgagttgattcgtgtaggtaagtaatatggtttgataacgcgcgatgaagtgtttgtcgatcgcggttattaggttgacggttcgttggtgtcgcgaacgtagttaggcgcgttgattgaaaacgaagaatatgcgttggcgtaaacgttggagatggtgtaatacggtagatttaaaagtattatcggcgaatgggtaacggtcgcggcgtaaacggtttgtttgtatggcgacggcgagtacgtattggcgttcgttcgtcgtttacgttttgtatttgtcgaataggggattgttgtcgtagtataatttcgattaataaagaatgaaaaa

SEQ ID NO: 13266 - DNA, 559 bp, Artificial Sequence
  chemically treated genomic DNA (Homo sapiens) CpG-island No: 13266
tttttcattctttattaatcgaaattatactacgacaacaatcccctattcgacaaatacaaaacgtaaacgacgaacgaacgccaatacgtactcgccgtcgccatacaaacaaaccgtttacgccgcgaccgttacccattcgccgataatacttttaaatctaccgtattacaccatctccaacgtttacgccaacgcatattcttcgttttcaatcaacgcgcctaactacgttcgcgacaccaacgaaccgtcaacctaataaccgcgatcgacaaacacttcatcgcgcgttatcaaaccatattacttacctacacgaatcaactcgcttcccgccaacccgacgaaaatcaatactaaatcgcaaacgtataccgctctaacgataacgtctaccaattatacttctttcgccgcctaattatacaacataccgtacgatttaacataacgcattacgccgccttacgcacgaacaatcgttaccaacgcgccaatttaatacaacgtctaaacgtaaacgatttctaacgacaactacataacgctacga

SEQ ID NO: 13267 - DNA, 559 bp, Artificial Sequence
  chemically treated genomic DNA (Homo sapiens) CpG-island No: 13267
ttttttattttttattaatcggggttatgttgcgataataattttttattcggtaaatgtagagcgtagacggcgagcgaacgttagtgcgtgttcgtcgtcgttatgtaggtagatcgtttgcgtcgcgatcgttgtttattcgtcggtgatatttttgaatttgtcgtgttgtattatttttagcgtttgcgttagcgtatgtttttcgtttttaattaacgcgtttgattgcgttcgcggtattagcgagtcgttagtttgataatcgcgatcggtaaatattttatcgcgcgttgttagattatattgtttgtttgtacgaattagttcgtttttcgttagttcgacgagaattaatgttggatcgtaagcgtatatcgttttagcgatggcgtttgttagttgtgtttttttcgtcgtttggttgtataatatgtcgtgcggtttgatatgacgtattacgtcgttttgcgtacgggtaatcgttgttagcgcgttaatttgatatagcgtttgggcgtaaacggtttttggcggtagttgtatggcgttgcga

SEQ ID NO: 13268 - DNA, 559 bp, Artificial Sequence
  chemically treated genomic DNA (Homo sapiens) CpG-island No: 13268
tcgcaacgccatacaactaccgccaaaaaccgtttacgcccaaacgctatatcaaattaacgcgctaacaacgattacccgtacgcaaaacgacgtaatacgtcatatcaaaccgcacgacatattatacaaccaaacgacgaaaaaaacacaactaacaaacgccatcgctaaaacgatatacgcttacgatccaacattaattctcgtcgaactaacgaaaaacgaactaattcgtacaaacaaacaatataatctaacaacgcgcgataaaatatttaccgatcgcgattatcaaactaacgactcgctaataccgcgaacgcaatcaaacgcgttaattaaaaacgaaaaacatacgctaacgcaaacgctaaaaataatacaacacgacaaattcaaaaatatcaccgacgaataaacaacgatcgcgacgcaaacgatctacctacataacgacgacgaacacgcactaacgttcgctcgccgtctacgctctacatttaccgaataaaaaattattatcgcaacataaccccgattaataaaaaataaaaaa

SEQ ID NO: 13269 - DNA, 580 bp, Artificial Sequence
  chemically treated genomic DNA (Homo sapiens) CpG-island No: 13269
tgttggtggcgtggtacggtattcgtcgtatgttgtttatttcgttggtaaaaattattgtttatattcgcgaaatcgtcggtggtaatttggcgaatattttgattattgacgggcgtagtgaaatgggcgatttggcgtagagcgttttatatatgtaacgttttttgattgatatcgttatttatgttcgcgaaggtttagatgttatttatgtcggtattcgtgaaattgcggcgggtaatatcgattttttttttcgtattgaatagtaggtattcgcgttggaagaaattgttcgtagtatggagtagtttatttagttattacgcgtttggtagtattttgatgttagatagtcgtagtaggtttgcgaattgttttatgtcgcgttgtattattcggagaatttaagcgaaggtcgtttatcggggtaaattgataacgatatttggttttggtaggcgatatgcgttaacgcgtagggcgatgaaattgaagcgacgcgttgtttacgtttggcggcgatcggcgatcgtattattaatatttatagttattataacgattagtcggttga

SEQ ID NO: 13270 - DNA, 580 bp, Artificial Sequence
  chemically treated genomic DNA (Homo sapiens) CpG-island No: 13270
tcaaccgactaatcgttataataactataaatattaataatacgatcgccgatcgccgccaaacgtaaacaacgcgtcgcttcaatttcatcgccctacgcgttaacgcatatcgcctaccaaaaccaaatatcgttatcaatttaccccgataaacgaccttcgcttaaattctccgaataatacaacgcgacataaaacaattcgcaaacctactacgactatctaacatcaaaatactaccaaacgcgtaataactaaataaactactccatactacgaacaatttcttccaacgcgaatacctactattcaatacgaaaaaaaaaatcgatattacccgccgcaatttcacgaataccgacataaataacatctaaaccttcgcgaacataaataacgatatcaatcaaaaaacgttacatatataaaacgctctacgccaaatcgcccatttcactacgcccgtcaataatcaaaatattcgccaaattaccaccgacgatttcgcgaatataaacaataatttttaccaacgaaataaacaacatacgacgaataccgtaccacgccaccaaca

SEQ ID NO: 13271 - DNA, 580 bp, Artificial Sequence
  chemically treated genomic DNA (Homo sapiens) CpG-island No: 13271
ttaatcggttgatcgttgtaataattgtgaatgttaatagtgcgatcgtcggtcgtcgttagacgtaaataacgcgtcgttttagttttatcgttttgcgcgttggcgtatatcgtttgttagaattagatgtcgttattagtttgtttcggtaaacggttttcgtttaaatttttcggataatgtagcgcggtatgaagtagttcgtaggtttgttgcggttgtttggtattaagatgttgttaagcgcgtaataattgggtgagttgttttatgttgcgggtagttttttttagcgcggatgtttgttgtttagtacgggaggaaagatcggtgttgttcgtcgtaattttacgggtatcggtatagatggtatttgaattttcgcggatatgagtgacggtgttagttaaagagcgttgtatatgtgaaacgttttgcgttaggtcgtttattttattgcgttcgttaatggttagggtattcgttaggttattatcggcgatttcgcgaatgtgagtaataatttttgttagcggagtaagtaatatacggcgaatgtcgtattacgttattagta

SEQ ID NO: 13272 - DNA, 580 bp, Artificial Sequence
  chemically treated genomic DNA (Homo sapiens) CpG-island No: 13272
tactaataacgtaatacgacattcgccgtatattacttactccgctaacaaaaattattactcacattcgcgaaatcgccgataataacctaacgaataccctaaccattaacgaacgcaataaaataaacgacctaacgcaaaacgtttcacatatacaacgctctttaactaacaccgtcactcatatccgcgaaaattcaaataccatctataccgatacccgtaaaattacgacgaacaacaccgatctttcctcccgtactaaacaacaaacatccgcgctaaaaaaaactacccgcaacataaaacaactcacccaattattacgcgcttaacaacatcttaataccaaacaaccgcaacaaacctacgaactacttcataccgcgctacattatccgaaaaatttaaacgaaaaccgtttaccgaaacaaactaataacgacatctaattctaacaaacgatatacgccaacgcgcaaaacgataaaactaaaacgacgcgttatttacgtctaacgacgaccgacgatcgcactattaacattcacaattattacaacgatcaaccgattaa

SEQ ID NO: 13273 - DNA, 665 bp, Artificial Sequence
  chemically treated genomic DNA (Homo sapiens) CpG-island No: 13273
cgggtagtgttattggtatgataattcgaatattagtgatgcgtttatttcggttttttcgtattaggagtagttttttttagttttttagcgtttacggtagatagggatcgaattgttttacgacgttttaaatttagttcgcgtattattttaaatggcgaatagttatatttttgggatttattttagttttaggatgtgatgagtcgatatcgaggtgttaaatatcgtcgtcgatatgaatttttgggcggtattagtttgttattttcggagtattttttattcgttgagcgatggtttttttatttagaattatcggattattatgatttgttttcgtatttgttcgcgtcgttacgttcgtagttaagttggtttatgttattgtattaattttttgatgttcgattaggattagttaattttcgttattatttaggcgttttgtaaaaagtacgaagggcgggaatattcgttcgtgtaggcgttgattgatgaatatcgtttcgatttggtgattttgttggagaataatacgtcgtgggtggcggatggtttacgtagtttcggtagttcggtggatcgtaaagagttttagaatttgttggtggagatgttcgaaggaataatatcgaatttgtgcgggttgaagaggaaga

SEQ ID NO: 13274 - DNA, 665 bp, Artificial Sequence
  chemically treated genomic DNA (Homo sapiens) CpG-island No: 13274
tcttcctcttcaacccgcacaaattcgatattattccttcgaacatctccaccaacaaattctaaaactctttacgatccaccgaactaccgaaactacgtaaaccatccgccacccacgacgtattattctccaacaaaatcaccaaatcgaaacgatattcatcaatcaacgcctacacgaacgaatattcccgcccttcgtactttttacaaaacgcctaaataataacgaaaattaactaatcctaatcgaacatcaaaaaattaatacaataacataaaccaacttaactacgaacgtaacgacgcgaacaaatacgaaaacaaatcataataatccgataattctaaataaaaaaaccatcgctcaacgaataaaaaatactccgaaaataacaaactaataccgcccaaaaattcatatcgacgacgatatttaacacctcgatatcgactcatcacatcctaaaactaaaataaatcccaaaaatataactattcgccatttaaaataatacgcgaactaaatttaaaacgtcgtaaaacaattcgatccctatctaccgtaaacgctaaaaaactaaaaaaaactactcctaatacgaaaaaaccgaaataaacgcatcactaatattcgaattatcataccaataacactacccg

SEQ ID NO: 13275 - DNA, 665 bp, Artificial Sequence
  chemically treated genomic DNA (Homo sapiens) CpG-island No: 13275
tttttttttttaattcgtataaattcgatattgttttttcgagtatttttattagtaagttttggaattttttgcgatttatcgaattgtcgaggttgcgtaaattattcgttatttacggcgtgttgttttttagtaggattattagatcgaaacggtatttattaattagcgtttgtacgaacggatgttttcgtttttcgtattttttgtagaacgtttgagtggtgacgaaggttggttaattttggtcggatattaggaggttagtgtaatggtataagttagtttgattgcgagcgtgacggcgcgagtaggtgcgaaagtaggttatagtgattcggtggttttgaatggaagggttatcgtttaacggataaaaggtatttcggggataataggttgatatcgtttaagagtttatatcgacggcggtgtttggtatttcgatgtcggtttattatattttggggttgaagtaggttttaagggtatggttgttcgttatttaaagtggtacgcgagttgggtttagaacgtcgtgagatagttcggtttttatttgtcgtgggcgttggagaattgaggggggttgtttttagtacgagaggatcggagtggacgtattattggtgttcgggttgttatgttaatggtattgttcg

SEQ ID NO: 13276 - DNA, 665 bp, Artificial Sequence
  chemically treated genomic DNA (Homo sapiens) CpG-island No: 13276
cgaacaataccattaacataacaacccgaacaccaataatacgtccactccgatcctctcgtactaaaaacaacccccctcaattctccaacgcccacgacaaataaaaaccgaactatctcacgacgttctaaacccaactcgcgtaccactttaaataacgaacaaccatacccttaaaacctacttcaaccccaaaatataataaaccgacatcgaaataccaaacaccgccgtcgatataaactcttaaacgatatcaacctattatccccgaaataccttttatccgttaaacgataacccttccattcaaaaccaccgaatcactataacctactttcgcacctactcgcgccgtcacgctcgcaatcaaactaacttataccattacactaacctcctaatatccgaccaaaattaaccaaccttcgtcaccactcaaacgttctacaaaaaatacgaaaaacgaaaacatccgttcgtacaaacgctaattaataaataccgtttcgatctaataatcctactaaaaaacaacacgccgtaaataacgaataatttacgcaacctcgacaattcgataaatcgcaaaaaattccaaaacttactaataaaaatactcgaaaaaacaatatcgaatttatacgaattaaaaaaaaaaa

SEQ ID NO: 13277 - DNA, 534 bp, Artificial Sequence
  chemically treated genomic DNA (Homo sapiens) CpG-island No: 13277
  misc_feature (345)..(345): n is either a, c, g or t
gtcgatcgttattatggtcggcgtattagatgcgcgcggttataacgttattgttatcgattcggtcgaaaaattgttggtagtggggtattatttcgaatttatcgtcgatattgttgagtttattcgtcgtattgcggtaagtcgtatttcggttgattatatggtgttgatggtaggttttatcgtcggtaatgaaaaaggcgaattggtggtgtttggacgtaacggtttcgattattttgttgcggtgttggttgtttgtttacgcgtcgattgttgcgagatttggacggacgttgacggggtttatatttgcgattcgcgttaggtgttcgatgcgangttgttgaagtcgatgttttattaggaagcgatggagtttttttatttcggcgttaaagttttttattttcgtattattatttttatcgtttagttttagattttttgtttgattaaaaatatcggaaatttttaagtattaggtacgtttattggtgttagtcgtgatgaagacgaattatcggttaa

SEQ ID NO: 13278 - DNA, 534 bp, Artificial Sequence
  chemically treated genomic DNA (Homo sapiens) CpG-island No: 13278
  misc_feature (190)..(190): n is either a, c, g or t
ttaaccgataattcgtcttcatcacgactaacaccaataaacgtacctaatacttaaaaatttccgatatttttaatcaaacaaaaaatctaaaactaaacgataaaaataataatacgaaaataaaaaactttaacgccgaaataaaaaaactccatcgcttcctaataaaacatcgacttcaacaacntcgcatcgaacacctaacgcgaatcgcaaatataaaccccgtcaacgtccgtccaaatctcgcaacaatcgacgcgtaaacaaacaaccaacaccgcaacaaaataatcgaaaccgttacgtccaaacaccaccaattcgcctttttcattaccgacgataaaacctaccatcaacaccatataatcaaccgaaatacgacttaccgcaatacgacgaataaactcaacaatatcgacgataaattcgaaataataccccactaccaacaatttttcgaccgaatcgataacaataacgttataaccgcgcgcatctaatacgccgaccataataacgatcgac

SEQ ID NO: 13279 - DNA, 534 bp, Artificial Sequence
  chemically treated genomic DNA (Homo sapiens) CpG-island No: 13279
  misc_feature (190)..(190): n is either a, c, g or t
ttgatcggtaattcgtttttattacggttggtattaatgagcgtatttggtgtttgaggattttcggtatttttaattaggtaagggatttggaattgggcgatgggggtaatggtgcgggggtgaagaattttagcgtcgaagtaggaaagttttatcgttttttggtaggatatcgattttaataatntcgtatcgggtatttgacgcgggtcgtaggtatagatttcgttaacgttcgtttaaatttcgtaataatcggcgcgtaaataggtagttagtatcgtagtagagtagtcggaatcgttgcgtttaagtattattagttcgttttttttattatcggcggtgaaatttgttattagtattatgtgattagtcggaatgcggtttgtcgtaatacggcgggtggatttagtaatatcgacggtagattcgaggtaatgttttattgttagtagtttttcgatcggatcgataatagtaacgttgtgatcgcgcgtatttaatacgtcggttataatggcgatcgat

SEQ ID NO: 13280 - DNA, 534 bp, Artificial Sequence
  chemically treated genomic DNA (Homo sapiens) CpG-island No: 13280
  misc_feature (345)..(345): n is either a, c, g or t
atcgatcgccattataaccgacgtattaaatacgcgcgatcacaacgttactattatcgatccgatcgaaaaactactaacaataaaacattacctcgaatctaccgtcgatattactaaatccacccgccgtattacgacaaaccgcattccgactaatcacataatactaataacaaatttcaccgccgataataaaaaaaacgaactaataatacttaaacgcaacgattccgactactctactacgatactaactacctatttacgcgccgattattacgaaatttaaacgaacgttaacgaaatctatacctacgacccgcgtcaaatacccgatacganattattaaaatcgatatcctaccaaaaaacgataaaactttcctacttcgacgctaaaattcttcacccccgcaccattacccccatcgcccaattccaaatcccttacctaattaaaaataccgaaaatcctcaaacaccaaatacgctcattaataccaaccgtaataaaaacgaattaccgatcaa

SEQ ID NO: 13281 - DNA, 541 bp, Artificial Sequence
  chemically treated genomic DNA (Homo sapiens) CpG-island No: 13281
ttgttttgcgcgacgaatattcggaagtgttgaatgtcgataataaaggtttgcgcgattatatcgaattggtaattcgttggttgtggcgtaagttggacgaaggtaaaacgttatcgttgaaatcgttgtcgttgaaagtggtttattatatttcgtgttatatggaaaaaatgggttggacgttttatattttggagttgttgcgtaatatttcggggtttgagttaacggtgttggatttttagtgttgcggtattgcgggtatttacggttttaaaaaagagaattattttattttataagttatcggcgtattattgtttcgttagatagaagaaagcggcgtagatttggtggttatcgattgcgaaatttgtaaatggtagattgagatgtttataagttttcgttgcgaatattcgattacgttattggtttaggcgttggtttaaatttttttttgatgttcggtaagtatgtggttatcgggtatttttgcgtatacgatttcgtgtttaatgtatgcgttgtaattagt

SEQ ID NO: 13282 - DNA, 541 bp, Artificial Sequence
  chemically treated genomic DNA (Homo sapiens) CpG-island No: 13282
actaattacaacgcatacattaaacacgaaatcgtatacgcaaaaatacccgataaccacatacttaccgaacatcaaaaaaaaatttaaaccaacgcctaaaccaataacgtaatcgaatattcgcaacgaaaacttataaacatctcaatctaccatttacaaatttcgcaatcgataaccaccaaatctacgccgctttcttctatctaacgaaacaataatacgccgataacttataaaataaaataattctcttttttaaaaccgtaaatacccgcaataccgcaacactaaaaatccaacaccgttaactcaaaccccgaaatattacgcaacaactccaaaatataaaacgtccaacccattttttccatataacacgaaatataataaaccactttcaacgacaacgatttcaacgataacgttttaccttcgtccaacttacgccacaaccaacgaattaccaattcgatataatcgcgcaaacctttattatcgacattcaacacttccgaatattcgtcgcgcaaaacaa

SEQ ID NO: 13283 - DNA, 541 bp, Artificial Sequence
  chemically treated genomic DNA (Homo sapiens) CpG-island No: 13283
attggttgtaacgtatatattgggtacggaatcgtgtacgtaaaaatgttcggtaattatatgtttatcgggtattagaaaggagtttaagttagcgtttgggttagtagcgtaatcggatgttcgtagcgaagatttgtggatattttaatttgttatttataggtttcgtagtcggtgattattagatttgcgtcgtttttttttatttggcggaatagtggtgcgtcgatggtttgtgaggtggggtagtttttttttttgaaatcgtaagtattcgtaatatcgtagtattgggaatttagtatcgttaatttaagtttcgggatgttacgtaatagttttagggtgtagagcgtttagtttattttttttatatggtacggagtgtgataaattatttttagcggtagcggttttagcggtaacgttttgttttcgtttagtttgcgttatagttagcgggttgttagttcgatatgatcgcgtaagtttttgttgtcgatatttagtattttcgggtattcgtcgcgtagggtaa

SEQ ID NO: 13284 - DNA, 541 bp, Artificial Sequence
  chemically treated genomic DNA (Homo sapiens) CpG-island No: 13284
ttaccctacgcgacgaatacccgaaaatactaaatatcgacaacaaaaacttacgcgatcatatcgaactaacaacccgctaactataacgcaaactaaacgaaaacaaaacgttaccgctaaaaccgctaccgctaaaaataatttatcacactccgtaccatataaaaaaaataaactaaacgctctacaccctaaaactattacgtaacatcccgaaacttaaattaacgatactaaattcccaatactacgatattacgaatacttacgatttcaaaaaaaaaaactaccccacctcacaaaccatcgacgcaccactattccgccaaataaaaaaaaacgacgcaaatctaataatcaccgactacgaaacctataaataacaaattaaaatatccacaaatcttcgctacgaacatccgattacgctactaacccaaacgctaacttaaactcctttctaatacccgataaacatataattaccgaacatttttacgtacacgattccgtacccaatatatacgttacaaccaat

SEQ ID NO: 13285 - DNA, 603 bp, Artificial Sequence
  chemically treated genomic DNA (Homo sapiens) CpG-island No: 13285
ggtggtcgagtcgtaagcgatggttattttgtcgtagattttcggtagttagaacgggaaagtcgaatatgtatattttgaaggttggaaagtgtgggagaacgttagcgcgttgtagtaaataatgtttttgatgagtgaaaagaatgagtgatgtcgtcgagatattagattttttgcgtttgtttttatagggtgagcgtttgattgaagtttttgtcggtataggtaaaaatttttacgattgcggcgttttatttgcgtttgttatttggattaggcggtttcgcgttttttttcgttcgttgatcgttgaagaattgttggtggttatttttatcgaggttgttacggtagaattgcgcggtcgtattcgtagtaatatttacgagttgcgtatcgtttgtttgcgtgaaattatcgataatttattgtacgaacgtttgttggaagagatcgacgataaagcgtaagtcgcgtagtggttgttgttagtcgaacggtagatggatgaagcggtagtttttattatttacggtttttgttagcgtatgtttaatttgaatgtttttgaattcggtatgttgtttgagtagtagttga

SEQ ID NO: 13286 - DNA, 603 bp, Artificial Sequence
  chemically treated genomic DNA (Homo sapiens) CpG-island No: 13286
tcaactactactcaaacaacataccgaattcaaaaacattcaaattaaacatacgctaacaaaaaccgtaaataataaaaactaccgcttcatccatctaccgttcgactaacaacaaccactacgcgacttacgctttatcgtcgatctcttccaacaaacgttcgtacaataaattatcgataatttcacgcaaacaaacgatacgcaactcgtaaatattactacgaatacgaccgcgcaattctaccgtaacaacctcgataaaaataaccaccaacaattcttcaacgatcaacgaacgaaaaaaaacgcgaaaccgcctaatccaaataacaaacgcaaataaaacgccgcaatcgtaaaaatttttacctataccgacaaaaacttcaatcaaacgctcaccctataaaaacaaacgcaaaaaatctaatatctcgacgacatcactcattcttttcactcatcaaaaacattatttactacaacgcgctaacgttctcccacactttccaaccttcaaaatatacatattcgactttcccgttctaactaccgaaaatctacgacaaaataaccatcgcttacgactcgaccacc

SEQ ID NO: 13287 - DNA, 603 bp, Artificial Sequence
  chemically treated genomic DNA (Homo sapiens) CpG-island No: 13287
ttagttgttgtttaaatagtatgtcggatttaaaggtatttaggttgagtatgcgttggtaaaagtcgtgaatagtaaagattgtcgttttatttatttgtcgttcggttaataataattattgcgcggtttgcgttttatcgtcgattttttttagtaggcgttcgtatagtggattgtcggtggttttacgtagataggcgatgcgtaattcgtggatattgttacggatacgatcgcgtaattttgtcgtggtagtttcggtaaaggtgattattagtagttttttaacggttagcgggcggggaaaggcgcggaatcgtttagtttaagtaataggcgtaaatagagcgtcgtaatcgtaaaggtttttgtttgtgtcggtagaggttttaattaggcgtttattttgtaagggtaagcgtaaaggatttagtgtttcggcgatattatttattttttttatttattaggggtattgtttgttgtaacgcgttgacgtttttttatattttttagtttttagggtgtatatattcggttttttcgttttggttgtcggaaatttgcgatagaatagttatcgtttgcggttcgattatt

SEQ ID NO: 13288 - DNA, 603 bp, Artificial Sequence
  chemically treated genomic DNA (Homo sapiens) CpG-island No: 13288
aataatcgaaccgcaaacgataactattctatcgcaaatttccgacaaccaaaacgaaaaaaccgaatatatacaccctaaaaactaaaaaatataaaaaaacgtcaacgcgttacaacaaacaatacccctaataaataaaaaaaataaataatatcgccgaaacactaaatcctttacgcttacccttacaaaataaacgcctaattaaaacctctaccgacacaaacaaaaacctttacgattacgacgctctatttacgcctattacttaaactaaacgattccgcgcctttccccgcccgctaaccgttaaaaaactactaataatcacctttaccgaaactaccacgacaaaattacgcgatcgtatccgtaacaatatccacgaattacgcatcgcctatctacgtaaaaccaccgacaatccactatacgaacgcctactaaaaaaaatcgacgataaaacgcaaaccgcgcaataattattattaaccgaacgacaaataaataaaacgacaatctttactattcacgacttttaccaacgcatactcaacctaaatacctttaaatccgacatactatttaaacaacaactaa

SEQ ID NO: 13289 - DNA, 584 bp, Artificial Sequence
  chemically treated genomic DNA (Homo sapiens) CpG-island No: 13289
cgtcgatttttggcgtcgttattgttattcgttgtcgcgtgaaatagtttaggtcgtttttgaaatttggaaagggtcgtagcgttgttgcgcgatattaatcgttatttgtaaggcgaacgatcggttattaaagtatcgtcgttcgatgatgaaacgttggtttttcgttacgcgtaaattgtggcgcgttgatatcggttagattattattgttattcgtatttaggcgggtattgtttagcggttggcggtagataacgttagcgtgaagtagagcgggtagtttatcgaataattatcgttgggcgtttacgacgcggtgcgtcgtttgttgggtcggttacgttcgcgttagttggatgattttattttggagtaggttattcgtttattgatgcgggaaatggagttggaagggcgcggtattgttagttatttcgaatggcgaatcgatgaattagcgttaagcgaaaattagcgcgtgacgttgtttcgtgtttgttaggaagggttgaataatattgtgaaatatgttgatgttagcgcggttattttgtaaggttggtagtaggatgaacggt

SEQ ID NO: 13290 - DNA, 584 bp, Artificial Sequence
  chemically treated genomic DNA (Homo sapiens) CpG-island No: 13290
accgttcatcctactaccaaccttacaaaataaccgcgctaacatcaacatatttcacaatattattcaacccttcctaacaaacacgaaacaacgtcacgcgctaattttcgcttaacgctaattcatcgattcgccattcgaaataactaacaataccgcgcccttccaactccatttcccgcatcaataaacgaataacctactccaaaataaaatcatccaactaacgcgaacgtaaccgacccaacaaacgacgcaccgcgtcgtaaacgcccaacgataattattcgataaactacccgctctacttcacgctaacgttatctaccgccaaccgctaaacaatacccgcctaaatacgaataacaataataatctaaccgatatcaacgcgccacaatttacgcgtaacgaaaaaccaacgtttcatcatcgaacgacgatactttaataaccgatcgttcgccttacaaataacgattaatatcgcgcaacaacgctacgaccctttccaaatttcaaaaacgacctaaactatttcacgcgacaacgaataacaataacgacgccaaaaatcgacg

SEQ ID NO: 13291 - DNA, 584 bp, Artificial Sequence
  chemically treated genomic DNA (Homo sapiens) CpG-island No: 13291
atcgtttattttgttgttagttttgtagggtgatcgcgttggtattagtatgttttataatgttgtttagttttttttggtagatacgaaatagcgttacgcgttggttttcgtttaacgttgatttatcgattcgttattcgagatggttgataatatcgcgtttttttagttttatttttcgtattagtgagcggatggtttgttttagggtgagattatttaattggcgcggacgtaatcgatttaataaacggcgtatcgcgtcgtaaacgtttagcgatagttgttcgatgagttgttcgttttgttttacgttggcgttatttgtcgttagtcgttgaataatgttcgtttgagtacgaatagtagtgatggtttgatcgatattaacgcgttataatttgcgcgtgacgggaagttagcgttttattatcgggcggcggtgttttgataatcggtcgttcgttttgtagataacgattaatatcgcgtagtaacgttgcggttttttttaggttttaaagacgatttgggttattttacgcggtagcgggtagtagtggcgacgttagaaatcggcg

SEQ ID NO: 13292 - DNA, 584 bp, Artificial Sequence
  chemically treated genomic DNA (Homo sapiens) CpG-island No: 13292
cgccgatttctaacgtcgccactactacccgctaccgcgtaaaataacccaaatcgtctttaaaacctaaaaaaaaccgcaacgttactacgcgatattaatcgttatctacaaaacgaacgaccgattatcaaaacaccgccgcccgataataaaacgctaacttcccgtcacgcgcaaattataacgcgttaatatcgatcaaaccatcactactattcgtactcaaacgaacattattcaacgactaacgacaaataacgccaacgtaaaacaaaacgaacaactcatcgaacaactatcgctaaacgtttacgacgcgatacgccgtttattaaatcgattacgtccgcgccaattaaataatctcaccctaaaacaaaccatccgctcactaatacgaaaaataaaactaaaaaaacgcgatattatcaaccatctcgaataacgaatcgataaatcaacgttaaacgaaaaccaacgcgtaacgctatttcgtatctaccaaaaaaaactaaacaacattataaaacatactaataccaacgcgatcaccctacaaaactaacaacaaaataaacgat

SEQ ID NO: 13293 - DNA, 1335 bp, Artificial Sequence
  chemically treated genomic DNA (Homo sapiens) CpG-island No: 13293
gggaagcgcgggttattttttttttttttttatttttcgtttttttttcgcgcgttattcgtttttttttttttttcgttaataacggttgggtggttgggggaggagggaaggtggtttcggcggagtttgggcgggcgttttttatttagtcgttagtcgtcgtgggagtcggaggatggcggcggtaatagcggtcgtcggagaggaggcggtggggaggttcggggcgttaagcgcgacggtagaaagcggtagcggttcgttatggcgtatcgaaattagcggtagtcgtacggttatttgagtcgtttttttttgttggagttagcgaggggtgtttgtagtcgggatattttttttttcgcgttttttcgtttttcgcgttcgcgttaggtcgttagttttgtttatcgtttcgagaagagcgcgtcgggcgtcgattgtttttcggggcgtcgagcggcggttttggacgtgcgggggtttttttgggtcggtcgcggcgtttcggttttgttttttagttttcgcgttcgtttttatttttttggttttcggggtatagcgcgcggttcggttcggagtagggcggataggagcgttaggtagagcggtttggtcgtcgttaacggcgtacgcgcgcgtattcggttcggatttattttttagtagtagcggagtggttaatgggatcgggattagggttgggggtcggggggtcgtcgtcgcggggaggttttcggtttaggtgtttagcgtttattagtttagcgtttcgggcggcgtcgcggtggtttcggtagtttcgcgtagttgttttttggggggcgtggcgtcgggggttcgcgcggcgtagtttttttttagtatttcgaatagtagtagcggttcgtaggattcgtaggattcggtgtatagtagttttgaggatggcggcggcggcggttagtatcggtcggtgggcgggagtttcggcgggtcgcgtttggtgatcggttttttattagtttattttttatcgcgtatgtttggaggtacggatttttttttacgcgttcgcgttcggttttttcgcggttgtacgtgggtcgtggtcgtcggttatttttatcgtttttttttttttttttcgtcggggcgtcgggggttgtttttcggtttagttcgttaggggttgtttttcggtttagttcgcgtcggtttttattttgggaagaaattcggtacgtaatatttgcggtgtcgttgtcgcgtagatacgtggttttgtttttaaatatcgtgagtatttatattttagcgggtatttagtagagatagtttattttttag

SEQ ID NO: 13294 - DNA, 1335 bp, Artificial Sequence
  chemically treated genomic DNA (Homo sapiens) CpG-island No: 13294
ctaaaaaataaactatctctactaaatacccgctaaaatataaatactcacgatatttaaaaacaaaaccacgtatctacgcgacaacgacaccgcaaatattacgtaccgaatttcttcccaaaataaaaaccgacgcgaactaaaccgaaaaacaacccctaacgaactaaaccgaaaaacaacccccgacgccccgacgaaaaaaaaaaaaaaaaacgataaaaataaccgacgaccacgacccacgtacaaccgcgaaaaaaccgaacgcgaacgcgtaaaaaaaaatccgtacctccaaacatacgcgataaaaaataaactaataaaaaaccgatcaccaaacgcgacccgccgaaactcccgcccaccgaccgatactaaccgccgccgccgccatcctcaaaactactatacaccgaatcctacgaatcctacgaaccgctactactattcgaaatactaaaaaaaaactacgccgcgcgaacccccgacgccacgccccccaaaaaacaactacgcgaaactaccgaaaccaccgcgacgccgcccgaaacgctaaactaataaacgctaaacacctaaaccgaaaacctccccgcgacgacgaccccccgacccccaaccctaatcccgatcccattaaccactccgctactactaaaaaataaatccgaaccgaatacgcgcgcgtacgccgttaacgacgaccaaaccgctctacctaacgctcctatccgccctactccgaaccgaaccgcgcgctataccccgaaaaccaaaaaaataaaaacgaacgcgaaaactaaaaaacaaaaccgaaacgccgcgaccgacccaaaaaaacccccgcacgtccaaaaccgccgctcgacgccccgaaaaacaatcgacgcccgacgcgctcttctcgaaacgataaacaaaactaacgacctaacgcgaacgcgaaaaacgaaaaaacgcgaaaaaaaaaatatcccgactacaaacacccctcgctaactccaacaaaaaaaaacgactcaaataaccgtacgactaccgctaatttcgatacgccataacgaaccgctaccgctttctaccgtcgcgcttaacgccccgaacctccccaccgcctcctctccgacgaccgctattaccgccgccatcctccgactcccacgacgactaacgactaaataaaaaacgcccgcccaaactccgccgaaaccaccttccctcctcccccaaccacccaaccgttattaacgaaaaaaaaaaaaaaacgaataacgcgcgaaaaaaaaacgaaaaataaaaaaaaaaaaaaaataacccgcgcttccc

SEQ ID NO: 13295 - DNA, 1335 bp, Artificial Sequence
  chemically treated genomic DNA (Homo sapiens) CpG-island No: 13295
ttggaaaatagattatttttattgagtattcgttgaggtgtgggtgtttacgatgtttaaaaataaaattacgtgtttacgcggtagcgatatcgtaggtgttacgtgtcgggtttttttttaggatggagatcggcgcgggttgggtcgggaagtagtttttggcgggttgggtcgggaagtagttttcggcgtttcggcggaaggagaaaaggagaacggtaaaaatagtcggcggttacggtttacgtgtagtcgcgggagaatcgagcgcgggcgcgtggagaggggttcgtatttttaaatatgcgcggtgagaggtgagttggtaaggagtcgattattaggcgcggttcgtcggggttttcgtttatcggtcggtgttggtcgtcgtcgtcgttatttttagggttgttgtgtatcgagttttgcgagttttgcggatcgttgttgttgttcgggatgttgaaggaggattgcgtcgcgcgggttttcgacgttacgttttttaggaaatagttgcgcggggttgtcggggttatcgcggcgtcgttcgaggcgttgggttggtgagcgttgggtatttgagtcgggaattttttcgcggcggcggtttttcggtttttagttttggtttcggttttattggttatttcgttgttattggaaggtagattcgagtcgagtacgcgcgcgtgcgtcgttagcggcggttaggtcgttttgtttggcgtttttgttcgttttgtttcggatcgggtcgcgcgttgtgtttcgagagttaagagggtaggagcgaacgcgggagttagagggtagggtcgaggcgtcgcggtcggtttagagaggttttcgtacgtttagggtcgtcgttcggcgtttcgaggggtagtcggcgttcggcgcgtttttttcggggcggtgggtaaggttggcggtttgacgcgggcgcgggagacgaggagacgcggagaggaaggtgtttcggttgtaggtatttttcgttggttttagtaggaaggggcgatttaggtggtcgtgcgattgtcgttggtttcggtgcgttatgacgggtcgttgtcgttttttgtcgtcgcgtttggcgtttcgggtttttttatcgtttttttttcggcggtcgttgttatcgtcgttatttttcggtttttacggcgattggcggttgagtgggaggcgttcgtttagatttcgtcggagttattttttttttttttttagttatttagtcgttattaacggagaaagaggaaaaacgggtggcgcgcgaggggaggacgaagaatgagagggagggaggggtggttcgcgtttttt

SEQ ID NO: 13296 - DNA, 1335 bp, Artificial Sequence
  chemically treated genomic DNA (Homo sapiens) CpG-island No: 13296
aaaaaacgcgaaccacccctccctccctctcattcttcgtcctcccctcgcgcgccacccgtttttcctctttctccgttaataacgactaaataactaaaaaaaaaaaaaaaataactccgacgaaatctaaacgaacgcctcccactcaaccgccaatcgccgtaaaaaccgaaaaataacgacgataacaacgaccgccgaaaaaaaaacgataaaaaaacccgaaacgccaaacgcgacgacaaaaaacgacaacgacccgtcataacgcaccgaaaccaacgacaatcgcacgaccacctaaatcgccccttcctactaaaaccaacgaaaaatacctacaaccgaaacaccttcctctccgcgtctcctcgtctcccgcgcccgcgtcaaaccgccaaccttacccaccgccccgaaaaaaacgcgccgaacgccgactacccctcgaaacgccgaacgacgaccctaaacgtacgaaaacctctctaaaccgaccgcgacgcctcgaccctaccctctaactcccgcgttcgctcctaccctcttaactctcgaaacacaacgcgcgacccgatccgaaacaaaacgaacaaaaacgccaaacaaaacgacctaaccgccgctaacgacgcacgcgcgcgtactcgactcgaatctaccttccaataacaacgaaataaccaataaaaccgaaaccaaaactaaaaaccgaaaaaccgccgccgcgaaaaaattcccgactcaaatacccaacgctcaccaacccaacgcctcgaacgacgccgcgataaccccgacaaccccgcgcaactatttcctaaaaaacgtaacgtcgaaaacccgcgcgacgcaatcctccttcaacatcccgaacaacaacaacgatccgcaaaactcgcaaaactcgatacacaacaaccctaaaaataacgacgacgacgaccaacaccgaccgataaacgaaaaccccgacgaaccgcgcctaataatcgactccttaccaactcacctctcaccgcgcatatttaaaaatacgaacccctctccacgcgcccgcgctcgattctcccgcgactacacgtaaaccgtaaccgccgactatttttaccgttctccttttctccttccgccgaaacgccgaaaactacttcccgacccaacccgccaaaaactacttcccgacccaacccgcgccgatctccatcctaaaaaaaaacccgacacgtaacacctacgatatcgctaccgcgtaaacacgtaattttatttttaaacatcgtaaacacccacacctcaacgaatactcaataaaaataatctattttccaa

SEQ ID NO: 13297 - DNA, 848 bp, Artificial Sequence
  chemically treated genomic DNA (Homo sapiens) CpG-island No: 13297
cggcgagatttcgttgtttagttattattagatcgagttatagatcgagttcgttttttagcgtgaagtttttttgtcgtttggtggttttatcgtaatcggtacgatcgaagcgttgacggtcgtcgatatttgggtcgtaagcggcgattcgcggcggcgtatatcgaagaaatcgcgtataatattgatcgggtagtcgtcgttgcgagtagacgatagtagcggttgcgtagatttcgcggcgtgattgtattcgagtgtatcgatatgacgttagaacgttacgatcgtgtaggagtaagtcgtttgcgtgagtcgatgcgttatgattagggttcggaattaaattagggatgatttttggtttaagttgtgttggaaagtattttcgttagcgcgttgagtttattattcgggtttaatttaggtacgtacgcgtgcgttaggtttttcgtagtatttgtagcgtgcgagataacgagtcgttgtcgggttttattcggcgggcgatcggcgcggagcggttgaagttaatatttaacgacggtattcgagggatcgtgtcgtagttgattttgagttattgaatcgataacgttttcgggtaaagcgtatcgaagttcgttacgattcgtttcgtcgggtaataatcggagagtatttattacgagagtcgtagttgataattgcggcgtttgcggaaatagattggaaatttcgtttttaagttattaggagttagcggtgtttgatggattattcgggggtatttttaagtatgttttttcgggaaacgttttttgttgtggtgatcgttgagttagtaggttatgttagtgaattat

SEQ ID NO: 13298 - DNA, 848 bp, Artificial Sequence
  chemically treated genomic DNA (Homo sapiens) CpG-island No: 13298
ataattcactaacataacctactaactcaacgatcaccacaacaaaaaacgtttcccgaaaaaacatacttaaaaatacccccgaataatccatcaaacaccgctaactcctaataacttaaaaacgaaatttccaatctatttccgcaaacgccgcaattatcaactacgactctcgtaataaatactctccgattattacccgacgaaacgaatcgtaacgaacttcgatacgctttacccgaaaacgttatcgattcaataactcaaaatcaactacgacacgatccctcgaataccgtcgttaaatattaacttcaaccgctccgcgccgatcgcccgccgaataaaacccgacaacgactcgttatctcgcacgctacaaatactacgaaaaacctaacgcacgcgtacgtacctaaattaaacccgaataataaactcaacgcgctaacgaaaatactttccaacacaacttaaaccaaaaatcatccctaatttaattccgaaccctaatcataacgcatcgactcacgcaaacgacttactcctacacgatcgtaacgttctaacgtcatatcgatacactcgaatacaatcacgccgcgaaatctacgcaaccgctactatcgtctactcgcaacgacgactacccgatcaatattatacgcgatttcttcgatatacgccgccgcgaatcgccgcttacgacccaaatatcgacgaccgtcaacgcttcgatcgtaccgattacgataaaaccaccaaacgacaaaaaaacttcacgctaaaaaacgaactcgatctataactcgatctaataataactaaacaacgaaatctcgccg

SEQ ID NO: 13299 - DNA, 848 bp, Artificial Sequence
  chemically treated genomic DNA (Homo sapiens) CpG-island No: 13299
atgatttattggtatagtttattgatttagcgattattataatagggagcgtttttcgggaaaatatatttgagaatgttttcgaatgatttattaggtatcgttagtttttgatagtttaagggcgggatttttagtttattttcgtaagcgtcgtagttgttagttacgattttcgtgatgaatgtttttcggttattattcggcggaacgagtcgtgacgggtttcgatgcgttttattcgagaacgttatcgatttagtagtttagaattaattgcggtacgatttttcgagtgtcgtcgttgagtgttagttttagtcgtttcgcgtcgatcgttcgtcgaatagggttcggtagcgattcgttgtttcgtacgttgtaggtattacggagagtttggcgtacgcgtgcgtgtttggattgagttcgagtgatgggtttagcgcgttgacggaaatattttttagtatagtttaagttagagattatttttgatttggtttcgggttttggttatgacgtatcggtttacgtagacggtttatttttgtacggtcgtggcgttttgacgttatgtcgatgtattcgagtatagttacgtcgcggagtttacgtagtcgttgttgtcgtttattcgtaacggcggttattcggttagtgttatacgcggttttttcgatatacgtcgtcgcgggtcgtcgtttgcggtttagatgtcgacggtcgttaacgtttcggtcgtgtcgattacgatggaattattagacggtagaagaattttacgttggaaggcggattcgatttgtgattcgatttggtagtggttgaatagcgggatttcgtcg

SEQ ID NO: 13300 - DNA, 848 bp, Artificial Sequence
  chemically treated genomic DNA (Homo sapiens) CpG-island No: 13300
cgacgaaatcccgctattcaaccactaccaaatcgaatcacaaatcgaatccgccttccaacgtaaaattcttctaccgtctaataattccatcgtaatcgacacgaccgaaacgttaacgaccgtcgacatctaaaccgcaaacgacgacccgcgacgacgtatatcgaaaaaaccgcgtataacactaaccgaataaccgccgttacgaataaacgacaacaacgactacgtaaactccgcgacgtaactatactcgaatacatcgacataacgtcaaaacgccacgaccgtacaaaaataaaccgtctacgtaaaccgatacgtcataaccaaaacccgaaaccaaatcaaaaataatctctaacttaaactatactaaaaaatatttccgtcaacgcgctaaacccatcactcgaactcaatccaaacacgcacgcgtacgccaaactctccgtaatacctacaacgtacgaaacaacgaatcgctaccgaaccctattcgacgaacgatcgacgcgaaacgactaaaactaacactcaacgacgacactcgaaaaatcgtaccgcaattaattctaaactactaaatcgataacgttctcgaataaaacgcatcgaaacccgtcacgactcgttccgccgaataataaccgaaaaacattcatcacgaaaatcgtaactaacaactacgacgcttacgaaaataaactaaaaatcccgcccttaaactatcaaaaactaacgatacctaataaatcattcgaaaacattctcaaatatattttcccgaaaaacgctccctattataataatcgctaaatcaataaactataccaataaatcat

SEQ ID NO: 13301 - DNA, 645 bp, Artificial Sequence
  chemically treated genomic DNA (Homo sapiens) CpG-island No: 13301
ttgacggtgtagaatcggttgtcggtagtttttacggcgtggtcgttggtgaagtggttgagtgtgcgttattcgaacgttgataaattgcgtgtgataaaagtgaatgtcggcggcgatcgtttgttggatatcgtttgcggtgcgttaaattgtcgttagggtttgtgtgtagcggtagcgattattggtgttgttttgtcgggtgattttaaaattaaagcggcgaaattgcgtggcgaatcgtttgaagggatgttgtgttttttttttgaattgggtatttttgacgattatagcggtattatcgaattgtttgcggatgcgtcgattggtatcgatattcgtgaatatttgaaatttgatgataatattatcgaaattagcgtgacgttaaatcgtgtcgattgtttaggtattattggtgttgcgcgtgacgttgtcgtgttgaattagttgtcgttggtttaatcggaaatcgtttcggttggtgcgattatcgacgatacgttgtcgattatagtcgaagcgtcggaagtttgtacgcgttattttggtcgtgtggtaaaaggtattaacgttaaagcgttaatttcgttgtggatgaaagaaaattgcgtcgttgcggggattcgttttatcgat

SEQ ID NO: 13302 - DNA, 645 bp, Artificial Sequence
  chemically treated genomic DNA (Homo sapiens) CpG-island No: 13302
atcgataaaacgaatccccgcaacgacgcaattttctttcatccacaacgaaattaacgctttaacgttaataccttttaccacacgaccaaaataacgcgtacaaacttccgacgcttcgactataatcgacaacgtatcgtcgataatcgcaccaaccgaaacgatttccgattaaaccaacgacaactaattcaacacgacaacgtcacgcgcaacaccaataatacctaaacaatcgacacgatttaacgtcacgctaatttcgataatattatcatcaaatttcaaatattcacgaatatcgataccaatcgacgcatccgcaaacaattcgataataccgctataatcgtcaaaaatacccaattcaaaaaaaaaacacaacatcccttcaaacgattcgccacgcaatttcgccgctttaattttaaaatcacccgacaaaacaacaccaataatcgctaccgctacacacaaaccctaacgacaatttaacgcaccgcaaacgatatccaacaaacgatcgccgccgacattcacttttatcacacgcaatttatcaacgttcgaataacgcacactcaaccacttcaccaacgaccacgccgtaaaaactaccgacaaccgattctacaccgtcaa

SEQ ID NO: 13303 - DNA, 645 bp, Artificial Sequence
  chemically treated genomic DNA (Homo sapiens) CpG-island No: 13303
atcgatagaacggattttcgtaacgacgtagtttttttttatttatagcggagttggcgttttaacgttaatgttttttattatacggttaagataacgcgtgtaggttttcggcgtttcgattgtaatcggtagcgtgtcgtcgatggtcgtattaatcggaacgattttcggttgaattagcggtagttggtttagtacggtaacgttacgcgtaatattaatgatgtttaagtagtcggtacggtttggcgttacgttgatttcgatggtgttgttattaagttttaggtatttacggatatcggtgttaatcggcgtattcgtaggtagttcgataatgtcgttgtgatcgttagaaatgtttagtttagagaaggagtatagtatttttttagacggttcgttacgtagtttcgtcgttttaattttgaaattattcggtagaatagtattaatggtcgttatcgttatatataggttttgacggtagtttggcgtatcgtagacgatgtttagtaggcgatcgtcgtcgatatttatttttgttatacgtagtttgttagcgttcggatggcgtatatttaattattttattaacgattacgtcgtggaagttgtcggtaatcggttttatatcgttaa

SEQ ID NO: 13304 - DNA, 645 bp, Artificial Sequence
  chemically treated genomic DNA (Homo sapiens) CpG-island No: 13304
ttaacgatataaaaccgattaccgacaacttccacgacgtaatcgttaataaaataattaaatatacgccatccgaacgctaacaaactacgtataacaaaaataaatatcgacgacgatcgcctactaaacatcgtctacgatacgccaaactaccgtcaaaacctatatataacgataacgaccattaatactattctaccgaataatttcaaaattaaaacgacgaaactacgtaacgaaccgtctaaaaaaatactatactccttctctaaactaaacatttctaacgatcacaacgacattatcgaactacctacgaatacgccgattaacaccgatatccgtaaatacctaaaacttaataacaacaccatcgaaatcaacgtaacgccaaaccgtaccgactacttaaacatcattaatattacgcgtaacgttaccgtactaaaccaactaccgctaattcaaccgaaaatcgttccgattaatacgaccatcgacgacacgctaccgattacaatcgaaacgccgaaaacctacacgcgttatcttaaccgtataataaaaaacattaacgttaaaacgccaactccgctataaataaaaaaaaactacgtcgttacgaaaatccgttctatcgat

SEQ ID NO: 13305 - DNA, 889 bp, Artificial Sequence
  chemically treated genomic DNA (Homo sapiens) CpG-island No: 13305
  misc_feature (80)..(80): n is either a, c, g or t
  misc_feature (204)..(205): n is either a, c, g or t
  misc_feature (210)..(210): n is either a, c, g or t
  misc_feature (508)..(508): n is either a, c, g or t
ttatttcggcgttgcgtatattttgtattgagtcggttattcgtcgtatatcgtttagacgaatcgcgtcgtcgttgttngtagtgaataattaacggttgatatttagcggcgggttttagtttattattggtttggatttgttagcggtgagtgttattttttagcgcgttttgcgggttacgtacgttggtattgttgatnngcgtncgtacgtcgtttagcgatacgttttgaattaatagcgtttgcggattaagttcgacgcgtacggcgggtagtgagttgtttcgatatcgatattattaatatcgtcgatttgcgaaatcgtcggagttagttgcgtcgaggcgaaatcgtatagtttatttgcgatataagtatcggacgttagcgtgaggattataattggcgtattcgacgggttcgttttgcgataggtcgggcggttgggtattttattgggtagtaaattttgtgtagcgttgatcgtcgtttgtatattatngcgtgcgtcgttgatatttcggttaaaattaaattgtaaaataatacgcgtgttgtcgagcgaattgttggaggttattttattgatttcggtaatgcgtttaagtgagcgttttagcggcgtggtaacggaagacgttattgtttttggtgacgtatcgggtagcgaggcgttgacgataattatcggaaaatcgatttgcggtagcggggcgatcggtagtatacggaagtttagtatgtcgtatagggtaatggtaatcgatagtaaaatcgtcgttatcgggcggtaaatgaagagggtaaaaaattttatttacgttttttttttatgacgggtaaagcggtttttggtttataatgttaggcggtcgaatagtaa

SEQ ID NO: 13306 - DNA, 889 bp, Artificial Sequence
  chemically treated genomic DNA (Homo sapiens) CpG-island No: 13306
  misc_feature (382)..(382): n is either a, c, g or t
  misc_feature (680)..(680): n is either a, c, g or t
  misc_feature (685)..(686): n is either a, c, g or t
  misc_feature (810)..(810): n is either a, c, g or t
ttactattcgaccgcctaacattataaaccaaaaaccgctttacccgtcataaaaaaaaaacgtaaataaaattttttaccctcttcatttaccgcccgataacgacgattttactatcgattaccattaccctatacgacatactaaacttccgtatactaccgatcgccccgctaccgcaaatcgattttccgataattatcgtcaacgcctcgctacccgatacgtcaccaaaaacaataacgtcttccgttaccacgccgctaaaacgctcacttaaacgcattaccgaaatcaataaaataacctccaacaattcgctcgacaacacgcgtattattttacaatttaattttaaccgaaatatcaacgacgcacgcnataatatacaaacgacgatcaacgctacacaaaatttactacccaataaaatacccaaccgcccgacctatcgcaaaacgaacccgtcgaatacgccaattataatcctcacgctaacgtccgatacttatatcgcaaataaactatacgatttcgcctcgacgcaactaactccgacgatttcgcaaatcgacgatattaataatatcgatatcgaaacaactcactacccgccgtacgcgtcgaacttaatccgcaaacgctattaattcaaaacgtatcgctaaacgacgtacgnacgcnnatcaacaataccaacgtacgtaacccgcaaaacgcgctaaaaaataacactcaccgctaacaaatccaaaccaataataaactaaaacccgccgctaaatatcaaccgttaattattcactacnaacaacgacgacgcgattcgtctaaacgatatacgacgaataaccgactcaatacaaaatatacgcaacgccgaaataa

SEQ ID NO: 13307 - DNA, 889 bp, Artificial Sequence
  chemically treated genomic DNA (Homo sapiens) CpG-island No: 13307
  misc_feature (382)..(382): n is either a, c, g or t
  misc_feature (680)..(680): n is either a, c, g or t
  misc_feature (685)..(686): n is either a, c, g or t
  misc_feature (810)..(810): n is either a, c, g or t
ttgttgttcgatcgtttggtattgtggattaaaagtcgttttgttcgttatgaagaggaggcgtaagtgaagttttttgttttttttatttatcgttcggtggcgacgattttattgtcggttgttattattttgtgcggtatattgggttttcgtatgttgtcggtcgtttcgttgtcgtaggtcgatttttcggtgattatcgttagcgtttcgttgttcggtgcgttattagaaataatggcgtttttcgttgttacgtcgttggagcgtttatttgggcgtattgtcggagttagtgaaatgatttttagtagttcgttcggtagtacgcgtattattttgtagtttgattttgatcgggatattaacggcgtacgtngtgatgtgtaggcggcgattaacgttgtataaagtttgttgtttagtgggatgtttagtcgttcgatttatcgtaaagcgaattcgtcggatgcgttaattatgatttttacgttgacgttcgatatttatatcgtaggtgaattgtacgatttcgtttcgacgtagttggtttcgacgatttcgtaaatcgacggtgttggtgatgtcgatgtcggagtagtttattgttcgtcgtacgcgtcgggtttaattcgtaggcgttgttaatttagggcgtgtcgttggacgacgtacgnacgtnngttagtaatgttaacgtgcgtaattcgtagggcgcgttggaagatggtatttatcgttggtagatttagattaatgatgagttaaaattcgtcgttgaatattagtcgttggttatttattatnaataacggcggcgcggttcgtttgggcgatgtgcgacgggtgatcgatttagtgtaggatgtgcgtaacgtcgggatga

SEQ ID NO: 13308 - DNA, 889 bp, Artificial Sequence
  chemically treated genomic DNA (Homo sapiens) CpG-island No: 13308
  misc_feature (80)..(80): n is either a, c, g or t
  misc_feature (204)..(205): n is either a, c, g or t
  misc_feature (210)..(210): n is either a, c, g or t
  misc_feature (508)..(508): n is either a, c, g or t
tcatcccgacgttacgcacatcctacactaaatcgatcacccgtcgcacatcgcccaaacgaaccgcgccgccgttattnataataaataaccaacgactaatattcaacgacgaattttaactcatcattaatctaaatctaccaacgataaataccatcttccaacgcgccctacgaattacgcacgttaacattactaacnnacgtncgtacgtcgtccaacgacacgccctaaattaacaacgcctacgaattaaacccgacgcgtacgacgaacaataaactactccgacatcgacatcaccaacaccgtcgatttacgaaatcgtcgaaaccaactacgtcgaaacgaaatcgtacaattcacctacgatataaatatcgaacgtcaacgtaaaaatcataattaacgcatccgacgaattcgctttacgataaatcgaacgactaaacatcccactaaacaacaaactttatacaacgttaatcgccgcctacacatcacnacgtacgccgttaatatcccgatcaaaatcaaactacaaaataatacgcgtactaccgaacgaactactaaaaatcatttcactaactccgacaatacgcccaaataaacgctccaacgacgtaacaacgaaaaacgccattatttctaataacgcaccgaacaacgaaacgctaacgataatcaccgaaaaatcgacctacgacaacgaaacgaccgacaacatacgaaaacccaatataccgcacaaaataataacaaccgacaataaaatcgtcgccaccgaacgataaataaaaaaaacaaaaaacttcacttacgcctcctcttcataacgaacaaaacgacttttaatccacaataccaaacgatcgaacaacaa

SEQ ID NO: 13309 - DNA, 624 bp, Artificial Sequence
  chemically treated genomic DNA (Homo sapiens) CpG-island No: 13309
tattacgtttattatcggtatcgttaaatatgtttagtagttgttgtttaatgttatgtagacgcgcgtagtaggcgtagaagtatagatcgtgagtgttattggtagtgtcgtacggtaggttttggcgaataatttttagttttttgttatttttttttagattaacgcgggtgaggtgagaggttttcgaacgtcgtcgtcgtcgatttttttcgtggtttttttggtgcgttcgattaatattttttgatcgtgaacgtttattcggttgagttgttttaaggtgtgttttaacgttggataatatatagttgtcgtcgtattaagtcgtttttaatcgtcgttttataaagcgtcgttttttttttatatcgatatcgtcgagcgttaaagtaatgatattatcgttatttagcggttattgatgttttgttagatacgtcgttgtatgggtatgatgatgtagtatcgtttgcgtcggtagatttattttacgcgtttattggttggagatatagttcggatgcgcgttatgtataacgtattgcggggtaaaatcgtagatgttttgtattaggttgtaacgttcgcgttattgtatttggatgttatcgttattta

SEQ ID NO: 13310 - DNA, 624 bp, Artificial Sequence
  chemically treated genomic DNA (Homo sapiens) CpG-island No: 13310
taaataacgataacatccaaatacaataacgcgaacgttacaacctaatacaaaacatctacgattttaccccgcaatacgttatacataacgcgcatccgaactatatctccaaccaataaacgcgtaaaataaatctaccgacgcaaacgatactacatcatcatacccatacaacgacgtatctaacaaaacatcaataaccgctaaataacgataatatcattactttaacgctcgacgatatcgatataaaaaaaaaacgacgctttataaaacgacgattaaaaacgacttaatacgacgacaactatatattatccaacgttaaaacacaccttaaaacaactcaaccgaataaacgttcacgatcaaaaaatattaatcgaacgcaccaaaaaaaccacgaaaaaaatcgacgacgacgacgttcgaaaacctctcacctcacccgcgttaatctaaaaaaaaataacaaaaaactaaaaattattcgccaaaacctaccgtacgacactaccaataacactcacgatctatacttctacgcctactacgcgcgtctacataacattaaacaacaactactaaacatatttaacgataccgataataaacgtaata

SEQ ID NO: 13311 - DNA, 624 bp, Artificial Sequence
  chemically treated genomic DNA (Homo sapiens) CpG-island No: 13311
taagtgacgatggtatttagatgtagtggcgcgaacgttatagtttgatgtaaaatatttacgattttatttcgtaatacgttgtgtatgacgcgtattcgggttatgtttttagttagtgggcgcgtgaaatgaatttgtcgacgtaaacggtattgtattattatgtttatgtagcggcgtgtttggtagagtattagtggtcgttggatggcggtgatgttattgttttgacgttcgacggtatcggtatggggggagaacggcgttttgtggggcggcgattaaaaacggtttgatgcggcggtagttatgtgttgtttagcgttggaatatattttgaagtagtttaatcggatgagcgtttacgattagaagatgttgatcgggcgtattaaagaggttacgaaagagatcgacggcgacgacgttcgggaattttttattttattcgcgttgatttgaaagaagatggtaaagggttgaagattgttcgttagagtttgtcgtacggtattgttagtggtatttacggtttgtatttttgcgtttattgcgcgcgtttgtataatattgagtagtaattgttgagtatgtttggcgatatcgatggtaagcgtgatg

SEQ ID NO: 13312 - DNA, 624 bp, Artificial Sequence
  chemically treated genomic DNA (Homo sapiens) CpG-island No: 13312
catcacgcttaccatcgatatcgccaaacatactcaacaattactactcaatattatacaaacgcgcgcaataaacgcaaaaatacaaaccgtaaataccactaacaataccgtacgacaaactctaacgaacaatcttcaaccctttaccatcttctttcaaatcaacgcgaataaaataaaaaattcccgaacgtcgtcgccgtcgatctctttcgtaacctctttaatacgcccgatcaacatcttctaatcgtaaacgctcatccgattaaactacttcaaaatatattccaacgctaaacaacacataactaccgccgcatcaaaccgtttttaatcgccgccccacaaaacgccgttctccccccataccgataccgtcgaacgtcaaaacaataacatcaccgccatccaacgaccactaatactctaccaaacacgccgctacataaacataataatacaataccgtttacgtcgacaaattcatttcacgcgcccactaactaaaaacataacccgaatacgcgtcatacacaacgtattacgaaataaaatcgtaaatattttacatcaaactataacgttcgcgccactacatctaaataccatcgtcactta

SEQ ID NO: 13313 - DNA, 845 bp, Artificial Sequence
  chemically treated genomic DNA (Homo sapiens) CpG-island No: 13313
  misc_feature (601)..(601): n is either a, c, g or t
  misc_feature (718)..(718): n is either a, c, g or t
  misc_feature (755)..(756): n is either a, c, g or t
ttttttttgtattttttcgtttaggattgtattcggtggtggatagcgtatagtggatcgaacgtttgttggatgtaggcgtacgtattttttagttacgtattaaagatcggcgcgatgaagaggtggaagtcgatgtcgtggcggtaattgcgttgggtcgtcgttataacgcgcgattgtttattaacgattattggcggttggcgattaagtattaggcgtatggcgtttatttggggtaggaagatttgtaagttatcgattttaatgttattcgcgcggtaggtttgcggttgggcgtttcgatatatgacgatatggaaatcgacgtcgcgttggtagtacgttttttttatatcgcgttgggatatgtgttttcgacgtaaattaaatagatgttttttgtatcgtagggttggaatagttggtacggtatgttgagcgattggcggattattttatcgtggcgattggcggtattagtttggtacgcgcgtttgcggtgatagtaacgggtgtcggtagtatcgtcgtcgttagcgttattatttaagtcgtagattggcgtttggtaacggtatagttgttggaaattgtnagagttcgcgatgaatgatcgtgattttatgcgttatagtcgttaaattttgttcgacgatatcgttttggacgggtagtaaaattgttcgatagttaggtgttgattattcgtttngggcggttgggtatattgttgcgttgtatttggcggnncgttgcgtcggaagtttgtattgtagatgcgacgatggtatttaatatttgtacgataattttttatattgaagtattatgtcgaatcg

SEQ ID NO: 13314 - DNA, 845 bp, Artificial Sequence
  chemically treated genomic DNA (Homo sapiens) CpG-island No: 13314
  misc_feature (90)..(91): n is either a, c, g or t
  misc_feature (128)..(128): n is either a, c, g or t
  misc_feature (245)..(245): n is either a, c, g or t
cgattcgacataatacttcaatataaaaaattatcgtacaaatattaaataccatcgtcgcatctacaatacaaacttccgacgcaacgnnccgccaaatacaacgcaacaatatacccaaccgcccnaaacgaataatcaacacctaactatcgaacaattttactacccgtccaaaacgatatcgtcgaacaaaatttaacgactataacgcataaaatcacgatcattcatcgcgaactctnacaatttccaacaactataccgttaccaaacgccaatctacgacttaaataataacgctaacgacgacgatactaccgacacccgttactatcaccgcaaacgcgcgtaccaaactaataccgccaatcgccacgataaaataatccgccaatcgctcaacataccgtaccaactattccaaccctacgatacaaaaaacatctatttaatttacgtcgaaaacacatatcccaacgcgatataaaaaaaacgtactaccaacgcgacgtcgatttccatatcgtcatatatcgaaacgcccaaccgcaaacctaccgcgcgaataacattaaaatcgataacttacaaatcttcctaccccaaataaacgccatacgcctaatacttaatcgccaaccgccaataatcgttaataaacaatcgcgcgttataacgacgacccaacgcaattaccgccacgacatcgacttccacctcttcatcgcgccgatctttaatacgtaactaaaaaatacgtacgcctacatccaacaaacgttcgatccactatacgctatccaccaccgaatacaatcctaaacgaaaaaatacaaaaaaaa

SEQ ID NO: 13315 - DNA, 845 bp, Artificial Sequence
  chemically treated genomic DNA (Homo sapiens) CpG-island No: 13315
  misc_feature (90)..(91): n is either a, c, g or t
  misc_feature (128)..(128): n is either a, c, g or t
  misc_feature (245)..(245): n is either a, c, g or t
cgattcggtatgatattttagtgtaagagattgtcgtgtagatgttaaatgttatcgtcgtatttgtagtataagttttcgacgtagcgnntcgttaggtatagcgtagtagtgtatttagtcgtttnagacggataattagtatttggttgtcgagtagttttgttgttcgtttagagcgatatcgtcgagtaggatttggcggttataacgtataaagttacggttatttatcgcgaattttngtaatttttagtaattgtgtcgttgttaaacgttagtttgcggtttgagtaatggcgttgacgacggcgatattgtcgatattcgttgttattatcgtaggcgcgcgtgttagattgatatcgttaatcgttacggtgggataattcgttagtcgtttaatatgtcgtgttagttgttttagttttgcggtgtagaaggtatttgtttggtttgcgtcgggaatatatgttttagcgcgatataagaggggcgtgttgttagcgcgacgtcgatttttatatcgttatgtgtcgaaacgtttagtcgtaggtttgtcgcgcggatggtattgagatcggtggtttgtaaatttttttgttttaaatggacgttatacgtttgatgtttgatcgttagtcgttagtaatcgttgataaataatcgcgcgttatagcggcggtttagcgtaattgtcgttacgatatcggtttttatttttttatcgcgtcgatttttgatgcgtagttggagagtacgtacgtttgtatttaatagacgttcgatttattgtacgttgtttattatcgggtatagttttgaacgaaaaggtataggaggaa

SEQ ID NO: 13316 - DNA, 845 bp, Artificial Sequence
  chemically treated genomic DNA (Homo sapiens) CpG-island No: 13316
  misc_feature (601)..(601): n is either a, c, g or t
  misc_feature (718)..(718): n is either a, c, g or t
  misc_feature (755)..(756): n is either a, c, g or t
ttcctcctataccttttcgttcaaaactatacccgataataaacaacgtacaataaatcgaacgtctattaaatacaaacgtacgtactctccaactacgcatcaaaaatcgacgcgataaaaaaataaaaaccgatatcgtaacgacaattacgctaaaccgccgctataacgcgcgattatttatcaacgattactaacgactaacgatcaaacatcaaacgtataacgtccatttaaaacaaaaaaatttacaaaccaccgatctcaataccatccgcgcgacaaacctacgactaaacgtttcgacacataacgatataaaaatcgacgtcgcgctaacaacacgcccctcttatatcgcgctaaaacatatattcccgacgcaaaccaaacaaataccttctacaccgcaaaactaaaacaactaacacgacatattaaacgactaacgaattatcccaccgtaacgattaacgatatcaatctaacacgcgcgcctacgataataacaacgaatatcgacaatatcgccgtcgtcaacgccattactcaaaccgcaaactaacgtttaacaacgacacaattactaaaaattacnaaaattcgcgataaataaccgtaactttatacgttataaccgccaaatcctactcgacgatatcgctctaaacgaacaacaaaactactcgacaaccaaatactaattatccgtctnaaacgactaaatacactactacgctatacctaacganncgctacgtcgaaaacttatactacaaatacgacgataacatttaacatctacacgacaatctcttacactaaaatatcataccgaatcg

SEQ ID NO: 13317 - DNA, 617 bp, Artificial Sequence
  chemically treated genomic DNA (Homo sapiens) CpG-island No: 13317
gaagcgtcgtttagttgttcggttgtatttgcgaagtatttttcgtaatcgttgatttaaatagttcgtcgggtaaattttgaattaatattttttgttcggcggttattatcgttagttagcgtaggtgttttttagttggcgtacgttgtttggttacgttagacgcgttagagtagtttcggttttcggatgtagtaatttcgtttttacgtttagttcgcgcgcggtaatttgtaaaaaatggcgcgttagacggggaatattttttcgacgttcgcgtagcggcggtagatgaacgcggataacgtttaggcggtggaatagatttttacggaatttatttttttgtattcgttgttcgagattttggtgagtggtagcgataattcgtatatttatttttatcggcgtatagtcgttaacgcggtaaaattgatcgtttgttagtacgcgtagtaaacgcgtttgtatatttagcggtatattattaatttcgtcgaggaataatgtatcgttatcggtttgtttaaaacgtttttgacgaatggtattcgcgttagtaaacgcgtttttttcgtggttaaatagttttgattcgattaaattttttggga

SEQ ID NO: 13318 - DNA, 617 bp, Artificial Sequence
  chemically treated genomic DNA (Homo sapiens) CpG-island No: 13318
tcccaaaaaatttaatcgaatcaaaactatttaaccacgaaaaaaacgcgtttactaacgcgaataccattcgtcaaaaacgttttaaacaaaccgataacgatacattattcctcgacgaaattaataatataccgctaaatatacaaacgcgtttactacgcgtactaacaaacgatcaattttaccgcgttaacgactatacgccgataaaaataaatatacgaattatcgctaccactcaccaaaatctcgaacaacgaatacaaaaaaataaattccgtaaaaatctattccaccgcctaaacgttatccgcgttcatctaccgccgctacgcgaacgtcgaaaaaatattccccgtctaacgcgccattttttacaaattaccgcgcgcgaactaaacgtaaaaacgaaattactacatccgaaaaccgaaactactctaacgcgtctaacgtaaccaaacaacgtacgccaactaaaaaacacctacgctaactaacgataataaccgccgaacaaaaaatattaattcaaaatttacccgacgaactatttaaatcaacgattacgaaaaatacttcgcaaatacaaccgaacaactaaacgacgcttc

SEQ ID NO: 13319 - DNA, 617 bp, Artificial Sequence
  chemically treated genomic DNA (Homo sapiens) CpG-island No: 13319
ttttaaaagatttgatcgaattagaattgtttggttacgagaaaggcgcgtttattggcgcgaatattattcgttaggggcgttttgaataggtcgatggcggtatattatttttcgacgaaattggtgatatgtcgttggatgtgtagacgcgtttgttgcgcgtgttggtagacggttagttttatcgcgttggcggttatgcgtcggtgaaagtggatgtgcggattatcgttgttatttattagaatttcgaatagcgagtgtaggaaggtaagtttcgtgaggatttgttttatcgtttgaacgttattcgcgtttatttgtcgtcgttgcgcgaacgtcgggaagatatttttcgtttggcgcgttattttttataggttgtcgcgcgcgaattgggcgtagaagcgaagttattgtattcggaaatcgaagttgttttgacgcgtttggcgtggttaggtaacgtgcgttagttggaaaatatttgcgttggttaacggtgatggtcgtcgggtaggaagtgttgatttaggatttgttcggcgaattgtttgaattaacggttgcggagagtatttcgtaaatgtaatcggatagttgggcgacgtttt

SEQ ID NO: 13320 - DNA, 617 bp, Artificial Sequence
  chemically treated genomic DNA (Homo sapiens) CpG-island No: 13320
aaaacgtcgcccaactatccgattacatttacgaaatactctccgcaaccgttaattcaaacaattcgccgaacaaatcctaaatcaacacttcctacccgacgaccatcaccgttaaccaacgcaaatattttccaactaacgcacgttacctaaccacgccaaacgcgtcaaaacaacttcgatttccgaatacaataacttcgcttctacgcccaattcgcgcgcgacaacctataaaaaataacgcgccaaacgaaaaatatcttcccgacgttcgcgcaacgacgacaaataaacgcgaataacgttcaaacgataaaacaaatcctcacgaaacttaccttcctacactcgctattcgaaattctaataaataacaacgataatccgcacatccactttcaccgacgcataaccgccaacgcgataaaactaaccgtctaccaacacgcgcaacaaacgcgtctacacatccaacgacatatcaccaatttcgtcgaaaaataatataccgccatcgacctattcaaaacgcccctaacgaataatattcgcgccaataaacgcgcctttctcgtaaccaaacaattctaattcgatcaaatcttttaaaa

SEQ ID NO: 13321 - DNA, 693 bp, Artificial Sequence
  chemically treated genomic DNA (Homo sapiens) CpG-island No: 13321
  misc_feature (662)..(662): n is either a, c, g or t
gttatcggtaggcgtaacggttttatttgtgtcgcgtagtagtgtagagacgttttagcgtcgtacgcgtttgttttaggtttttttcgttgtagtttaattggttgcgatagtggttcgatattaggaagtaacgtacggttttcgcgtcgtagtattttagtatatcgcgtacggtaaagaagttatttagcgatttggatattttttcgcggttaattattattattttcgagtgtatttagtagtttatatattgattattatgggtataggtggattgcgcgatttcgttttcgtggtgcgggaatattaggtttgaatcgtcgtcgtggatattaaagtggttatttagttgtttgtagtttattgtcgaatatttaatgtgttagttaggacgattcgcgttttacggagacggttagttcggttcgttttttttcgatattttttatagaacgaagtttattgggttgcgtttgtcgtcgattacgttaacgcgcgcgtttgtttgtagttggtcgagattttgacgcgatagtacgttataagttggatcggtcgggacgtcgaatattacgtcgtcgttgttcgttatataagcgtgatttttggcgattagttgtttagtgagtttaataatttttgcgatatggtgcgtncgcgcggttttatattcgggcgtagaatgtt

SEQ ID NO: 13322 - DNA, 693 bp, Artificial Sequence
  chemically treated genomic DNA (Homo sapiens) CpG-island No: 13322
  misc_feature (32)..(32): n is either a, c, g or t
aacattctacgcccgaatataaaaccgcgcgnacgcaccatatcgcaaaaattattaaactcactaaacaactaatcgccaaaaatcacgcttatataacgaacaacgacgacgtaatattcgacgtcccgaccgatccaacttataacgtactatcgcgtcaaaatctcgaccaactacaaacaaacgcgcgcgttaacgtaatcgacgacaaacgcaacccaataaacttcgttctataaaaaatatcgaaaaaaaacgaaccgaactaaccgtctccgtaaaacgcgaatcgtcctaactaacacattaaatattcgacaataaactacaaacaactaaataaccactttaatatccacgacgacgattcaaacctaatattcccgcaccacgaaaacgaaatcgcgcaatccacctatacccataataatcaatatataaactactaaatacactcgaaaataataataattaaccgcgaaaaaatatccaaatcgctaaataacttctttaccgtacgcgatatactaaaatactacgacgcgaaaaccgtacgttacttcctaatatcgaaccactatcgcaaccaattaaactacaacgaaaaaaacctaaaacaaacgcgtacgacgctaaaacgtctctacactactacgcgacacaaataaaaccgttacgcctaccgataac

SEQ ID NO: 13323 - DNA, 693 bp, Artificial Sequence
  chemically treated genomic DNA (Homo sapiens) CpG-island No: 13323
  misc_feature (32)..(32): n is either a, c, g or t
aatattttgcgttcggatatggagtcgcgcgnacgtattatatcgtagaaattattgaatttattgaataattgatcgttaaaggttacgtttatgtggcggataacggcgacgtgatgttcgacgtttcgatcgatttaatttatggcgtgttgtcgcgttaggatttcgattagttgtaggtaggcgcgcgcgttgacgtggtcgacgataaacgtaatttaatggatttcgttttgtggaagatgtcgaaagagggcgaatcgagttggtcgttttcgtggggcgcgggtcgttttggttggtatattgaatgttcggtaatgaattgtaagtagttgggtaattattttgatatttacggcggcggtttagatttgatgttttcgtattacgaaaacgaaatcgcgtagtttatttgtgtttatgatggttagtatgtgaattattggatgtattcggggatggtgatggttgatcgcgagaagatgtttaaatcgttgggtaatttttttatcgtgcgcgatgtgttgaaatattacgacgcggaaatcgtgcgttattttttgatgtcgggttattatcgtagttagttgaattatagcgaagagaatttgaagtaggcgcgtgcggcgttggagcgtttttatattgttgcgcggtatagataaaatcgttgcgtttgtcggtggt

SEQ ID NO: 13324 - DNA, 693 bp, Artificial Sequence
  chemically treated genomic DNA (Homo sapiens) CpG-island No: 13324
  misc_feature (662)..(662): n is either a, c, g or t
accaccgacaaacgcaacgattttatctataccgcgcaacaatataaaaacgctccaacgccgcacgcgcctacttcaaattctcttcgctataattcaactaactacgataataacccgacatcaaaaaataacgcacgatttccgcgtcgtaatatttcaacacatcgcgcacgataaaaaaattacccaacgatttaaacatcttctcgcgatcaaccatcaccatccccgaatacatccaataattcacatactaaccatcataaacacaaataaactacgcgatttcgttttcgtaatacgaaaacatcaaatctaaaccgccgccgtaaatatcaaaataattacccaactacttacaattcattaccgaacattcaatataccaaccaaaacgacccgcgccccacgaaaacgaccaactcgattcgccctctttcgacatcttccacaaaacgaaatccattaaattacgtttatcgtcgaccacgtcaacgcgcgcgcctacctacaactaatcgaaatcctaacgcgacaacacgccataaattaaatcgatcgaaacgtcgaacatcacgtcgccgttatccgccacataaacgtaacctttaacgatcaattattcaataaattcaataatttctacgatataatacgtncgcgcgactccatatccgaacgcaaaatatt

SEQ ID NO: 13325 - DNA, 507 bp, Artificial Sequence
  chemically treated genomic DNA (Homo sapiens) CpG-island No: 13325
  misc_feature (204)..(204): n is either a, c, g or t
  misc_feature (225)..(225): n is either a, c, g or t
  misc_feature (381)..(381): n is either a, c, g or t
  misc_feature (418)..(418): n is either a, c, g or t
  misc_feature (460)..(460): n is either a, c, g or t
gtaaaatcgttagagtttgaatagtttgttgtcgtcgttacgtgaataattggacggttttcgtcgttagtttaggatagtttcggtaaagaagtataagaacgttatattttgatttacgaaattcgtaatttttagtaatttttacgcgttaatggtttaggaagcgattaatttgacgcgcgcgttgaaaagcgataatanaatttagggtattggggcgangtagtatgatagcggtgttggagttttagtttgcgtgaaggtatgatatgaatttagttatatcgaaatgacgttgttcgtcgatgtagttgatgttatcgtcgtttgcgtaggaaaagatgtgtgatgacgttaaatgacgttgtcgttatgatnttatttaacgcgagacgttatatcgcgaagcgttatnagatatatcggtcgtgcgtattatattcgttgttggattaangatattatattgtcgggtcgattttgattagtttgatgttatttcgt

SEQ ID NO: 13326 - DNA, 507 bp, Artificial Sequence
  chemically treated genomic DNA (Homo sapiens) CpG-island No: 13326
  misc_feature (48)..(48): n is either a, c, g or t
  misc_feature (90)..(90): n is either a, c, g or t
  misc_feature (127)..(127): n is either a, c, g or t
  misc_feature (283)..(283): n is either a, c, g or t
  misc_feature (304)..(304): n is either a, c, g or t
acgaaataacatcaaactaatcaaaatcgacccgacaatataatatcnttaatccaacaacgaatataatacgcacgaccgatatatctnataacgcttcgcgatataacgtctcgcgttaaataanatcataacgacaacgtcatttaacgtcatcacacatcttttcctacgcaaacgacgataacatcaactacatcgacgaacaacgtcatttcgatataactaaattcatatcataccttcacgcaaactaaaactccaacaccgctatcatactacntcgccccaataccctaaattntattatcgcttttcaacgcgcgcgtcaaattaatcgcttcctaaaccattaacgcgtaaaaattactaaaaattacgaatttcgtaaatcaaaatataacgttcttatacttctttaccgaaactatcctaaactaacgacgaaaaccgtccaattattcacgtaacgacgacaacaaactattcaaactctaacgattttac

SEQ ID NO: 13327 - DNA, 507 bp, Artificial Sequence
  chemically treated genomic DNA (Homo sapiens) CpG-island No: 13327
  misc_feature (48)..(48): n is either a, c, g or t
  misc_feature (90)..(90): n is either a, c, g or t
  misc_feature (127)..(127): n is either a, c, g or t
  misc_feature (283)..(283): n is either a, c, g or t
  misc_feature (304)..(304): n is either a, c, g or t
acgggataatattagattaattagagtcgattcggtagtgtgatattnttggtttagtaacggatatggtacgtacgatcgatatgtttngtagcgtttcgcggtgtagcgtttcgcgttaaatagngttatagcgatagcgttatttggcgttattatatatttttttttgcgtaggcgacgatgatattagttgtatcggcgagtagcgttatttcgatgtgattgggtttatattatatttttacgtagattgaagttttagtatcgttgttatattatntcgttttagtgttttgggttntattgtcgttttttagcgcgcgcgttaggttgatcgttttttgggttattggcgcgtgaaagttgttggagattgcgaatttcgtgggttagggtatggcgtttttgtgtttttttatcgaagttgttttgaattgacggcggaaatcgtttagttgtttacgtagcggcgataataggttgtttagattttgacggttttgt

SEQ ID NO: 13328 - DNA, 507 bp, Artificial Sequence
  chemically treated genomic DNA (Homo sapiens) CpG-island No: 13328
  misc_feature (204)..(204): n is either a, c, g or t
  misc_feature (225)..(225): n is either a, c, g or t
  misc_feature (381)..(381): n is either a, c, g or t
  misc_feature (418)..(418): n is either a, c, g or t
  misc_feature (460)..(460): n is either a, c, g or t
acaaaaccgtcaaaatctaaacaacctattatcgccgctacgtaaacaactaaacgatttccgccgtcaattcaaaacaacttcgataaaaaaacacaaaaacgccataccctaacccacgaaattcgcaatctccaacaactttcacgcgccaataacccaaaaaacgatcaacctaacgcgcgcgctaaaaaacgacaatanaacccaaaacactaaaacganataatataacaacgatactaaaacttcaatctacgtaaaaatataatataaacccaatcacatcgaaataacgctactcgccgatacaactaatatcatcgtcgcctacgcaaaaaaaaatatataataacgccaaataacgctatcgctataacnctatttaacgcgaaacgctacaccgcgaaacgctacnaaacatatcgatcgtacgtaccatatccgttactaaaccaanaatatcacactaccgaatcgactctaattaatctaatattatcccgt

SEQ ID NO: 13329 - DNA, 583 bp, Artificial Sequence
  chemically treated genomic DNA (Homo sapiens) CpG-island No: 13329
atattatttttgtttcgttatttcgaatttattcgttaattttacgtacgttcgtcgatattcggtggttagtcgcgtggatttcgtaggtgtttggtggggtggcgggcgtaagtttgtggatgtcgtgttgtttggggtcggcgggcgagggcgggtcggggtcgtggtgggtcggggcggattggtcgtaacgtagggaatcgggtgggggggggtggggggtgggggggcggggatattaatagcgtacgcgagtattttaattaatcgataatcgataatcgattagaatatttgcgtaacgttcgatttacgttacggtttaaaggtttatttggcgtcgatcgttatcgtttatagtacgaaatcgtttaatatttttttttatatttaacgttggggggagtgggggtagtatattaaaagggtttcggaggtatttaatgaagcgtatgcgtcgattcgttgatgttttttatcgtaatcgttttttagacgaaatggtttaatagatatttttatttttaatcgaatcgggttgttttgagatttttattttgggtgcgggtgcggatggggt

SEQ ID NO: 13330 - DNA, 583 bp, Artificial Sequence
  chemically treated genomic DNA (Homo sapiens) CpG-island No: 13330
accccatccgcacccgcacccaaaataaaaatctcaaaacaacccgattcgattaaaaataaaaatatctattaaaccatttcgtctaaaaaacgattacgataaaaaacatcaacgaatcgacgcatacgcttcattaaatacctccgaaacccttttaatatactacccccactccccccaacgttaaatataaaaaaaaatattaaacgatttcgtactataaacgataacgatcgacgccaaataaacctttaaaccgtaacgtaaatcgaacgttacgcaaatattctaatcgattatcgattatcgattaattaaaatactcgcgtacgctattaatatccccgcccccccaccccccacccccccccacccgattccctacgttacgaccaatccgccccgacccaccacgaccccgacccgccctcgcccgccgaccccaaacaacacgacatccacaaacttacgcccgccaccccaccaaacacctacgaaatccacgcgactaaccaccgaatatcgacgaacgtacgtaaaattaacgaataaattcgaaataacgaaacaaaaataatat

SEQ ID NO: 13331 - DNA, 583 bp, Artificial Sequence
  chemically treated genomic DNA (Homo sapiens) CpG-island No: 13331
attttattcgtattcgtatttagagtaaaaattttaaaataattcgattcggttgggagtggaggtatttgttagattatttcgtttaaagggcggttgcggtgggaggtattagcggatcggcgtatgcgttttattaggtattttcggagtttttttgatatattatttttattttttttaacgttgggtgtggaggagggtgttagacgatttcgtattatgggcggtagcggtcggcgttaggtgagtttttgggtcgtggcgtaagtcgagcgttgcgtaagtgttttagtcgattgtcgattgtcgattggttagggtgttcgcgtgcgttattgatattttcgtttttttattttttatttttttttattcgattttttacgttacgattagttcgtttcgatttattacggtttcggttcgttttcgttcgtcggttttaaataatacgatatttataaatttacgttcgttattttattagatatttacggaatttacgcggttaattatcgggtgtcgacgaacgtgcgtgaaattgacgagtgagttcgggatgacgaaatagaaatgatat

SEQ ID NO: 13332 - DNA, 583 bp, Artificial Sequence
  chemically treated genomic DNA (Homo sapiens) CpG-island No: 13332
atatcatttctatttcgtcatcccgaactcactcgtcaatttcacgcacgttcgtcgacacccgataattaaccgcgtaaattccgtaaatatctaataaaataacgaacgtaaatttataaatatcgtattatttaaaaccgacgaacgaaaacgaaccgaaaccgtaataaatcgaaacgaactaatcgtaacgtaaaaaatcgaataaaaaaaaataaaaaataaaaaaacgaaaatatcaataacgcacgcgaacaccctaaccaatcgacaatcgacaatcgactaaaacacttacgcaacgctcgacttacgccacgacccaaaaactcacctaacgccgaccgctaccgcccataatacgaaatcgtctaacaccctcctccacacccaacgttaaaaaaaataaaaataatatatcaaaaaaactccgaaaatacctaataaaacgcatacgccgatccgctaatacctcccaccgcaaccgccctttaaacgaaataatctaacaaatacctccactcccaaccgaatcgaattattttaaaatttttactctaaatacgaatacgaataaaat

SEQ ID NO: 13333 - DNA, 803 bp, Artificial Sequence
  chemically treated genomic DNA (Homo sapiens) CpG-island No: 13333
  misc_feature (145)..(145): n is either a, c, g or t
  misc_feature (156)..(156): n is either a, c, g or t
  misc_feature (159)..(159): n is either a, c, g or t
  misc_feature (193)..(193): n is either a, c, g or t
  misc_feature (196)..(196): n is either a, c, g or t
  misc_feature (241)..(241): n is either a, c, g or t
  misc_feature (281)..(281): n is either a, c, g or t
  misc_feature (302)..(302): n is either a, c, g or t
gaagggttattttcgaggtgggcgtggagaggtttgagcggttggtgtttgaatgaggtttggggtgtttggggtggggcgattgcgttgaaatgatgttgtttttgggggcgcggggttgcgaggtagagatgtcggtttgggngaatggggttnttntgagcgggaatggcgtattgtaattattggtgtnttnagaattgtgcggtgcgtgtgtgaaagaggcggatagtcgttgcgngtgtcggggagagagttaatgacgcgggtgcgttaagttngggatgcgtgacgtttttgtnattgtgcgggcgtttcgtgtcgttcgaacgtagtcgtacgggattgtgcggaattaattggttcggcgaggtgatgcggtgacgtgatttttttttatttcggagtttggtttgtacgttggcgttggtcgattttttttgtttattttaaaggttattatattttgtttattcgtagatattttatcgcgacgaatatagttataatcggtttttggtagattcggtataatgtcgaaggttattagtttgttcgtttcggtatatggtatggtattacgtacggcggtacggaacgcgtttttatcggtaattatatgattcgtcgttaatattagtattaacgggtcgtttttcgggttatgacgttttgtcgttagcgtcgttagcgtaatggtaggtgtcgtgtttcgttttgtcggttcgagaataatgttttcggtaagtttgtttagttgacgtagttgtttcgcgataataaagcggtgttgtttattgtaa

SEQ ID NO: 13334 - DNA, 803 bp, Artificial Sequence
  chemically treated genomic DNA (Homo sapiens) CpG-island No: 13334
  misc_feature (502)..(502): n is either a, c, g or t
  misc_feature (523)..(523): n is either a, c, g or t
  misc_feature (563)..(563): n is either a, c, g or t
  misc_feature (608)..(608): n is either a, c, g or t
  misc_feature (611)..(611): n is either a, c, g or t
  misc_feature (645)..(645): n is either a, c, g or t
  misc_feature (648)..(648): n is either a, c, g or t
  misc_feature (659)..(659): n is either a, c, g or t
ttacaataaacaacaccgctttattatcgcgaaacaactacgtcaactaaacaaacttaccgaaaacattattctcgaaccgacaaaacgaaacacgacacctaccattacgctaacgacgctaacgacaaaacgtcataacccgaaaaacgacccgttaatactaatattaacgacgaatcatataattaccgataaaaacgcgttccgtaccgccgtacgtaataccataccatataccgaaacgaacaaactaataaccttcgacattataccgaatctaccaaaaaccgattataactatattcgtcgcgataaaatatctacgaataaacaaaatataataacctttaaaataaacaaaaaaaatcgaccaacgccaacgtacaaaccaaactccgaaataaaaaaaaatcacgtcaccgcatcacctcgccgaaccaattaattccgcacaatcccgtacgactacgttcgaacgacacgaaacgcccgcacaatnacaaaaacgtcacgcatcccnaacttaacgcacccgcgtcattaactctctccccgacacncgcaacgactatccgcctctttcacacacgcaccgcacaattctnaanacaccaataattacaatacgccattcccgctcanaanaaccccattcncccaaaccgacatctctacctcgcaaccccgcgcccccaaaaacaacatcatttcaacgcaatcgccccaccccaaacaccccaaacctcattcaaacaccaaccgctcaaacctctccacgcccacctcgaaaataacccttc

SEQ ID NO: 13335 - DNA, 803 bp, Artificial Sequence
  chemically treated genomic DNA (Homo sapiens) CpG-island No: 13335
  misc_feature (502)..(502): n is either a, c, g or t
  misc_feature (523)..(523): n is either a, c, g or t
  misc_feature (563)..(563): n is either a, c, g or t
  misc_feature (608)..(608): n is either a, c, g or t
  misc_feature (611)..(611): n is either a, c, g or t
  misc_feature (645)..(645): n is either a, c, g or t
  misc_feature (648)..(648): n is either a, c, g or t
  misc_feature (659)..(659): n is either a, c, g or t
ttgtaatgagtagtatcgttttattgtcgcggaatagttgcgttaattgaataaatttatcgagaatattattttcgaatcggtagggcgaaatacggtatttgttattgcgttggcggcgttggcggtaaaacgttatagttcggagagcgattcgttaatgttggtattggcggcggattatgtgattgtcgatgaagacgcgtttcgtgtcgtcgtgcgtaatgttatgttatatgtcgaagcgggtaagttggtgattttcggtattgtgtcggatttattagaaatcggttatggttatattcgtcgcggtgaagtgtttgcgggtgagtaggatatggtggtttttgaagtgggtaaaaggagtcgattaacgttagcgtataagttaaatttcggggtaagagagagttacgttatcgtattatttcgtcgggttagttgatttcgtataatttcgtacgattacgttcgagcggtacgaagcgttcgtataatnataagagcgttacgtattttngatttgacgtattcgcgttattgatttttttttcgatatncgtaacgattattcgttttttttatatacgtatcgtataattttnagngtattaatagttataatacgttattttcgtttanaanggttttatttntttagatcgatatttttatttcgtaatttcgcgtttttaaagatagtattattttaacgtagtcgttttattttaagtattttaagttttatttaaatattagtcgtttagatttttttacgtttatttcgagaataatttttt

SEQ ID NO: 13336 - DNA, 803 bp, Artificial Sequence
  chemically treated genomic DNA (Homo sapiens) CpG-island No: 13336
  misc_feature (145)..(145): n is either a, c, g or t
  misc_feature (156)..(156): n is either a, c, g or t
  misc_feature (159)..(159): n is either a, c, g or t
  misc_feature (193)..(193): n is either a, c, g or t
  misc_feature (196)..(196): n is either a, c, g or t
  misc_feature (241)..(241): n is either a, c, g or t
  misc_feature (281)..(281): n is either a, c, g or t
  misc_feature (302)..(302): n is either a, c, g or t
aaaaaattattctcgaaataaacgtaaaaaaatctaaacgactaatatttaaataaaacttaaaatacttaaaataaaacgactacgttaaaataatactatctttaaaaacgcgaaattacgaaataaaaatatcgatctaaanaaataaaaccnttntaaacgaaaataacgtattataactattaatacnctnaaaattatacgatacgtatataaaaaaaacgaataatcgttacgnatatcgaaaaaaaaatcaataacgcgaatacgtcaaatcnaaaatacgtaacgctcttatnattatacgaacgcttcgtaccgctcgaacgtaatcgtacgaaattatacgaaatcaactaacccgacgaaataatacgataacgtaactctctcttaccccgaaatttaacttatacgctaacgttaatcgactccttttacccacttcaaaaaccaccatatcctactcacccgcaaacacttcaccgcgacgaatataaccataaccgatttctaataaatccgacacaataccgaaaatcaccaacttacccgcttcgacatataacataacattacgcacgacgacacgaaacgcgtcttcatcgacaatcacataatccgccgccaataccaacattaacgaatcgctctccgaactataacgttttaccgccaacgccgccaacgcaataacaaataccgtatttcgccctaccgattcgaaaataatattctcgataaatttattcaattaacgcaactattccgcgacaataaaacgatactactcattacaa

SEQ ID NO: 13337 - DNA, 575 bp, Artificial Sequence
  chemically treated genomic DNA (Homo sapiens) CpG-island No: 13337
  misc_feature (513)..(513): n is either a, c, g or t
  misc_feature (530)..(530): n is either a, c, g or t
tttttcggtacgtttttttggttgtttttgtaattcgacggtagcgtgtcgtttatcgagttggtggattaggcgtggtagtagggtttaatcgaatttgattcgcgtgacgatttttttggtaaagacgtgatgcgtaagttggtgattttggcgcgtgaagtaggttataatatcgaatcggattaggtacgtgtggaatcgttggtgtttgtttattgcgaaggcggtagtatcgattatttttttgaaaatggcgatgaattgaacgagtagatggtgtaacggttggaagcggttcgcgaaatggggttggtgttgcgttacgtggcgcgtttcgatgttaacggtaaagcgcgtgtaggcgtggaagcggtgcgtgaagattattcgttggtattattgttgtcgtgcgataacgtttttgttatcgaaagtcgttggtatcgcgataattttttggtgattcgcggatttggcgttgggcgcgacgttatcgtcggggcgatttangtcgatattaatcgttngtatagttgttgtaatttagaaattaataatgttcgtatttatgt

SEQ ID NO: 13338 - DNA, 575 bp, Artificial Sequence
  chemically treated genomic DNA (Homo sapiens) CpG-island No: 13338
  misc_feature (46)..(46): n is either a, c, g or t
  misc_feature (63)..(63): n is either a, c, g or t
acataaatacgaacattattaatttctaaattacaacaactatacnaacgattaatatcgacntaaatcgccccgacgataacgtcgcgcccaacgccaaatccgcgaatcaccaaaaaattatcgcgataccaacgactttcgataacaaaaacgttatcgcacgacaacaataataccaacgaataatcttcacgcaccgcttccacgcctacacgcgctttaccgttaacatcgaaacgcgccacgtaacgcaacaccaaccccatttcgcgaaccgcttccaaccgttacaccatctactcgttcaattcatcgccattttcaaaaaaataatcgatactaccgccttcgcaataaacaaacaccaacgattccacacgtacctaatccgattcgatattataacctacttcacgcgccaaaatcaccaacttacgcatcacgtctttaccaaaaaaatcgtcacgcgaatcaaattcgattaaaccctactaccacgcctaatccaccaactcgataaacgacacgctaccgtcgaattacaaaaacaaccaaaaaaacgtaccgaaaaa

SEQ ID NO: 13339 - DNA, 575 bp, Artificial Sequence
  chemically treated genomic DNA (Homo sapiens) CpG-island No: 13339
  misc_feature (46)..(46): n is either a, c, g or t
  misc_feature (63)..(63): n is either a, c, g or t
atatgagtacgggtattattaatttttgaattataataattgtgtnagcggttgatatcgatntgaatcgtttcggcggtgacgtcgcgtttagcgttaggttcgcggattattagagggttatcgcgatattagcggttttcgatggtaaagacgttatcgtacggtagtagtgatgttaacggatgatttttacgtatcgtttttacgtttatacgcgttttatcgttggtatcgaaacgcgttacgtagcgtagtattagttttatttcgcgggtcgtttttagtcgttgtattatttgttcgtttagtttatcgttatttttaaagaaatggtcgatgttgtcgttttcgtaatgagtaggtattagcgattttatacgtatttgattcggttcgatgttgtaatttgttttacgcgttagaattattagtttgcgtattacgtttttgttagagagatcgttacgcgggttaggttcggttaagttttgttgttacgtttgatttattagttcggtaaacggtacgttatcgtcgaattgtaggaatagttaggagagcgtgtcggagaa

SEQ ID NO: 13340 - DNA, 575 bp, Artificial Sequence
  chemically treated genomic DNA (Homo sapiens) CpG-island No: 13340
  misc_feature (513)..(513): n is either a, c, g or t
  misc_feature (530)..(530): n is either a, c, g or t
ttctccgacacgctctcctaactattcctacaattcgacgataacgtaccgtttaccgaactaataaatcaaacgtaacaacaaaacttaaccgaacctaacccgcgtaacgatctctctaacaaaaacgtaatacgcaaactaataattctaacgcgtaaaacaaattacaacatcgaaccgaatcaaatacgtataaaatcgctaatacctactcattacgaaaacgacaacatcgaccatttctttaaaaataacgataaactaaacgaacaaataatacaacgactaaaaacgacccgcgaaataaaactaatactacgctacgtaacgcgtttcgataccaacgataaaacgcgtataaacgtaaaaacgatacgtaaaaatcatccgttaacatcactactaccgtacgataacgtctttaccatcgaaaaccgctaatatcgcgataaccctctaataatccgcgaacctaacgctaaacgcgacgtcaccgccgaaacgattcanatcgatatcaaccgctnacacaattattataattcaaaaattaataatacccgtactcatat

SEQ ID NO: 13341 - DNA, 521 bp, Artificial Sequence
  chemically treated genomic DNA (Homo sapiens) CpG-island No: 13341
gtggtttaaatagatttcggcgttgatttcgttgaagaaatcggtttgatttttatcgaaaacgcgattttgaaagcgcgttatgcggtaaaagtgatcgttttatcggtaattgtcgacgattttggtttggcggtagatgtgtttggcggcgcgtcgggtatttatttcgcgcgttatttcggtgaagacgcgatcgattaaaagaatttgtaaaaattgttggaaataatgaaagacgtatcggacgattaacgttaggcgcgtttttattgcgtgttggtatatttgcgttacgcggaagattttatttcgttggtatgttacggtaattggtcgggcgtgattattcgtgaattagcgggtattggtggttttggttatgatttaatttttttcgtatttttcgaaggaaaatcgtcgtcgaattgattcgcgaagaaaagagcgttattttttatcgtgggttaggcgttgaaattgttgttggacgttttacgtaataaaaatgatcgttttgt

SEQ ID NO: 13342 - DNA, 521 bp, Artificial Sequence
  chemically treated genomic DNA (Homo sapiens) CpG-island No: 13342
acaaaacgatcatttttattacgtaaaacgtccaacaacaatttcaacgcctaacccacgataaaaaataacgctcttttcttcgcgaatcaattcgacgacgattttccttcgaaaaatacgaaaaaaattaaatcataaccaaaaccaccaatacccgctaattcacgaataatcacgcccgaccaattaccgtaacataccaacgaaataaaatcttccgcgtaacgcaaatataccaacacgcaataaaaacgcgcctaacgttaatcgtccgatacgtctttcattatttccaacaatttttacaaattcttttaatcgatcgcgtcttcaccgaaataacgcgcgaaataaatacccgacgcgccgccaaacacatctaccgccaaaccaaaatcgtcgacaattaccgataaaacgatcacttttaccgcataacgcgctttcaaaatcgcgttttcgataaaaatcaaaccgatttcttcaacgaaatcaacgccgaaatctatttaaaccac

SEQ ID NO: 13343 - DNA, 521 bp, Artificial Sequence
  chemically treated genomic DNA (Homo sapiens) CpG-island No: 13343
ataaaacggttatttttattacgtaaagcgtttagtagtagttttaacgtttgatttacggtgggaaatggcgttttttttttcgcgggttagttcggcggcggttttttttcggaaggtacgaagaagattggattataattaaagttattagtgttcgttggtttacgaataattacgttcggttagttatcgtggtatattagcggagtgggatttttcgcgtgacgtagatatattagtacgtagtggaaacgcgtttgacgttggtcgttcggtacgttttttattgtttttagtagtttttgtagatttttttgatcggtcgcgtttttatcggaataacgcgcggagtaaatgttcggcgcgtcgttaagtatatttatcgttagattagagtcgtcggtaattgtcggtaaagcggttatttttgtcgtatggcgcgtttttagaatcgcgttttcgataaaggttaggtcggtttttttagcggaattaacgtcgaggtttgtttgggttat

SEQ ID NO: 13344 - DNA, 521 bp, Artificial Sequence
  chemically treated genomic DNA (Homo sapiens) CpG-island No: 13344
ataacccaaacaaacctcgacgttaattccgctaaaaaaaccgacctaacctttatcgaaaacgcgattctaaaaacgcgccatacgacaaaaataaccgctttaccgacaattaccgacgactctaatctaacgataaatatacttaacgacgcgccgaacatttactccgcgcgttattccgataaaaacgcgaccgatcaaaaaaatctacaaaaactactaaaaacaataaaaaacgtaccgaacgaccaacgtcaaacgcgtttccactacgtactaatatatctacgtcacgcgaaaaatcccactccgctaatataccacgataactaaccgaacgtaattattcgtaaaccaacgaacactaataactttaattataatccaatcttcttcgtaccttccgaaaaaaaaccgccgccgaactaacccgcgaaaaaaaaaacgccatttcccaccgtaaatcaaacgttaaaactactactaaacgctttacgtaataaaaataaccgttttat

SEQ ID NO: 13345 - DNA, 711 bp, Artificial Sequence
  chemically treated genomic DNA (Homo sapiens) CpG-island No: 13345
gtattcggtttttcgtttggtcgaatacgatgttcgtcgtcgatttaaatatttcgttcgttatttttatttcgtcgtgtagatcgaattttttcgttatttgtttgtcgagcgtagtttggtcgttatggaacgtcggtagatagtgtaggaattttacgttcgggttgtcggttagcgttattatttgcgcgtttatttgatattcgcgtatagcgtaattcgttttgtttatttttttttggtttcgtttatcgatatttatacgtcggtatagataaagttcgcgtttttaacgtttgtcgttacgtttttcgttagagtaattttttcgtcgtgttttttcgttagcgcgttgtatttcgttattaggttttttttcggttagtaggttttcggggttaataggcgtagatttagttcggttagcgtcgtcgtttttagtatcgagttgtttatgttgttgcgcgtatcgttcgcgtagattagcgttatttcgttaaacgttttgttcggtaggtgtttttgtatggttattaggttcgttagtagttgggtcgggtggaattcgttggttagttcgttttatatcggtacgttcgtatatttgcgtacggatttcgatatttttttggcgtgatcgcgatattgaatgtagttatatattcgttcgagaaatcgcgcggtgtttttaattgattttttatgtta

SEQ ID NO: 13346 - DNA, 711 bp, Artificial Sequence
  chemically treated genomic DNA (Homo sapiens) CpG-island No: 13346
taacataaaaaatcaattaaaaacaccgcgcgatttctcgaacgaatatataactacattcaatatcgcgatcacgccaaaaaaatatcgaaatccgtacgcaaatatacgaacgtaccgatataaaacgaactaaccaacgaattccacccgacccaactactaacgaacctaataaccatacaaaaacacctaccgaacaaaacgtttaacgaaataacgctaatctacgcgaacgatacgcgcaacaacataaacaactcgatactaaaaacgacgacgctaaccgaactaaatctacgcctattaaccccgaaaacctactaaccgaaaaaaaacctaataacgaaatacaacgcgctaacgaaaaaacacgacgaaaaaattactctaacgaaaaacgtaacgacaaacgttaaaaacgcgaactttatctataccgacgtataaatatcgataaacgaaaccaaaaaaaaataaacaaaacgaattacgctatacgcgaatatcaaataaacgcgcaaataataacgctaaccgacaacccgaacgtaaaattcctacactatctaccgacgttccataacgaccaaactacgctcgacaaacaaataacgaaaaaattcgatctacacgacgaaataaaaataacgaacgaaatatttaaatcgacgacgaacatcgtattcgaccaaacgaaaaaccgaatac

SEQ ID NO: 13347 - DNA, 711 bp, Artificial Sequence
  chemically treated genomic DNA (Homo sapiens) CpG-island No: 13347
tggtataaagagttaattaaggatatcgcgcggtttttcgggcggatgtatgattgtatttagtatcgcggttacgttagaaaagtgtcgaaattcgtgcgtaagtatgcgggcgtgtcggtgtggaacgggttgattaacgagttttattcgatttagttgttggcggatttgatgattatgtaggagtatttgtcgggtaaggcgtttaacgagatgacgttggtttacgcgggcgatgcgcgtaataatatgggtaattcgatgttggaagcggcggcgttgatcgggttggatttgcgtttgttggtttcgaaagtttgttggtcggaagagagtttggtggcggagtgtagcgcgttggcggagaagtacggcgggaaaattattttgacggaagacgtggcggtaggcgttaagggcgcggattttatttatatcgacgtgtgggtgtcgatgggcgaggttaaagagaagtgggtagagcggattgcgttgtgcgcgggtattaggtgaacgcgtagatgatggcgttgatcgataattcgaacgtgaagtttttgtattgtttgtcggcgttttatgacgattagattacgttcggtaagtagatggcgaaggagttcgatttgtacggcgggatggaggtgacggacgaggtgtttgagtcggcggcgagtatcgtgttcgattaggcggaaaatcggatgt

SEQ ID NO: 13348 - DNA, 711 bp, Artificial Sequence
  chemically treated genomic DNA (Homo sapiens) CpG-island No: 13348
acatccgattttccgcctaatcgaacacgatactcgccgccgactcaaacacctcgtccgtcacctccatcccgccgtacaaatcgaactccttcgccatctacttaccgaacgtaatctaatcgtcataaaacgccgacaaacaatacaaaaacttcacgttcgaattatcgatcaacgccatcatctacgcgttcacctaatacccgcgcacaacgcaatccgctctacccacttctctttaacctcgcccatcgacacccacacgtcgatataaataaaatccgcgcccttaacgcctaccgccacgtcttccgtcaaaataattttcccgccgtacttctccgccaacgcgctacactccgccaccaaactctcttccgaccaacaaactttcgaaaccaacaaacgcaaatccaacccgatcaacgccgccgcttccaacatcgaattacccatattattacgcgcatcgcccgcgtaaaccaacgtcatctcgttaaacgccttacccgacaaatactcctacataatcatcaaatccgccaacaactaaatcgaataaaactcgttaatcaacccgttccacaccgacacgcccgcatacttacgcacgaatttcgacacttttctaacgtaaccgcgatactaaatacaatcatacatccgcccgaaaaaccgcgcgatatccttaattaactctttatacca

SEQ ID NO: 13349 - DNA, 792 bp, Artificial Sequence
  chemically treated genomic DNA (Homo sapiens) CpG-island No: 13349
tttttttcgggttgcgcgattttcgcgttttcggatgcgggtgcgagttttcgttttgtttcgtatttagttttcggcgttattatacgtttttggttttcgttttggtttgtcgtttttttcggggtcgggcgtttttttcgaggcgagattcgtcggtaattgggaaggggggtttttataaatttgatcgtaagtttagcgtcgattttcggtagggcgcgcggggtaggcggaggagaggtcgttgttcgtattttttgttatcgtcgttttaattgagtcggtaggaaaagttttttcgacgagggtaggcgtgttttttttatttaggggaggcgcgggttcggtagttttcgggtcggggtcgcgtagttaggttagagaagcggaggggaaaggaataagatcgcgaggagttaagttttataatttttgggcgggacggtcgggttcgttttcgcggtatcggtatcgttttcgtttatttcgattgagttttttcgtgttgttgtcgtcgtcgtcgtcgacgttgcggttgggtcgatgtgtatttcggatttcggggtttacggattgatgagtttttttagagttagcgttcgttcgttagattttttcgtttttcgtcgtttttattttttttttttcggatttaggtttcgcggggaggcgtagggggcgggcggcggtaacgcggaaagaaggaaaaggagagtagggaggaaaggatcgttttcggagagaagttcgttttagttgtagtcgttagttttttttttttttttcgtt

SEQ ID NO: 13350 - DNA, 792 bp, Artificial Sequence
  chemically treated genomic DNA (Homo sapiens) CpG-island No: 13350
aacgaaaaaaaaaaaaaaaactaacgactacaactaaaacgaacttctctccgaaaacgatcctttcctccctactctccttttccttctttccgcgttaccgccgcccgccccctacgcctccccgcgaaacctaaatccgaaaaaaaaaaaataaaaacgacgaaaaacgaaaaaatctaacgaacgaacgctaactctaaaaaaactcatcaatccgtaaaccccgaaatccgaaatacacatcgacccaaccgcaacgtcgacgacgacgacgacaacaacacgaaaaaactcaatcgaaataaacgaaaacgataccgataccgcgaaaacgaacccgaccgtcccgcccaaaaattataaaacttaactcctcgcgatcttattcctttcccctccgcttctctaacctaactacgcgaccccgacccgaaaactaccgaacccgcgcctcccctaaataaaaaaaacacgcctaccctcgtcgaaaaaacttttcctaccgactcaattaaaacgacgataacaaaaaatacgaacaacgacctctcctccgcctaccccgcgcgccctaccgaaaatcgacgctaaacttacgatcaaatttataaaaaccccccttcccaattaccgacgaatctcgcctcgaaaaaaacgcccgaccccgaaaaaaacgacaaaccaaaacgaaaaccaaaaacgtataataacgccgaaaactaaatacgaaacaaaacgaaaactcgcacccgcatccgaaaacgcgaaaatcgcgcaacccgaaaaaaa

SEQ ID NO: 13351 - DNA, 792 bp, Artificial Sequence
  chemically treated genomic DNA (Homo sapiens) CpG-island No: 13351
ggcgggaaagagggagggggttagcggttgtagttggagcgggttttttttcggggacggtttttttttttttgtttttttttttttttttttcgcgttgtcgtcgttcgttttttgcgttttttcgcggagtttgggttcgggagggggaaggtaggggcggcggggggcgggagagtttggcgagcggacgttagttttgaggaaatttattaattcgtgagtttcggagttcggggtgtatatcggtttagtcgtagcgtcggcggcggcggcggtagtagtacgaaggggtttagtcggggtaggcgggggcggtgtcggtgtcgcgggggcgggttcgatcgtttcgtttagaagttgtagggtttggtttttcgcgattttgtttttttttttttcgtttttttgatttagttgcgcggtttcggttcgggagttgtcgaattcgcgttttttttgggtgaggaggatacgtttgttttcgtcgagaaaattttttttgtcgatttagttggggcggcggtggtaggaagtgcgggtagcgatttttttttcgtttgtttcgcgcgttttgtcggaggtcggcgttgagtttgcgattaagtttgtgggggtttttttttttagttgtcggcgagtttcgtttcgagaggggcgttcgatttcggggagggcggtaggttagggcgaaggttaagggcgtgtggtggcgtcggagattaggtgcggagtaaggcggggattcgtattcgtattcgagagcgcggaggtcgcgtagttcgggagaag

SEQ ID NO: 13352 - DNA, 792 bp, Artificial Sequence
  chemically treated genomic DNA (Homo sapiens) CpG-island No: 13352
cttctcccgaactacgcgacctccgcgctctcgaatacgaatacgaatccccgccttactccgcacctaatctccgacgccaccacacgcccttaaccttcgccctaacctaccgccctccccgaaatcgaacgcccctctcgaaacgaaactcgccgacaactaaaaaaaaaaacccccacaaacttaatcgcaaactcaacgccgacctccgacaaaacgcgcgaaacaaacgaaaaaaaaatcgctacccgcacttcctaccaccgccgccccaactaaatcgacaaaaaaaattttctcgacgaaaacaaacgtatcctcctcacccaaaaaaaacgcgaattcgacaactcccgaaccgaaaccgcgcaactaaatcaaaaaaacgaaaaaaaaaaaaacaaaatcgcgaaaaaccaaaccctacaacttctaaacgaaacgatcgaacccgcccccgcgacaccgacaccgcccccgcctaccccgactaaaccccttcgtactactaccgccgccgccgccgacgctacgactaaaccgatatacaccccgaactccgaaactcacgaattaataaatttcctcaaaactaacgtccgctcgccaaactctcccgccccccgccgcccctaccttccccctcccgaacccaaactccgcgaaaaaacgcaaaaaacgaacgacgacaacgcgaaaaaaaaaaaaaaaaaaacaaaaaaaaaaaaaccgtccccgaaaaaaaacccgctccaactacaaccgctaaccccctccctctttcccgcc

SEQ ID NO: 13353 - DNA, 634 bp, Artificial Sequence
  chemically treated genomic DNA (Homo sapiens) CpG-island No: 13353
tcgtcgtcgttcggtttcgtcggtcgtgcgtttcgcggcgttcgtcgttcgttacgtcgtcgtttacggtgcggtttcgttcggcgcgtggggggttcgacgtttacgcggtcgtcgcgcgtagtagtattcgcggtacgttttttgatcggtcgtcgtaatcgtcgcgtacgttgtttagcgtcgcgtcggtatatcgcggagcgtttttatcgcgtaggcgcgtcggttcgtcgattatcgcgtcgttatcgcgtcggagcgcgtcgtgtacggcgagcggcgcgtatcgagacggtcgcgtcggtgcggcgcgtcgcgcgatcgcgtcgtcgtaggcgcgttcgttcgcgtttttttcgttattcgtcggtcgttcgttggcgggtcgtatagttcgtttttgcgttcgatagcgcgtcgttttcgtcgtttacgtcgtatcgtagcgtttagtcgttatatcgttcgtcgtttcgtatttattcgatacgtttttaacgttttcgttacgtcggtttcgtcggtcgtttcgttgtacggcgtacgttcgcgcgtagcgatagttatggagattttttgttttttagaaaaatattttatgttttggtatgaaattgttaaggaaaataat

SEQ ID NO: 13354 - DNA, 634 bp, Artificial Sequence
  chemically treated genomic DNA (Homo sapiens) CpG-island No: 13354
attattttccttaacaatttcataccaaaacataaaatatttttctaaaaaacaaaaaatctccataactatcgctacgcgcgaacgtacgccgtacaacgaaacgaccgacgaaaccgacgtaacgaaaacgttaaaaacgtatcgaataaatacgaaacgacgaacgatataacgactaaacgctacgatacgacgtaaacgacgaaaacgacgcgctatcgaacgcaaaaacgaactatacgacccgccaacgaacgaccgacgaataacgaaaaaaacgcgaacgaacgcgcctacgacgacgcgatcgcgcgacgcgccgcaccgacgcgaccgtctcgatacgcgccgctcgccgtacacgacgcgctccgacgcgataacgacgcgataatcgacgaaccgacgcgcctacgcgataaaaacgctccgcgatataccgacgcgacgctaaacaacgtacgcgacgattacgacgaccgatcaaaaaacgtaccgcgaatactactacgcgcgacgaccgcgtaaacgtcgaaccccccacgcgccgaacgaaaccgcaccgtaaacgacgacgtaacgaacgacgaacgccgcgaaacgcacgaccgacgaaaccgaacgacgacga

SEQ ID NO: 13355 - DNA, 634 bp, Artificial Sequence
  chemically treated genomic DNA (Homo sapiens) CpG-island No: 13355
gttgttttttttggtaattttatgttaaaatatagaatgtttttttgggggataagagatttttataattatcgttgcgcgcgggcgtgcgtcgtgtagcgggacggtcggcggggtcggcgtggcgggggcgttgagggcgtgtcgggtgggtgcggggcggcgggcggtgtggcggttgggcgttgcggtgcggcgtgggcggcgggggcggcgcgttgtcggacgtaggggcgggttgtgcggttcgttagcgggcggtcggcgggtagcggggggggcgcgggcgggcgcgtttgcggcggcgcggtcgcgcggcgcgtcgtatcggcgcggtcgtttcggtgcgcgtcgttcgtcgtgtacggcgcgtttcgacgcggtggcggcgcggtggtcggcgggtcggcgcgtttgcgcggtgggggcgtttcgcggtgtgtcggcgcggcgttggataacgtgcgcggcggttgcggcggtcggttagagggcgtgtcgcgagtgttgttgcgcgcggcggtcgcgtgggcgtcgggttttttacgcgtcgggcggggtcgtatcgtgggcggcggcgtggcgggcggcgggcgtcgcggagcgtacggtcggcgggatcgggcggcggcgg

SEQ ID NO: 13356 - DNA, 634 bp, Artificial Sequence
  chemically treated genomic DNA (Homo sapiens) CpG-island No: 13356
ccgccgccgcccgatcccgccgaccgtacgctccgcgacgcccgccgcccgccacgccgccgcccacgatacgaccccgcccgacgcgtaaaaaacccgacgcccacgcgaccgccgcgcgcaacaacactcgcgacacgccctctaaccgaccgccgcaaccgccgcgcacgttatccaacgccgcgccgacacaccgcgaaacgcccccaccgcgcaaacgcgccgacccgccgaccaccgcgccgccaccgcgtcgaaacgcgccgtacacgacgaacgacgcgcaccgaaacgaccgcgccgatacgacgcgccgcgcgaccgcgccgccgcaaacgcgcccgcccgcgccccccccgctacccgccgaccgcccgctaacgaaccgcacaacccgcccctacgtccgacaacgcgccgcccccgccgcccacgccgcaccgcaacgcccaaccgccacaccgcccgccgccccgcacccacccgacacgccctcaacgcccccgccacgccgaccccgccgaccgtcccgctacacgacgcacgcccgcgcgcaacgataattataaaaatctcttatcccccaaaaaaacattctatattttaacataaaattaccaaaaaaaacaac

SEQ ID NO: 13357 - DNA, 677 bp, Artificial Sequence
  chemically treated genomic DNA (Homo sapiens) CpG-island No: 13357
tggcggtcgtttttgtttcgttttacgggcggggtcgattttcgtttttgcgttgtgtttgtttgtcgggcgtagtgtgttatggttttcgtttcgatttcggtagtcgttagatttttttcggtggagacgttttcgttttgatttgcgtcggtcgttttgttaggttttgtattttgattgtaagacgttgtttgtggtttttacggtatcgttttattagcgtattgtgttcgtttattacgtttaacggtgtacgtgttttgtcgtttacgttttagttagcgattgcgagcgcgtttgtgcgtttttcggttagcgatcggtgagtgtgcgtttcgttttggttttcgatcgagcgatcggtttgggcgttgttgtcgagttagttggtattcgcgtttttgtattttgttgttggtggtacggttatgcggcgttgtagtttcgatgatgtgtttgttgtgtattttttttcgttgtcgttagcgtttcgcgcgtgggtttgttttgtgggttcgttttgttgttagtcgttacgttgcgaggtattatgttgcggtgttaggttgttttgtgttgcgagttgttgatgtgattggtgtgtatcgtatacgttatgagatattggtggttgtattttaagttcgttgagtagtgagatgtgtgtgatttgt

SEQ ID NO: 13358 - DNA, 677 bp, Artificial Sequence
  chemically treated genomic DNA (Homo sapiens) CpG-island No: 13358
acaaatcacacacatctcactactcaacgaacttaaaatacaaccaccaatatctcataacgtatacgatacacaccaatcacatcaacaactcgcaacacaaaacaacctaacaccgcaacataatacctcgcaacgtaacgactaacaacaaaacgaacccacaaaacaaacccacgcgcgaaacgctaacgacaacgaaaaaaaatacacaacaaacacatcatcgaaactacaacgccgcataaccgtaccaccaacaacaaaatacaaaaacgcgaataccaactaactcgacaacaacgcccaaaccgatcgctcgatcgaaaaccaaaacgaaacgcacactcaccgatcgctaaccgaaaaacgcacaaacgcgctcgcaatcgctaactaaaacgtaaacgacaaaacacgtacaccgttaaacgtaataaacgaacacaatacgctaataaaacgataccgtaaaaaccacaaacaacgtcttacaatcaaaatacaaaacctaacaaaacgaccgacgcaaatcaaaacgaaaacgtctccaccgaaaaaaatctaacgactaccgaaatcgaaacgaaaaccataacacactacgcccgacaaacaaacacaacgcaaaaacgaaaatcgaccccgcccgtaaaacgaaacaaaaacgaccgcca

SEQ ID NO: 13359 - DNA, 677 bp, Artificial Sequence
  chemically treated genomic DNA (Homo sapiens) CpG-island No: 13359
atagattatatatattttattgtttagcgagtttagagtatagttattaatgttttatggcgtatgcgatgtatattaattatattagtagttcgtaatataagataatttagtatcgtagtatgatatttcgtaacgtggcgattagtagtagagcgagtttataaaataagtttacgcgcgaaacgttgacgatagcgaagaggaatgtatagtagatatattatcgaggttgtagcgtcgtatggtcgtattattagtagtaagatgtaaaggcgcgagtgttagttagttcgatagtagcgtttagatcgatcgttcgatcgagagttaaagcgaagcgtatatttatcggtcgttgatcgagagacgtatagacgcgttcgtagtcgttgattaggacgtgggcgatagggtacgtatatcgttagacgtagtgaacgagtatagtgcgttgatagagcgatgtcgtgaaagttatagatagcgttttgtaattaagatgtaagatttgataggacggtcggcgtaggttaggacgagagcgtttttatcggggagaatttagcggttgtcgagatcgggacgaaaattatgatatattgcgttcgataagtaagtataacgtagagacgggagtcgatttcgttcgtggagcgaggtagagacgatcgtta

SEQ ID NO: 13360 - DNA, 677 bp, Artificial Sequence
  chemically treated genomic DNA (Homo sapiens) CpG-island No: 13360
taacgatcgtctctacctcgctccacgaacgaaatcgactcccgtctctacgttatacttacttatcgaacgcaatatatcataattttcgtcccgatctcgacaaccgctaaattctccccgataaaaacgctctcgtcctaacctacgccgaccgtcctatcaaatcttacatcttaattacaaaacgctatctataactttcacgacatcgctctatcaacgcactatactcgttcactacgtctaacgatatacgtaccctatcgcccacgtcctaatcaacgactacgaacgcgtctatacgtctctcgatcaacgaccgataaatatacgcttcgctttaactctcgatcgaacgatcgatctaaacgctactatcgaactaactaacactcgcgcctttacatcttactactaataatacgaccatacgacgctacaacctcgataatatatctactatacattcctcttcgctatcgtcaacgtttcgcgcgtaaacttattttataaactcgctctactactaatcgccacgttacgaaatatcatactacgatactaaattatcttatattacgaactactaatataattaatatacatcgcatacgccataaaacattaataactatactctaaactcgctaaacaataaaatatatataatctat

SEQ ID NO: 13361 - DNA, 522 bp, Artificial Sequence
  chemically treated genomic DNA (Homo sapiens) CpG-island No: 13361
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgtaatattgttgaagtcgtcggtagtgatcggttagtgtaggggtttagcgattataggagtttagggcgaacgtgaaacggagttttttttcgggattacggagaattcgaattcgtcgagtaattttttgaatgtattagtacggttattttgcggatgtgtcgaataatggggacgtaggttcggttagaaagcgtatcgggtatagcggtattcgtgggagatcgggattataagacgatatcgaagagttacgcgcggttaaaatatgaatattaagggtaagaattatataaggaaggggattatacgggtaaagtagggacgaaagtaattacgaggttttttataagtgaa

SEQ ID NO: 13362 - DNA, 522 bp, Artificial Sequence
  chemically treated genomic DNA (Homo sapiens) CpG-island No: 13362
ttcacttataaaaaacctcgtaattactttcgtccctactttacccgtataatccccttccttatataattcttacccttaatattcatattttaaccgcgcgtaactcttcgatatcgtcttataatcccgatctcccacgaataccgctatacccgatacgctttctaaccgaacctacgtccccattattcgacacatccgcaaaataaccgtactaatacattcaaaaaattactcgacgaattcgaattctccgtaatcccgaaaaaaaactccgtttcacgttcgccctaaactcctataatcgctaaacccctacactaaccgatcactaccgacgacttcaacaatattacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 13363 - DNA, 522 bp, Artificial Sequence
  chemically treated genomic DNA (Homo sapiens) CpG-island No: 13363
tttatttgtgaggagtttcgtggttattttcgtttttgttttgttcgtgtggtttttttttttatgtggtttttatttttggtgtttatattttagtcgcgcgtggtttttcgatgtcgttttgtgatttcggttttttacgggtatcgttatgttcgatgcgttttttggtcggatttgcgtttttattgttcggtatattcgtagggtggtcgtattggtgtatttagggagttgttcgacgggttcgagtttttcgtgatttcggagagagatttcgttttacgttcgttttggatttttgtgatcgttgagtttttgtattggtcggttattatcggcggttttaatagtgttatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 13364 - DNA, 522 bp, Artificial Sequence
  chemically treated genomic DNA (Homo sapiens) CpG-island No: 13364
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactataacactattaaaaccgccgataataaccgaccaatacaaaaactcaacgatcacaaaaatccaaaacgaacgtaaaacgaaatctctctccgaaatcacgaaaaactcgaacccgtcgaacaactccctaaatacaccaatacgaccaccctacgaatataccgaacaataaaaacgcaaatccgaccaaaaaacgcatcgaacataacgatacccgtaaaaaaccgaaatcacaaaacgacatcgaaaaaccacgcgcgactaaaatataaacaccaaaaataaaaaccacataaaaaaaaaaaccacacgaacaaaacaaaaacgaaaataaccacgaaactcctcacaaataaa

SEQ ID NO: 13365 - DNA, 526 bp, Artificial Sequence
  chemically treated genomic DNA (Homo sapiens) CpG-island No: 13365
ttgtttcgtgttaaggtttgtgttgtgttagtggtgggtttcgtggcggtggtcggtggttggtcgggttatgtggtgggtggttaggggggtatgtttgtgtgcgtatgttgttttttttgtatgttttgtaattgttcgtggatttgggttcggtttggggtcgatttttgtgcggtttttcgtttggtggtgttttgggcggtcgtttgtggcgtgtttatttgtttgtggtgtgttttgtgtgtggtagtgttgtgtcgtttgtgtgtttcgtgttgtcgttttcgtatgcgcggtgggttgttttatgtgtggtgtatggtgtttgcgtgtgtcggattcggttggtttttgtcgtttgttgttttgtgggagtgtggggagtcgtgggggtgcggggtgcgggtgttgtttgttcgtgtggcgttgtcgtgtgcgatgtttttgttgtgggtcgttggatgtgtggtgagttgtgtgtgttgtttgtggtttggtgtggtttggttttggtgttttgttt

SEQ ID NO: 13366 - DNA, 526 bp, Artificial Sequence
  chemically treated genomic DNA (Homo sapiens) CpG-island No: 13366
aaacaaaacaccaaaaccaaaccacaccaaaccacaaacaacacacacaactcaccacacatccaacgacccacaacaaaaacatcgcacacgacaacgccacacgaacaaacaacacccgcaccccgcacccccacgactccccacactcccacaaaacaacaaacgacaaaaaccaaccgaatccgacacacgcaaacaccatacaccacacataaaacaacccaccgcgcatacgaaaacgacaacacgaaacacacaaacgacacaacactaccacacacaaaacacaccacaaacaaataaacacgccacaaacgaccgcccaaaacaccaccaaacgaaaaaccgcacaaaaatcgaccccaaaccgaacccaaatccacgaacaattacaaaacatacaaaaaaaacaacatacgcacacaaacatacccccctaaccacccaccacataacccgaccaaccaccgaccaccgccacgaaacccaccactaacacaacacaaaccttaacacgaaacaa

SEQ ID NO: 13367 - DNA, 526 bp, Artificial Sequence
  chemically treated genomic DNA (Homo sapiens) CpG-island No: 13367
agatagagtattaaaattagattatattagattataaatagtatatatagtttattatatatttaacgatttataatagagatatcgtatacggtaacgttatacgaataaataatattcgtatttcgtatttttacggttttttatatttttatagaataataagcgatagaaattagtcgaattcgatatacgtaaatattatatattatatatgagataatttatcgcgtatgcggaaacgatagtacggaatatataagcggtataatattgttatatatagaatatattataagtaaatagatacgttataggcgatcgtttagagtattattaggcgagagatcgtataaggatcgattttaagtcgaatttagatttacgaataattataggatatataaaaggaataatatacgtatataaatatatttttttggttatttattatatgattcggttaattatcggttatcgttacgggatttattattgatataatataaattttgatacgaaataa

SEQ ID NO: 13368 - DNA, 526 bp, Artificial Sequence
  chemically treated genomic DNA (Homo sapiens) CpG-island No: 13368
ttatttcgtatcaaaatttatattatatcaataataaatcccgtaacgataaccgataattaaccgaatcatataataaataaccaaaaaaatatatttatatacgtatattattccttttatatatcctataattattcgtaaatctaaattcgacttaaaatcgatccttatacgatctctcgcctaataatactctaaacgatcgcctataacgtatctatttacttataatatattctatatataacaatattataccgcttatatattccgtactatcgtttccgcatacgcgataaattatctcatatataatatataatatttacgtatatcgaattcgactaatttctatcgcttattattctataaaaatataaaaaaccgtaaaaatacgaaatacgaatattatttattcgtataacgttaccgtatacgatatctctattataaatcgttaaatatataataaactatatatactatttataatctaatataatctaattttaatactctatct

SEQ ID NO: 13369 - DNA, 621 bp, Artificial Sequence
  chemically treated genomic DNA (Homo sapiens) CpG-island No: 13369
agaggacgggttattggttcgtgggtacgcgtagggaatagtggagatttgttggggagataattttgggaagtatgtgcgtcgagggatgcggatgtagtcggtcgaatcggaagggtaaatttggattggaaatttcgagttattaacgggggatcggagtaatcggtttttttttttaatttttcgttgttttttacggggggttttaaagaagcgaaaatattattttttacgttgtttttatacggcgaatgtatttttatgcggaaaatttttttttttatttgggttaagaagattttggggtcgtattagcggcggcgcgtaaataattattgtggtggttaggtgaaaaagacgtattacgagtgaattcgcgtttgaaatttaatcgggcgaaaagtttttatacgaagcgtagatatttaattatatgggttatttttaaaatcgggggggatattatgtgacgaggtttcggtaatagtattaatcgtagttaatataggatagagacgacgatagaagttttattggggacgtacgtaatgaagtgaggggaggtataattaatagggaggcgttttgacggagagtaatttattttatagcgcgttt

SEQ ID NO: 13370 - DNA, 621 bp, Artificial Sequence
  chemically treated genomic DNA (Homo sapiens) CpG-island No: 13370
aaacgcgctataaaataaattactctccgtcaaaacgcctccctattaattatacctcccctcacttcattacgtacgtccccaataaaacttctatcgtcgtctctatcctatattaactacgattaatactattaccgaaacctcgtcacataatatcccccccgattttaaaaataacccatataattaaatatctacgcttcgtataaaaacttttcgcccgattaaatttcaaacgcgaattcactcgtaatacgtctttttcacctaaccaccacaataattatttacgcgccgccgctaatacgaccccaaaatcttcttaacccaaataaaaaaaaaaattttccgcataaaaatacattcgccgtataaaaacaacgtaaaaaataatattttcgcttctttaaaaccccccgtaaaaaacaacgaaaaattaaaaaaaaaaaccgattactccgatcccccgttaataactcgaaatttccaatccaaatttacccttccgattcgaccgactacatccgcatccctcgacgcacatacttcccaaaattatctccccaacaaatctccactattccctacgcgtacccacgaaccaataacccgtcctct

SEQ ID NO: 13371 - DNA, 621 bp, Artificial Sequence
  chemically treated genomic DNA (Homo sapiens) CpG-island No: 13371
gggcgcgttgtgaggtgagttgtttttcgttagggcgtttttttgttggttgtgtttttttttattttattgcgtgcgtttttagtggggtttttgtcgtcgtttttgttttgtgttggttacggttggtgttgttgtcggggtttcgttatatagtgtttttttcggttttggggatggtttatatgattggatgtttgcgtttcgtatggggatttttcgttcgattaaattttaagcgcgggtttattcgtggtgcgttttttttatttggttattatagtggttgtttacgcgtcgtcgttgatacggttttagagtttttttggtttaagtgggggagaaaatttttcgtatggaggtgtattcgtcgtgtagaggtaacgtaggaggtaatgttttcgtttttttggggtttttcgtggaagatagcgaggggttaaaaaaggggatcgattatttcggtttttcgttggtaattcggggtttttaatttaagtttgttttttcgattcggtcgattatattcgtatttttcggcgtatatattttttaaagttatttttttaataagtttttattgttttttacgcgtgtttacgaattagtggttcgtttttt

SEQ ID NO: 13372 - DNA, 621 bp, Artificial Sequence
  chemically treated genomic DNA (Homo sapiens) CpG-island No: 13372
aaaaaacgaaccactaattcgtaaacacgcgtaaaaaacaataaaaacttattaaaaaaataactttaaaaaatatatacgccgaaaaatacgaatataatcgaccgaatcgaaaaaacaaacttaaattaaaaaccccgaattaccaacgaaaaaccgaaataatcgatccccttttttaacccctcgctatcttccacgaaaaaccccaaaaaaacgaaaacattacctcctacgttacctctacacgacgaatacacctccatacgaaaaattttctcccccacttaaaccaaaaaaactctaaaaccgtatcaacgacgacgcgtaaacaaccactataataaccaaataaaaaaaacgcaccacgaataaacccgcgcttaaaatttaatcgaacgaaaaatccccatacgaaacgcaaacatccaatcatataaaccatccccaaaaccgaaaaaaacactatataacgaaaccccgacaacaacaccaaccgtaaccaacacaaaacaaaaacgacgacaaaaaccccactaaaaacgcacgcaataaaataaaaaaaaacacaaccaacaaaaaaacgccctaacgaaaaacaactcacctcacaacgcgccc

SEQ ID NO: 13373 - DNA, 913 bp, Artificial Sequence
  chemically treated genomic DNA (Homo sapiens) CpG-island No: 13373
ggcggcgcggaataaacgatataatttaggaaattagagaagttagtatacggaatatgttttttatcgaagaaggcgtaaatttcgttagatggcggtagttacggaagtcgagttttagaatatttagtagattttttagcggtttatttttcgggtagttgttttgttagagcgtttatgtattcgtacgggtaaacgtatattgtataaaatcgatatgttgttgggtggtgagcggtattaattttagtttaattttattatttattacgcgcgttatttgggtcgggaagacgtatttttgttgatcgcgtttaagtaatagatttattttttgtttttttagaatttgcgtttgatcgttgattttgatttttaaattatcgtcggagaaattttgaacggtatacgagaagaggtgattattttcgcgggtaattgtcgcgggtatcgttatttttacgcggtgcgatcggcgtatttgtttgttttttatcgatatcgtaattgcgtcgttaagaataattaggttgtagaatatttatattatattgacgattacggtgagtatttcggttggcgggttatagaagtagcgttagatgtttatcgtaacgtttattaggttgagtaggataaggaagatgtagggtcgcgagattatttagtcgacgtattttttttttattagtttatttttggcggtgacgttaaatttgtttttgtgcgggttaattagcgttattagcgtcggtggtgcgatatattacgttagtatcgtttcgtagattttattttagaaagagtggcgatatttgttttggattttggagttggttaggttggtatggattatatgcggtagtacgaatagggcgattattaacgttggcgtatagatgatgtatgt

SEQ ID NO: 13374 - DNA, 913 bp, Artificial Sequence
  chemically treated genomic DNA (Homo sapiens) CpG-island No: 13374
acatacatcatctatacgccaacgttaataatcgccctattcgtactaccgcatataatccataccaacctaaccaactccaaaatccaaaacaaatatcgccactctttctaaaataaaatctacgaaacgatactaacgtaatatatcgcaccaccgacgctaataacgctaattaacccgcacaaaaacaaatttaacgtcaccgccaaaaataaactaataaaaaaaaaatacgtcgactaaataatctcgcgaccctacatcttccttatcctactcaacctaataaacgttacgataaacatctaacgctacttctataacccgccaaccgaaatactcaccgtaatcgtcaatataatataaatattctacaacctaattattcttaacgacgcaattacgatatcgataaaaaacaaacaaatacgccgatcgcaccgcgtaaaaataacgatacccgcgacaattacccgcgaaaataatcacctcttctcgtataccgttcaaaatttctccgacgataatttaaaaatcaaaatcaacgatcaaacgcaaattctaaaaaaacaaaaaataaatctattacttaaacgcgatcaacaaaaatacgtcttcccgacccaaataacgcgcgtaataaataataaaattaaactaaaattaataccgctcaccacccaacaacatatcgattttatacaatatacgtttacccgtacgaatacataaacgctctaacaaaacaactacccgaaaaataaaccgctaaaaaatctactaaatattctaaaactcgacttccgtaactaccgccatctaacgaaatttacgccttcttcgataaaaaacatattccgtatactaacttctctaatttcctaaattatatcgtttattccgcgccgcc

SEQ ID NO: 13375 - DNA, 913 bp, Artificial Sequence
  chemically treated genomic DNA (Homo sapiens) CpG-island No: 13375
gtatatattatttatgcgttagcgttgatgatcgttttattcgtgttgtcgtatatgatttatgttagtttgattaattttaagatttagggtaaatatcgttattttttttggagtgaaatttacgaaacggtgttggcgtggtatatcgtattatcgacgttggtggcgttgattaattcgtataaaggtaaatttaacgttatcgttaaaggtggattggtggaagaagagtacgtcgattgggtgatttcgcggttttatattttttttgttttgtttaatttggtgggcgttgcggtaggtatttggcgttatttttatggttcgttaatcgagatgtttatcgtggtcgttagtatggtgtgggtgttttataatttgattgtttttggcggcgtagttgcggtatcggtagaaagtaaataggtacgtcgatcgtatcgcgtggagatgacgatgttcgcggtaattgttcgcgaagatggttattttttttcgtgtatcgtttaggattttttcgacggtggtttggggattaagattaacggttaggcgtagattttggaagggtagaaagtgaatttgttgtttaaacgcggttagtaggaatacgttttttcgatttaggtggcgcgcgtgatgggtaatgaagttgggttgaaattaatgtcgtttattatttagtaatatatcgattttgtgtagtgtacgtttgttcgtgcggatatatgggcgttttggtaggatagttattcggaagataagtcgttggaaagtttgttggatattttgaagttcggttttcgtggttatcgttatttggcggagtttgcgtttttttcggtgaagggtatatttcgtgtgttgatttttttggttttttgggttgtatcgtttatttcgcgtcgtt

SEQ ID NO: 13376 - DNA, 913 bp, Artificial Sequence
  chemically treated genomic DNA (Homo sapiens) CpG-island No: 13376
aacgacgcgaaataaacgatacaacccaaaaaaccaaaaaaatcaacacacgaaatatacccttcaccgaaaaaaacgcaaactccgccaaataacgataaccacgaaaaccgaacttcaaaatatccaacaaactttccaacgacttatcttccgaataactatcctaccaaaacgcccatatatccgcacgaacaaacgtacactacacaaaatcgatatattactaaataataaacgacattaatttcaacccaacttcattacccatcacgcgcgccacctaaatcgaaaaaacgtattcctactaaccgcgtttaaacaacaaattcactttctacccttccaaaatctacgcctaaccgttaatcttaatccccaaaccaccgtcgaaaaaatcctaaacgatacacgaaaaaaaataaccatcttcgcgaacaattaccgcgaacatcgtcatctccacgcgatacgatcgacgtacctatttactttctaccgataccgcaactacgccgccaaaaacaatcaaattataaaacacccacaccatactaacgaccacgataaacatctcgattaacgaaccataaaaataacgccaaatacctaccgcaacgcccaccaaattaaacaaaacaaaaaaaatataaaaccgcgaaatcacccaatcgacgtactcttcttccaccaatccacctttaacgataacgttaaatttacctttatacgaattaatcaacgccaccaacgtcgataatacgatataccacgccaacaccgtttcgtaaatttcactccaaaaaaaataacgatatttaccctaaatcttaaaattaatcaaactaacataaatcatatacgacaacacgaataaaacgatcatcaacgctaacgcataaataatatatac

SEQ ID NO: 13377 - DNA, 1034 bp, Artificial Sequence
  chemically treated genomic DNA (Homo sapiens) CpG-island No: 13377
atcgaattgatcggttattggatttgggaataggcgtaatagtggcgcgatgtaggtattgggtaggtggtttattatcgtagtcgtgacgcgtaggtcgtaggcgtggcgtggggcgaagcggatattatcgcgattaaacgttttttcgatatgggttttaaagttatcgttatcggaggtttggcgttggaagatttgtcgttgtttaagggtatttcgatttacgtttttatcgcgggtcgtagtattcgtgatgtcgttttttcggtggaagtcgtacgttagtttaaacgttttatcgttgaattgtggggttaaggagcggatatgttgtttaaataaatttcgtttggtatttatgaaaaagcgtttttcgtcggggagtgttggttggaacgtttgtaattggtaaaaacgttaggtttcgattttgtcgaaatgtcggtagatgaaattgacgatcgtttgtcgcgttttaattggagtcgcgagtagcgtttggcgttggttaatgcgattgttgaaatcggcgtgcgcgtgtcgtttatgtgtttttttgtttatcgtcgtttttcgttgggtagtgaagatgacgcggtgcgggcgtaggggttggagattatgcgtaaagttatttagttcgtttaggatgtcggtattcgcgtgatttagttggcgggttatgacgtttattattaggaagttaataacgaaacgcgtcgtcgttttcgtgacggtttgaaagagagcgttgagatggtaagtcgcgcgtaggtgacgttggcgatggagattatggattattcgttgatgagttttattagtaaggcgttgggatacgcgtattattttaataattcgtggttttagttttattcggatatcggtaatttgtcggcgtgggataacgatgtgtagatggagttgtaggtcggaatcgggtatatcgtcgcggtatatgtgaaagatattaaatttggcgtttttaaaaacgtgtcgtttggcgaaggtgtagtggatttcgaacgttg

SEQ ID NO: 13378 - DNA, 1034 bp, Artificial Sequence
  chemically treated genomic DNA (Homo sapiens) CpG-island No: 13378
caacgttcgaaatccactacaccttcgccaaacgacacgtttttaaaaacgccaaatttaatatctttcacatataccgcgacgatatacccgattccgacctacaactccatctacacatcgttatcccacgccgacaaattaccgatatccgaataaaactaaaaccacgaattattaaaataatacgcgtatcccaacgccttactaataaaactcatcaacgaataatccataatctccatcgccaacgtcacctacgcgcgacttaccatctcaacgctctctttcaaaccgtcacgaaaacgacgacgcgtttcgttattaacttcctaataataaacgtcataacccgccaactaaatcacgcgaataccgacatcctaaacgaactaaataactttacgcataatctccaacccctacgcccgcaccgcgtcatcttcactacccaacgaaaaacgacgataaacaaaaaaacacataaacgacacgcgcacgccgatttcaacaatcgcattaaccaacgccaaacgctactcgcgactccaattaaaacgcgacaaacgatcgtcaatttcatctaccgacatttcgacaaaatcgaaacctaacgtttttaccaattacaaacgttccaaccaacactccccgacgaaaaacgctttttcataaataccaaacgaaatttatttaaacaacatatccgctccttaaccccacaattcaacgataaaacgtttaaactaacgtacgacttccaccgaaaaaacgacatcacgaatactacgacccgcgataaaaacgtaaatcgaaatacccttaaacaacgacaaatcttccaacgccaaacctccgataacgataactttaaaacccatatcgaaaaaacgtttaatcgcgataatatccgcttcgccccacgccacgcctacgacctacgcgtcacgactacgataataaaccacctacccaatacctacatcgcgccactattacgcctattcccaaatccaataaccgatcaattcgat

SEQ ID NO: 13379 - DNA, 1034 bp, Artificial Sequence
  chemically treated genomic DNA (Homo sapiens) CpG-island No: 13379
taacgttcgaaatttattatattttcgttaaacggtacgtttttgaagacgttaggtttggtgttttttatatgtatcgcgacgatatgttcgatttcggtttgtaattttatttgtatatcgttgttttacgtcgataggttgtcgatattcgggtagagttggaattacggattgttgagatagtgcgcgtattttagcgttttgttgatggagtttattaacggataatttatgatttttatcgttagcgttatttgcgcgcggtttgttattttaacgtttttttttaggtcgttacggaaacgacgacgcgtttcgttattggttttttgatagtaaacgttatagttcgttagttggattacgcgaatatcgatattttgggcgaattggatagttttacgtataatttttagtttttgcgttcgtatcgcgttatttttattgtttagcgggaaacgacgatgagtagaaaggtatatggacggtacgcgtacgtcggttttaataatcgtattgattagcgttagacgttgttcgcggttttagttgaggcgcgataggcgatcgttagttttatttatcgatatttcgataaaatcgaagtttaacgtttttgttagttgtaggcgttttagttagtatttttcggcggggagcgtttttttatagatgttaagcgggatttgtttggataatatattcgttttttagttttatagtttagcgatggaacgtttgaattgacgtgcggtttttatcggagaagcggtattacggatattacggttcgcgataaagacgtgaatcggaatatttttgaatagcggtagattttttagcgttaggttttcggtgacggtgattttgaagtttatatcggaaagacgtttgatcgcggtgatgttcgtttcgttttacgttacgtttgcggtttgcgcgttacggttgcggtgataaattatttgtttaatgtttgtatcgcgttattgttgcgtttgtttttaggtttagtaatcggttagttcgat

SEQ ID NO: 13380 - DNA, 1034 bp, Artificial Sequence
  chemically treated genomic DNA (Homo sapiens) CpG-island No: 13380
atcgaactaaccgattactaaacctaaaaacaaacgcaacaataacgcgatacaaacattaaacaaataatttatcaccgcaaccgtaacgcgcaaaccgcaaacgtaacgtaaaacgaaacgaacatcaccgcgatcaaacgtctttccgatataaacttcaaaatcaccgtcaccgaaaacctaacgctaaaaaatctaccgctattcaaaaatattccgattcacgtctttatcgcgaaccgtaatatccgtaataccgcttctccgataaaaaccgcacgtcaattcaaacgttccatcgctaaactataaaactaaaaaacgaatatattatccaaacaaatcccgcttaacatctataaaaaaacgctccccgccgaaaaatactaactaaaacgcctacaactaacaaaaacgttaaacttcgattttatcgaaatatcgataaataaaactaacgatcgcctatcgcgcctcaactaaaaccgcgaacaacgtctaacgctaatcaatacgattattaaaaccgacgtacgcgtaccgtccatatacctttctactcatcgtcgtttcccgctaaacaataaaaataacgcgatacgaacgcaaaaactaaaaattatacgtaaaactatccaattcgcccaaaatatcgatattcgcgtaatccaactaacgaactataacgtttactatcaaaaaaccaataacgaaacgcgtcgtcgtttccgtaacgacctaaaaaaaaacgttaaaataacaaaccgcgcgcaaataacgctaacgataaaaatcataaattatccgttaataaactccatcaacaaaacgctaaaatacgcgcactatctcaacaatccgtaattccaactctacccgaatatcgacaacctatcgacgtaaaacaacgatatacaaataaaattacaaaccgaaatcgaacatatcgtcgcgatacatataaaaaacaccaaacctaacgtcttcaaaaacgtaccgtttaacgaaaatataataaatttcgaacgtta

SEQ ID NO: 13381 - DNA, 879 bp, Artificial Sequence
  chemically treated genomic DNA (Homo sapiens) CpG-island No: 13381
  misc_feature (64)..(64): n is either a, c, g or t
  misc_feature (115)..(115): n is either a, c, g or t
  misc_feature (156)..(156): n is either a, c, g or t
  misc_feature (280)..(280): n is either a, c, g or t
  misc_feature (307)..(307): n is either a, c, g or t
  misc_feature (316)..(316): n is either a, c, g or t
  misc_feature (389)..(389): n is either a, c, g or t
  misc_feature (391)..(391): n is either a, c, g or t
  misc_feature (585)..(585): n is either a, c, g or t
  misc_feature (599)..(600): n is either a, c, g or t
  misc_feature (716)..(716): n is either a, c, g or t
  misc_feature (734)..(734): n is either a, c, g or t
gttgtacgcggcgttttcgttagttttgtgggagatagtttttgggttttcgtttggttttagntttggttatttatattgaatatttcgcgtcgttagattgtcggttgggtgnacgagcgtcgcgttgtcgtcgttagtttagtgggttggttnttattttcgattgtgtttgttgatatttatttgtatttttcgttttcgcgatttttaggtgcggtattagagtcgttattgggatagacgatagcgttgtttaaggttataaattgcgatatangcgtagggtaagagttattcgcgtatnatttcgtanttaaggaagtgtttcgggggtgaagtaaatcggttatgtggatatacgtatatttaatttgtttgatcggttntntatacgcgtcgtaacggtaaagatatgtcgtttaagagaaattttcgtgagaattataagggttcgacgatttgttttggggtagttatttttatttatttaagcggtttttttggacgtttttttcgaaacgtagttaattttattattagaattcggtttcgttttcgatgtttagttattgtcgtggtganatcgattcgatcgnnggggttattattagcgaatattttttggttcggtttttttttttttttggcgatatgcgtcgtattttcggttgcggcgtttttttttgatttttcggattttttttgtttcggtntttgattttgcgaattanttttcggtgttcggtacgtgttttcgtttttttcgtatttcgcggagggaaaaatcgtttcggcggtatggcgagatatcgggagattcggtattttttttttttatatttttaaaattttaatgggtttttttttaatacgggt

SEQ ID NO: 13382 - DNA, 879 bp, Artificial Sequence
  chemically treated genomic DNA (Homo sapiens) CpG-island No: 13382
  misc_feature (146)..(146): n is either a, c, g or t
  misc_feature (164)..(164): n is either a, c, g or t
  misc_feature (280)..(281): n is either a, c, g or t
  misc_feature (295)..(295): n is either a, c, g or t
  misc_feature (489)..(489): n is either a, c, g or t
  misc_feature (491)..(491): n is either a, c, g or t
  misc_feature (564)..(564): n is either a, c, g or t
  misc_feature (573)..(573): n is either a, c, g or t
  misc_feature (600)..(600): n is either a, c, g or t
  misc_feature (724)..(724): n is either a, c, g or t
  misc_feature (765)..(765): n is either a, c, g or t
  misc_feature (816)..(816): n is either a, c, g or t
acccgtattaaaaaaaaacccattaaaattttaaaaatataaaaaaaaaaaataccgaatctcccgatatctcgccataccgccgaaacgatttttccctccgcgaaatacgaaaaaaacgaaaacacgtaccgaacaccgaaaantaattcgcaaaatcaaanaccgaaacaaaaaaaatccgaaaaatcaaaaaaaaacgccgcaaccgaaaatacgacgcatatcgccaaaaaaaaaaaaaaaccgaaccaaaaaatattcgctaataataaccccnncgatcgaatcgatntcaccacgacaataactaaacatcgaaaacgaaaccgaattctaataataaaattaactacgtttcgaaaaaaacgtccaaaaaaaccgcttaaataaataaaaataactaccccaaaacaaatcgtcgaacccttataattctcacgaaaatttctcttaaacgacatatctttaccgttacgacgcgtatananaaccgatcaaacaaattaaatatacgtatatccacataaccgatttacttcacccccgaaacacttccttaantacgaaatnatacgcgaataactcttaccctacgcntatatcgcaatttataaccttaaacaacgctatcgtctatcccaataacgactctaataccgcacctaaaaatcgcgaaaacgaaaaatacaaataaatatcaacaaacacaatcgaaaataanaaccaacccactaaactaacgacgacaacgcgacgctcgtncacccaaccgacaatctaacgacgcgaaatattcaatataaataaccaaanctaaaaccaaacgaaaacccaaaaactatctcccacaaaactaacgaaaacgccgcgtacaac

SEQ ID NO: 13383 - DNA, 879 bp, Artificial Sequence
  chemically treated genomic DNA (Homo sapiens) CpG-island No: 13383
  misc_feature (146)..(146): n is either a, c, g or t
  misc_feature (164)..(164): n is either a, c, g or t
  misc_feature (280)..(281): n is either a, c, g or t
  misc_feature (295)..(295): n is either a, c, g or t
  misc_feature (489)..(489): n is either a, c, g or t
  misc_feature (491)..(491): n is either a, c, g or t
  misc_feature (564)..(564): n is either a, c, g or t
  misc_feature (573)..(573): n is either a, c, g or t
  misc_feature (600)..(600): n is either a, c, g or t
  misc_feature (724)..(724): n is either a, c, g or t
  misc_feature (765)..(765): n is either a, c, g or t
  misc_feature (816)..(816): n is either a, c, g or t
gttcgtgttgggaaggggtttattaaaattttgggagtatggggaaaaaaaatatcgggtttttcggtgtttcgttatatcgtcgggacggttttttttttcgcgaaatacggggggaacgaaaatacgtatcgggtatcgagggntaattcgtaggattaaanatcgaggtagggggaattcgggaaattaggagaggacgtcgtaatcggaggtgcgacgtatatcgttaaaggagaggagaaatcggattaggggatattcgttggtaatagttttnncgatcgggtcggtnttattacgatagtagttgaatatcggaagcggagtcgaattttagtggtggaattgattgcgtttcgaggagggcgtttagagaagtcgtttaagtgggtggaaataattgttttaagataaatcgtcggatttttgtagtttttacggggattttttttgggcgatatgtttttgtcgttgcgacgcgtgtgngnggtcggttaaataaattggatgtgcgtatatttatatggtcggtttgttttattttcggggtatttttttggntgcgaagtnatacgcgggtgatttttattttgcgtntgtgtcgtagtttgtagttttgaataacgttgtcgtttgttttagtgacggttttgatatcgtatttggaagtcgcgaaggcggaagatataagtgaatgttagtaggtatagtcgggaatagnagttagtttattaaattgacggcgataacgcgacgttcgtntatttagtcggtagtttggcgacgcggaatgtttaatgtgaatggttaagnttagagttaagcggaaatttaagggttgttttttatagaattggcgaaaacgtcgcgtgtagt

SEQ ID NO: 13384 - DNA, 879 bp, Artificial Sequence
  chemically treated genomic DNA (Homo sapiens) CpG-island No: 13384
  misc_feature (64)..(64): n is either a, c, g or t
  misc_feature (115)..(115): n is either a, c, g or t
  misc_feature (156)..(156): n is either a, c, g or t
  misc_feature (280)..(280): n is either a, c, g or t
  misc_feature (307)..(307): n is either a, c, g or t
  misc_feature (316)..(316): n is either a, c, g or t
  misc_feature (389)..(389): n is either a, c, g or t
  misc_feature (391)..(391): n is either a, c, g or t
  misc_feature (585)..(585): n is either a, c, g or t
  misc_feature (599)..(600): n is either a, c, g or t
  misc_feature (716)..(716): n is either a, c, g or t
  misc_feature (734)..(734): n is either a, c, g or t
actacacgcgacgttttcgccaattctataaaaaacaacccttaaatttccgcttaactctaancttaaccattcacattaaacattccgcgtcgccaaactaccgactaaatanacgaacgtcgcgttatcgccgtcaatttaataaactaactnctattcccgactatacctactaacattcacttatatcttccgccttcgcgacttccaaatacgatatcaaaaccgtcactaaaacaaacgacaacgttattcaaaactacaaactacgacacanacgcaaaataaaaatcacccgcgtatnacttcgcanccaaaaaaataccccgaaaataaaacaaaccgaccatataaatatacgcacatccaatttatttaaccgaccncncacacgcgtcgcaacgacaaaaacatatcgcccaaaaaaaatccccgtaaaaactacaaaaatccgacgatttatcttaaaacaattatttccacccacttaaacgacttctctaaacgccctcctcgaaacgcaatcaattccaccactaaaattcgactccgcttccgatattcaactactatcgtaataanaccgacccgatcgnnaaaactattaccaacgaatatcccctaatccgatttctcctctcctttaacgatatacgtcgcacctccgattacgacgtcctctcctaatttcccgaattccccctacctcgatntttaatcctacgaattanccctcgatacccgatacgtattttcgttccccccgtatttcgcgaaaaaaaaaaccgtcccgacgatataacgaaacaccgaaaaacccgatattttttttccccatactcccaaaattttaataaaccccttcccaacacgaac

SEQ ID NO: 13385 - DNA, 800 bp, Artificial Sequence
  chemically treated genomic DNA (Homo sapiens) CpG-island No: 13385
ttaaatagcggttatagagtgttaatgtcgtttagcggatcgattacgttttgatggaggaagtagttttacgttagtacgtatagcgttgttgttagtaggttagtaggtagtgaatcggttcgttttaggttaggagatattacgtttagtagattttgtaatataaagcgcgtagtacgcgtatttgtatttatcgtcgttagaataaatagtgttttaaataaaatggcgaagtgatattagaacgttatatttattatgtcgtttagcgcgtcgtgtagaatgtaggttatttttatcgttagcgtcggcgtatcgttcgtacgggaaatgatcgattgtttatttatttcgttggtaatttggtttagcgtatttggtgtaatgttaaagttttagttatttattatttgcgcggtagaagcgattatattcgtcgtttttgtcggagttagtatcgttatcgggttgtttatggtaaaatatacgttcggatcgatgatataggcggaaattagcgttataatcgttacgaaggattttattaatattttatcgtagtcgataaagtacgtttgtttttcgttcgttagtattttcggcgtggttttagaagagattagcgtatggaagttagaatacgcgttataggcgatggtgattaatcgggacgggaataggttatcggtttatacgggttaggtgtatcgattaaattgggtcgcgttaggtattgttaaggtcgagggatttattaaaagtggtatcgttaaatacgaaaaaattatttaattaat

SEQ ID NO: 13386 - DNA, 800 bp, Artificial Sequence
  chemically treated genomic DNA (Homo sapiens) CpG-island No: 13386
attaattaaataattttttcgtatttaacgataccacttttaataaatccctcgaccttaacaatacctaacgcgacccaatttaatcgatacacctaacccgtataaaccgataacctattcccgtcccgattaatcaccatcgcctataacgcgtattctaacttccatacgctaatctcttctaaaaccacgccgaaaatactaacgaacgaaaaacaaacgtactttatcgactacgataaaatattaataaaatccttcgtaacgattataacgctaatttccgcctatatcatcgatccgaacgtatattttaccataaacaacccgataacgatactaactccgacaaaaacgacgaatataatcgcttctaccgcgcaaataataaataactaaaactttaacattacaccaaatacgctaaaccaaattaccaacgaaataaataaacaatcgatcatttcccgtacgaacgatacgccgacgctaacgataaaaataacctacattctacacgacgcgctaaacgacataataaatataacgttctaatatcacttcgccattttatttaaaacactatttattctaacgacgataaatacaaatacgcgtactacgcgctttatattacaaaatctactaaacgtaatatctcctaacctaaaacgaaccgattcactacctactaacctactaacaacaacgctatacgtactaacgtaaaactacttcctccatcaaaacgtaatcgatccgctaaacgacattaacactctataaccgctatttaa

SEQ ID NO: 13387 - DNA, 800 bp, Artificial Sequence
  chemically treated genomic DNA (Homo sapiens) CpG-island No: 13387
gttaattgggtgattttttcgtgtttggcggtattatttttgataagtttttcggttttgataatgtttggcgcggtttaatttggtcgatgtatttgattcgtatggatcggtaatttgttttcgtttcggttagttattatcgtttgtggcgcgtgttttggtttttatgcgttgattttttttgggattacgtcgaagatgttggcgaacgaagggtaggcgtgttttatcggttacggtgggatgttaatggaatttttcgtggcgattatggcgttggttttcgtttgtattatcgattcgggcgtgtattttgttatgaatagttcgatggcggtgttggtttcggtagggacggcggatgtggtcgtttttgtcgcgtaggtggtgagtagttggggttttagtattatattagatacgttaaattagattgttagcgaagtgggtgaatagtcgattatttttcgtgcgggcggtgcgtcgacgttggcggtggggatggtttatattttgtacggcgcgttgggcggtatgatggatgtggcgttttggtattatttcgttattttgtttgaagtattgtttattttgacggcggtggatgtaggtacgcgtgttgcgcgttttatgttgtaggatttgttgggcgtggtgttttttggtttgaagcggatcgatttattgtttgttaatttgttggtaatagcgttgtgcgtattggcgtggggttattttttttattagggcgtggtcgattcgttgggcggtattaatattttgtggtcgttgtttgg

SEQ ID NO: 13388 - DNA, 800 bp, Artificial Sequence
  chemically treated genomic DNA (Homo sapiens) CpG-island No: 13388
ccaaacaacgaccacaaaatattaataccgcccaacgaatcgaccacgccctaataaaaaaaataaccccacgccaatacgcacaacgctattaccaacaaattaacaaacaataaatcgatccgcttcaaaccaaaaaacaccacgcccaacaaatcctacaacataaaacgcgcaacacgcgtacctacatccaccgccgtcaaaataaacaatacttcaaacaaaataacgaaataataccaaaacgccacatccatcataccgcccaacgcgccgtacaaaatataaaccatccccaccgccaacgtcgacgcaccgcccgcacgaaaaataatcgactattcacccacttcgctaacaatctaatttaacgtatctaatataatactaaaaccccaactactcaccacctacgcgacaaaaacgaccacatccgccgtccctaccgaaaccaacaccgccatcgaactattcataacaaaatacacgcccgaatcgataatacaaacgaaaaccaacgccataatcgccacgaaaaattccattaacatcccaccgtaaccgataaaacacgcctacccttcgttcgccaacatcttcgacgtaatcccaaaaaaaatcaacgcataaaaaccaaaacacgcgccacaaacgataataactaaccgaaacgaaaacaaattaccgatccatacgaatcaaatacatcgaccaaattaaaccgcgccaaacattatcaaaaccgaaaaacttatcaaaaataataccgccaaacacgaaaaaatcacccaattaac

SEQ ID NO: 13389 - DNA, 642 bp, Artificial Sequence
  chemically treated genomic DNA (Homo sapiens) CpG-island No: 13389
ttcggtggtgagcgtcgaaggttgcgagttgattttgtttgacggtagacgtttggttgacggtatgtcgttttggtgggcggcgatttacggttataattattcgtagtttaatgcggcgatgaagtcgtaaattgatgttatgtcgtatgtgatgtttggcggtattatttatgcgttagttattgagttgtgtcgtaaattggtggcgatgacgtcgtaatcgttggagtgcgtttttttcgcggatttcggtttcgtagcggtggaagtggcgatgaaaatggcgttgtagtattggtaagttaaaggcgaagcgcgttagcgttttttgatttttcgtaatggttattatggcgatatttttggcgcgatgtcggtgtgcgattcggataatttaatgtatagtttgtggaaaggttattggtaaaaatcggttggttcggttcgaaagcgtatgattggaagggattacgtaatgggggttgatcgttaatggggtatgaagaaatcgggggaatagagttaggtcgggtagggaagttgttcggagggaaatattaaatgtcgtaaaatttgagtataaatcggttggttatagtgggtaaacgaatgtgagaaaggaaagtttattaggattag

SEQ ID NO: 13390 - DNA, 642 bp, Artificial Sequence
  chemically treated genomic DNA (Homo sapiens) CpG-island No: 13390
ctaatcctaataaactttcctttctcacattcgtttacccactataaccaaccgatttatactcaaattttacgacatttaatatttccctccgaacaacttccctacccgacctaactctattcccccgatttcttcataccccattaacgatcaacccccattacgtaatcccttccaatcatacgctttcgaaccgaaccaaccgatttttaccaataacctttccacaaactatacattaaattatccgaatcgcacaccgacatcgcgccaaaaatatcgccataataaccattacgaaaaatcaaaaaacgctaacgcgcttcgcctttaacttaccaatactacaacgccattttcatcgccacttccaccgctacgaaaccgaaatccgcgaaaaaaacgcactccaacgattacgacgtcatcgccaccaatttacgacacaactcaataactaacgcataaataataccgccaaacatcacatacgacataacatcaatttacgacttcatcgccgcattaaactacgaataattataaccgtaaatcgccgcccaccaaaacgacataccgtcaaccaaacgtctaccgtcaaacaaaatcaactcgcaaccttcgacgctcaccaccgaa

SEQ ID NO: 13391 - DNA, 642 bp, Artificial Sequence
  chemically treated genomic DNA (Homo sapiens) CpG-island No: 13391
ttggttttggtggattttttttttttatattcgtttatttattgtggttaatcggtttgtgtttaaattttgcgatatttggtgttttttttcggatagtttttttgttcggtttggttttgttttttcggtttttttatgttttattagcggttagtttttattgcgtaattttttttaattatgcgttttcgggtcggattaatcggtttttgttagtagtttttttatagattgtgtattgaattattcggatcgtatatcgatatcgcgttaaaggtatcgttatgataattattgcggaaggttagaaaacgttggcgcgtttcgtttttggtttgttagtattgtaacgttatttttatcgttatttttatcgttacggaatcggagttcgcgagaaaaacgtattttagcggttgcggcgttatcgttattagtttgcggtatagtttaatggttggcgtatgggtgatatcgttaaatattatatgcgatatggtattaatttgcgattttatcgtcgtattaagttgcgggtgattgtagtcgtggatcgtcgtttattaggacgatatatcgttaattaggcgtttgtcgttagataaaattagttcgtaattttcggcgtttattatcgga

SEQ ID NO: 13392 - DNA, 642 bp, Artificial Sequence
  chemically treated genomic DNA (Homo sapiens) CpG-island No: 13392
tccgataataaacgccgaaaattacgaactaattttatctaacgacaaacgcctaattaacgatatatcgtcctaataaacgacgatccacgactacaatcacccgcaacttaatacgacgataaaatcgcaaattaataccatatcgcatataatatttaacgatatcacccatacgccaaccattaaactataccgcaaactaataacgataacgccgcaaccgctaaaatacgtttttctcgcgaactccgattccgtaacgataaaaataacgataaaaataacgttacaatactaacaaaccaaaaacgaaacgcgccaacgttttctaaccttccgcaataattatcataacgatacctttaacgcgatatcgatatacgatccgaataattcaatacacaatctataaaaaaactactaacaaaaaccgattaatccgacccgaaaacgcataattaaaaaaaattacgcaataaaaactaaccgctaataaaacataaaaaaaccgaaaaaacaaaaccaaaccgaacaaaaaaactatccgaaaaaaaacaccaaatatcgcaaaatttaaacacaaaccgattaaccacaataaataaacgaatataaaaaaaaaaaatccaccaaaaccaa

SEQ ID NO: 13393 - DNA, 551 bp, Artificial Sequence
  chemically treated genomic DNA (Homo sapiens) CpG-island No: 13393
tacggattggcgtatttggaaaaagcgagtgtacgcgggtaatatagtttgttattgttggggatggttttattttgcgtattgattttgattttttggcgcgtggtttatcgtttagttacgcgtttatttgtcgaataaacgtaggcgttgtaacggttgttggacggtgatattgatttttttttttcggaaatcgttggcgtacgggagttggatattatcgggcggttgatggatgcgtttcgtagtaatgtttatgtattgaatcgttatcgcgaatagttggcggcgtaggttaaagcgcgtatagttgaattgtaggaattggtgatagaatatcgataggtacgggcggaagtagaaaaagttagttaggtaaaatcggcgtttttggcggcgatgagttatgagattcgtatatcgttgtacggtattttcggtattgtttaattgttggtagataatttcgtatttaacgtttagcgtgatgatttgcgggtaattattgattttggtgaatcgttgttgattatttttaacgatatttt

SEQ ID NO: 13394 - DNA, 551 bp, Artificial Sequence
  chemically treated genomic DNA (Homo sapiens) CpG-island No: 13394
aaaatatcgttaaaaataatcaacaacgattcaccaaaatcaataattacccgcaaatcatcacgctaaacgttaaatacgaaattatctaccaacaattaaacaataccgaaaataccgtacaacgatatacgaatctcataactcatcgccgccaaaaacgccgattttacctaactaactttttctacttccgcccgtacctatcgatattctatcaccaattcctacaattcaactatacgcgctttaacctacgccgccaactattcgcgataacgattcaatacataaacattactacgaaacgcatccatcaaccgcccgataatatccaactcccgtacgccaacgatttccgaaaaaaaaaaatcaatatcaccgtccaacaaccgttacaacgcctacgtttattcgacaaataaacgcgtaactaaacgataaaccacgcgccaaaaaatcaaaatcaatacgcaaaataaaaccatccccaacaataacaaactatattacccgcgtacactcgctttttccaaatacgccaatccgta

SEQ ID NO: 13395 - DNA, 551 bp, Artificial Sequence
  chemically treated genomic DNA (Homo sapiens) CpG-island No: 13395
agaatatcgttgaggatggttagtaacgatttattagagttagtaattgttcgtaaattattacgttgggcgttaagtgcggggttatttgttagtagttgagtagtgtcgagaatatcgtatagcggtgtgcggattttatggtttatcgtcgttagaaacgtcgattttgtttggttggttttttttgttttcgttcgtgtttgtcggtgttttattattagtttttgtaatttagttgtacgcgttttgatttgcgtcgttagttgttcgcggtggcgatttagtgtatgaatattgttgcgaaacgtatttattagtcgttcgatggtatttagttttcgtacgttagcggttttcgggaaaggggagttaatattatcgtttagtagtcgttgtagcgtttgcgtttgttcggtaagtggacgcgtgattgagcgataaattacgcgttagaggattagaattagtgcgtaaagtgaaattatttttagtaataataggttgtattgttcgcgtgtattcgttttttttagatgcgttagttcgtg

SEQ ID NO: 13396 - DNA, 551 bp, Artificial Sequence
  chemically treated genomic DNA (Homo sapiens) CpG-island No: 13396
cacgaactaacgcatctaaaaaaaacgaatacacgcgaacaatacaacctattattactaaaaataatttcactttacgcactaattctaatcctctaacgcgtaatttatcgctcaatcacgcgtccacttaccgaacaaacgcaaacgctacaacgactactaaacgataatattaactcccctttcccgaaaaccgctaacgtacgaaaactaaataccatcgaacgactaataaatacgtttcgcaacaatattcatacactaaatcgccaccgcgaacaactaacgacgcaaatcaaaacgcgtacaactaaattacaaaaactaataataaaacaccgacaaacacgaacgaaaacaaaaaaaaccaaccaaacaaaatcgacgtttctaacgacgataaaccataaaatccgcacaccgctatacgatattctcgacactactcaactactaacaaataaccccgcacttaacgcccaacgtaataatttacgaacaattactaactctaataaatcgttactaaccatcctcaacgatattct

SEQ ID NO: 13397 - DNA, 779 bp, Artificial Sequence
  chemically treated genomic DNA (Homo sapiens) CpG-island No: 13397
agcgttaagatttttgtttgattaaatagtatcgtaagcggcgtgcgtaaattatgcgaaagcgtcgttagtagggcgttgcggatttgtttacgttcgtttgttattcgcgtttgtttttcgttggcggttagcgttagtcgtttaagggtattggcgattaatagcgtaaacgtttttagtaggcgttgttgtttcgggattattaattggcgtagatttttcggttttattattattagttcgtaagttttttcgtcgttttttagcggtaaaatttggtacggtatatcgggtaacgtgtcggtgttcgcgttcgtaggtaggtttttattaaaattttattgcgcgatggtatcgttttacggcgttattttttgcggatgtgttaacggttgtaatttatcgttgttatcgggtaataatatttgattgcgggtatgaaacgtggaggtaataaattgttcgttggtggtagcgatattttgcggattgcggtttatcgttagagttttcgatattttatataagtgtcgagtgcgttgttcgcggtaacgggttattcgagtttgataacgtacgtttagtagtaaggtttcgtattattagttcgattgttaatattatcgggaaggttagtagatatggttttcgataacgtaacgtgttcgtgggcgtataacgaaattaaattatattttatatcgggtattacgaaagtaggttataagtaggtatatatagttagaattggtttaggtgggttaggtttcgtcgtt

SEQ ID NO: 13398 - DNA, 779 bp, Artificial Sequence
  chemically treated genomic DNA (Homo sapiens) CpG-island No: 13398
aacgacgaaacctaacccacctaaaccaattctaactatatatacctacttataacctactttcgtaatacccgatataaaatataatttaatttcgttatacgcccacgaacacgttacgttatcgaaaaccatatctactaaccttcccgataatattaacaatcgaactaataatacgaaaccttactactaaacgtacgttatcaaactcgaataacccgttaccgcgaacaacgcactcgacacttatataaaatatcgaaaactctaacgataaaccgcaatccgcaaaatatcgctaccaccaacgaacaatttattacctccacgtttcatacccgcaatcaaatattattacccgataacaacgataaattacaaccgttaacacatccgcaaaaaataacgccgtaaaacgataccatcgcgcaataaaattttaataaaaacctacctacgaacgcgaacaccgacacgttacccgatataccgtaccaaattttaccgctaaaaaacgacgaaaaaacttacgaactaataataataaaaccgaaaaatctacgccaattaataatcccgaaacaacaacgcctactaaaaacgtttacgctattaatcgccaatacccttaaacgactaacgctaaccgccaacgaaaaacaaacgcgaataacaaacgaacgtaaacaaatccgcaacgccctactaacgacgctttcgcataatttacgcacgccgcttacgatactatttaatcaaacaaaaatcttaacgct

SEQ ID NO: 13399 - DNA, 779 bp, Artificial Sequence
  chemically treated genomic DNA (Homo sapiens) CpG-island No: 13399
agcggcggggtttagtttatttgggttaattttggttgtgtgtgtttatttatgatttgttttcgtggtgttcggtataagatgtgatttgatttcgttatgcgtttacgggtacgttgcgttgtcgaaggttatatttgttaattttttcggtgatgttaatagtcgggttggtgatgcggaattttattgttgggcgtgcgttattaggttcgggtagttcgttatcgcgagtaacgtattcggtatttatatgaaatgtcgaaagttttggcggtgggtcgtagttcgtaggatatcgttgttattagcgaataatttattgtttttacgttttatgttcgtagttaggtgttgttgttcgatgataacggtaaattgtagtcgttaatatattcgtaaggaatgacgtcgtgggacgatgttatcgcgtagtggagttttgataaaggtttgtttgcgggcgcgggtatcgatacgttattcggtgtatcgtattagattttgtcgttaaaaagcggcgagaaaatttacgggttggtggtggtggagtcggggaatttgcgttagttgatgatttcggaatagtagcgtttgttggagacgtttacgttgttagtcgttaatgtttttgagcggttgacgttaatcgttagcgaagaataggcgcggatggtaagcgaacgtgaatagattcgtaacgttttgttggcggcgttttcgtatgatttacgtacgtcgtttacggtgttgtttggttaggtagaaattttaacgtt

SEQ ID NO: 13400 - DNA, 779 bp, Artificial Sequence
  chemically treated genomic DNA (Homo sapiens) CpG-island No: 13400
aacgttaaaatttctacctaaccaaacaacaccgtaaacgacgtacgtaaatcatacgaaaacgccgccaacaaaacgttacgaatctattcacgttcgcttaccatccgcgcctattcttcgctaacgattaacgtcaaccgctcaaaaacattaacgactaacaacgtaaacgtctccaacaaacgctactattccgaaatcatcaactaacgcaaattccccgactccaccaccaccaacccgtaaattttctcgccgctttttaacgacaaaatctaatacgatacaccgaataacgtatcgatacccgcgcccgcaaacaaacctttatcaaaactccactacgcgataacatcgtcccacgacgtcattccttacgaatatattaacgactacaatttaccgttatcatcgaacaacaacacctaactacgaacataaaacgtaaaaacaataaattattcgctaataacaacgatatcctacgaactacgacccaccgccaaaactttcgacatttcatataaataccgaatacgttactcgcgataacgaactacccgaacctaataacgcacgcccaacaataaaattccgcatcaccaacccgactattaacatcaccgaaaaaattaacaaatataaccttcgacaacgcaacgtacccgtaaacgcataacgaaatcaaatcacatcttataccgaacaccacgaaaacaaatcataaataaacacacacaaccaaaattaacccaaataaactaaaccccgccgct

SEQ ID NO: 13401 - DNA, 628 bp, Artificial Sequence
  chemically treated genomic DNA (Homo sapiens) CpG-island No: 13401
  misc_feature (135)..(135): n is either a, c, g or t
tagcgtcgcgcgatatgaatttagttacgtatggaaggattaggggcgtgcgttaacgaatttattggatattagttttcggggaatattttttatttcggcggtaataaatacgaagtttcggtagcggggatntttttttttttcgcggattaatgattcgcggtaatgtttcggttagttcgtagatatattttgtattagcggggttggttttgattaaaggttcgaaaatacggtaatggttggaatagtaattgcgtgcgttgcgtaaagtgtttacgtcggatatacgtattattgtcggtgttaaggttcgtgatatttatatttttacgttggaattgttcgaaaaagtgttcggtttaattattattacgttggtatggaaaaaagcgcgtttgattaattgtatttttaatgaatcgtagttggtcgatgcgtcgtagatcgttagttggaagttggaaggtattgattggattatttataattatgcgaatgttttttttcgtatcgggtttgatatcggcgcgcgtttttttatgtaatatttgttagagaatttcgaaggggagattgtcgatttcggttgcggtaatggcgttattggtttgacgttgtttga

SEQ ID NO: 13402 - DNA, 628 bp, Artificial Sequence
  chemically treated genomic DNA (Homo sapiens) CpG-island No: 13402
  misc_feature (494)..(494): n is either a, c, g or t
tcaaacaacgtcaaaccaataacgccattaccgcaaccgaaatcgacaatctccccttcgaaattctctaacaaatattacataaaaaaacgcgcgccgatatcaaacccgatacgaaaaaaaacattcgcataattataaataatccaatcaataccttccaacttccaactaacgatctacgacgcatcgaccaactacgattcattaaaaatacaattaatcaaacgcgcttttttccataccaacgtaataataattaaaccgaacactttttcgaacaattccaacgtaaaaatataaatatcacgaaccttaacaccgacaataatacgtatatccgacgtaaacactttacgcaacgcacgcaattactattccaaccattaccgtattttcgaacctttaatcaaaaccaaccccgctaatacaaaatatatctacgaactaaccgaaacattaccgcgaatcattaatccgcgaaaaaaaaaaanatccccgctaccgaaacttcgtatttattaccgccgaaataaaaaatattccccgaaaactaatatccaataaattcgttaacgcacgcccctaatccttccatacgtaactaaattcatatcgcgcgacgcta

SEQ ID NO: 13403 - DNA, 628 bp, Artificial Sequence
  chemically treated genomic DNA (Homo sapiens) CpG-island No: 13403
  misc_feature (494)..(494): n is either a, c, g or t
ttaagtagcgttagattaataacgttattatcgtaatcgagatcgataatttttttttcgagattttttggtagatgttgtataaagaagcgcgcgtcgatattaagttcggtgcgggagaagatattcgtatggttgtggatagtttagttagtattttttagtttttagttaacggtttgcggcgtatcggttagttgcggtttattgaaagtgtaattaattaggcgcgtttttttttatgttagcgtggtggtggttgggtcgagtattttttcgaatagttttagcgtggaagtgtgaatgttacgggttttggtatcggtaataatacgtgtattcgacgtgagtattttgcgtagcgtacgtagttgttgttttagttattgtcgtgttttcgggtttttggttaggattaatttcgttggtgtagggtatgtttgcgggttggtcgaaatattatcgcgagttattaattcgcggaggggggaaanattttcgttgtcgggatttcgtgtttgttgtcgtcgggatggggagtatttttcgggggttaatgtttagtgagttcgttagcgtacgtttttgatttttttatgcgtgattgagtttatgtcgcgcggcgttg

SEQ ID NO: 13404 - DNA, 628 bp, Artificial Sequence
  chemically treated genomic DNA (Homo sapiens) CpG-island No: 13404
  misc_feature (135)..(135): n is either a, c, g or t
caacgccgcgcgacataaactcaatcacgcataaaaaaatcaaaaacgtacgctaacgaactcactaaacattaacccccgaaaaatactccccatcccgacgacaacaaacacgaaatcccgacaacgaaaatntttcccccctccgcgaattaataactcgcgataatatttcgaccaacccgcaaacataccctacaccaacgaaattaatcctaaccaaaaacccgaaaacacgacaataactaaaacaacaactacgtacgctacgcaaaatactcacgtcgaatacacgtattattaccgataccaaaacccgtaacattcacacttccacgctaaaactattcgaaaaaatactcgacccaaccaccaccacgctaacataaaaaaaaacgcgcctaattaattacactttcaataaaccgcaactaaccgatacgccgcaaaccgttaactaaaaactaaaaaatactaactaaactatccacaaccatacgaatatcttctcccgcaccgaacttaatatcgacgcgcgcttctttatacaacatctaccaaaaaatctcgaaaaaaaaattatcgatctcgattacgataataacgttattaatctaacgctacttaa

SEQ ID NO: 13405 - DNA, 561 bp, Artificial Sequence
  chemically treated genomic DNA (Homo sapiens) CpG-island No: 13405
cgcgttttcggttagttttttttttttttattcgcgttttttcgcgagattcggggttgggtcgtgtcggtcgtcgcgtagtaggaagggagcggttgttacggaaaacgtttggtcggacggtgtggttggcggttttgtttgggcgcggagggcggcggtggcgggtttcgcggtttttttttaggtattttagtgttcgttgatcgttttgagcggtttagttgttttttcgattcgtatcgcggggtcgtggcgtaggggttttgttgcgttttagtttgggggtcgcggtggggcggggtagtgatttcgggtcggtcgttgtgtttttattttttttatttttttttcgtatagttttttttttttttacgacggtttttatagttcggagttcggcggagttcggatttggcggggagagttgtttttacggtcgggtatttagattttatcgtcgtagtcgttattattttagtttatttttggtatcggtaatgggtttcgtattttttagtgtatttgtaattgatttggatacggaatattaagaattta

SEQ ID NO: 13406 - DNA, 561 bp, Artificial Sequence
  chemically treated genomic DNA (Homo sapiens) CpG-island No: 13406
taaattcttaatattccgtatccaaatcaattacaaatacactaaaaaatacgaaacccattaccgataccaaaaataaactaaaataataacgactacgacgataaaatctaaatacccgaccgtaaaaacaactctccccgccaaatccgaactccgccgaactccgaactataaaaaccgtcgtaaaaaaaaaaaaaactatacgaaaaaaaaataaaaaaaataaaaacacaacgaccgacccgaaatcactaccccgccccaccgcgacccccaaactaaaacgcaacaaaacccctacgccacgaccccgcgatacgaatcgaaaaaacaactaaaccgctcaaaacgatcaacgaacactaaaatacctaaaaaaaaaccgcgaaacccgccaccgccgccctccgcgcccaaacaaaaccgccaaccacaccgtccgaccaaacgttttccgtaacaaccgctcccttcctactacgcgacgaccgacacgacccaaccccgaatctcgcgaaaaaacgcgaataaaaaaaaaaaaaactaaccgaaaacgcg

SEQ ID NO: 13407 - DNA, 561 bp, Artificial Sequence
  chemically treated genomic DNA (Homo sapiens) CpG-island No: 13407
tgagtttttagtatttcgtgtttaagttagttataagtgtattggaggatacgaagtttattgtcggtattaaggatggattgaggtggtggcgattgcgacggtggggtttgggtgttcggtcgtggaggtagtttttttcgttaggttcgggtttcgtcgggtttcggattgtggaggtcgtcgtgaggagaaaggaagttatacgaaggaagggtgggagggatgagggtataacggtcggttcggggttattgtttcgttttatcgcgatttttaagttggaacgtaataaggtttttacgttacggtttcgcggtgcggatcggggaagtagttgggtcgtttagggcggttagcgggtattggggtatttgagagaaggtcgcggggttcgttatcgtcgtttttcgcgtttaggtagggtcgttagttatatcgttcggttaggcgtttttcgtggtagtcgttttttttttgttgcgcggcgatcggtacggtttagtttcgggtttcgcgaggaggcgcgggtgaaagggagagaagttgatcgaaggcgcg

SEQ ID NO: 13408 - DNA, 561 bp, Artificial Sequence
  chemically treated genomic DNA (Homo sapiens) CpG-island No: 13408
cgcgccttcgatcaacttctctccctttcacccgcgcctcctcgcgaaacccgaaactaaaccgtaccgatcgccgcgcaacaaaaaaaaaacgactaccacgaaaaacgcctaaccgaacgatataactaacgaccctacctaaacgcgaaaaacgacgataacgaaccccgcgaccttctctcaaataccccaatacccgctaaccgccctaaacgacccaactacttccccgatccgcaccgcgaaaccgtaacgtaaaaaccttattacgttccaacttaaaaatcgcgataaaacgaaacaataaccccgaaccgaccgttataccctcatccctcccacccttccttcgtataacttcctttctcctcacgacgacctccacaatccgaaacccgacgaaacccgaacctaacgaaaaaaactacctccacgaccgaacacccaaaccccaccgtcgcaatcgccaccacctcaatccatccttaataccgacaataaacttcgtatcctccaatacacttataactaacttaaacacgaaatactaaaaactca

SEQ ID NO: 13409 - DNA, 502 bp, Artificial Sequence
  chemically treated genomic DNA (Homo sapiens) CpG-island No: 13409
cggaatcgtttatttcgcgaattgttgtattaatcggcgtatttttttaaaaaattgttcgtcggtatcggtattttttcgttggttagtttgtttaatatttgggtcggcgttttcggaaaaaattttttggtgaacggacgtattatttcggtgatgtttcgacggaattcgttttgattattgggtagttattttatcggcgggattgtcgggaattatcggatttaaatgataatcggggcgtgattgcgatttttatttttatattaagtttttggcggaggtgttattcggtcgggtttattcgaaaaatttttaaagatttacggttgggttatcggaattttcggcgggttatggtgtgaatcgttattttgaatttcggtaatttttgagggttattttcgcgttaagaggttagatcgtttttaaaatcgggattttaaagaatttcgagaacgttcgattcgggttaaaagagtttttgagggaaatattt

SEQ ID NO: 13410 - DNA, 502 bp, Artificial Sequence
  chemically treated genomic DNA (Homo sapiens) CpG-island No: 13410
aaatatttccctcaaaaactcttttaacccgaatcgaacgttctcgaaattctttaaaatcccgattttaaaaacgatctaacctcttaacgcgaaaataaccctcaaaaattaccgaaattcaaaataacgattcacaccataacccgccgaaaattccgataacccaaccgtaaatctttaaaaatttttcgaataaacccgaccgaataacacctccgccaaaaacttaatataaaaataaaaatcgcaatcacgccccgattatcatttaaatccgataattcccgacaatcccgccgataaaataactacccaataatcaaaacgaattccgtcgaaacatcaccgaaataatacgtccgttcaccaaaaaattttttccgaaaacgccgacccaaatattaaacaaactaaccaacgaaaaaataccgataccgacgaacaattttttaaaaaaatacgccgattaatacaacaattcgcgaaataaacgattccg

SEQ ID NO: 13411 - DNA, 502 bp, Artificial Sequence
  chemically treated genomic DNA (Homo sapiens) CpG-island No: 13411
aagtgttttttttaggagtttttttaattcggatcgaacgttttcgaggttttttgggatttcgattttaagaacggtttggttttttaacgcggaggtggtttttagaaattatcgagatttagggtaacggtttatattatagttcgtcggagatttcggtggtttaatcgtgggtttttgaggatttttcgggtggattcggtcggatagtattttcgttagaagtttggtgtaaaagtagggatcgtagttacgtttcggttattatttaaattcggtgattttcggtaatttcgtcgataaggtggttatttagtggttaaaacggatttcgtcggaatattatcgggataatacgttcgtttattagggagtttttttcgggaacgtcggtttaggtgttgaataggttgattagcgagaaaatgtcggtatcggcgagtaattttttgggggagtgcgtcgattggtgtaatagttcgcgaaataggcggtttcg

SEQ ID NO: 13412 - DNA, 502 bp, Artificial Sequence
  chemically treated genomic DNA (Homo sapiens) CpG-island No: 13412
cgaaaccgcctatttcgcgaactattacaccaatcgacgcactcccccaaaaaattactcgccgataccgacattttctcgctaatcaacctattcaacacctaaaccgacgttcccgaaaaaaactccctaataaacgaacgtattatcccgataatattccgacgaaatccgttttaaccactaaataaccaccttatcgacgaaattaccgaaaatcaccgaatttaaataataaccgaaacgtaactacgatccctacttttacaccaaacttctaacgaaaatactatccgaccgaatccacccgaaaaatcctcaaaaacccacgattaaaccaccgaaatctccgacgaactataatataaaccgttaccctaaatctcgataatttctaaaaaccacctccgcgttaaaaaaccaaaccgttcttaaaatcgaaatcccaaaaaacctcgaaaacgttcgatccgaattaaaaaaactcctaaaaaaaacactt

SEQ ID NO: 13413 - DNA, 1145 bp, Artificial Sequence
  chemically treated genomic DNA (Homo sapiens) CpG-island No: 13413
gcggttattattagatcggaattacggacgatatcgtcgttagtaaagattttcgggttgttggtttggaaggcgttgtcgttgtttttcggggcgatgatgcggttttgtgaatttagttcgacgttgtgttttgttagttattttatgttgtgtggacggaaattaaacgttatgattatcgtatttgtcggaacgatatgttcggaatttgtaacgattttcgcgcggcgacggtttttggcgttcggttcgtttatttcggtacgtattatttttacgtcgttgattttgtcgttatcgtttattttaatatttagcggttggacgttgaatttgaattttacgtttttttttcgcgcgttttttatttcgcggcgggaattcggtatgttttttttattacgacgattgggatagggtacgtgtttcggtttttggggtacggaggttgcggatgagcgcgtaaggggtgataggggttaattggtttcgatgtcgttttttttttttattttaattttttttttagaggggcgaggggatcgatcgcgtttaatgttgcgatcggtttgttttattttttgcgtaataattttaacgtattcgttgttattagtatcgtcgttttcgtatttgttagtattgttagttataattcggttatttttaatagcgtggtgacgaggaagattttttttagttttagcgtaatagtgatgttttggcggatattggcgtgagtggcgcgtgttagtttaattatttgtattaggtcgcgtaggtggttatgggttaatgttgcgtcggcggtttttagcgttacgtttgtgtcgttatttattgtaatttcgatggcggtagtttttatcgttggcgcgtcgttaatatcgttatcgattatcgttagcggcgtatgttgatttagttcggttatcgttttgattttatttttcggttttggtttgaaagggatggagcgttacggttatcgtgatgatgttttgaagttggcggatacgttttttcggtacgttaaagggttaatcgtcgatggattaatttaggaaaattataattcgttgataggcgtatagtaaggcgtattaaattttttttggagtgtcgcgtatttgtatatgttg

SEQ ID NO: 13414 - DNA, 1145 bp, Artificial Sequence
  chemically treated genomic DNA (Homo sapiens) CpG-island No: 13414
caacatatacaaatacgcgacactccaaaaaaaatttaatacgccttactatacgcctatcaacgaattataattttcctaaattaatccatcgacgattaaccctttaacgtaccgaaaaaacgtatccgccaacttcaaaacatcatcacgataaccgtaacgctccatccctttcaaaccaaaaccgaaaaataaaatcaaaacgataaccgaactaaatcaacatacgccgctaacgataatcgataacgatattaacgacgcgccaacgataaaaactaccgccatcgaaattacaataaataacgacacaaacgtaacgctaaaaaccgccgacgcaacattaacccataaccacctacgcgacctaatacaaataattaaactaacacgcgccactcacgccaatatccgccaaaacatcactattacgctaaaactaaaaaaaatcttcctcgtcaccacgctattaaaaataaccgaattataactaacaatactaacaaatacgaaaacgacgatactaataacaacgaatacgttaaaattattacgcaaaaaataaaacaaaccgatcgcaacattaaacgcgatcgatcccctcgcccctctaaaaaaaaaattaaaataaaaaaaaaaaacgacatcgaaaccaattaacccctatcaccccttacgcgctcatccgcaacctccgtaccccaaaaaccgaaacacgtaccctatcccaatcgtcgtaataaaaaaaacataccgaattcccgccgcgaaataaaaaacgcgcgaaaaaaaaacgtaaaattcaaattcaacgtccaaccgctaaatattaaaataaacgataacgacaaaatcaacgacgtaaaaataatacgtaccgaaataaacgaaccgaacgccaaaaaccgtcgccgcgcgaaaatcgttacaaattccgaacatatcgttccgacaaatacgataatcataacgtttaatttccgtccacacaacataaaataactaacaaaacacaacgtcgaactaaattcacaaaaccgcatcatcgccccgaaaaacaacgacaacgccttccaaaccaacaacccgaaaatctttactaacgacgatatcgtccgtaattccgatctaataataaccgc

SEQ ID NO: 13415 - DNA, 1145 bp, Artificial Sequence
  chemically treated genomic DNA (Homo sapiens) CpG-island No: 13415
taatatatataaatgcgcggtattttaggagaaatttggtgcgttttgttgtgcgtttgttagcgggttgtaatttttttgaattggtttatcggcggttaattttttggcgtgtcggaagaacgtattcgttagttttagggtattattacgataatcgtaacgttttattttttttagattaaagtcggaagataaagttaaagcggtgatcgagttgaattaatatgcgtcgttggcgatggtcggtgacggtattaacgacgcgttagcgatgaaagttgtcgttatcgggattgtaatgggtagcggtatagacgtggcgttggaaatcgtcgacgtagtattaatttataattatttgcgcggtttggtgtaaatgattgaattggtacgcgttatttacgttaatattcgttagaatattattattgcgttggggttgaaagggatttttttcgttattacgttgttagggatgatcgggttgtggttggtagtgttggtagatacgggggcgacggtgttggtgatagcgaatgcgttaagattgttgcgtaggagataaggtaaatcgatcgtaatattgagcgcgatcggttttttcgtttttttggggagagggttagggtgaggggaaaaggcggtatcgaagttaattagtttttattattttttacgcgtttattcgtaattttcgtgttttagggatcgaagtacgtattttgttttaatcgtcgtgatgaagagaatatgtcgggttttcgtcgcgaagtgaaaaacgcgcgggaagaaggcgtagagtttaaatttaacgtttagtcgttgggtattgaagtgaacggtaacggtaaagttagcggcgtaaaaatggtgcgtatcgaaatgggcgaatcggacgttaaaggtcgtcgtcgcgcggagatcgttgtaggtttcgaatatatcgtttcggtagatgcggtgattatggcgtttggttttcgtttatataatatggaatggttggtaaaatatagcgtcgagttggatttataaggtcgtattatcgtttcggaaggtagcgataacgttttttagattagtaattcgaaaatttttgttggcggcgatatcgttcgtggtttcgatttggtggtgatcgt

SEQ ID NO: 13416 - DNA, 1145 bp, Artificial Sequence
  chemically treated genomic DNA (Homo sapiens) CpG-island No: 13416
acgatcaccaccaaatcgaaaccacgaacgatatcgccgccaacaaaaattttcgaattactaatctaaaaaacgttatcgctaccttccgaaacgataatacgaccttataaatccaactcgacgctatattttaccaaccattccatattatataaacgaaaaccaaacgccataatcaccgcatctaccgaaacgatatattcgaaacctacaacgatctccgcgcgacgacgacctttaacgtccgattcgcccatttcgatacgcaccatttttacgccgctaactttaccgttaccgttcacttcaatacccaacgactaaacgttaaatttaaactctacgccttcttcccgcgcgtttttcacttcgcgacgaaaacccgacatattctcttcatcacgacgattaaaacaaaatacgtacttcgatccctaaaacacgaaaattacgaataaacgcgtaaaaaataataaaaactaattaacttcgataccgccttttcccctcaccctaaccctctccccaaaaaaacgaaaaaaccgatcgcgctcaatattacgatcgatttaccttatctcctacgcaacaatcttaacgcattcgctatcaccaacaccgtcgcccccgtatctaccaacactaccaaccacaacccgatcatccctaacaacgtaataacgaaaaaaatccctttcaaccccaacgcaataataatattctaacgaatattaacgtaaataacgcgtaccaattcaatcatttacaccaaaccgcgcaaataattataaattaatactacgtcgacgatttccaacgccacgtctataccgctacccattacaatcccgataacgacaactttcatcgctaacgcgtcgttaataccgtcaccgaccatcgccaacgacgcatattaattcaactcgatcaccgctttaactttatcttccgactttaatctaaaaaaaataaaacgttacgattatcgtaataataccctaaaactaacgaatacgttcttccgacacgccaaaaaattaaccgccgataaaccaattcaaaaaaattacaacccgctaacaaacgcacaacaaaacgcaccaaatttctcctaaaataccgcgcatttatatatatta

SEQ ID NO: 13417 - DNA, 890 bp, Artificial Sequence
  chemically treated genomic DNA (Homo sapiens) CpG-island No: 13417
gttttgttcgttataatttcgataatttgtcgattcgtttgttgtatcgaatggtttgttaacgtatataggttggtaatcgattgtttaatattatgcgttataatttttttattgtcggttacggcggtattatttagcgttattaatatcgttttttacgtagtcgaagtattggtcgaaatttttatcgcgtagttgttcgacgtattatcgtaaattatgtcgttgatatcgtcgattatattgttgatcgttatcgagatggttttataacgtttatttattagttatgttatttcggcggcggtttttattgttgcggtcgttgcggtatatagcgtagataaacgcggtaattggttatggatgtaaattgcgtttaaatgcgaaagtattagcgtacgcgttagtcgtttattattcgtttcgaagtgttttgttattattattataggtattgttgcggtaattttttggttattcgagtcggagttatttatagtcggaagcgtagcgtcgtttatacgcgtatcggatgtcgcgttggtacgaattataatggatgaagagagatttttcgttagtaaatcgcgttcgtattgtttttttagcgtcgcgttaatatgtagtttttatttatcgtttaaatttttttgcgataacgtataatttagtttcgcggaatcgagaataaagcggatcgtcgtcgttggtcggtttgttgaggtcgatttggaagtatcgttaggataattttttggtgtgaaaggtgtttacgtcgcggaatttggagggcgtatttatttgtattagggtatcgttgacggtaattttgaacgtaaattttagttagttgagaatatttatgttcgtggtgttaatttggt

SEQ ID NO: 13418 - DNA, 890 bp, Artificial Sequence
  chemically treated genomic DNA (Homo sapiens) CpG-island No: 13418
accaaattaacaccacgaacataaatattctcaactaactaaaatttacgttcaaaattaccgtcaacgataccctaatacaaataaatacgccctccaaattccgcgacgtaaacacctttcacaccaaaaaattatcctaacgatacttccaaatcgacctcaacaaaccgaccaacgacgacgatccgctttattctcgattccgcgaaactaaattatacgttatcgcaaaaaaatttaaacgataaataaaaactacatattaacgcgacgctaaaaaaacaatacgaacgcgatttactaacgaaaaatctctcttcatccattataattcgtaccaacgcgacatccgatacgcgtataaacgacgctacgcttccgactataaataactccgactcgaataaccaaaaaattaccgcaacaatacctataataataataacaaaacacttcgaaacgaataataaacgactaacgcgtacgctaatactttcgcatttaaacgcaatttacatccataaccaattaccgcgtttatctacgctatataccgcaacgaccgcaacaataaaaaccgccgccgaaataacataactaataaataaacgttataaaaccatctcgataacgatcaacaatataatcgacgatatcaacgacataatttacgataatacgtcgaacaactacgcgataaaaatttcgaccaatacttcgactacgtaaaaaacgatattaataacgctaaataataccgccgtaaccgacaataaaaaaattataacgcataatattaaacaatcgattaccaacctatatacgttaacaaaccattcgatacaacaaacgaatcgacaaattatcgaaattataacgaacaaaac

SEQ ID NO: 13419 - DNA, 890 bp, Artificial Sequence
  chemically treated genomic DNA (Homo sapiens) CpG-island No: 13419
attaggttagtattacgaatatgaatgtttttagttaattggaatttgcgtttaaagttgtcgttagcgatgttttggtatagataggtgcgttttttaagtttcgcggcgtgagtattttttatattaggagattattttggcggtatttttagatcgattttagtaaatcggttagcgacggcgattcgttttattttcgatttcgcgaagttaaattgtgcgttatcgtaggaaggtttgagcggtaagtgggggttgtatattggcgcgacgttggaaaaatagtgcgagcgcggtttgttggcgaaagatttttttttatttattgtgattcgtattagcgcggtattcgatgcgcgtatgggcggcgttacgttttcggttatgagtaatttcggttcgggtaattaggggattatcgtaataatgtttgtggtggtggtagtagaatatttcggagcggatgatgaacggttggcgcgtgcgttgatgttttcgtatttgagcgtaatttatatttataattagttatcgcgtttgtttgcgttgtgtgtcgtaacgatcgtagtaatgggggtcgtcgtcgggatggtatggttggtggatgggcgttatgaaattatttcgatggcgattagtagtatgatcggcgatgttagcggtatgatttgcgatggtgcgtcgaatagttgcgcgatgaaggtttcgattagtgtttcggttgcgtggaaagcggtgttaatggcgttggatgatatcgtcgtgatcggtaatgaagggattgtggcgtatgatgttgagtagtcgattgttaatttgtgtgcgttagtaagttattcgatgtagtaaacggatcggtagattatcgagattatggcgagtaaggt

SEQ ID NO: 13420 - DNA, 890 bp, Artificial Sequence
  chemically treated genomic DNA (Homo sapiens) CpG-island No: 13420
accttactcgccataatctcgataatctaccgatccgtttactacatcgaataacttactaacgcacacaaattaacaatcgactactcaacatcatacgccacaatcccttcattaccgatcacgacgatatcatccaacgccattaacaccgctttccacgcaaccgaaacactaatcgaaaccttcatcgcgcaactattcgacgcaccatcgcaaatcataccgctaacatcgccgatcatactactaatcgccatcgaaataatttcataacgcccatccaccaaccataccatcccgacgacgacccccattactacgatcgttacgacacacaacgcaaacaaacgcgataactaattataaatataaattacgctcaaatacgaaaacatcaacgcacgcgccaaccgttcatcatccgctccgaaatattctactaccaccaccacaaacattattacgataatcccctaattacccgaaccgaaattactcataaccgaaaacgtaacgccgcccatacgcgcatcgaataccgcgctaatacgaatcacaataaataaaaaaaaatctttcgccaacaaaccgcgctcgcactatttttccaacgtcgcgccaatatacaacccccacttaccgctcaaaccttcctacgataacgcacaatttaacttcgcgaaatcgaaaataaaacgaatcgccgtcgctaaccgatttactaaaatcgatctaaaaataccgccaaaataatctcctaatataaaaaatactcacgccgcgaaacttaaaaaacgcacctatctataccaaaacatcgctaacgacaactttaaacgcaaattccaattaactaaaaacattcatattcgtaatactaacctaat

SEQ ID NO: 13421 - DNA, 784 bp, Artificial Sequence
  chemically treated genomic DNA (Homo sapiens) CpG-island No: 13421
gcgtagcgtggttataagttattttttcggatatgttggtgaaagagggcgatatgcgtttttttcgcgtttagtaagtttttatttttcgcggtatgattattgatcgttttggtcgttcgttagcggtgagcgtgtcggtaaaagcgatttgggttgattcgaaagaagtgtatgacgttggcggtattagcgtcggtgatcgttggaaggcgttggttcgttcgtaataaatgtatcgagcgttatcgatagttttagcgtatttataaataatgcggaatttaatattagtagtagcgtcgcggcggtgaatatttttcgtacgttagaagttgtaataaagcggaatatcggacgtagtaaatagcgtttattaattagtatgtcgataaacgttagtatttttatgtcgatttttatttagtcgaaatgttcgtttgtcgatttcgttaataacggtattaacgttagtgttgggattattgttagattttgaaatagtagaatcgaaaattcgagttggtcggattcgttgcgatttattttttttttacgtattaattgtaacgttattgtagttgaagatatcgtaaggttaatgttatcgattatcgtcgtttgttaggcgaaattcgttagtattaataatttcgttagtaacgtcgcgtttaatagtatttgtgtcgcgtttacgttaaaaatcgaacgtcgtagttgttaaagtttggagggatttaatttaaggtcgatgataaatattaggaatattacgtcgagtttt

SEQ ID NO: 13422 - DNA, 784 bp, Artificial Sequence
  chemically treated genomic DNA (Homo sapiens) CpG-island No: 13422
aaaactcgacgtaatattcctaatatttatcatcgaccttaaattaaatccctccaaactttaacaactacgacgttcgatttttaacgtaaacgcgacacaaatactattaaacgcgacgttactaacgaaattattaatactaacgaatttcgcctaacaaacgacgataatcgataacattaaccttacgatatcttcaactacaataacgttacaattaatacgtaaaaaaaaaataaatcgcaacgaatccgaccaactcgaattttcgattctactatttcaaaatctaacaataatcccaacactaacgttaataccgttattaacgaaatcgacaaacgaacatttcgactaaataaaaatcgacataaaaatactaacgtttatcgacatactaattaataaacgctatttactacgtccgatattccgctttattacaacttctaacgtacgaaaaatattcaccgccgcgacgctactactaatattaaattccgcattatttataaatacgctaaaactatcgataacgctcgatacatttattacgaacgaaccaacgccttccaacgatcaccgacgctaataccgccaacgtcatacacttctttcgaatcaacccaaatcgcttttaccgacacgctcaccgctaacgaacgaccaaaacgatcaataatcataccgcgaaaaataaaaacttactaaacgcgaaaaaaacgcatatcgccctctttcaccaacatatccgaaaaaataacttataaccacgctacgc

SEQ ID NO: 13423 - DNA, 784 bp, Artificial Sequence
  chemically treated genomic DNA (Homo sapiens) CpG-island No: 13423
ggaattcggcgtggtatttttgatgtttattatcggttttgagttgaatttttttaaattttggtaattacggcgttcgatttttggcgtaggcgcggtataggtgttgttaagcgcggcgttgttggcgggattattgatgttgacggatttcgtttggtaggcggcggtggtcggtggtattggttttgcgatgtttttaattgtaatggcgttgtaattgatgcgtgagaaagggatgaatcgtagcgaattcggttagttcgggttttcggttttgttgttttaggatttggtagtaattttagtattggcgttagtgtcgttgttggcggggtcggtagacgaatatttcgattggatgaaggtcggtatgaaggtgttggcgtttgtcggtatgttgattggtgggcgttatttattgcgttcggtatttcgttttattgtagtttttggcgtgcgggaagtgtttatcgtcgcgacgttgttgttggtgttgggtttcgtattgtttatggatgcgttggggttgtcgatggcgttcggtatatttattgcgggcgagttagcgttttttagcggttatcgacgttgatatcgttagcgttatgtatttttttcgggttagtttaaatcgtttttatcggtacgtttatcgttaacgggcgattagaacggttagtaattatgtcgcgggaggtggaaatttgttgaacgcgaagagaacgtatgtcgtttttttttattagtatattcggggagataatttgtaattacgttacgt

SEQ ID NO: 13424 - DNA, 784 bp, Artificial Sequence
  chemically treated genomic DNA (Homo sapiens) CpG-island No: 13424
acgtaacgtaattacaaattatctccccgaatatactaataaaaaaaaacgacatacgttctcttcgcgttcaacaaatttccacctcccgcgacataattactaaccgttctaatcgcccgttaacgataaacgtaccgataaaaacgatttaaactaacccgaaaaaaatacataacgctaacgatatcaacgtcgataaccgctaaaaaacgctaactcgcccgcaataaatataccgaacgccatcgacaaccccaacgcatccataaacaatacgaaacccaacaccaacaacaacgtcgcgacgataaacacttcccgcacgccaaaaactacaataaaacgaaataccgaacgcaataaataacgcccaccaatcaacataccgacaaacgccaacaccttcataccgaccttcatccaatcgaaatattcgtctaccgaccccgccaacaacgacactaacgccaatactaaaattactaccaaatcctaaaacaacaaaaccgaaaacccgaactaaccgaattcgctacgattcatccctttctcacgcatcaattacaacgccattacaattaaaaacatcgcaaaaccaataccaccgaccaccgccgcctaccaaacgaaatccgtcaacatcaataatcccgccaacaacgccgcgcttaacaacacctataccgcgcctacgccaaaaatcgaacgccgtaattaccaaaatttaaaaaaattcaactcaaaaccgataataaacatcaaaaataccacgccgaattcc

SEQ ID NO: 13425 - DNA, 540 bp, Artificial Sequence
  chemically treated genomic DNA (Homo sapiens) CpG-island No: 13425
gggcggtggtgtattacggtttatgacggttgtcgttagtttaattattgttattttatatttgcgttgcgtggcgttggtagttagttttagattaatagtttcggtatcgattattacgattggtcggttcggttgtcgaattttttcgcgttcggggggatatcgggatgggtagggtaagcgcggtttttcgggttttagttcgcgcgggttattgtcgttcgggggttataagcggttttcggttcgttgtcggggtgaattattttcgtttggtttcggttgtggtttcgtcgcgacgaagagttttcgttttacggggttattattttttggggcgtttagttcgtcgacgaggttaattaattgattaattttttttatcgttatacggatgttggtggatttattgttgcgcgtcgttttttttcgttttacgcggtcggttggcgtttgttcggttgttagtttaagtattggtggggtggatatttttggcgagatttttattgttttaaaggtaatttgatcggtttt

SEQ ID NO: 13426 - DNA, 540 bp, Artificial Sequence
  chemically treated genomic DNA (Homo sapiens) CpG-island No: 13426
aaaaccgatcaaattacctttaaaacaataaaaatctcgccaaaaatatccaccccaccaatacttaaactaacaaccgaacaaacgccaaccgaccgcgtaaaacgaaaaaaaacgacgcgcaacaataaatccaccaacatccgtataacgataaaaaaaattaatcaattaattaacctcgtcgacgaactaaacgccccaaaaaataataaccccgtaaaacgaaaactcttcgtcgcgacgaaaccacaaccgaaaccaaacgaaaataattcaccccgacaacgaaccgaaaaccgcttataacccccgaacgacaataacccgcgcgaactaaaacccgaaaaaccgcgcttaccctacccatcccgatatccccccgaacgcgaaaaaattcgacaaccgaaccgaccaatcgtaataatcgataccgaaactattaatctaaaactaactaccaacgccacgcaacgcaaatataaaataacaataattaaactaacgacaaccgtcataaaccgtaatacaccaccgccc

SEQ ID NO: 13427 - DNA, 540 bp, Artificial Sequence
  chemically treated genomic DNA (Homo sapiens) CpG-island No: 13427
gaagtcgattagattatttttgaaatagtagaagtttcgttaaaaatatttattttattagtgtttaaattggtagtcgaataagcgttaatcggtcgcgtggagcgggaaaaaacgacgcgtagtaatgaatttattagtattcgtgtagcggtagaaaaggttgattaattaattaatttcgtcggcgagttgggcgttttagagagtagtgatttcgtagggcgaaaatttttcgtcgcggcggaattataatcggggttaaacggaggtggtttatttcggtaacgggtcgggaatcgtttatagttttcgggcggtagtgattcgcgcgggttgaagttcggggaatcgcgtttattttatttatttcggtattttttcggacgcggagaagttcggtagtcggatcggttagtcgtgataatcggtgtcggaattattggtttggaattggttgttagcgttacgtagcgtagatgtaaggtgatagtgattgaattggcggtaatcgttatgggtcgtaatgtattatcgttt

SEQ ID NO: 13428 - DNA, 540 bp, Artificial Sequence
  chemically treated genomic DNA (Homo sapiens) CpG-island No: 13428
aaacgataatacattacgacccataacgattaccgccaattcaatcactatcaccttacatctacgctacgtaacgctaacaaccaattccaaaccaataattccgacaccgattatcacgactaaccgatccgactaccgaacttctccgcgtccgaaaaaataccgaaataaataaaataaacgcgattccccgaacttcaacccgcgcgaatcactaccgcccgaaaactataaacgattcccgacccgttaccgaaataaaccacctccgtttaaccccgattataattccgccgcgacgaaaaattttcgccctacgaaatcactactctctaaaacgcccaactcgccgacgaaattaattaattaatcaaccttttctaccgctacacgaatactaataaattcattactacgcgtcgttttttcccgctccacgcgaccgattaacgcttattcgactaccaatttaaacactaataaaataaatatttttaacgaaacttctactatttcaaaaataatctaatcgacttc

SEQ ID NO: 13429 - DNA, 671 bp, Artificial Sequence
  chemically treated genomic DNA (Homo sapiens) CpG-island No: 13429
atggtatagtttggcgtaatacgtttggtggatttgattggtcgtatcgatttgttgaaagagttggacggttttatcgttaaatagtagaagttggcgttgtcgaagttgttggagattgtcgaatcgtatttaggtaaggtattttattgtatcgaaaataattcgtcgtttgataacggtttgttgaacgcgtagttgttgtaataggcgaaatcgtttgtcgatgagcgttagagtaaaattttttggttcgatattcgtaatatcgatcgttttgtcggcgcgtcgtttttaggttatatcgtttagacgtacggcgattaggggttggtagtcgattttattaaagcgtattttaacggtatcgtaggttagagtttcggcgtgtggaacgcgggcggcgtggaattgtatttgatcggtgatgttaacgattatgtcggtaaaggtatggcgggcggtttaatcgttattcgtttttcggttggtttcgtttttcgtagttatgaagtaagtattatcggtaatatttgtttgtatgggcggatcggggtgttttttttttaaggcggttcgggagaaatataggggggagtattcgggattttaggagaagacggtgttttagggtattatttggcgtttttttttttgtttttttttttttt

SEQ ID NO: 13430 - DNA, 671 bp, Artificial Sequence
  chemically treated genomic DNA (Homo sapiens) CpG-island No: 13430
aaaaaaaaaaaaaacaaaaaaaaaaacgccaaataataccctaaaacaccgtcttctcctaaaatcccgaatactcccccctatatttctcccgaaccgccttaaaaaaaaaacaccccgatccgcccatacaaacaaatattaccgataatacttacttcataactacgaaaaacgaaaccaaccgaaaaacgaataacgattaaaccgcccgccatacctttaccgacataatcgttaacatcaccgatcaaatacaattccacgccgcccgcgttccacacgccgaaactctaacctacgataccgttaaaatacgctttaataaaatcgactaccaacccctaatcgccgtacgtctaaacgatataacctaaaaacgacgcgccgacaaaacgatcgatattacgaatatcgaaccaaaaaattttactctaacgctcatcgacaaacgatttcgcctattacaacaactacgcgttcaacaaaccgttatcaaacgacgaattattttcgatacaataaaataccttacctaaatacgattcgacaatctccaacaacttcgacaacgccaacttctactatttaacgataaaaccgtccaactctttcaacaaatcgatacgaccaatcaaatccaccaaacgtattacgccaaactataccat

SEQ ID NO: 13431 - DNA, 671 bp, Artificial Sequence
  chemically treated genomic DNA (Homo sapiens) CpG-island No: 13431
aagaagagaaaggataaagagaaaaacgttagataatattttggggtatcgtttttttttgggatttcgggtatttttttttatatttttttcgggtcgttttggaaaaaaagtatttcggttcgtttatataggtaggtgttgtcgataatgtttgttttatggttgcggaaggcggaattaatcggaggacgaatggcgattaagtcgttcgttatgtttttatcgatatagtcgttggtattatcggttaggtatagttttacgtcgttcgcgttttatacgtcgaagttttggtttgcggtgtcgttgaagtacgttttgataggatcggttgttagtttttgatcgtcgtgcgtttgggcgatatagtttgaaagcgacgcgtcgatagaacggtcggtgttgcgaatatcgaattagaaggttttgttttggcgtttatcgataaacggtttcgtttgttgtagtaattgcgcgtttagtaggtcgttattaaacggcgggttgttttcggtgtagtagagtgttttatttggatgcggttcggtagtttttagtagtttcgatagcgttagtttttgttgtttggcggtgaaatcgtttagtttttttagtaggtcggtgcgattaattagatttattagacgtgttacgttaagttgtgttat

SEQ ID NO: 13432 - DNA, 671 bp, Artificial Sequence
  chemically treated genomic DNA (Homo sapiens) CpG-island No: 13432
ataacacaacttaacgtaacacgtctaataaatctaattaatcgcaccgacctactaaaaaaactaaacgatttcaccgccaaacaacaaaaactaacgctatcgaaactactaaaaactaccgaaccgcatccaaataaaacactctactacaccgaaaacaacccgccgtttaataacgacctactaaacgcgcaattactacaacaaacgaaaccgtttatcgataaacgccaaaacaaaaccttctaattcgatattcgcaacaccgaccgttctatcgacgcgtcgctttcaaactatatcgcccaaacgcacgacgatcaaaaactaacaaccgatcctatcaaaacgtacttcaacgacaccgcaaaccaaaacttcgacgtataaaacgcgaacgacgtaaaactatacctaaccgataataccaacgactatatcgataaaaacataacgaacgacttaatcgccattcgtcctccgattaattccgccttccgcaaccataaaacaaacattatcgacaacacctacctatataaacgaaccgaaatactttttttccaaaacgacccgaaaaaaatataaaaaaaaatacccgaaatcccaaaaaaaaacgataccccaaaatattatctaacgtttttctctttatcctttctcttctt

SEQ ID NO: 13433 - DNA, 578 bp, Artificial Sequence
  chemically treated genomic DNA (Homo sapiens) CpG-island No: 13433
cgcggtagagtatagttcgttgtatatttcggtagattcgttgtaaagtatgagtcgtgaagagaagttggatattttgcgtcgcgtcgataaggttgttcgcgaagcggataagcgcgtataggaagtgattgttagttttagtggtgtttatgaattaattttggttgcggttatcgacggtacgttagcggcggatgttcgttcgttggtgcgttttttcgtgagcgttttcgtcgaagaagatggtaaacgcgaacgcggtgttagtggcggcggcggtcgttttggttatgaatttttttttgtcgatttcgacggcgaagttcgtgcggatgtatgggtaaaagaagtagtgcgtatggcgttggttaatttttttgtcgttgttgtattagcgggtattatgtcggtagtatttggcgtaggttggtcgggcgtgttgttgtatgaagcggttggttacggtttggaaggcgattttaatcgtcgtggtattttagtatttagtggatagtcggggagttggtggttttagaattgtgtatcgtagtgatgatggattagttgattatttt

SEQ ID NO: 13434 - DNA, 578 bp, Artificial Sequence
  chemically treated genomic DNA (Homo sapiens) CpG-island No: 13434
aaaataatcaactaatccatcatcactacgatacacaattctaaaaccaccaactccccgactatccactaaatactaaaataccacgacgattaaaatcgccttccaaaccgtaaccaaccgcttcatacaacaacacgcccgaccaacctacgccaaatactaccgacataatacccgctaatacaacaacgacaaaaaaattaaccaacgccatacgcactacttcttttacccatacatccgcacgaacttcgccgtcgaaatcgacaaaaaaaaattcataaccaaaacgaccgccgccgccactaacaccgcgttcgcgtttaccatcttcttcgacgaaaacgctcacgaaaaaacgcaccaacgaacgaacatccgccgctaacgtaccgtcgataaccgcaaccaaaattaattcataaacaccactaaaactaacaatcacttcctatacgcgcttatccgcttcgcgaacaaccttatcgacgcgacgcaaaatatccaacttctcttcacgactcatactttacaacgaatctaccgaaatatacaacgaactatactctaccgcg

SEQ ID NO: 13435 - DNA, 578 bp, Artificial Sequence
  chemically treated genomic DNA (Homo sapiens) CpG-island No: 13435
gggataattagttggtttattattattacggtatatagttttgaagttattagtttttcgattgtttattaaatattgaagtgttacggcggttgaagtcgttttttagatcgtgattaatcgttttatgtaatagtacgttcggttaatttgcgttaagtattatcggtatggtgttcgttggtgtagtaacggtagaaagattgattagcgttatacgtattgttttttttgtttatgtattcgtacggatttcgtcgtcgagatcggtaaggaagaatttataattaaaacgatcgtcgtcgttattggtatcgcgttcgcgtttgttatttttttcgacgagaacgtttacggaaagacgtattagcggacggatattcgtcgttagcgtgtcgtcggtggtcgtaattaaaattaatttatagatattattgaggttggtagttattttttgtacgcgtttgttcgtttcgcgggtaattttatcgacgcgacgtaggatatttagtttttttttacggtttatgttttgtagcggatttatcgaggtatataacgggttatgttttatcgcg

SEQ ID NO: 13436 - DNA, 578 bp, Artificial Sequence
  chemically treated genomic DNA (Homo sapiens) CpG-island No: 13436
cgcgataaaacataacccgttatatacctcgataaatccgctacaaaacataaaccgtaaaaaaaaactaaatatcctacgtcgcgtcgataaaattacccgcgaaacgaacaaacgcgtacaaaaaataactaccaacctcaataatatctataaattaattttaattacgaccaccgacgacacgctaacgacgaatatccgtccgctaatacgtctttccgtaaacgttctcgtcgaaaaaaataacaaacgcgaacgcgataccaataacgacgacgatcgttttaattataaattcttccttaccgatctcgacgacgaaatccgtacgaatacataaacaaaaaaaacaatacgtataacgctaatcaatctttctaccgttactacaccaacgaacaccataccgataatacttaacgcaaattaaccgaacgtactattacataaaacgattaatcacgatctaaaaaacgacttcaaccgccgtaacacttcaatatttaataaacaatcgaaaaactaataacttcaaaactatataccgtaataataataaaccaactaattatccc

SEQ ID NO: 13437 - DNA, 509 bp, Artificial Sequence
  chemically treated genomic DNA (Homo sapiens) CpG-island No: 13437
atcgcggtcgagtataatttgtaggtgttggattttattattgttaacgtggcgatttttattatcgtcgggaatttgggtttatcgtttagttaggaacgtgggtaattatttttttcggggtggcgaatgttatttcgatttcgtttatcggttggttggtaaagcgcgtcggggaagtgaaattgtttttttggtttattatcgtttttgttattgcgtcgtgggcgtgtggtgtttttagtagtttgaatatgttgattttttttcgcgtgatttaggggattgtcgtcgggtcgttgatttcgttttcgtaaagtttattgttgaataattattcgttagttaaacgttcgatcgcgttggcgttgtggtcgatgacggtgattgtcgcgttaatttgcggttcgattttcggcggttatattagcgataattattattggggttggatattttttattaacgtgtcgattggcgtggcggtggtgttgatgatattgtaaatt

SEQ ID NO: 13438 - DNA, 509 bp, Artificial Sequence
  chemically treated genomic DNA (Homo sapiens) CpG-island No: 13438
aatttacaatatcatcaacaccaccgccacgccaatcgacacgttaataaaaaatatccaaccccaataataattatcgctaatataaccgccgaaaatcgaaccgcaaattaacgcgacaatcaccgtcatcgaccacaacgccaacgcgatcgaacgtttaactaacgaataattattcaacaataaactttacgaaaacgaaatcaacgacccgacgacaatcccctaaatcacgcgaaaaaaaatcaacatattcaaactactaaaaacaccacacgcccacgacgcaataacaaaaacgataataaaccaaaaaaacaatttcacttccccgacgcgctttaccaaccaaccgataaacgaaatcgaaataacattcgccaccccgaaaaaaataattacccacgttcctaactaaacgataaacccaaattcccgacgataataaaaatcgccacgttaacaataataaaatccaacacctacaaattatactcgaccgcgat

SEQ ID NO: 13439 - DNA, 509 bp, Artificial Sequence
  chemically treated genomic DNA (Homo sapiens) CpG-island No: 13439
gatttgtagtgttattaatattatcgttacgttaatcggtacgttgatgaagaatatttagttttagtggtaattatcgttgatataatcgtcgaggatcgggtcgtaaattggcgcgataattatcgttatcgattataacgttagcgcgatcgagcgtttggttggcgggtagttatttagtaatagattttgcgaaagcgggattaacggttcggcgataattttttgaattacgcggaagaagattagtatatttaggttgttggagatattatacgtttacgacgtaatagtaaaggcgatggtggattaaaggaatagttttattttttcgacgcgttttgttagttagtcggtaagcgggatcgagatggtattcgttatttcgaaagaagtgattatttacgtttttggttgagcgatgagtttagattttcggcgatagtggggatcgttacgttagtaatggtggagtttagtatttgtagattatgttcgatcgcggt

SEQ ID NO: 13440 - DNA, 509 bp, Artificial Sequence
  chemically treated genomic DNA (Homo sapiens) CpG-island No: 13440
accgcgatcgaacataatctacaaatactaaactccaccattactaacgtaacgatccccactatcgccgaaaatctaaactcatcgctcaaccaaaaacgtaaataatcacttctttcgaaataacgaataccatctcgatcccgcttaccgactaactaacaaaacgcgtcgaaaaaataaaactattcctttaatccaccatcgcctttactattacgtcgtaaacgtataatatctccaacaacctaaatatactaatcttcttccgcgtaattcaaaaaattatcgccgaaccgttaatcccgctttcgcaaaatctattactaaataactacccgccaaccaaacgctcgatcgcgctaacgttataatcgataacgataattatcgcgccaatttacgacccgatcctcgacgattatatcaacgataattaccactaaaactaaatattcttcatcaacgtaccgattaacgtaacgataatattaataacactacaaatc

SEQ ID NO: 13441 - DNA, 548 bp, Artificial Sequence
  chemically treated genomic DNA (Homo sapiens) CpG-island No: 13441
tcgttttcggtcgcgtgagcgatatggtgtttttcgatgattttaattcgttaatcggttttatgttaatcgatatcgttatttggggtgaagacggtaattttatcgatgtcgtcgtttatatgattttgtttgttattgtgttgggtattatttcgttggcggttattgtgcgtatgatacgtttttcgatgttggaagtgttgggcgaggattatattcgtatcgcgcgcgttaaagggttaattcgtatgcgggtgattatcgtttatgcgttgcgtaacgcgatgttgtcggtggtgatcgttatcggtttgtaggtgggaatattgttggcgggggcgattttgatcgaaattattttttcgtggttcggtttgggacgttggttgattgacgtattgtaacgtcgcgattattcggtagtgtagggcggcgtattgttggtggcgacgatgattattttcgttaatttgttggtcgatttgttgtacggcgtggtgaattcgcgtattcgttataagaagtaaggggatattatgttatag

SEQ ID NO: 13442 - DNA, 548 bp, Artificial Sequence
  chemically treated genomic DNA (Homo sapiens) CpG-island No: 13442
ctataacataatatccccttacttcttataacgaatacgcgaattcaccacgccgtacaacaaatcgaccaacaaattaacgaaaataatcatcgtcgccaccaacaatacgccgccctacactaccgaataatcgcgacgttacaatacgtcaatcaaccaacgtcccaaaccgaaccacgaaaaaataatttcgatcaaaatcgcccccgccaacaatattcccacctacaaaccgataacgatcaccaccgacaacatcgcgttacgcaacgcataaacgataatcacccgcatacgaattaaccctttaacgcgcgcgatacgaatataatcctcgcccaacacttccaacatcgaaaaacgtatcatacgcacaataaccgccaacgaaataatacccaacacaataacaaacaaaatcatataaacgacgacatcgataaaattaccgtcttcaccccaaataacgatatcgattaacataaaaccgattaacgaattaaaatcatcgaaaaacaccatatcgctcacgcgaccgaaaacga

SEQ ID NO: 13443 - DNA, 548 bp, Artificial Sequence
  chemically treated genomic DNA (Homo sapiens) CpG-island No: 13443
ttgtgatatgatgtttttttattttttatgacgaatacgcgggtttattacgtcgtatagtagatcgattagtaagttgacgaggataattatcgtcgttattagtaatacgtcgttttgtattatcggatagtcgcggcgttgtagtgcgttaattaattagcgttttagatcgggttacgagaagatggtttcggttagaatcgttttcgttagtaatgtttttatttgtaggtcgataacggttattatcggtagtatcgcgttacgtagcgtatggacgataattattcgtatgcgggttagttttttggcgcgcgcggtgcggatgtaattttcgtttagtatttttagtatcgaggagcgtgttatacgtataatgatcgttagcggaatagtatttagtataatggtaggtaagattatatgggcgacggtatcgataaagttgtcgtttttattttagatggcggtgtcgattagtataaaatcggttaacggattggagttatcgaggaatattatatcgtttacgcgatcggagacgg

SEQ ID NO: 13444 - DNA, 548 bp, Artificial Sequence
  chemically treated genomic DNA (Homo sapiens) CpG-island No: 13444
ccgtctccgatcgcgtaaacgatataatattcctcgataactccaatccgttaaccgattttatactaatcgacaccgccatctaaaataaaaacgacaactttatcgataccgtcgcccatataatcttacctaccattatactaaatactattccgctaacgatcattatacgtataacacgctcctcgatactaaaaatactaaacgaaaattacatccgcaccgcgcgcgccaaaaaactaacccgcatacgaataattatcgtccatacgctacgtaacgcgatactaccgataataaccgttatcgacctacaaataaaaacattactaacgaaaacgattctaaccgaaaccatcttctcgtaacccgatctaaaacgctaattaattaacgcactacaacgccgcgactatccgataatacaaaacgacgtattactaataacgacgataattatcctcgtcaacttactaatcgatctactatacgacgtaataaacccgcgtattcgtcataaaaaataaaaaaacatcatatcacaa

SEQ ID NO: 13445 - DNA, 570 bp, Artificial Sequence
  chemically treated genomic DNA (Homo sapiens) CpG-island No: 13445
  misc_feature (567)..(567): n is either a, c, g or t
gtcgggttggtttacgtcgttatcgtgttaaatacggacggtttcgtcgttaggtttaggatagtttcggtaaagaagtataagaacgttatattttgatttacgaaattcgtaatttttagtaatttaacgcgtaaatggtttaggaagcgattaatttgacgcgcgcgttgaaaggcgataataaaatttagggtaattggggcgaggtagtattgacgcgggtgttggaggttttcggtttgcgtgaagggtatgaatatgaaatttaggttagtatcgaaaatgacgttcgttcgcggatgtagtcggatgttatcgtgcgtttgtcgtagggaaaagatgtggtgatcgacgttaaaatgacgttggtcgtttatgaacgttattttaacgtcgaagacgattatataagtagttcggatcgtagtttaaggcgtcgtattgtatcggatagtcgattaatgttatcggcggttaggtgatgttttgattaatagcggagatttattaaggattttcgtgagattatagaatgtttgatgcgttacgtttattaggtatatnagg

SEQ ID NO: 13446 - DNA, 570 bp, Artificial Sequence
  chemically treated genomic DNA (Homo sapiens) CpG-island No: 13446
  misc_feature (4)..(4): n is either a, c, g or t
cctnatatacctaataaacgtaacgcatcaaacattctataatctcacgaaaatccttaataaatctccgctattaatcaaaacatcacctaaccgccgataacattaatcgactatccgatacaatacgacgccttaaactacgatccgaactacttatataatcgtcttcgacgttaaaataacgttcataaacgaccaacgtcattttaacgtcgatcaccacatcttttccctacgacaaacgcacgataacatccgactacatccgcgaacgaacgtcattttcgatactaacctaaatttcatattcatacccttcacgcaaaccgaaaacctccaacacccgcgtcaatactacctcgccccaattaccctaaattttattatcgcctttcaacgcgcgcgtcaaattaatcgcttcctaaaccatttacgcgttaaattactaaaaattacgaatttcgtaaatcaaaatataacgttcttatacttctttaccgaaactatcctaaacctaacgacgaaaccgtccgtatttaacacgataacgacgtaaaccaacccgac

SEQ ID NO: 13447 - DNA, 570 bp, Artificial Sequence
  chemically treated genomic DNA (Homo sapiens) CpG-island No: 13447
  misc_feature (4)..(4): n is either a, c, g or t
tttngtatgtttgatgagcgtagcgtattaggtattttatagttttacggagatttttaatggattttcgttgttgattagaatattatttgatcgtcggtgatattgatcgattgttcggtgtagtacgacgttttagattgcggttcgagttatttatgtagtcgttttcggcgttaaaatagcgtttataggcgattagcgttattttggcgtcgattattatattttttttttgcggtaggcgtacgatgatattcggttgtattcgcgagcgggcgttattttcgatgttgatttgggttttatatttatattttttacgtagatcggaagtttttagtattcgcgttaatattatttcgttttagttgttttgggttttattgtcgttttttagcgcgcgcgttaggttgatcgttttttgggttatttgcgcgttgagttgttggagattgcgaatttcgtgggttagggtatggcgtttttgtgtttttttatcgaagttgttttgaatttgacggcggaatcgttcgtgtttagtacgatgacgacgtaaattagttcgat

SEQ ID NO: 13448 - DNA, 570 bp, Artificial Sequence
  chemically treated genomic DNA (Homo sapiens) CpG-island No: 13448
  misc_feature (567)..(567): n is either a, c, g or t
atcgaactaatttacgtcgtcatcgtactaaacacgaacgattccgccgtcaaattcaaaacaacttcgataaaaaaacacaaaaacgccataccctaacccacgaaattcgcaatctccaacaactcaacgcgcaaataacccaaaaaacgatcaacctaacgcgcgcgctaaaaaacgacaataaaacccaaaacaactaaaacgaaataatattaacgcgaatactaaaaacttccgatctacgtaaaaaatataaatataaaacccaaatcaacatcgaaaataacgcccgctcgcgaatacaaccgaatatcatcgtacgcctaccgcaaaaaaaaaatataataatcgacgccaaaataacgctaatcgcctataaacgctattttaacgccgaaaacgactacataaataactcgaaccgcaatctaaaacgtcgtactacaccgaacaatcgatcaatatcaccgacgatcaaataatattctaatcaacaacgaaaatccattaaaaatctccgtaaaactataaaatacctaatacgctacgctcatcaaacatacnaaa

SEQ ID NO: 13449 - DNA, 743 bp, Artificial Sequence
  chemically treated genomic DNA (Homo sapiens) CpG-island No: 13449
tttgcgttagcgtattatgaaacgtttacgcgcgttgattaatcggtgtttgttagtttagttattgttgttagaaagtggcgagatttagttgattgtttattcgcggtattgttatcggatgcgttatttcgtggtatgaggttgcgagcgtttttagagtataagtcgttttatttttataatttaacgtggttggcgtatagtttagtgtcgtcgttattgtatcgaaaaaacgtttatacgatgacgttagcggcgcgttaattttacgtttaatggttcgcgttagtacgttttagttttgttgttgtatatttgttgttttagagtaattttgttatttcggtataaagcgtaggtattgcgttagtaggtttcgttacggttgtttcgttgttaaatcgttattcggaagcgttattgtaggtaagtcgtttaggtgtttatattcgcgatagtttattcgtaggtattcgtcgttttattaagcgtcgtttttttttatatcgatatcgtcgagcgttaaagtaatgatattatcgttatttagcggttattgatgttttgttagatacgtcgttgtatgggtatgatgatgtagtatcgtttgcgtcggtagatttattttacgtttttattggttggagatatagttcggatgcgcgttatgtataacgtattgcggggtaaaatcgtagatgttttgtattagtgtttgaagtgattttagaggatttttt

SEQ ID NO: 13450 - DNA, 743 bp, Artificial Sequence
  chemically treated genomic DNA (Homo sapiens) CpG-island No: 13450
aaaaaatcctctaaaatcacttcaaacactaatacaaaacatctacgattttaccccgcaatacgttatacataacgcgcatccgaactatatctccaaccaataaaaacgtaaaataaatctaccgacgcaaacgatactacatcatcatacccatacaacgacgtatctaacaaaacatcaataaccgctaaataacgataatatcattactttaacgctcgacgatatcgatataaaaaaaaacgacgcttaataaaacgacgaatacctacgaataaactatcgcgaatataaacacctaaacgacttacctacaataacgcttccgaataacgatttaacaacgaaacaaccgtaacgaaacctactaacgcaatacctacgctttataccgaaataacaaaattactctaaaacaacaaatatacaacaacaaaactaaaacgtactaacgcgaaccattaaacgtaaaattaacgcgccgctaacgtcatcgtataaacgttttttcgatacaataacgacgacactaaactatacgccaaccacgttaaattataaaaataaaacgacttatactctaaaaacgctcgcaacctcataccacgaaataacgcatccgataacaataccgcgaataaacaatcaactaaatctcgccactttctaacaacaataactaaactaacaaacaccgattaatcaacgcgcgtaaacgtttcataatacgctaacgcaaa

SEQ ID NO: 13451 - DNA, 743 bp, Artificial Sequence
  chemically treated genomic DNA (Homo sapiens) CpG-island No: 13451
gggggattttttagagttattttaagtattgatgtaaaatatttacgattttatttcgtaatacgttgtgtatgacgcgtattcgggttatgtttttagttagtgggggcgtgaaatgaatttgtcgacgtaaacggtattgtattattatgtttatgtagcggcgtgtttggtagagtattagtggtcgttggatggcggtgatgttattgttttgacgttcgacggtatcggtatgggggagaacggcgtttggtggggcggcgagtgtttgcgggtgaattatcgcgaatgtgagtatttgggcggtttgtttgtagtggcgttttcgggtggcgatttggtagcgaagtagtcgtggcgaaatttgttggcgtagtgtttgcgttttgtgtcggagtggtagaattattttgaaatagtaagtgtgtaatagtaaaattggagcgtgttggcgcgggttattgagcgtggaattaacgcgtcgttggcgttatcgtgtgggcgttttttcgatgtagtggcggcggtattgggttgtgcgttagttacgttaagttatgaaggtgaagcggtttgtgttttggaggcgttcgtagttttatgttacggagtgacgtattcggtgataatgtcgcgggtggataattaattggatttcgttattttttggtagtagtggttgaattggtaggtatcggttaattaacgcgcgtgggcgttttatgatgcgttggcgtagg

SEQ ID NO: 13452 - DNA, 743 bp, Artificial Sequence
  chemically treated genomic DNA (Homo sapiens) CpG-island No: 13452
cctacgccaacgcatcataaaacgcccacgcgcgttaattaaccgatacctaccaattcaaccactactaccaaaaaataacgaaatccaattaattatccacccgcgacattatcaccgaatacgtcactccgtaacataaaactacgaacgcctccaaaacacaaaccgcttcaccttcataacttaacgtaactaacgcacaacccaataccgccgccactacatcgaaaaaacgcccacacgataacgccaacgacgcgttaattccacgctcaataacccgcgccaacacgctccaattttactattacacacttactatttcaaaataattctaccactccgacacaaaacgcaaacactacgccaacaaatttcgccacgactacttcgctaccaaatcgccacccgaaaacgccactacaaacaaaccgcccaaatactcacattcgcgataattcacccgcaaacactcgccgccccaccaaacgccgttctcccccataccgataccgtcgaacgtcaaaacaataacatcaccgccatccaacgaccactaatactctaccaaacacgccgctacataaacataataatacaataccgtttacgtcgacaaattcatttcacgcccccactaactaaaaacataacccgaatacgcgtcatacacaacgtattacgaaataaaatcgtaaatattttacatcaatacttaaaataactctaaaaaatccccc

SEQ ID NO: 13453 - DNA, 583 bp, Artificial Sequence
  chemically treated genomic DNA (Homo sapiens) CpG-island No: 13453
  misc_feature (327)..(328): n is either a, c, g or t
  misc_feature (347)..(347): n is either a, c, g or t
  misc_feature (360)..(360): n is either a, c, g or t
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggtttattttggttnntgtatcgtgttcgtttcgntatggcggtatangtacggtttttcgtttaacgtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcga

SEQ ID NO: 13454 - DNA, 583 bp, Artificial Sequence
  chemically treated genomic DNA (Homo sapiens) CpG-island No: 13454
  misc_feature (224)..(224): n is either a, c, g or t
  misc_feature (237)..(237): n is either a, c, g or t
  misc_feature (256)..(257): n is either a, c, g or t
tcgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacgttaaacgaaaaaccgtacntataccgccatancgaaacgaacacgatacannaaccaaaataaaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 13455 - DNA, 583 bp, Artificial Sequence
  chemically treated genomic DNA (Homo sapiens) CpG-island No: 13455
  misc_feature (224)..(224): n is either a, c, g or t
  misc_feature (237)..(237): n is either a, c, g or t
  misc_feature (256)..(257): n is either a, c, g or t
tcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgcgttgagcggaaaatcgtgtntgtatcgttatgncgaaacgggtacgatatannggttagagtggatcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 13456 - DNA, 583 bp, Artificial Sequence
  chemically treated genomic DNA (Homo sapiens) CpG-island No: 13456
  misc_feature (327)..(328): n is either a, c, g or t
  misc_feature (347)..(347): n is either a, c, g or t
  misc_feature (360)..(360): n is either a, c, g or t
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgatccactctaaccnntatatcgtacccgtttcgncataacgatacanacacgattttccgctcaacgcaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcga

SEQ ID NO: 13457 - DNA, 594 bp, Artificial Sequence
  chemically treated genomic DNA (Homo sapiens) CpG-island No: 13457
  misc_feature (18)..(18): n is either a, c, g or t
  misc_feature (20)..(20): n is either a, c, g or t
  misc_feature (30)..(30): n is either a, c, g or t
  misc_feature (36)..(36): n is either a, c, g or t
ttttattaggtcgttagngnttataggttntttatnggggagatagggtcgtagggcgtaggggtttcggcgcggttggtagcggtcggcgcgttgcgtttttaggttagtttagcggtcggcgttttttgcggtttttttttttagataggatgttcgtcggtagttttcgtttcgttcgcgttcgcgttcgttttttagagtcgttttcggaatagattcgagtacgtttcgttttttgggtcgtagttcgttgtttcgtggtgtcgtatacgtttcgtcgcgttttgtcgttcgttcgtttttcgcggcgtttttatttgggtttggaggattttttttttcgttcgtacgcgttcgttttcgcgttcgcgcggtttgttttagttcggatttaggaggtgtgcggttttgtttgtatttcgttagcgatggggttttattatcgtattttttagtcggttttatgtcggaatgcggagattgttggagcgcgtttttattttagggaattaaaatttttttttttgtagtcgttatttattttttggttttgggtttgttttttttattcgtcgcgggttttttttgagt

SEQ ID NO: 13458 - DNA, 594 bp, Artificial Sequence
  chemically treated genomic DNA (Homo sapiens) CpG-island No: 13458
  misc_feature (559)..(559): n is either a, c, g or t
  misc_feature (565)..(565): n is either a, c, g or t
  misc_feature (575)..(575): n is either a, c, g or t
  misc_feature (577)..(577): n is either a, c, g or t
actcaaaaaaaacccgcgacgaataaaaaaaacaaacccaaaaccaaaaaataaataacgactacaaaaaaaaaaattttaattccctaaaataaaaacgcgctccaacaatctccgcattccgacataaaaccgactaaaaaatacgataataaaaccccatcgctaacgaaatacaaacaaaaccgcacacctcctaaatccgaactaaaacaaaccgcgcgaacgcgaaaacgaacgcgtacgaacgaaaaaaaaaatcctccaaacccaaataaaaacgccgcgaaaaacgaacgaacgacaaaacgcgacgaaacgtatacgacaccacgaaacaacgaactacgacccaaaaaacgaaacgtactcgaatctattccgaaaacgactctaaaaaacgaacgcgaacgcgaacgaaacgaaaactaccgacgaacatcctatctaaaaaaaaaaaccgcaaaaaacgccgaccgctaaactaacctaaaaacgcaacgcgccgaccgctaccaaccgcgccgaaacccctacgccctacgaccctatctccccnataaanaacctataancnctaacgacctaataaaa

SEQ ID NO: 13459 - DNA, 594 bp, Artificial Sequence
  chemically treated genomic DNA (Homo sapiens) CpG-island No: 13459
  misc_feature (559)..(559): n is either a, c, g or t
  misc_feature (565)..(565): n is either a, c, g or t
  misc_feature (575)..(575): n is either a, c, g or t
  misc_feature (577)..(577): n is either a, c, g or t
gtttaagaaagattcgcggcgaatggagaagataagtttaaagttaggaaatgggtggcggttgtagggaagggggttttgattttttaggataaaaacgcgttttaatagttttcgtatttcggtatggagtcggttgaggggtgcggtggtaagattttatcgttagcggagtgtaagtaaagtcgtatattttttgggttcgggttggggtaggtcgcgcgggcgcgggaacgaacgcgtgcggacggggaaaagggttttttaagtttaagtgggagcgtcgcggagggcgagcgagcggtagggcgcggcggggcgtgtgcggtattacgggatagcgggttgcggtttagggggcgaggcgtgttcgggtttatttcgggagcggttttgaggggcgggcgcgggcgcgggcggggcgggggttgtcggcgagtattttgtttgggggaggggatcgtagagagcgtcggtcgttgggttggtttgagagcgtagcgcgtcggtcgttattagtcgcgtcggagtttttgcgttttgcggttttgtttttttngtgggnaatttgtggntnttggcggtttaatggaa

SEQ ID NO: 13460 - DNA, 594 bp, Artificial Sequence
  chemically treated genomic DNA (Homo sapiens) CpG-island No: 13460
  misc_feature (18)..(18): n is either a, c, g or t
  misc_feature (20)..(20): n is either a, c, g or t
  misc_feature (30)..(30): n is either a, c, g or t
  misc_feature (36)..(36): n is either a, c, g or t
ttccattaaaccgccaananccacaaattncccacnaaaaaaacaaaaccgcaaaacgcaaaaactccgacgcgactaataacgaccgacgcgctacgctctcaaaccaacccaacgaccgacgctctctacgatcccctcccccaaacaaaatactcgccgacaacccccgccccgcccgcgcccgcgcccgcccctcaaaaccgctcccgaaataaacccgaacacgcctcgccccctaaaccgcaacccgctatcccgtaataccgcacacgccccgccgcgccctaccgctcgctcgccctccgcgacgctcccacttaaacttaaaaaacccttttccccgtccgcacgcgttcgttcccgcgcccgcgcgacctaccccaacccgaacccaaaaaatatacgactttacttacactccgctaacgataaaatcttaccaccgcacccctcaaccgactccataccgaaatacgaaaactattaaaacgcgtttttatcctaaaaaatcaaaacccccttccctacaaccgccacccatttcctaactttaaacttatcttctccattcgccgcgaatctttcttaaac

SEQ ID NO: 13461 - DNA, 541 bp, Artificial Sequence
  chemically treated genomic DNA (Homo sapiens) CpG-island No: 13461
  misc_feature (17)..(17): n is either a, c, g or t
  misc_feature (233)..(233): n is either a, c, g or t
  misc_feature (272)..(272): n is either a, c, g or t
ttattgcgcggtttgtntatattggttttaggagtgtttgtcggtcggatggtagtcgttttgttcggatcgattgcgttttttcgttttcgtgtaatcggacgtaggtgtgttcgttcgtgtggtttatttattggaattttaattttttacgttgaatttgttcgttcgggattatcgttgtagcgttttgaatgtgggtcggaatatggtttcggttttttttagtggtnttaatcggcgaatttttttttgatttcggcgttttattntaagattgttcgatttttttcggggggatgaatcggtagcggtgaatatttcgatgatttcgttttcgtacggtttgtgtttttttttttttttttatgttttttttagggtatagcggtttttcgttttcgagttttcgtttttttttttgatttgcgtatttttattgattgattcgtagcgtatattacgggttgattaaaaatttaacgttttttaaaaaataatttatagaagagacgcgtaaattattttttaaatcgcgaaa

SEQ ID NO: 13462 - DNA, 541 bp, Artificial Sequence
  chemically treated genomic DNA (Homo sapiens) CpG-island No: 13462
  misc_feature (270)..(270): n is either a, c, g or t
  misc_feature (309)..(309): n is either a, c, g or t
  misc_feature (525)..(525): n is either a, c, g or t
tttcgcgatttaaaaaataatttacgcgtctcttctataaattattttttaaaaaacgttaaatttttaatcaacccgtaatatacgctacgaatcaatcaataaaaatacgcaaatcaaaaaaaaaaacgaaaactcgaaaacgaaaaaccgctataccctaaaaaaaacataaaaaaaaaaaaaaaaacacaaaccgtacgaaaacgaaatcatcgaaatattcaccgctaccgattcatccccccgaaaaaaatcgaacaatcttanaataaaacgccgaaatcaaaaaaaaattcgccgattaanaccactaaaaaaaaccgaaaccatattccgacccacattcaaaacgctacaacgataatcccgaacgaacaaattcaacgtaaaaaattaaaattccaataaataaaccacacgaacgaacacacctacgtccgattacacgaaaacgaaaaaacgcaatcgatccgaacaaaacgactaccatccgaccgacaaacactcctaaaaccaatatanacaaaccgcgcaataa

SEQ ID NO: 13463 - DNA, 541 bp, Artificial Sequence
  chemically treated genomic DNA (Homo sapiens) CpG-island No: 13463
  misc_feature (270)..(270): n is either a, c, g or t
  misc_feature (309)..(309): n is either a, c, g or t
  misc_feature (525)..(525): n is either a, c, g or t
tttcgcgatttggggggtggtttgcgcgttttttttatgggttgttttttggggggcgttgggtttttagttagttcgtaatatgcgttacgaattagttagtgggggtacgtaaattaaggggggaaacgggggttcgaaggcggggaatcgttgtgttttagagggagtataaggggggggaagaaggtataaatcgtgcggaagcggggttatcgaagtgtttatcgttatcggtttattttttcgaggagggtcgggtaattttgnaatggaacgtcgggattaagaggaggttcgtcgattganattattggaagaggtcggggttatgtttcggtttatatttaaaacgttgtagcggtgatttcggacggataaatttagcgtgaaaaattggagttttagtaggtggattatacgaacgggtatatttgcgttcggttgtacgaaggcgaaaaaacgtaatcggttcgagtagaacgattattattcggtcgataggtatttttggaattagtgtgngtaggtcgcgtaataa

SEQ ID NO: 13464 - DNA, 541 bp, Artificial Sequence
  chemically treated genomic DNA (Homo sapiens) CpG-island No: 13464
  misc_feature (17)..(17): n is either a, c, g or t
  misc_feature (233)..(233): n is either a, c, g or t
  misc_feature (272)..(272): n is either a, c, g or t
ttattacgcgacctacncacactaattccaaaaatacctatcgaccgaataataatcgttctactcgaaccgattacgttttttcgccttcgtacaaccgaacgcaaatatacccgttcgtataatccacctactaaaactccaatttttcacgctaaatttatccgtccgaaatcaccgctacaacgttttaaatataaaccgaaacataaccccgacctcttccaataatntcaatcgacgaacctcctcttaatcccgacgttccattncaaaattacccgaccctcctcgaaaaaataaaccgataacgataaacacttcgataaccccgcttccgcacgatttataccttcttccccccccttatactccctctaaaacacaacgattccccgccttcgaacccccgtttccccccttaatttacgtacccccactaactaattcgtaacgcatattacgaactaactaaaaacccaacgccccccaaaaaacaacccataaaaaaaacgcgcaaaccaccccccaaatcgcgaaa

SEQ ID NO: 13465 - DNA, 718 bp, Artificial Sequence
  chemically treated genomic DNA (Homo sapiens) CpG-island No: 13465
gtcgtcgtttttttttttcggttttttttcgtattttttttcgtttggttcgtttagcgcggaaagtagcgttttttgcgggcgtcgtcgtacgttttttagggttcgattatcgttagatttttttttcgggagtcgcgtcgttcgttcgttcgcgtcgttttgttagttcggggtcgcgagacgtcgggttcgtcgttttcgtcgttttcgttttcgttttcgtcgcgcgttttcgttttcgttcgcggttcgggaacgcgcgcgtaatggatcgttggttagtttgtcgcgttcgttttcgttacgtcgttttttcgtttcgcgcgcgcgcgcgtttgtcggtattagcggtagttttgtagtttttcgggttttcgcgatcgtttttcgttttttttttattttagttgttttcgttttttttttttgtcggatgttatcggaaagttaaaataattggggtcgcgtaggcgcgaaagaggaaacggaaagagtaggaagggcgggggcggcgcgaggtgacgggaagcgtaattgaagggggttttcgggaaaggttatgggagagtttttgaggggcgcgtgcgcggtagaggggtatttcgagtagtcgcggcggtcgaggttttgggtttagacgggcggatggagaggttcgataagtttattgttaggaaatttagagagtaaaatattaattgttatgttgaaggag

SEQ ID NO: 13466 - DNA, 718 bp, Artificial Sequence
  chemically treated genomic DNA (Homo sapiens) CpG-island No: 13466
ctccttcaacataacaattaatattttactctctaaatttcctaacaataaacttatcgaacctctccatccgcccgtctaaacccaaaacctcgaccgccgcgactactcgaaatacccctctaccgcgcacgcgcccctcaaaaactctcccataacctttcccgaaaacccccttcaattacgcttcccgtcacctcgcgccgcccccgcccttcctactctttccgtttcctctttcgcgcctacgcgaccccaattattttaactttccgataacatccgacaaaaaaaaaaaacgaaaacaactaaaataaaaaaaaaacgaaaaacgatcgcgaaaacccgaaaaactacaaaactaccgctaataccgacaaacgcgcgcgcgcgcgaaacgaaaaaacgacgtaacgaaaacgaacgcgacaaactaaccaacgatccattacgcgcgcgttcccgaaccgcgaacgaaaacgaaaacgcgcgacgaaaacgaaaacgaaaacgacgaaaacgacgaacccgacgtctcgcgaccccgaactaacaaaacgacgcgaacgaacgaacgacgcgactcccgaaaaaaaaatctaacgataatcgaaccctaaaaaacgtacgacgacgcccgcaaaaaacgctactttccgcgctaaacgaaccaaacgaaaaaaaatacgaaaaaaaaccgaaaaaaaaaaacgacgac

SEQ ID NO: 13467 - DNA, 718 bp, Artificial Sequence
  chemically treated genomic DNA (Homo sapiens) CpG-island No: 13467
tttttttagtataataattggtgttttgttttttagattttttagtaatgaatttgtcgggtttttttattcgttcgtttaggtttaaggtttcggtcgtcgcggttattcggagtgtttttttgtcgcgtacgcgttttttaagggtttttttatgatttttttcgggaattttttttaattacgtttttcgttatttcgcgtcgttttcgttttttttgtttttttcgttttttttttcgcgtttgcgcggttttaattgttttggtttttcggtggtattcggtagaggaaaagggcgggggtagttagagtaagggaggggcgggggacggtcgcgaggattcgggaaattgtaaaattgtcgttggtgtcgataggcgcgcgcgcgcgcgaggcgggagggcggcgtggcgagggcgggcgcggtaggttggttagcggtttattgcgcgcgcgttttcgggtcgcgggcgggggcgagagcgcgcggcgggggcgggggcgggggcggcgggggcggcgggttcggcgtttcgcggtttcggattgataaggcggcgcgggcgggcgggcggcgcggttttcgggggaggagtttggcggtggtcgggttttgaggagcgtgcggcggcgttcgtagaggacgttgtttttcgcgttggacggattaagcgagggagggtgcgaggggaaatcggaaggaagaggcggcggt

SEQ ID NO: 13468 - DNA, 718 bp, Artificial Sequence
  chemically treated genomic DNA (Homo sapiens) CpG-island No: 13468
accgccgcctcttccttccgatttcccctcgcaccctccctcgcttaatccgtccaacgcgaaaaacaacgtcctctacgaacgccgccgcacgctcctcaaaacccgaccaccgccaaactcctcccccgaaaaccgcgccgcccgcccgcccgcgccgccttatcaatccgaaaccgcgaaacgccgaacccgccgcccccgccgcccccgcccccgcccccgccgcgcgctctcgcccccgcccgcgacccgaaaacgcgcgcgcaataaaccgctaaccaacctaccgcgcccgccctcgccacgccgccctcccgcctcgcgcgcgcgcgcgcctatcgacaccaacgacaattttacaatttcccgaatcctcgcgaccgtcccccgcccctcccttactctaactacccccgcccttttcctctaccgaataccaccgaaaaaccaaaacaattaaaaccgcgcaaacgcgaaaaaaaaaacgaaaaaaacaaaaaaaacgaaaacgacgcgaaataacgaaaaacgtaattaaaaaaaattcccgaaaaaaatcataaaaaaacccttaaaaaacgcgtacgcgacaaaaaaacactccgaataaccgcgacgaccgaaaccttaaacctaaacgaacgaataaaaaaacccgacaaattcattactaaaaaatctaaaaaacaaaacaccaattattatactaaaaaaa

SEQ ID NO: 13469 - DNA, 511 bp, Artificial Sequence
  chemically treated genomic DNA (Homo sapiens) CpG-island No: 13469
  misc_feature (462)..(462): n is either a, c, g or t
  misc_feature (464)..(464): n is either a, c, g or t
  misc_feature (468)..(468): n is either a, c, g or t
gattggggcgttaaagttttcgttttttttgatgtttgtcgtcgcgtggtatttgaaaatattgaagatgtagttcgttacggtttgtattatgtcgagttgcgttttttattaggttatatggtaatggtatattagttgtttgtagcgggtgttgtcgaagcggtgatcgatggcgtacgtgaaggttgtcgtatttttggtgtgtaggcgaagttatcggtattatgaatcgacgttcggtacgattggggcgttttggtatcgggttttattacggattagcggggttaagttgaatggtggcgacggttatgaaaattattgggttgcgcgtgtacggttttcgaagagtgtttttgttaaattcggttggtttgttgcgtatgtttagtttaatttttgttgtcgcgtttttttgtttttttttgtttttttttatttttttattttttcgttgtngngagngaaaaaagaaaatattgggcgttttaacgtagtgttttagcgt

SEQ ID NO: 13470 - DNA, 511 bp, Artificial Sequence
  chemically treated genomic DNA (Homo sapiens) CpG-island No: 13470
  misc_feature (44)..(44): n is either a, c, g or t
  misc_feature (48)..(48): n is either a, c, g or t
  misc_feature (50)..(50): n is either a, c, g or t
acgctaaaacactacgttaaaacgcccaatattttcttttttcnctcncnacaacgaaaaaataaaaaaataaaaaaaaacaaaaaaaaacaaaaaaacgcgacaacaaaaattaaactaaacatacgcaacaaaccaaccgaatttaacaaaaacactcttcgaaaaccgtacacgcgcaacccaataattttcataaccgtcgccaccattcaacttaaccccgctaatccgtaataaaacccgataccaaaacgccccaatcgtaccgaacgtcgattcataataccgataacttcgcctacacaccaaaaatacgacaaccttcacgtacgccatcgatcaccgcttcgacaacacccgctacaaacaactaatataccattaccatataacctaataaaaaacgcaactcgacataatacaaaccgtaacgaactacatcttcaatattttcaaataccacgcgacgacaaacatcaaaaaaaacgaaaactttaacgccccaatc

SEQ ID NO: 13471 - DNA, 511 bp, Artificial Sequence
  chemically treated genomic DNA (Homo sapiens) CpG-island No: 13471
  misc_feature (44)..(44): n is either a, c, g or t
  misc_feature (48)..(48): n is either a, c, g or t
  misc_feature (50)..(50): n is either a, c, g or t
acgttggggtattgcgttagggcgtttaatattttttttttttntttntngtagcggaggagtggggagataggagaaggtagagaagaatagagaggcgcgatagtaaaaattaggttgggtatgcgtaataaattaatcgggtttggtaaaggtatttttcgaagatcgtatacgcgtaatttaatagtttttatgatcgtcgttattatttagtttgatttcgttaattcgtggtggaattcggtattagggcgttttagtcgtatcgaacgtcggtttataatgtcgatagtttcgtttgtatattaaaggtgcggtaatttttacgtacgttatcgattatcgtttcgataatattcgttataggtagttgatgtgttattgttatgtagtttggtgaaaaacgtagttcgatatagtgtaggtcgtgacgggttgtatttttaatgtttttaaatgttacgcggcgataggtattaagagaggcgagaattttaacgttttagtt

SEQ ID NO: 13472 - DNA, 511 bp, Artificial Sequence
  chemically treated genomic DNA (Homo sapiens) CpG-island No: 13472
  misc_feature (462)..(462): n is either a, c, g or t
  misc_feature (464)..(464): n is either a, c, g or t
  misc_feature (468)..(468): n is either a, c, g or t
aactaaaacgttaaaattctcgcctctcttaatacctatcgccgcgtaacatttaaaaacattaaaaatacaacccgtcacgacctacactatatcgaactacgtttttcaccaaactacataacaataacacatcaactacctataacgaatattatcgaaacgataatcgataacgtacgtaaaaattaccgcacctttaatatacaaacgaaactatcgacattataaaccgacgttcgatacgactaaaacgccctaataccgaattccaccacgaattaacgaaatcaaactaaataataacgacgatcataaaaactattaaattacgcgtatacgatcttcgaaaaatacctttaccaaacccgattaatttattacgcatacccaacctaatttttactatcgcgcctctctattcttctctaccttctcctatctccccactcctccgctacnanaaanaaaaaaaaaaaatattaaacgccctaacgcaataccccaacgt

SEQ ID NO: 13473 - DNA, 770 bp, Artificial Sequence
  chemically treated genomic DNA (Homo sapiens) CpG-island No: 13473
aaggcggaggaggttgtcgggagttcggttttcgagtaatttttcgtttcgttgggtttttatgtttgttaaagggtcgagatgaacgggtaagggagagagagggcgaggaaaaataaaaaagagattgtcgagtgggacgaggggttcgggagtagtcgcggtcgcgttattttagagtttagaggtttgggggaggggttttcggcgttgtcgcggatttcggggttttcggcgggtaggttttgtagggtcgcggagcgagaaggttgatgtttcgggtgtttcggggagttttttcgacgtcgtttgttgtttgttagtcgttagttgtgatacggtagcgggtcgggttacgttgttttcggtcgttaggcgggttgcgggaggggtcgcggtgtcgtttttttaggttcggtttggtttatattattggggtcgggggtttattgtttcggagagttataggtacggtcggtttggattcgtcgggtagtgtttcgttttgttcgtttcggtttggggttaagttaatagttgtaaggtacgtcgattggcggtagatcggtggttcgtgtgtgtttttttaagggggtcgggtttgcgaagttgaggggcgggtggggtgtgcgtcgttttcggtgtgagggtgagagggagagagcggttggcgggcgttcgagggagggagggagcgacgagcgaggtagcgacgcgggtcgtttttgtcgtcgtcgtcgtcgtcgtcgcggtcggatttgcggtttttt

SEQ ID NO: 13474 - DNA, 770 bp, Artificial Sequence
  chemically treated genomic DNA (Homo sapiens) CpG-island No: 13474
aaaaaaccgcaaatccgaccgcgacgacgacgacgacgacgacaaaaacgacccgcgtcgctacctcgctcgtcgctccctccctccctcgaacgcccgccaaccgctctctccctctcaccctcacaccgaaaacgacgcacaccccacccgcccctcaacttcgcaaacccgacccccttaaaaaaacacacacgaaccaccgatctaccgccaatcgacgtaccttacaactattaacttaaccccaaaccgaaacgaacaaaacgaaacactacccgacgaatccaaaccgaccgtacctataactctccgaaacaataaacccccgaccccaataatataaaccaaaccgaacctaaaaaaacgacaccgcgacccctcccgcaacccgcctaacgaccgaaaacaacgtaacccgacccgctaccgtatcacaactaacgactaacaaacaacaaacgacgtcgaaaaaactccccgaaacacccgaaacatcaaccttctcgctccgcgaccctacaaaacctacccgccgaaaaccccgaaatccgcgacaacgccgaaaacccctcccccaaacctctaaactctaaaataacgcgaccgcgactactcccgaacccctcgtcccactcgacaatctcttttttatttttcctcgccctctctctcccttacccgttcatctcgaccctttaacaaacataaaaacccaacgaaacgaaaaattactcgaaaaccgaactcccgacaacctcctccgcctt

SEQ ID NO: 13475 - DNA, 770 bp, Artificial Sequence
  chemically treated genomic DNA (Homo sapiens) CpG-island No: 13475
aggaggtcgtaggttcgatcgcggcggcggcggcggcggcggtaggggcggttcgcgtcgttatttcgttcgtcgttttttttttttttcggacgttcgttagtcgtttttttttttttatttttatatcgggagcgacgtatattttattcgttttttagtttcgtaggttcggtttttttaaagagatatatacgggttatcgatttgtcgttagtcggcgtgttttgtagttgttggtttgattttaggtcgggacgggtagagcggaatattgttcggcgggtttaggtcgatcgtgtttgtggtttttcggaataataaattttcggttttagtgatgtgggttagatcggatttggagaggcggtatcgcgatttttttcgtaattcgtttggcggtcgggggtagcgtgattcggttcgttatcgtgttatagttggcgattgataaatagtaggcgacgtcgggagaatttttcgagatattcgagatattagttttttcgtttcgcggttttgtaggatttgttcgtcgggagtttcggagttcgcggtagcgtcgagggttttttttttaggtttttgggttttgaggtaacgcggtcgcggttgttttcgggtttttcgttttattcgataattttttttttattttttttcgtttttttttttttttgttcgtttatttcgattttttagtaagtatggaagtttagcgaggcgggggattgttcggaggtcgagttttcggtagtttttttcgtttt

SEQ ID NO: 13476 - DNA, 770 bp, Artificial Sequence
  chemically treated genomic DNA (Homo sapiens) CpG-island No: 13476
aaaacgaaaaaaactaccgaaaactcgacctccgaacaatcccccgcctcgctaaacttccatacttactaaaaaatcgaaataaacgaacaaaaaaaaaaaaaaacgaaaaaaaataaaaaaaaaattatcgaataaaacgaaaaacccgaaaacaaccgcgaccgcgttacctcaaaacccaaaaacctaaaaaaaaaaccctcgacgctaccgcgaactccgaaactcccgacgaacaaatcctacaaaaccgcgaaacgaaaaaactaatatctcgaatatctcgaaaaattctcccgacgtcgcctactatttatcaatcgccaactataacacgataacgaaccgaatcacgctacccccgaccgccaaacgaattacgaaaaaaatcgcgataccgcctctccaaatccgatctaacccacatcactaaaaccgaaaatttattattccgaaaaaccacaaacacgatcgacctaaacccgccgaacaatattccgctctacccgtcccgacctaaaatcaaaccaacaactacaaaacacgccgactaacgacaaatcgataacccgtatatatctctttaaaaaaaccgaacctacgaaactaaaaaacgaataaaatatacgtcgctcccgatataaaaataaaaaaaaaaaaacgactaacgaacgtccgaaaaaaaaaaaaaacgacgaacgaaataacgacgcgaaccgcccctaccgccgccgccgccgccgccgcgatcgaacctacgacctcct

SEQ ID NO: 13477 - DNA, 638 bp, Artificial Sequence
  chemically treated genomic DNA (Homo sapiens) CpG-island No: 13477
  misc_feature (547)..(547): n is either a, c, g or t
  misc_feature (586)..(586): n is either a, c, g or t
acggttcgggggttaggtaattcgcgttaggttttttcggttcgaggcgtcgttatcgcggggaggtcgggcgacgggtcgagtttttattcgagttcggggatttaaggattattttatcggcgtttttttgtcgggttcggtatcggtagttttttcgattttgttttttggttagtagcggggttcggacgagttacgaggagttcgagaggatcgtcgagtttcgggatggtcgggtcggtgcggatacggcggtaatcgtagggatcgtggtcgttttttttttatcggttcggtttattcgtcgtcgcgatacgagtagcggcgttaacgtcgggtttaatcgcgggtttgttgcggtttcggttaagcggttcgaagtggcggttttttttttttttttttttttttttttttttttttttcgttttttttcgttttttttttttttttttttcggcgtttttttttttttttttttttttttcgttttttcgcgtttttttttttttttgttttttttttttttttttttttcggtgtntttttttttttcgtttttgtcgtgttttttttatttttnttttttttttttttttgtttttttttttttgttgtttatttttcgcgcggcg

SEQ ID NO: 13478 - DNA, 638 bp, Artificial Sequence
  chemically treated genomic DNA (Homo sapiens) CpG-island No: 13478
  misc_feature (53)..(53): n is either a, c, g or t
  misc_feature (92)..(92): n is either a, c, g or t
cgccgcgcgaaaaataaacaacaaaaaaaaaaaaacaaaaaaaaaaaaaaaanaaaaataaaaaaaacacgacaaaaacgaaaaaaaaaaanacaccgaaaaaaaaaaaaaaaaaaaaaacaaaaaaaaaaaaaaacgcgaaaaaacgaaaaaaaaaaaaaaaaaaaaaaaaacgccgaaaaaaaaaaaaaaaaaaaacgaaaaaaaacgaaaaaaaaaaaaaaaaaaaaaaaaaaaaaaaaaaaaaaccgccacttcgaaccgcttaaccgaaaccgcaacaaacccgcgattaaacccgacgttaacgccgctactcgtatcgcgacgacgaataaaccgaaccgataaaaaaaaaacgaccacgatccctacgattaccgccgtatccgcaccgacccgaccatcccgaaactcgacgatcctctcgaactcctcgtaactcgtccgaaccccgctactaaccaaaaaacaaaatcgaaaaaactaccgataccgaacccgacaaaaaaacgccgataaaataatccttaaatccccgaactcgaataaaaactcgacccgtcgcccgacctccccgcgataacgacgcctcgaaccgaaaaaacctaacgcgaattacctaacccccgaaccgt

SEQ ID NO: 13479 - DNA, 638 bp, Artificial Sequence
  chemically treated genomic DNA (Homo sapiens) CpG-island No: 13479
  misc_feature (53)..(53): n is either a, c, g or t
  misc_feature (92)..(92): n is either a, c, g or t
cgtcgcgcggaaagtgagtagtagagagagaagaatagggaaggggggagganagagatagaaggagtacgataagggcgggaggagagaanatatcgagaaggggagaagagagggagataagggggagggggggcgcgggggaacgggaaaaaagaaggaaaaggagagagcgtcgaaggaaggagaagagaaggacggagaggagcggagaaggggaagaagaaggaaaggggagaggaggagagtcgttatttcgagtcgtttggtcgggatcgtagtaggttcgcggttgggttcggcgttggcgtcgttgttcgtgtcgcggcggcggatgggtcgggtcggtgggggaggggcggttacggtttttacggttatcgtcgtgttcgtatcgattcggttatttcggggttcggcggttttttcgggtttttcgtggttcgttcgggtttcgttgttagttaaagggtagagtcggaggagttgtcggtgtcgggttcggtaagagggcgtcgatggggtagtttttgaattttcgggttcgggtggaagttcgattcgtcgttcgattttttcgcgatggcggcgtttcggatcggaagggtttagcgcgggttgtttggttttcgggtcgt

SEQ ID NO: 13480 - DNA, 638 bp, Artificial Sequence
  chemically treated genomic DNA (Homo sapiens) CpG-island No: 13480
  misc_feature (547)..(547): n is either a, c, g or t
  misc_feature (586)..(586): n is either a, c, g or t
acgacccgaaaaccaaacaacccgcgctaaacccttccgatccgaaacgccgccatcgcgaaaaaatcgaacgacgaatcgaacttccacccgaacccgaaaattcaaaaactaccccatcgacgccctcttaccgaacccgacaccgacaactcctccgactctaccctttaactaacaacgaaacccgaacgaaccacgaaaaacccgaaaaaaccgccgaaccccgaaataaccgaatcgatacgaacacgacgataaccgtaaaaaccgtaaccgcccctcccccaccgacccgacccatccgccgccgcgacacgaacaacgacgccaacgccgaacccaaccgcgaacctactacgatcccgaccaaacgactcgaaataacgactctcctcctctcccctttccttcttcttccccttctccgctcctctccgtccttctcttctccttccttcgacgctctctccttttccttcttttttcccgttcccccgcgccccccctcccccttatctccctctcttctccccttctcgatatnttctctcctcccgcccttatcgtactccttctatctctntcctccccccttccctattcttctctctctactactcactttccgcgcgacg

SEQ ID NO: 13481 - DNA, 602 bp, Artificial Sequence
  chemically treated genomic DNA (Homo sapiens) CpG-island No: 13481
gttagaggcgcggtcggaggaaacgttatggaaataaataagggcggttataagtatatggggttcgggaagcggcgggcgttaattaggggtaggaggagtttaggatttgtttagcgtcggtcgcgttcgtttttcgagtttttttgtgttaggttcggtgttcggtatttaatatgcgttcgtatttcgttttttagatagttttggtaggacgcgtttttttagttgatattttatattcgtgaagacgaaggtttagggatatttagtgttttgtatcgggttttagggtgggtggtttcggtttcgattgggaaaatcgtcgttcgcgaacgtgtggggaggaggttgggtcgagaacggggatttcgggcgggatcggggtggggtttagattcgggtaggggagtcgagtttaaggtaagtaggcgggcgggtattatttgttgcggggggcgttttttcgtcgttatcgggcgcgtcggagtttcgggtttcgcggtgtcggaagtggtagtagggtcgtcggtagggtttttcgggcgttttagattaataggggtagttaatggttcggaagaagttagtggagcgtagta

SEQ ID NO: 13482 - DNA, 602 bp, Artificial Sequence
  chemically treated genomic DNA (Homo sapiens) CpG-island No: 13482
tactacgctccactaacttcttccgaaccattaactacccctattaatctaaaacgcccgaaaaaccctaccgacgaccctactaccacttccgacaccgcgaaacccgaaactccgacgcgcccgataacgacgaaaaaacgccccccgcaacaaataatacccgcccgcctacttaccttaaactcgactcccctacccgaatctaaaccccaccccgatcccgcccgaaatccccgttctcgacccaacctcctccccacacgttcgcgaacgacgattttcccaatcgaaaccgaaaccacccaccctaaaacccgatacaaaacactaaatatccctaaaccttcgtcttcacgaatataaaatatcaactaaaaaaacgcgtcctaccaaaactatctaaaaaacgaaatacgaacgcatattaaataccgaacaccgaacctaacacaaaaaaactcgaaaaacgaacgcgaccgacgctaaacaaatcctaaactcctcctacccctaattaacgcccgccgcttcccgaaccccatatacttataaccgcccttatttatttccataacgtttcctccgaccgcgcctctaac

SEQ ID NO: 13483 - DNA, 602 bp, Artificial Sequence
  chemically treated genomic DNA (Homo sapiens) CpG-island No: 13483
tgttacgttttattggtttttttcgggttattgattgtttttattggtttggggcgttcggggggttttgtcggcggttttattgttattttcggtatcgcggggttcggggtttcggcgcgttcggtgacggcggagaggcgtttttcgtagtaggtaatgttcgttcgtttgtttgttttgggttcggtttttttgttcgggtttggattttatttcggtttcgttcggggttttcgttttcggtttagttttttttttatacgttcgcgggcgacggtttttttagtcgggatcggaattatttattttgggattcggtgtaaagtattagatgtttttaagttttcgtttttacgagtgtgaaatgttaattaggaggacgcgttttgttagggttgtttagagggcggagtgcgagcgtatgttgagtatcgggtatcgggtttgatataagggggttcgggagacgggcgcggtcggcgttaggtaggttttggattttttttgtttttgattggcgttcgtcgtttttcggattttatgtgtttgtggtcgtttttgtttatttttatgacgtttttttcggtcgcgtttttggt

SEQ ID NO: 13484 - DNA, 602 bp, Artificial Sequence
  chemically treated genomic DNA (Homo sapiens) CpG-island No: 13484
accaaaaacgcgaccgaaaaaaacgtcataaaaataaacaaaaacgaccacaaacacataaaatccgaaaaacgacgaacgccaatcaaaaacaaaaaaaatccaaaacctacctaacgccgaccgcgcccgtctcccgaacccccttatatcaaacccgatacccgatactcaacatacgctcgcactccgccctctaaacaaccctaacaaaacgcgtcctcctaattaacatttcacactcgtaaaaacgaaaacttaaaaacatctaatactttacaccgaatcccaaaataaataattccgatcccgactaaaaaaaccgtcgcccgcgaacgtataaaaaaaaaactaaaccgaaaacgaaaaccccgaacgaaaccgaaataaaatccaaacccgaacaaaaaaaccgaacccaaaacaaacaaacgaacgaacattacctactacgaaaaacgcctctccgccgtcaccgaacgcgccgaaaccccgaaccccgcgataccgaaaataacaataaaaccgccgacaaaaccccccgaacgccccaaaccaataaaaacaatcaataacccgaaaaaaaccaataaaacgtaaca

SEQ ID NO: 13485 - DNA, 509 bp, Artificial Sequence
  chemically treated genomic DNA (Homo sapiens) CpG-island No: 13485
ttcgtttcgcggcggggtttcggttcggagtcgttcgggttttagggtttttttattggcgtcgcggtcgtcgtcgttcgcgttttacggatttcgtcgtcgttattttgtttcgaggttttcggaggttttcgggacgtcgtcgtaagggatttcgggaggggttgttcgtagcgcgtttgtttagaaacgtttgtttttgcgcgattaaggttggtgacggatttttgggtcgggatagacggtcgcgggaggaagtaaggagggtaggggttgttttgtttgcggttttcgggagtttcgttagcgtcgtcgttcgattttcggcggttgtagcggcgttattttgagttttaggtttttgcggcgttagggttgtttacggcgcgtttgattaaaaaagtttcgcggggttcgttattatttatttgtatattattttttttcgttagtatattattttaaggcgttttttgttggacgaggagagttttgcggggaggtggttt

SEQ ID NO: 13486 - DNA, 509 bp, Artificial Sequence
  chemically treated genomic DNA (Homo sapiens) CpG-island No: 13486
aaaccacctccccgcaaaactctcctcgtccaacaaaaaacgccttaaaataatatactaacgaaaaaaaataatatacaaataaataataacgaaccccgcgaaacttttttaatcaaacgcgccgtaaacaaccctaacgccgcaaaaacctaaaactcaaaataacgccgctacaaccgccgaaaatcgaacgacgacgctaacgaaactcccgaaaaccgcaaacaaaacaacccctaccctccttacttcctcccgcgaccgtctatcccgacccaaaaatccgtcaccaaccttaatcgcgcaaaaacaaacgtttctaaacaaacgcgctacgaacaacccctcccgaaatcccttacgacgacgtcccgaaaacctccgaaaacctcgaaacaaaataacgacgacgaaatccgtaaaacgcgaacgacgacgaccgcgacgccaataaaaaaaccctaaaacccgaacgactccgaaccgaaaccccgccgcgaaacgaa

SEQ ID NO: 13487 - DNA, 509 bp, Artificial Sequence
  chemically treated genomic DNA (Homo sapiens) CpG-island No: 13487
aggttattttttcgtagaatttttttcgtttagtagagggcgttttaaggtgatatgttaacgaaaggaaataatatgtaaatgagtaatagcgggtttcgcggggtttttttggttaggcgcgtcgtggatagttttggcgtcgtaggggtttggggtttaagatggcgtcgttatagtcgtcgaaggtcgggcggcggcgttggcgaggttttcggagatcgtaggtagggtagtttttgttttttttattttttttcgcggtcgtttgtttcggtttaggggttcgttattagttttggtcgcgtaggagtaggcgtttttgagtaggcgcgttgcgggtagtttttttcggggttttttgcggcggcgtttcgagggttttcgggggtttcggagtaagatggcggcggcggggttcgtgaggcgcgggcggcggcgatcgcggcgttagtgagggggttttggggttcgggcggtttcgggtcggggtttcgtcgcgggacgga

SEQ ID NO: 13488 - DNA, 509 bp, Artificial Sequence
  chemically treated genomic DNA (Homo sapiens) CpG-island No: 13488
tccgtcccgcgacgaaaccccgacccgaaaccgcccgaaccccaaaaccccctcactaacgccgcgatcgccgccgcccgcgcctcacgaaccccgccgccgccatcttactccgaaacccccgaaaaccctcgaaacgccgccgcaaaaaaccccgaaaaaaactacccgcaacgcgcctactcaaaaacgcctactcctacgcgaccaaaactaataacgaacccctaaaccgaaacaaacgaccgcgaaaaaaaataaaaaaaacaaaaactaccctacctacgatctccgaaaacctcgccaacgccgccgcccgaccttcgacgactataacgacgccatcttaaaccccaaacccctacgacgccaaaactatccacgacgcgcctaaccaaaaaaaccccgcgaaacccgctattactcatttacatattatttcctttcgttaacatatcaccttaaaacgccctctactaaacgaaaaaaattctacgaaaaaataacct

SEQ ID NO: 13489 - DNA, 1521 bp, Artificial Sequence
  chemically treated genomic DNA (Homo sapiens) CpG-island No: 13489
ggttattcgttcgtcgttcgatcgcgtggtcgttacgtttttcgcgcgcgttttatttatcgaggtttcgttttgtcggtcggcgcggcggcggttcgggcgcgttttttttttcgttttttacgcgttacgtagtttcggggttttggcgggggaggggttttaggcggtcgttttcgtaagggtcgggatcgcggttgtatttatttgtgtgcgttcgtaggtgcgattttaggtgcgaggatttgtagtaggttttggcgtagttcgggaagggatagcggtggtttttggcggcggcggagggcgcggcgtcgggggcgcggttcgaggacggggacgaggcggttgaggaggaggaggcgggcgaggcgtttttcggggcggtttcgggttcgtcgcgtaggtcggttaggatgttggcggttagtaggtggggcgtcgcggcggcgtcggggttcgggttagaagcggcggggggcggcgggggtggtttcggggtttcgggtgaggcggtttcgcggcgcgtcgcgcgtatatttaggtcggcggcggggttcgcgttttcggggtcgggtcgttcgcggtgtattacggcgttcgaagagatggttatgagtacgtcggcggcgaagtaatttacgtacgttacggtcgtcgatatgtcgagtaagggcgcgcggcgcggcgggcggagcggaggcggcgggagcggcgttcgttcggtcggcggcggttgttcgagtgcgggaggcggaggaggaggaggaggaggttcggcgcgcgtcgtcgtcgtcgttcgcgttcggtttgtttcgtttcgtttgacgcgttttgacgtatcggagttcgcgggggcggttatagttcgtttcgttcggaggacgttttttcggggcgtcgtagttacgtttttcgttcggcgcgttttttattatttttcgagtcgcgcgcggtcgtcgggggcggggttcgggtcggaggaattcgtttttcggcgcgtttatttcggttttcgttagcgtttagcgttttaggttcggagcgcgtttttttcgcgttagggtgtaaggtcgggagtttcgttttttttcggcgcgttttattttagcgcgcgttttcgtattttttttcggagtattatttttttaagtcggggcgggaggtcgaggatttcgtttttttttcggtacgttttttttttcgagagcgcgtttcgttttatttcggtacgttttttttttttagagcgcgtttcgttttttcgttggcgcgtttattttacgtcggggcgcgcggtcggcgggagttcgtttttttttcggatgttttttttttggtttcgggcgcgttttcgttcgcgatggaggagggtttcgatttttacgtggtcggggttggaggggtgcggaagcggtcggtttcgtttttaggttacgtgcgcgatttttttttttttttttttcggtttggggttttgttttgatttcgtatttaggtatttgttcgtttttttttttg

SEQ ID NO: 13490 - DNA, 1521 bp, Artificial Sequence
  chemically treated genomic DNA (Homo sapiens) CpG-island No: 13490
caaaaaaaaaaacgaacaaatacctaaatacgaaatcaaaacaaaaccccaaaccgaaaaaaaaaaaaaaaaaaatcgcgcacgtaacctaaaaacgaaaccgaccgcttccgcacccctccaaccccgaccacgtaaaaatcgaaaccctcctccatcgcgaacgaaaacgcgcccgaaaccaaaaaaaaaacatccgaaaaaaaaacgaactcccgccgaccgcgcgccccgacgtaaaataaacgcgccaacgaaaaaacgaaacgcgctctaaaaaaaaaaaacgtaccgaaataaaacgaaacgcgctctcgaaaaaaaaaacgtaccgaaaaaaaaacgaaatcctcgacctcccgccccgacttaaaaaaataatactccgaaaaaaaatacgaaaacgcgcgctaaaataaaacgcgccgaaaaaaaacgaaactcccgaccttacaccctaacgcgaaaaaaacgcgctccgaacctaaaacgctaaacgctaacgaaaaccgaaataaacgcgccgaaaaacgaattcctccgacccgaaccccgcccccgacgaccgcgcgcgactcgaaaaataataaaaaacgcgccgaacgaaaaacgtaactacgacgccccgaaaaaacgtcctccgaacgaaacgaactataaccgcccccgcgaactccgatacgtcaaaacgcgtcaaacgaaacgaaacaaaccgaacgcgaacgacgacgacgacgcgcgccgaacctcctcctcctcctcctccgcctcccgcactcgaacaaccgccgccgaccgaacgaacgccgctcccgccgcctccgctccgcccgccgcgccgcgcgcccttactcgacatatcgacgaccgtaacgtacgtaaattacttcgccgccgacgtactcataaccatctcttcgaacgccgtaatacaccgcgaacgacccgaccccgaaaacgcgaaccccgccgccgacctaaatatacgcgcgacgcgccgcgaaaccgcctcacccgaaaccccgaaaccacccccgccgccccccgccgcttctaacccgaaccccgacgccgccgcgacgccccacctactaaccgccaacatcctaaccgacctacgcgacgaacccgaaaccgccccgaaaaacgcctcgcccgcctcctcctcctcaaccgcctcgtccccgtcctcgaaccgcgcccccgacgccgcgccctccgccgccgccaaaaaccaccgctatcccttcccgaactacgccaaaacctactacaaatcctcgcacctaaaatcgcacctacgaacgcacacaaataaatacaaccgcgatcccgacccttacgaaaacgaccgcctaaaacccctcccccgccaaaaccccgaaactacgtaacgcgtaaaaaacgaaaaaaaaaacgcgcccgaaccgccgccgcgccgaccgacaaaacgaaacctcgataaataaaacgcgcgcgaaaaacgtaacgaccacgcgatcgaacgacgaacgaataacc

SEQ ID NO: 13491 - DNA, 1521 bp, Artificial Sequence
  chemically treated genomic DNA (Homo sapiens) CpG-island No: 13491
tagagaagaggacgagtagatgtttgagtgcggggttaaagtagggttttaggtcgggagaagaggggggaagggtcgcgtacgtggtttgggggcggggtcggtcgttttcgtatttttttaatttcggttacgtggggatcggagtttttttttatcgcgaacgggggcgcgttcggggttaggagggaagtattcggggagggggcgggttttcgtcggtcgcgcgtttcggcgtggggtgggcgcgttagcgaggaggcggggcgcgttttgggagggaggggcgtgtcgggatggggcggggcgcgttttcggaaggaggggcgtgtcggagagggggcggggttttcggtttttcgtttcggtttgagggggtggtgtttcgggaaagggtacgggggcgcgcgttggagtggggcgcgtcgggagggggcggggttttcggttttgtattttagcgcggagaaggcgcgtttcgggtttaagacgttaggcgttggcggaggtcggagtgggcgcgtcggggggcgggttttttcggttcgagtttcgttttcggcggtcgcgcgcggttcggagagtggtggagggcgcgtcgggcggggggcgtggttgcggcgtttcgagggggcgtttttcgggcggggcgggttgtggtcgttttcgcgggtttcggtgcgttaggacgcgttaggcggggcggggtaggtcgagcgcgggcggcggcggcggcgcgcgtcgggtttttttttttttttttttcgtttttcgtattcgagtagtcgtcgtcggtcggacggacgtcgttttcgtcgttttcgtttcgttcgtcgcgtcgcgcgtttttgttcggtatgtcggcggtcgtggcgtgcgtggattatttcgtcgtcgacgtgtttatggttattttttcgggcgtcgtggtgtatcgcgggcggttcggtttcgagggcgcgggtttcgtcgtcggtttggatgtgcgcgcggcgcgtcgcgaggtcgttttattcgggatttcggggttattttcgtcgtttttcgtcgtttttggttcgggtttcggcgtcgtcgcggcgttttatttgttggtcgttagtattttggtcgatttgcgcggcggattcggagtcgtttcggggggcgtttcgttcgtttttttttttttagtcgtttcgttttcgttttcgggtcgcgttttcggcgtcgcgtttttcgtcgtcgttaagagttatcgttgttttttttcggattgcgttaaagtttattataagttttcgtatttaaagtcgtatttgcggacgtatataggtgagtgtagtcgcgatttcggtttttgcgggggcggtcgtttgagatttttttttcgttaggatttcgaaattgcgtggcgcgtggggggcggggaggggggcgcgttcgggtcgtcgtcgcgtcggtcggtagggcggggtttcggtgggtggggcgcgcgcggggggcgtggcggttacgcggtcgggcggcgagcggatggtt

SEQ ID NO: 13492 - DNA, 1521 bp, Artificial Sequence
  chemically treated genomic DNA (Homo sapiens) CpG-island No: 13492
aaccatccgctcgccgcccgaccgcgtaaccgccacgccccccgcgcgcgccccacccaccgaaaccccgccctaccgaccgacgcgacgacgacccgaacgcgcccccctccccgccccccacgcgccacgcaatttcgaaatcctaacgaaaaaaaaatctcaaacgaccgcccccgcaaaaaccgaaatcgcgactacactcacctatatacgtccgcaaatacgactttaaatacgaaaacttataataaactttaacgcaatccgaaaaaaaacaacgataactcttaacgacgacgaaaaacgcgacgccgaaaacgcgacccgaaaacgaaaacgaaacgactaaaaaaaaaaaaacgaacgaaacgccccccgaaacgactccgaatccgccgcgcaaatcgaccaaaatactaacgaccaacaaataaaacgccgcgacgacgccgaaacccgaaccaaaaacgacgaaaaacgacgaaaataaccccgaaatcccgaataaaacgacctcgcgacgcgccgcgcgcacatccaaaccgacgacgaaacccgcgccctcgaaaccgaaccgcccgcgatacaccacgacgcccgaaaaaataaccataaacacgtcgacgacgaaataatccacgcacgccacgaccgccgacataccgaacaaaaacgcgcgacgcgacgaacgaaacgaaaacgacgaaaacgacgtccgtccgaccgacgacgactactcgaatacgaaaaacgaaaaaaaaaaaaaaaaaaacccgacgcgcgccgccgccgccgcccgcgctcgacctaccccgccccgcctaacgcgtcctaacgcaccgaaacccgcgaaaacgaccacaacccgccccgcccgaaaaacgccccctcgaaacgccgcaaccacgccccccgcccgacgcgccctccaccactctccgaaccgcgcgcgaccgccgaaaacgaaactcgaaccgaaaaaacccgccccccgacgcgcccactccgacctccgccaacgcctaacgtcttaaacccgaaacgcgccttctccgcgctaaaatacaaaaccgaaaaccccgccccctcccgacgcgccccactccaacgcgcgcccccgtaccctttcccgaaacaccaccccctcaaaccgaaacgaaaaaccgaaaaccccgccccctctccgacacgcccctccttccgaaaacgcgccccgccccatcccgacacgcccctccctcccaaaacgcgccccgcctcctcgctaacgcgcccaccccacgccgaaacgcgcgaccgacgaaaacccgccccctccccgaatacttccctcctaaccccgaacgcgcccccgttcgcgataaaaaaaaactccgatccccacgtaaccgaaattaaaaaaatacgaaaacgaccgaccccgcccccaaaccacgtacgcgacccttcccccctcttctcccgacctaaaaccctactttaaccccgcactcaaacatctactcgtcctcttctcta

SEQ ID NO: 13493 - DNA, 1092 bp, Artificial Sequence
  chemically treated genomic DNA (Homo sapiens) CpG-island No: 13493
gagcgcgggttagggcggtgggggacgttggggtttcgagtgtagggttaacggggtgttgcggcggtggggttttgagtgtgggggttagtttgcggggcggttagacgggttggggggcgttggggttcggagtacggggtcggtagggcgtaggagggtagtggatatcgagtgtgggggcgggggcgtcgggggttattgggggcgtttagggttagggtgtagggggcgaaggggtcggggcgggcgcgcgcgtcgttattttggtttcgtcgtggtcgggttcgcgggtagcgtttgggcggtcggttcggttttagtagcgtagcggtattttcgtttcgggtttcgcgttttttcgcgtttcggtttcggtgttcgtttgggttttcgtttcggttttcgcgtcgtttgggtcggttttcgtatgttcgggacgggaggcgtcgggttcgtcgcgtttcgtcgcgttcgtttcggggttcgcgcgttttacgtcgttagcgtttgttagcggggggcggtagttatacgcgttttattgcgtagtcgcggttacggcgtcgggggcgcgcgtcgtcgacgttatagcgcggggcggggttaatattcggttgggcgtttttcgcgtcgttttgcgataacggatggcgtcgcgcgacggttacggcgttttgcggtcgttacgaggtcgtcgggtcgttgttcgcgggggatatcgaaagcgcgtggtcgcgagggcgcgcgcgggtaggaaagggggtttaacggtttttatatttttttaggggcgggtttttcgtcgttcgttttttttcgttcgttgttgttatggcgacgcgtggttggtcgttttggtatcgttttgtcgtcgtgtgttacgttatagtttcgttatttgacgttacggacgggcggcgtcgcgggatgtttcgtgcgtggggcggtggcgggcgcggcgcggggaggcggcgggttgcgcgcgttaggtcgcgaggttttcgggataggcgttggaaggggcgattggttagaaaatgagttggtttagggtaagagggtttttttatttggtttttttgggcgagg

SEQ ID NO: 13494 - DNA, 1092 bp, Artificial Sequence
  chemically treated genomic DNA (Homo sapiens) CpG-island No: 13494
cctcgcccaaaaaaaccaaataaaaaaaccctcttaccctaaaccaactcattttctaaccaatcgccccttccaacgcctatcccgaaaacctcgcgacctaacgcgcgcaacccgccgcctccccgcgccgcgcccgccaccgccccacgcacgaaacatcccgcgacgccgcccgtccgtaacgtcaaataacgaaactataacgtaacacacgacgacaaaacgataccaaaacgaccaaccacgcgtcgccataacaacaacgaacgaaaaaaaacgaacgacgaaaaacccgcccctaaaaaaatataaaaaccgttaaaccccctttcctacccgcgcgcgccctcgcgaccacgcgctttcgatatcccccgcgaacaacgacccgacgacctcgtaacgaccgcaaaacgccgtaaccgtcgcgcgacgccatccgttatcgcaaaacgacgcgaaaaacgcccaaccgaatattaaccccgccccgcgctataacgtcgacgacgcgcgcccccgacgccgtaaccgcgactacgcaataaaacgcgtataactaccgccccccgctaacaaacgctaacgacgtaaaacgcgcgaaccccgaaacgaacgcgacgaaacgcgacgaacccgacgcctcccgtcccgaacatacgaaaaccgacccaaacgacgcgaaaaccgaaacgaaaacccaaacgaacaccgaaaccgaaacgcgaaaaaacgcgaaacccgaaacgaaaataccgctacgctactaaaaccgaaccgaccgcccaaacgctacccgcgaacccgaccacgacgaaaccaaaataacgacgcgcgcgcccgccccgaccccttcgccccctacaccctaaccctaaacgcccccaataacccccgacgcccccgcccccacactcgatatccactaccctcctacgccctaccgaccccgtactccgaaccccaacgccccccaacccgtctaaccgccccgcaaactaacccccacactcaaaaccccaccgccgcaacaccccgttaaccctacactcgaaaccccaacgtcccccaccgccctaacccgcgctc

SEQ ID NO: 13495 - DNA, 1092 bp, Artificial Sequence
  chemically treated genomic DNA (Homo sapiens) CpG-island No: 13495
tttcgtttaggaaagttagatggaaaaatttttttgttttgaattagtttattttttggttagtcgttttttttagcgtttgtttcggaaatttcgcggtttagcgcgcgtagttcgtcgttttttcgcgtcgcgttcgttatcgttttacgtacggaatatttcgcggcgtcgttcgttcgtgacgttaggtggcgagattgtgacgtaatatacggcggtagggcggtgttaggacgattagttacgcgtcgttatggtaatagcgggcggggaggggcgggcggcggaaggttcgtttttagaagggtgtggaaatcgttagatttttttttttgttcgcgcgcgttttcgcggttacgcgttttcggtgtttttcgcgggtagcggttcggcggtttcgtagcggtcgtaaaacgtcgtggtcgtcgcgcggcgttattcgttgtcgtaaagcggcgcgagaaacgtttagtcgggtgttggtttcgtttcgcgttgtgacgtcggcggcgcgcgttttcggcgtcgtggtcgcggttgcgtagtggggcgcgtatggttgtcgtttttcgttggtagacgttggcggcgtaaggcgcgcgggtttcggagcgggcgcggcggagcgcggcgagttcggcgtttttcgtttcgaatatgcggaggtcggtttaggcggcgcgggagtcggagcgggggtttaagcgggtatcggagtcggagcgcgagggggcgcggggttcggagcgggggtgtcgttgcgttgttgaggtcgggtcggtcgtttagacgttgttcgcgggttcggttacggcggagttaaggtaacgacgcgcgcgttcgtttcggttttttcgttttttgtattttggttttgggcgtttttagtgattttcggcgttttcgtttttatattcggtgtttattgtttttttgcgttttgtcgatttcgtgtttcggattttagcgttttttaattcgtttaatcgtttcgtaagttgatttttatatttagggttttatcgtcgtaatatttcgttgattttgtattcgggattttagcgttttttatcgttttaattcgcgttt

SEQ ID NO: 13496 - DNA, 1092 bp, Artificial Sequence
  chemically treated genomic DNA (Homo sapiens) CpG-island No: 13496
aaacgcgaattaaaacgataaaaaacgctaaaatcccgaatacaaaatcaacgaaatattacgacgataaaaccctaaatataaaaatcaacttacgaaacgattaaacgaattaaaaaacgctaaaatccgaaacacgaaatcgacaaaacgcaaaaaaacaataaacaccgaatataaaaacgaaaacgccgaaaatcactaaaaacgcccaaaaccaaaatacaaaaaacgaaaaaaccgaaacgaacgcgcgcgtcgttaccttaactccgccgtaaccgaacccgcgaacaacgtctaaacgaccgacccgacctcaacaacgcaacgacacccccgctccgaaccccgcgccccctcgcgctccgactccgatacccgcttaaacccccgctccgactcccgcgccgcctaaaccgacctccgcatattcgaaacgaaaaacgccgaactcgccgcgctccgccgcgcccgctccgaaacccgcgcgccttacgccgccaacgtctaccaacgaaaaacgacaaccatacgcgccccactacgcaaccgcgaccacgacgccgaaaacgcgcgccgccgacgtcacaacgcgaaacgaaaccaacacccgactaaacgtttctcgcgccgctttacgacaacgaataacgccgcgcgacgaccacgacgttttacgaccgctacgaaaccgccgaaccgctacccgcgaaaaacaccgaaaacgcgtaaccgcgaaaacgcgcgcgaacaaaaaaaaaaatctaacgatttccacacccttctaaaaacgaaccttccgccgcccgcccctccccgcccgctattaccataacgacgcgtaactaatcgtcctaacaccgccctaccgccgtatattacgtcacaatctcgccacctaacgtcacgaacgaacgacgccgcgaaatattccgtacgtaaaacgataacgaacgcgacgcgaaaaaacgacgaactacgcgcgctaaaccgcgaaatttccgaaacaaacgctaaaaaaaacgactaaccaaaaaataaactaattcaaaacaaaaaaatttttccatctaactttcctaaacgaaa

SEQ ID NO: 13497 - DNA, 867 bp, Artificial Sequence
  chemically treated genomic DNA (Homo sapiens) CpG-island No: 13497
agggcggtcgtagaagggtatcgttggtacggggtggttttaatgatcgagtttaggaaagttcgattcgtacggaaggtagtattcgtgtttttcgttggaggcggtatgtgtttttgaaatttacggttaggtttgtgcggaagaaatcgaggttcggaagtttaggaggggcgttttacggtcgggagcgggaagggttcggaggtaggagggcggcgtttacgtgtcggggtttagttagcggtattgtttttttagtatttcgcggaatatttggaagcggtggttgaggtcgggtcgtgcgtggatgcggaagcgggtgtttagggcgtcgtcgggcgagggcgtatcgtagaagacgcgtaggatgcgtgcgtgtattagggttatggcgtatatggcgtagggttcgcgggttacgtataggtcgtagttagtgtataggtaggggaggtcgttttcgtttgcgtttagtttacgtacggcgtttgcgcggacggtttggggggtagcggtcggggcgaaggagtaggcggggaagggtttgaagtcgtaggtgtcgcggttttggtcgcgcgttacgaggtttacgtatattatgacggcgtgtaggagggggttgttcgcgtagttgtagtcgtggtcggtggttagtacgcggttcgaggtcgggtttattattacggtttttacggttcgtaagtttcgcgttgttgttcgtcgggtcgtttatatcgttcgttttatgtggttttgtatggcggcgcgtttttgcgtggagaagagtcgtttagttagggcgttggttatttgtttgttttcgtggaaggacgtgggttagtgggttcgggttttttcgaattg

SEQ ID NO: 13498 - DNA, 867 bp, Artificial Sequence
  chemically treated genomic DNA (Homo sapiens) CpG-island No: 13498
caattcgaaaaaacccgaacccactaacccacgtccttccacgaaaacaaacaaataaccaacgccctaactaaacgactcttctccacgcaaaaacgcgccgccatacaaaaccacataaaacgaacgatataaacgacccgacgaacaacaacgcgaaacttacgaaccgtaaaaaccgtaataataaacccgacctcgaaccgcgtactaaccaccgaccacgactacaactacgcgaacaaccccctcctacacgccgtcataatatacgtaaacctcgtaacgcgcgaccaaaaccgcgacacctacgacttcaaacccttccccgcctactccttcgccccgaccgctaccccccaaaccgtccgcgcaaacgccgtacgtaaactaaacgcaaacgaaaacgacctcccctacctatacactaactacgacctatacgtaacccgcgaaccctacgccatatacgccataaccctaatacacgcacgcatcctacgcgtcttctacgatacgccctcgcccgacgacgccctaaacacccgcttccgcatccacgcacgacccgacctcaaccaccgcttccaaatattccgcgaaatactaaaaaaacaataccgctaactaaaccccgacacgtaaacgccgccctcctacctccgaacccttcccgctcccgaccgtaaaacgcccctcctaaacttccgaacctcgatttcttccgcacaaacctaaccgtaaatttcaaaaacacataccgcctccaacgaaaaacacgaatactaccttccgtacgaatcgaactttcctaaactcgatcattaaaaccaccccgtaccaacgatacccttctacgaccgccct

SEQ ID NO: 13499 - DNA, 867 bp, Artificial Sequence
  chemically treated genomic DNA (Homo sapiens) CpG-island No: 13499
tagttcgaggaggttcgggtttattggtttacgtttttttacgaggataagtaggtgattagcgttttggttgggcggtttttttttacgtaggagcgcgtcgttatgtagagttatatggagcgggcggtgtgggcggttcggcgggtagtagcgcggggtttgcgggtcgtgggggtcgtggtagtggattcggtttcggatcgcgtgttggttatcggttacgattgtagttgcgcggataatttttttttgtacgtcgttatggtgtgcgtggatttcgtggcgcgcggttagggtcgcggtatttacgattttagattttttttcgtttgttttttcgtttcggtcgttgttttttaggtcgttcgcgtaggcgtcgtgcgtaaattggacgtagacgaggacggttttttttatttgtgtattggttacgatttgtacgtgattcgcgagttttgcgttatgtgcgttatggttttggtgtacgtacgtattttgcgcgttttttacggtgcgttttcgttcgacggcgttttgggtattcgttttcgtatttacgtacggttcgattttaattatcgtttttaggtgtttcgcggggtgttggaggagtagtgtcgttggttggatttcgatacgtaggcgtcgtttttttgttttcggatttttttcgttttcggtcgtggggcgttttttttggattttcgggtttcgatttttttcgtataagtttgatcgtggattttagggatatatatcgtttttagcggggagtacgggtgttgtttttcgtgcggatcgagtttttttggattcggttattggggttatttcgtgttagcggtgtttttttgcggtcgtttt

SEQ ID NO: 13500 - DNA, 867 bp, Artificial Sequence
  chemically treated genomic DNA (Homo sapiens) CpG-island No: 13500
aaaacgaccgcaaaaaaacaccgctaacacgaaataaccccaataaccgaatccaaaaaaactcgatccgcacgaaaaacaacacccgtactccccgctaaaaacgatatatatccctaaaatccacgatcaaacttatacgaaaaaaatcgaaacccgaaaatccaaaaaaaacgccccacgaccgaaaacgaaaaaaatccgaaaacaaaaaaacgacgcctacgtatcgaaatccaaccaacgacactactcctccaacaccccgcgaaacacctaaaaacgataattaaaatcgaaccgtacgtaaatacgaaaacgaatacccaaaacgccgtcgaacgaaaacgcaccgtaaaaaacgcgcaaaatacgtacgtacaccaaaaccataacgcacataacgcaaaactcgcgaatcacgtacaaatcgtaaccaatacacaaataaaaaaaaccgtcctcgtctacgtccaatttacgcacgacgcctacgcgaacgacctaaaaaacaacgaccgaaacgaaaaaacaaacgaaaaaaaatctaaaatcgtaaataccgcgaccctaaccgcgcgccacgaaatccacgcacaccataacgacgtacaaaaaaaaattatccgcgcaactacaatcgtaaccgataaccaacacgcgatccgaaaccgaatccactaccacgacccccacgacccgcaaaccccgcgctactacccgccgaaccgcccacaccgcccgctccatataactctacataacgacgcgctcctacgtaaaaaaaaaccgcccaaccaaaacgctaatcacctacttatcctcgtaaaaaaacgtaaaccaataaacccgaacctcctcgaacta

SEQ ID NO: 13501 - DNA, 629 bp, Artificial Sequence
  chemically treated genomic DNA (Homo sapiens) CpG-island No: 13501
ttaggacgttagtcgcgcggtcgttttgtgtttgtagattttcgtttcgcgcgtttttcgcgttattttcggggcggtggtgagaacgaggtttattttcgttcgtggggggagttgcggcggtggcggtgtaggaggtcgggtaggggtgcggagggatcgacggacgtacgggcgggcggtcgggagttatggagcgcggttttggggttcgggggcgcgggtcggggtggtgagtgtcgggtaggggcgggggcgggcgcggtcgcgcggggtttcgggtcgggtttcgagggtttgatagttcggttggacgttttcgagatttttgtagttttagggttttcgcgggttttgttcgaggagtttagagtaggggcgcggatcgcggatgagcgtttgtgattgggaaagttttgtttttatttatttagtttttcggcgtgggttgcgtttttatttttttgcggacgcggtttttgttttcggggagtattcgttcgagtcgcggatttcgtttttttgtttcgaaattgtttttagttcgataaacgtttcggtttttcgttttttaaggtagtttttaggggttttttcgagttttgttttttaattagtttttagtcgtt

SEQ ID NO: 13502 - DNA, 629 bp, Artificial Sequence
  chemically treated genomic DNA (Homo sapiens) CpG-island No: 13502
aacgactaaaaactaattaaaaaacaaaactcgaaaaaacccctaaaaactaccttaaaaaacgaaaaaccgaaacgtttatcgaactaaaaacaatttcgaaacaaaaaaacgaaatccgcgactcgaacgaatactccccgaaaacaaaaaccgcgtccgcaaaaaaataaaaacgcaacccacgccgaaaaactaaataaataaaaacaaaactttcccaatcacaaacgctcatccgcgatccgcgcccctactctaaactcctcgaacaaaacccgcgaaaaccctaaaactacaaaaatctcgaaaacgtccaaccgaactatcaaaccctcgaaacccgacccgaaaccccgcgcgaccgcgcccgcccccgcccctacccgacactcaccaccccgacccgcgcccccgaaccccaaaaccgcgctccataactcccgaccgcccgcccgtacgtccgtcgatccctccgcacccctacccgacctcctacaccgccaccgccgcaactccccccacgaacgaaaataaacctcgttctcaccaccgccccgaaaataacgcgaaaaacgcgcgaaacgaaaatctacaaacacaaaacgaccgcgcgactaacgtcctaa

SEQ ID NO: 13503 - DNA, 629 bp, Artificial Sequence
  chemically treated genomic DNA (Homo sapiens) CpG-island No: 13503
agcgattgggagttggttgggaagtagggttcgggagggtttttgggagttgttttggggggcgagaggtcgaagcgtttgtcggattgggggtagtttcggggtaaaagagcggaattcgcggttcggacgggtgtttttcgaaggtaagggtcgcgttcgtaggagggtgggagcgtaatttacgtcggagggttgaatggatggggatagggtttttttaattatagacgtttattcgcggttcgcgtttttgttttgggtttttcgggtaggattcgcggaagttttgggattgtaggggtttcggggacgtttaatcgggttgttaggttttcgaggttcggttcgggatttcgcgcggtcgcgttcgttttcgtttttgttcggtatttattatttcggttcgcgttttcgggttttagggtcgcgttttatggttttcggtcgttcgttcgtgcgttcgtcggttttttcgtatttttgttcggttttttgtatcgttatcgtcgtagttttttttacggacggaagtgagtttcgtttttattatcgtttcggaagtgacgcgaggagcgcgcggggcgggggtttgtaggtatagagcgatcgcgcgattagcgttttgg

SEQ ID NO: 13504 - DNA, 629 bp, Artificial Sequence
  chemically treated genomic DNA (Homo sapiens) CpG-island No: 13504
ccaaaacgctaatcgcgcgatcgctctatacctacaaacccccgccccgcgcgctcctcgcgtcacttccgaaacgataataaaaacgaaactcacttccgtccgtaaaaaaaactacgacgataacgatacaaaaaaccgaacaaaaatacgaaaaaaccgacgaacgcacgaacgaacgaccgaaaaccataaaacgcgaccctaaaacccgaaaacgcgaaccgaaataataaataccgaacaaaaacgaaaacgaacgcgaccgcgcgaaatcccgaaccgaacctcgaaaacctaacaacccgattaaacgtccccgaaacccctacaatcccaaaacttccgcgaatcctacccgaaaaacccaaaacaaaaacgcgaaccgcgaataaacgtctataattaaaaaaaccctatccccatccattcaaccctccgacgtaaattacgctcccaccctcctacgaacgcgacccttaccttcgaaaaacacccgtccgaaccgcgaattccgctcttttaccccgaaactacccccaatccgacaaacgcttcgacctctcgccccccaaaacaactcccaaaaaccctcccgaaccctacttcccaaccaactcccaatcgct

SEQ ID NO: 13505 - DNA, 651 bp, Artificial Sequence
  chemically treated genomic DNA (Homo sapiens) CpG-island No: 13505
cgcgcgcgtcggaggtcgcggttgattttgtttcggcgtcgttaggtacggtattagttcggatagtattattttgtacgggtagagtatcggtacggtgtttatcgtggatttggtttcgcgttacgagtgtgtcgcggtggtgttgtattcgtcgtttatttcgggtatgcgcgtcgtttttttcgatattaagaagatttattgtttcgacgttttttttaagtgagcggttcgggcggggacgggggcggggcggggttcgggtcgggcgcgaagttttatcggttttacgattttttcgtagtatcgagaaggtgtttaagattacgtttttcgtgtttattatttacggtacggaggacgaggtgatcgatttttcgtacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgcgtttagcggcggttttaatcggtcggattttagtaataaggcggttttcggattttatttcgcgtcggtttttatttaggggttgtatgtggatttttcgggcggtttaggggatttcgtttcg

SEQ ID NO: 13506 - DNA, 651 bp, Artificial Sequence
  chemically treated genomic DNA (Homo sapiens) CpG-island No: 13506
cgaaacgaaatcccctaaaccgcccgaaaaatccacatacaacccctaaataaaaaccgacgcgaaataaaatccgaaaaccgccttattactaaaatccgaccgattaaaaccgccgctaaacgcgctaactaaacaactcctaaaaaataaaacgacgcaaacgctccaaatactaactataaaactcgatatcgttatacccgacgccctccacccacaacgactccaccgccttaaaacaacgctcgtaaaacgccaacccgtacgaaaaatcgatcacctcgtcctccgtaccgtaaataataaacacgaaaaacgtaatcttaaacaccttctcgatactacgaaaaaatcgtaaaaccgataaaacttcgcgcccgacccgaaccccgccccgcccccgtccccgcccgaaccgctcacttaaaaaaaacgtcgaaacaataaatcttcttaatatcgaaaaaaacgacgcgcatacccgaaataaacgacgaatacaacaccaccgcgacacactcgtaacgcgaaaccaaatccacgataaacaccgtaccgatactctacccgtacaaaataatactatccgaactaataccgtacctaacgacgccgaaacaaaatcaaccgcgacctccgacgcgcgcg

SEQ ID NO: 13507 - DNA, 651 bp, Artificial Sequence
  chemically treated genomic DNA (Homo sapiens) CpG-island No: 13507
cggggcggggttttttgggtcgttcggggggtttatatgtagtttttgggtgggggtcggcgcggggtgaggttcgggggtcgttttattgttgaggttcggtcggttggggtcgtcgttaggcgcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgcgagaagtcgattatttcgtttttcgtgtcgtggatgatgagtacgggagacgtgattttggatattttttcgatgttgcgggagggtcgtggagtcggtgagatttcgcgttcggttcgggtttcgtttcgttttcgttttcgttcgggtcgtttatttagggaaggcgtcgaagtagtaggtttttttggtgtcggggaaggcgacgcgtatgttcgaggtgagcggcgagtgtagtattatcgcggtatattcgtagcgcgaggttaggtttacggtgggtatcgtgtcgatgttttgttcgtataggatgatgttgttcgggttgatgtcgtatttggcggcgtcggagtagggttagtcgcggttttcgacgcgcgcg

SEQ ID NO: 13508 - DNA, 651 bp, Artificial Sequence
  chemically treated genomic DNA (Homo sapiens) CpG-island No: 13508
cgcgcgcgtcgaaaaccgcgactaaccctactccgacgccgccaaatacgacatcaacccgaacaacatcatcctatacgaacaaaacatcgacacgatacccaccgtaaacctaacctcgcgctacgaatataccgcgataatactacactcgccgctcacctcgaacatacgcgtcgccttccccgacaccaaaaaaacctactacttcgacgccttccctaaataaacgacccgaacgaaaacgaaaacgaaacgaaacccgaaccgaacgcgaaatctcaccgactccacgaccctcccgcaacatcgaaaaaatatccaaaatcacgtctcccgtactcatcatccacgacacgaaaaacgaaataatcgacttctcgcacgaactaacgctctacgaacgctaccccaaaacgataaaaccgctataaataaaaaacgccgaacacaacgacatcgaactctacaaccaatacctaaaacgcctacgtcgcttcatctcccaaaaactacccaaccaacgcgcctaacgacgaccccaaccgaccgaacctcaacaataaaacgacccccgaacctcaccccgcgccgacccccacccaaaaactacatataaaccccccgaacgacccaaaaaaccccgccccg

SEQ ID NO: 13509 - DNA, 758 bp, Artificial Sequence
  chemically treated genomic DNA (Homo sapiens) CpG-island No: 13509
gtcgcgcgattaggcggtggcgaggtcgggattttaagttgtatttagttagttttagttcgcggtttttttaagggggggcggtgttttagtttgggcgcgagaaggcgttgcgttacgtgcggggtcgtagtacggacggaagcggaagtggcggcgtgcgtgcggtagtggagacggcggcggcggtggttggcgttaggttgtggacgaagaggcggtttcggtggtaagtggcggtcgttgggatttagttaggtatcggttcggttcggttttgttttttttcggtcgtttttattttttttttcggtttcgagtttttcgtaggttcgtgggggtcgtcgcggggtcggggttgcgaggtagcgttcgtcgttttatggtaagcggtgttacgggacgttcggaaggaaatttcgttagagtaggggacgtttgggtttttggttgattacggggtttttgtacggttagggttttgcgatcgtagtgttttttttttgttttcggtcgtgcgtcgtgttttttagcgcggtttacgtttcggaatacgtttgttttttatgtttttcgaagagttttttcgtatttcgtgttttttgttcgttgttgtcgttgatttttgggcgttgcgttggtttagagcgtgttgttttttgacgtcgttagaatttgagttttttgcgagttgggatttcgtcgtgtttttattgtttttagtgtaaagtaattgtttgtaagagaataaaagtgtg

SEQ ID NO: 13510 - DNA, 758 bp, Artificial Sequence
  chemically treated genomic DNA (Homo sapiens) CpG-island No: 13510
cacacttttattctcttacaaacaattactttacactaaaaacaataaaaacacgacgaaatcccaactcgcaaaaaactcaaattctaacgacgtcaaaaaacaacacgctctaaaccaacgcaacgcccaaaaatcaacgacaacaacgaacaaaaaacacgaaatacgaaaaaactcttcgaaaaacataaaaaacaaacgtattccgaaacgtaaaccgcgctaaaaaacacgacgcacgaccgaaaacaaaaaaaaaacactacgatcgcaaaaccctaaccgtacaaaaaccccgtaatcaaccaaaaacccaaacgtcccctactctaacgaaatttccttccgaacgtcccgtaacaccgcttaccataaaacgacgaacgctacctcgcaaccccgaccccgcgacgacccccacgaacctacgaaaaactcgaaaccgaaaaaaaaaataaaaacgaccgaaaaaaaacaaaaccgaaccgaaccgatacctaactaaatcccaacgaccgccacttaccaccgaaaccgcctcttcgtccacaacctaacgccaaccaccgccgccgccgtctccactaccgcacgcacgccgccacttccgcttccgtccgtactacgaccccgcacgtaacgcaacgccttctcgcgcccaaactaaaacaccgcccccccttaaaaaaaccgcgaactaaaactaactaaatacaacttaaaatcccgacctcgccaccgcctaatcgcgcgac

SEQ ID NO: 13511 - DNA, 758 bp, Artificial Sequence
  chemically treated genomic DNA (Homo sapiens) CpG-island No: 13511
tatatttttgtttttttgtaagtagttgttttgtattggaggtaatgaagatacggcggagttttagttcgtagggagtttaggttttgacggcgttagaggataatacgttttggattagcgtagcgtttaagggttagcggtagtagcgagtagggggtacgggatgcggggaggtttttcgggaggtatgaaaggtagacgtgtttcgaaacgtgagtcgcgttgaggggtacggcgtacgatcggggatagaaggaagatattgcggtcgtaaagttttggtcgtgtaaaggtttcgtggttagttaggagtttaggcgttttttgttttagcgaggttttttttcgaacgtttcgtagtatcgtttattatggaacggcgggcgttgtttcgtagtttcgatttcgcggcggtttttacgggtttacgaggaattcgaggtcgagggaaggagtgagagcggtcggaaaggggtagggtcgagtcggatcggtatttggttgggttttagcggtcgttatttattatcgaggtcgttttttcgtttatagtttgacgttagttatcgtcgtcgtcgtttttattgtcgtacgtacgtcgttattttcgttttcgttcgtgttgcggtttcgtacgtgacgtagcgttttttcgcgtttagattgaagtatcgtttttttttaaaggggtcgcggattagagttagttggatgtagtttgggatttcggtttcgttatcgtttggtcgcgcgat

SEQ ID NO: 13512 - DNA, 758 bp, Artificial Sequence
  chemically treated genomic DNA (Homo sapiens) CpG-island No: 13512
atcgcgcgaccaaacgataacgaaaccgaaatcccaaactacatccaactaactctaatccgcgacccctttaaaaaaaaacgatacttcaatctaaacgcgaaaaaacgctacgtcacgtacgaaaccgcaacacgaacgaaaacgaaaataacgacgtacgtacgacaataaaaacgacgacgacgataactaacgtcaaactataaacgaaaaaacgacctcgataataaataacgaccgctaaaacccaaccaaataccgatccgactcgaccctacccctttccgaccgctctcactccttccctcgacctcgaattcctcgtaaacccgtaaaaaccgccgcgaaatcgaaactacgaaacaacgcccgccgttccataataaacgatactacgaaacgttcgaaaaaaaacctcgctaaaacaaaaaacgcctaaactcctaactaaccacgaaacctttacacgaccaaaactttacgaccgcaatatcttccttctatccccgatcgtacgccgtacccctcaacgcgactcacgtttcgaaacacgtctacctttcatacctcccgaaaaacctccccgcatcccgtaccccctactcgctactaccgctaacccttaaacgctacgctaatccaaaacgtattatcctctaacgccgtcaaaacctaaactccctacgaactaaaactccgccgtatcttcattacctccaatacaaaacaactacttacaaaaaaacaaaaatata

SEQ ID NO: 13513 - DNA, 528 bp, Artificial Sequence
  chemically treated genomic DNA (Homo sapiens) CpG-island No: 13513
  misc_feature (392)..(392): n is either a, c, g or t
  misc_feature (436)..(436): n is either a, c, g or t
  misc_feature (470)..(470): n is either a, c, g or t
ttttgtttgtatttttcgatttaagcggtggcgcgggaataagtttagtgtttggttcgtagggtgatattttttcggttagtaattcgacgttaaaaagcgaagattcgatcggcgcgtcggtaattagtagcggttttttcggcgtattaacgattttagcgtttggtgtattggaaggtagcgaatcgacgtttgcgttatagttcgttgttatagtttcgtcgataacgtttgtaatttcgtttgtaatggtgatatcgtaagtcgtttcgtaaagcgttagcggtaattttatggtgtaagtcggggtcgtaagcgattaggttcgtgcgtaatagtattaatagtaattgggatagaagttcggcgttttcggtcgcgtaatttanaatggcgcggtttggcggatttagtttggtttattcgttagtanagtcgaagttagtattttgtagttacgtttgtanatcgaagtttaattatagttatttattattatcgcgtagtagcgtaaagtaggtattt

SEQ ID NO: 13514 - DNA, 528 bp, Artificial Sequence
  chemically treated genomic DNA (Homo sapiens) CpG-island No: 13514
  misc_feature (59)..(59): n is either a, c, g or t
  misc_feature (93)..(93): n is either a, c, g or t
  misc_feature (137)..(137): n is either a, c, g or t
aaatacctactttacgctactacgcgataataataaataactataattaaacttcgatntacaaacgtaactacaaaatactaacttcgactntactaacgaataaaccaaactaaatccgccaaaccgcgccattntaaattacgcgaccgaaaacgccgaacttctatcccaattactattaatactattacgcacgaacctaatcgcttacgaccccgacttacaccataaaattaccgctaacgctttacgaaacgacttacgatatcaccattacaaacgaaattacaaacgttatcgacgaaactataacaacgaactataacgcaaacgtcgattcgctaccttccaatacaccaaacgctaaaatcgttaatacgccgaaaaaaccgctactaattaccgacgcgccgatcgaatcttcgctttttaacgtcgaattactaaccgaaaaaatatcaccctacgaaccaaacactaaacttattcccgcgccaccgcttaaatcgaaaaatacaaacaaaa

SEQ ID NO: 13515 - DNA, 528 bp, Artificial Sequence
  chemically treated genomic DNA (Homo sapiens) CpG-island No: 13515
  misc_feature (59)..(59): n is either a, c, g or t
  misc_feature (93)..(93): n is either a, c, g or t
  misc_feature (137)..(137): n is either a, c, g or t
agatgtttgttttacgttattgcgcggtagtaataaatgattgtaattgggtttcggtntgtaaacgtggttgtaaggtattggtttcggttntgttggcgaatgggttaagttggattcgttagatcgcgttattntgagttacgcgatcggggacgtcgaatttttgttttagttgttgttggtattgttgcgtacgagtttgatcgtttacggtttcgatttgtattataaagttgtcgttggcgttttgcgagacggtttgcggtgttattattgtaggcgaggttgtaggcgttgtcgacggagttgtaataacgggttgtggcgtaggcgtcggttcgttgttttttagtatattaggcgttaaggtcgttggtgcgtcgaggaaatcgttattggttatcggcgcgtcggtcggattttcgttttttagcgtcgaattattgatcggaagaatgttattttgcgggttagatattgaatttgttttcgcgttatcgtttaaatcgggaggtgtaggtaggg

SEQ ID NO: 13516 - DNA, 528 bp, Artificial Sequence
  chemically treated genomic DNA (Homo sapiens) CpG-island No: 13516
  misc_feature (392)..(392): n is either a, c, g or t
  misc_feature (436)..(436): n is either a, c, g or t
  misc_feature (470)..(470): n is either a, c, g or t
ccctacctacacctcccgatttaaacgataacgcgaaaacaaattcaatatctaacccgcaaaataacattcttccgatcaataattcgacgctaaaaaacgaaaatccgaccgacgcgccgataaccaataacgatttcctcgacgcaccaacgaccttaacgcctaatatactaaaaaacaacgaaccgacgcctacgccacaacccgttattacaactccgtcgacaacgcctacaacctcgcctacaataataacaccgcaaaccgtctcgcaaaacgccaacgacaactttataatacaaatcgaaaccgtaaacgatcaaactcgtacgcaacaataccaacaacaactaaaacaaaaattcgacgtccccgatcgcgtaactcanaataacgcgatctaacgaatccaacttaacccattcgccaacanaaccgaaaccaataccttacaaccacgtttacanaccgaaacccaattacaatcatttattactaccgcgcaataacgtaaaacaaacatct

SEQ ID NO: 13517 - DNA, 563 bp, Artificial Sequence
  chemically treated genomic DNA (Homo sapiens) CpG-island No: 13517
  misc_feature (513)..(513): n is either a, c, g or t
cgatcgttacgatcgtagatgatttttttattattatcgcgttagggttagtttttgttattcgtagtgtttcggtaatcgcgtcgtcggagttgacgttatagaatattttttttcgtatcgttagttcgcgtatggtgtttttcgtatcgcgttgatgaatatttagtattttatttattagagaagcgttgaaaattttcggtagatatttcgtaggttagcggcgaatgtcgggaatgttgttgttttttttcggttgtaggtcgataatggttatcggtttggattgttcgcgtataaagcgtgagacgtcggtgatagtgtcggtcgtttttatgttggagataaaatgagtgatgcgttcgtcggtttgttgttagattttcggtttagtggtggtgtaatgcgtataagggttatcgggattattgaattgatcgagtagttttttttcgttacgattcgttatttttagcgttagatcgcgcgtattttttatgttttgttttntggtgataagaattagtttcgtattataagtacgtatcgtcgtacggggt

SEQ ID NO: 13518 - DNA, 563 bp, Artificial Sequence
  chemically treated genomic DNA (Homo sapiens) CpG-island No: 13518
  misc_feature (51)..(51): n is either a, c, g or t
accccgtacgacgatacgtacttataatacgaaactaattcttatcaccanaaaacaaaacataaaaaatacgcgcgatctaacgctaaaaataacgaatcgtaacgaaaaaaaactactcgatcaattcaataatcccgataacccttatacgcattacaccaccactaaaccgaaaatctaacaacaaaccgacgaacgcatcactcattttatctccaacataaaaacgaccgacactatcaccgacgtctcacgctttatacgcgaacaatccaaaccgataaccattatcgacctacaaccgaaaaaaaacaacaacattcccgacattcgccgctaacctacgaaatatctaccgaaaattttcaacgcttctctaataaataaaatactaaatattcatcaacgcgatacgaaaaacaccatacgcgaactaacgatacgaaaaaaaatattctataacgtcaactccgacgacgcgattaccgaaacactacgaataacaaaaactaaccctaacgcgataataataaaaaaatcatctacgatcgtaacgatcg

SEQ ID NO: 13519 - DNA, 563 bp, Artificial Sequence
  chemically treated genomic DNA (Homo sapiens) CpG-island No: 13519
  misc_feature (51)..(51): n is either a, c, g or t
atttcgtgcggcgatgcgtgtttatggtgcggaattgatttttgttattanagagtagggtatgaaaggtgcgcgcgatttggcgttggagatggcgaatcgtggcgaaggaaagttgttcgattagtttaataatttcgataatttttatgcgtattatattattattgggtcggaaatttggtagtaaatcggcgggcgtattatttattttgtttttagtatggggacgatcggtattattatcggcgttttacgttttatgcgcgaataatttaaatcggtgattattgtcggtttgtaatcggaagagggtagtagtattttcggtattcgtcgttggtttacggaatatttgtcggggatttttaacgtttttttggtggatgaggtgttggatatttattagcgcgatgcggaaaatattatgcgcgaattggcggtgcgggaaggaatattttgtggcgttagtttcggcggcgcggttgtcggagtattgcgggtggtaaaagttaattttgacgcggtggtggtagaaagattatttgcgatcgtggcgatcg

SEQ ID NO: 13520 - DNA, 563 bp, Artificial Sequence
  chemically treated genomic DNA (Homo sapiens) CpG-island No: 13520
  misc_feature (513)..(513): n is either a, c, g or t
cgatcgccacgatcgcaaataatctttctaccaccaccgcgtcaaaattaacttttaccacccgcaatactccgacaaccgcgccgccgaaactaacgccacaaaatattccttcccgcaccgccaattcgcgcataatattttccgcatcgcgctaataaatatccaacacctcatccaccaaaaaaacgttaaaaatccccgacaaatattccgtaaaccaacgacgaataccgaaaatactactaccctcttccgattacaaaccgacaataatcaccgatttaaattattcgcgcataaaacgtaaaacgccgataataataccgatcgtccccatactaaaaacaaaataaataatacgcccgccgatttactaccaaatttccgacccaataataatataatacgcataaaaattatcgaaattattaaactaatcgaacaactttccttcgccacgattcgccatctccaacgccaaatcgcgcgcacctttcataccctactctntaataacaaaaatcaattccgcaccataaacacgcatcgccgcacgaaat

SEQ ID NO: 13521 - DNA, 751 bp, Artificial Sequence
  chemically treated genomic DNA (Homo sapiens) CpG-island No: 13521
gaaacgtatagaaacgagataaagtacgatagataagcgtataaacgattagcgagcgaagatttagaaaacgggacggaagcgatagattcgagtatagggcgagtcgacgaggaataagcgtcgagggaggacggaggagaaagcgtcggttttggtaggacgaggcgtaagcgcgagttagagacggagtatcgagtatcggacgaaaggaggagataggagtaggcgaggtcggagaatgcgaatagaagagcgatcgcgtgagtatacgatatagagagaataagcgggtaagtagcgtcgataggagtagtagatatgcgaaacgatcgacgtaggcgagagagagggggaggagatagagggagagtacggaagcgcgatttagtagatagtaagaatcgagatcgttagatataaagtacgcggagacggatagtatagtaggcggtaacggtacggagaaagcgtagtatagtaagtaacgagagagaagttggcgaagattgcgaagggggagagtcggaggtcgatagtaagaaatagcgagcgatattagcgtcgttgataggataggcgagagagcgagaggaaggatcgattagagggagagcgagagcgcgttagagagttaggcgagagttatgtttagacgagacgagagcggatcgcgcgttaagtcgaacgttagcgagagcggacggcgaaagttagttagcggaagtgtagttttagttatttgggaggt

SEQ ID NO: 13522 - DNA, 751 bp, Artificial Sequence
  chemically treated genomic DNA (Homo sapiens) CpG-island No: 13522
acctcccaaataactaaaactacacttccgctaactaactttcgccgtccgctctcgctaacgttcgacttaacgcgcgatccgctctcgtctcgtctaaacataactctcgcctaactctctaacgcgctctcgctctccctctaatcgatccttcctctcgctctctcgcctatcctatcaacgacgctaatatcgctcgctatttcttactatcgacctccgactctcccccttcgcaatcttcgccaacttctctctcgttacttactatactacgctttctccgtaccgttaccgcctactatactatccgtctccgcgtactttatatctaacgatctcgattcttactatctactaaatcgcgcttccgtactctccctctatctcctccccctctctctcgcctacgtcgatcgtttcgcatatctactactcctatcgacgctacttacccgcttattctctctatatcgtatactcacgcgatcgctcttctattcgcattctccgacctcgcctactcctatctcctcctttcgtccgatactcgatactccgtctctaactcgcgcttacgcctcgtcctaccaaaaccgacgctttctcctccgtcctccctcgacgcttattcctcgtcgactcgccctatactcgaatctatcgcttccgtcccgttttctaaatcttcgctcgctaatcgtttatacgcttatctatcgtactttatctcgtttctatacgtttc

SEQ ID NO: 13523 - DNA, 751 bp, Artificial Sequence
  chemically treated genomic DNA (Homo sapiens) CpG-island No: 13523
gttttttaagtagttgaaattgtattttcgttggttggttttcgtcgttcgttttcgttgacgttcggtttggcgcgcggttcgttttcgtttcgtttgggtatggttttcgtttggttttttggcgcgttttcgttttttttttgatcggttttttttttcgttttttcgtttgttttgttagcggcgttggtatcgttcgttgttttttgttgtcggttttcggtttttttttttcgtagttttcgttagtttttttttcgttgtttgttgtgttgcgtttttttcgtgtcgttatcgtttgttgtgttgttcgttttcgcgtgttttgtgtttggcggtttcggtttttgttgtttgttgggtcgcgttttcgtattttttttttgttttttttttttttttttcgtttgcgtcggtcgtttcgtatgtttgttgtttttgtcggcgttgtttgttcgtttgttttttttatgtcgtgtgtttacgcggtcgtttttttgttcgtatttttcggtttcgtttgtttttgtttttttttttcgttcgatgttcggtgtttcgtttttgattcgcgtttgcgtttcgttttgttagggtcggcgttttttttttcgttttttttcggcgtttgtttttcgtcggttcgttttatgttcgagtttatcgttttcgtttcgttttttgggttttcgttcgttagtcgtttgtgcgtttgtttgtcgtattttgtttcgtttttgtacgtttt

SEQ ID NO: 13524 - DNA, 751 bp, Artificial Sequence
  chemically treated genomic DNA (Homo sapiens) CpG-island No: 13524
aaaacgtacaaaaacgaaacaaaatacgacaaacaaacgcacaaacgactaacgaacgaaaacccaaaaaacgaaacgaaaacgataaactcgaacataaaacgaaccgacgaaaaacaaacgccgaaaaaaaacgaaaaaaaaaacgccgaccctaacaaaacgaaacgcaaacgcgaatcaaaaacgaaacaccgaacatcgaacgaaaaaaaaaaacaaaaacaaacgaaaccgaaaaatacgaacaaaaaaacgaccgcgtaaacacacgacataaaaaaaacaaacgaacaaacaacgccgacaaaaacaacaaacatacgaaacgaccgacgcaaacgaaaaaaaaaaaaaaaaaacaaaaaaaaaatacgaaaacgcgacccaacaaacaacaaaaaccgaaaccgccaaacacaaaacacgcgaaaacgaacaacacaacaaacgataacgacacgaaaaaaacgcaacacaacaaacaacgaaaaaaaaactaacgaaaactacgaaaaaaaaaaaccgaaaaccgacaacaaaaaacaacgaacgataccaacgccgctaacaaaacaaacgaaaaaacgaaaaaaaaaaccgatcaaaaaaaaaacgaaaacgcgccaaaaaaccaaacgaaaaccatacccaaacgaaacgaaaacgaaccgcgcgccaaaccgaacgtcaacgaaaacgaacgacgaaaaccaaccaacgaaaatacaatttcaactacttaaaaaac

SEQ ID NO: 13525 - DNA, 1090 bp, Artificial Sequence
  chemically treated genomic DNA (Homo sapiens) CpG-island No: 13525
  misc_feature (104)..(104): n is either a, c, g or t
  misc_feature (137)..(139): n is either a, c, g or t
agttcgcgtagcggattgtagatgggttggtcgatgcgtagtcggttgtttattttaaggtagaaggtcgtttttaatatgttggtttagtcgaggggattatncgaagggttcgtagtcgtatacgtttaaggttnnncgttattaaataaagatataatatatagttattttatatatattacgattatattatatcgcgatatataataattagtattataatatattaacgcgacgggtaggggatcgtagcgtacgcgagagcgggcggcgacgcgggaggatagcgagagagcgtagaagggtaagaacgcgggtgtaaattcgtcgatagggggcgaagcgtcgagtacggagtaagagtagggcgtcgaacgggtagatataggagcgggggaatagagtacgcgaggtagtagaacggcggggtagtagcggcggtacgtagagagtagagtcgttagggtagtacgcgatagtaagatcggacgacgaacggcggacgcgcggacgcggatagtaagtaggcgcgagagagacggggcgagggcgtcgtcgcgttaacggggacgcgcggcggatcgagcgcgttagtcgtcgcggggcgattacgcgattaagacgtattatcgcgatagcggtttaatcggtcggtacggacgcggcgaagcgtcggttagtacgggacggcgtaggtacgcgtacgatatagttaacgagagacgtatatagacgtaggacgacgaacggcgaataggttatatataattaaacgcgtagtagtattaacgaatagtacgttattaagttcgagacgggatacgggtaggagagtaagtcgcgaagtagtaggatacgataaacgtaggtattgggtagaaggcgtagtcgataataaagcgacgagtaacgatatatagcgttatataggtattagacgatacgtaatagaggggtcgtaggtcgtttacggaatttatatcgaggcgatcgggagagatagtgaagagagggcgggatcgcgggattacggaaattaaagaataaaaagtaatcgtaagaagtaattttttatagataaggatgt

SEQ ID NO: 13526 - DNA, 1090 bp, Artificial Sequence
  chemically treated genomic DNA (Homo sapiens) CpG-island No: 13526
  misc_feature (952)..(954): n is either a, c, g or t
  misc_feature (987)..(987): n is either a, c, g or t
acatccttatctataaaaaattacttcttacgattactttttattctttaatttccgtaatcccgcgatcccgccctctcttcactatctctcccgatcgcctcgatataaattccgtaaacgacctacgacccctctattacgtatcgtctaatacctatataacgctatatatcgttactcgtcgctttattatcgactacgccttctacccaatacctacgtttatcgtatcctactacttcgcgacttactctcctacccgtatcccgtctcgaacttaataacgtactattcgttaatactactacgcgtttaattatatataacctattcgccgttcgtcgtcctacgtctatatacgtctctcgttaactatatcgtacgcgtacctacgccgtcccgtactaaccgacgcttcgccgcgtccgtaccgaccgattaaaccgctatcgcgataatacgtcttaatcgcgtaatcgccccgcgacgactaacgcgctcgatccgccgcgcgtccccgttaacgcgacgacgccctcgccccgtctctctcgcgcctacttactatccgcgtccgcgcgtccgccgttcgtcgtccgatcttactatcgcgtactaccctaacgactctactctctacgtaccgccgctactaccccgccgttctactacctcgcgtactctattcccccgctcctatatctacccgttcgacgccctactcttactccgtactcgacgcttcgccccctatcgacgaatttacacccgcgttcttacccttctacgctctctcgctatcctcccgcgtcgccgcccgctctcgcgtacgctacgatcccctacccgtcgcgttaatatattataatactaattattatatatcgcgatataatataatcgtaatatatataaaataactatatattatatctttatttaataacgnnnaaccttaaacgtatacgactacgaacccttcgnataatcccctcgactaaaccaacatattaaaaacgaccttctaccttaaaataaacaaccgactacgcatcgaccaacccatctacaatccgctacgcgaact

SEQ ID NO: 13527 - DNA, 1090 bp, Artificial Sequence
  chemically treated genomic DNA (Homo sapiens) CpG-island No: 13527
  misc_feature (952)..(954): n is either a, c, g or t
  misc_feature (987)..(987): n is either a, c, g or t
gtatttttatttataaggagttgttttttacggttattttttgttttttggttttcgtggtttcgcggtttcgttttttttttattgtttttttcgatcgtttcggtgtaggtttcgtgggcggtttgcgatttttttgttgcgtgtcgtttggtgtttgtgtgacgttgtgtgtcgttgttcgtcgttttgttgtcggttgcgttttttgtttagtgtttgcgtttgtcgtgttttgttgtttcgcggtttgtttttttgttcgtgtttcgtttcgggtttggtggcgtgttgttcgttggtgttgttgcgcgtttggttatgtgtggtttgttcgtcgttcgtcgttttgcgtttgtgtgcgtttttcgttggttgtgtcgtgcgcgtgtttgcgtcgtttcgtgttggtcggcgtttcgtcgcgttcgtgtcggtcggttgggtcgttgtcgcggtggtgcgttttggtcgcgtgatcgtttcgcggcggttggcgcgttcggttcgtcgcgcgttttcgttgacgcggcggcgttttcgtttcgtttttttcgcgtttgtttgttgttcgcgttcgcgcgttcgtcgttcgtcgttcggttttgttgtcgcgtgttgttttggcgattttgttttttgcgtgtcgtcgttgttgtttcgtcgttttgttgtttcgcgtgttttgttttttcgtttttgtatttgttcgttcggcgttttgtttttgtttcgtgttcggcgtttcgttttttgtcggcgggtttgtattcgcgtttttgtttttttgcgttttttcgttgttttttcgcgtcgtcgttcgttttcgcgtacgttgcggttttttgttcgtcgcgttggtgtgttgtggtgttggttgttgtgtgtcgcggtgtggtgtggtcgtggtgtgtgtggggtggttgtgtgttgtgtttttgtttggtggcgnnnggttttaggcgtatgcggttgcggatttttcgngtgattttttcggttgggttagtatgttggagacgattttttgttttgggataggtagtcgattgcgtatcggttagtttatttgtagttcgttgcgcgagtt

SEQ ID NO: 13528 - DNA, 1090 bp, Artificial Sequence
  chemically treated genomic DNA (Homo sapiens) CpG-island No: 13528
  misc_feature (104)..(104): n is either a, c, g or t
  misc_feature (137)..(139): n is either a, c, g or t
aactcgcgcaacgaactacaaataaactaaccgatacgcaatcgactacctatcccaaaacaaaaaatcgtctccaacatactaacccaaccgaaaaaatcacncgaaaaatccgcaaccgcatacgcctaaaaccnnncgccaccaaacaaaaacacaacacacaaccaccccacacacaccacgaccacaccacaccgcgacacacaacaaccaacaccacaacacaccaacgcgacgaacaaaaaaccgcaacgtacgcgaaaacgaacgacgacgcgaaaaaacaacgaaaaaacgcaaaaaaacaaaaacgcgaatacaaacccgccgacaaaaaacgaaacgccgaacacgaaacaaaaacaaaacgccgaacgaacaaatacaaaaacgaaaaaacaaaacacgcgaaacaacaaaacgacgaaacaacaacgacgacacgcaaaaaacaaaatcgccaaaacaacacgcgacaacaaaaccgaacgacgaacgacgaacgcgcgaacgcgaacaacaaacaaacgcgaaaaaaacgaaacgaaaacgccgccgcgtcaacgaaaacgcgcgacgaaccgaacgcgccaaccgccgcgaaacgatcacgcgaccaaaacgcaccaccgcgacaacgacccaaccgaccgacacgaacgcgacgaaacgccgaccaacacgaaacgacgcaaacacgcgcacgacacaaccaacgaaaaacgcacacaaacgcaaaacgacgaacgacgaacaaaccacacataaccaaacgcgcaacaacaccaacgaacaacacgccaccaaacccgaaacgaaacacgaacaaaaaaacaaaccgcgaaacaacaaaacacgacaaacgcaaacactaaacaaaaaacgcaaccgacaacaaaacgacgaacaacgacacacaacgtcacacaaacaccaaacgacacgcaacaaaaaaatcgcaaaccgcccacgaaacctacaccgaaacgatcgaaaaaaacaataaaaaaaaaacgaaaccgcgaaaccacgaaaaccaaaaaacaaaaaataaccgtaaaaaacaactccttataaataaaaatac

SEQ ID NO: 13529 - DNA, 698 bp, Artificial Sequence
  chemically treated genomic DNA (Homo sapiens) CpG-island No: 13529
gttttcgatgtaggttatcggtgcggattgatttttttttttcgtcgtgggtggttacgcgcggttttcggttgcgttcgttttttggggagagtacgttttcggtagcggtagaatcgatcgtttattaatatacgaacgagaagacgaatattcgagagacgttttaatagcgattaaatataagatacgaatcgattaataatatttataacgaaattaagtatatatatagataattttcgattagttttaattttatattatcgtatagatatatattatatttaataaataatacggcgatattttacgattatattacgtttatatttataagtacgcgtcgtttaatcggatatagtattcggtattttaagtttagtacgaagtttaatacgagtatatagataatatataggatagttatcgcgtttcgatttttaatatagttatttcgcgcgatttcgtaattagtagattttaaacgattaaaaattataagcggataaatcgaatacgttattagtacgacgtttattttcgatcggacgacgtaacgtatcgaattttgatcggtttgtattttgtttgtgcgttggagcggtattaaaacgaacgttagtcgattatttgttttcggattagaacgcgattgttattattaattagttcgttattgagcgcgatgttttaaa

SEQ ID NO: 13530 - DNA, 698 bp, Artificial Sequence
  chemically treated genomic DNA (Homo sapiens) CpG-island No: 13530
tttaaaacatcgcgctcaataacgaactaattaataataacaatcgcgttctaatccgaaaacaaataatcgactaacgttcgttttaataccgctccaacgcacaaacaaaatacaaaccgatcaaaattcgatacgttacgtcgtccgatcgaaaataaacgtcgtactaataacgtattcgatttatccgcttataatttttaatcgtttaaaatctactaattacgaaatcgcgcgaaataactatattaaaaatcgaaacgcgataactatcctatatattatctatatactcgtattaaacttcgtactaaacttaaaataccgaatactatatccgattaaacgacgcgtacttataaatataaacgtaatataatcgtaaaatatcgccgtattatttattaaatataatatatatctatacgataatataaaattaaaactaatcgaaaattatctatatatatacttaatttcgttataaatattattaatcgattcgtatcttatatttaatcgctattaaaacgtctctcgaatattcgtcttctcgttcgtatattaataaacgatcgattctaccgctaccgaaaacgtactctccccaaaaaacgaacgcaaccgaaaaccgcgcgtaaccacccacgacgaaaaaaaaaaatcaatccgcaccgataacctacatcgaaaac

SEQ ID NO: 13531 - DNA, 698 bp, Artificial Sequence
  chemically treated genomic DNA (Homo sapiens) CpG-island No: 13531
tttaaaatatcgcgtttaatggcgagttgattaatagtggtaatcgcgttttggttcgagagtaaatgatcggttggcgttcgttttgatgtcgttttagcgtataggtaaaatataaatcgattagggttcggtgcgttgcgtcgttcggtcgggggtgggcgtcgtgttggtggcgtgttcggtttgttcgtttgtggtttttggtcgtttggagtttgttggttgcggagtcgcgcggggtgattgtgttggaggtcgggacgcggtgattgttttgtgtgttgtttgtgtgttcgtgttgggtttcgtgttgggtttggggtgtcgggtgttgtgttcggttgggcggcgcgtgtttgtgagtatgggcgtgatgtggtcgtggggtgtcgtcgtgttgtttgttgagtgtggtgtgtgtttgtgcggtggtgtggagttggggttggtcgggggttgtttgtgtgtgtgtttggtttcgttgtgagtgttgttggtcggttcgtgttttgtgtttggtcgttgttggggcgtttttcgggtgttcgttttttcgttcgtgtattagtgagcggtcggttttgtcgttgtcgagagcgtgttttttttagggggcggacgtagtcggaaatcgcgcgtggttatttacgacgggaaggagggattagttcgtatcggtagtttgtatcggagat

SEQ ID NO: 13532 - DNA, 698 bp, Artificial Sequence
  chemically treated genomic DNA (Homo sapiens) CpG-island No: 13532
atctccgatacaaactaccgatacgaactaatccctccttcccgtcgtaaataaccacgcgcgatttccgactacgtccgccccctaaaaaaaacacgctctcgacaacgacaaaaccgaccgctcactaatacacgaacgaaaaaacgaacacccgaaaaacgccccaacaacgaccaaacacaaaacacgaaccgaccaacaacactcacaacgaaaccaaacacacacacaaacaacccccgaccaaccccaactccacaccaccgcacaaacacacaccacactcaacaaacaacacgacgacaccccacgaccacatcacgcccatactcacaaacacgcgccgcccaaccgaacacaacacccgacaccccaaacccaacacgaaacccaacacgaacacacaaacaacacacaaaacaatcaccgcgtcccgacctccaacacaatcaccccgcgcgactccgcaaccaacaaactccaaacgaccaaaaaccacaaacgaacaaaccgaacacgccaccaacacgacgcccacccccgaccgaacgacgcaacgcaccgaaccctaatcgatttatattttacctatacgctaaaacgacatcaaaacgaacgccaaccgatcatttactctcgaaccaaaacgcgattaccactattaatcaactcgccattaaacgcgatattttaaa

SEQ ID NO: 13533 - DNA, 768 bp, Artificial Sequence
  chemically treated genomic DNA (Homo sapiens) CpG-island No: 13533
  misc_feature (189)..(189): n is either a, c, g or t
ttttttagggcggttattttttaagcgtttggtacgcgttattttttaaagttgagtttcgttaagggggcgttattaaaagggttattcgtaatattttttaggtcgtgagtttattatgaatttagataaatacgcgattataagggggtatattttttatttcgtgcgttgtttaatttttttttntatcgcgtattaatataatagaagaataagagataatatagcgagaagatatagataatatattacgataatcgtatacgtagattagaatagttatacgtagatagtaacgtataaataacgagaggaggggggagtagacgggtcggagaggagagaagcgaagggaggcggacggcgggagggcgtcggacgcgtagagggagcgggagatagggcggggatagggcgagaggagggggcgacggtataggcgacgggagtcgagggaggaggcgaagggaaataggggacgagggttagaaaacgggagcggggggagcggatatagcggcggagtaggggcgcgtagaagaggaagcgaaaggacgttagcgtagaggagagggcgggaggataagataaaaacggaataggagcgcgatatcgaacgtcgagaggggttcgtacggaggtacgaggagtagagcgaaaagggcggcggataggaagagagattcgggacgattagaggttaggagagagacgagaagaggacgaatagggagtataataggaggggaagaggagattagttat

SEQ ID NO: 13534 - DNA, 768 bp, Artificial Sequence
  chemically treated genomic DNA (Homo sapiens) CpG-island No: 13534
  misc_feature (580)..(580): n is either a, c, g or t
ataactaatctcctcttcccctcctattatactccctattcgtcctcttctcgtctctctcctaacctctaatcgtcccgaatctctcttcctatccgccgcccttttcgctctactcctcgtacctccgtacgaacccctctcgacgttcgatatcgcgctcctattccgtttttatcttatcctcccgccctctcctctacgctaacgtcctttcgcttcctcttctacgcgcccctactccgccgctatatccgctccccccgctcccgttttctaaccctcgtcccctatttcccttcgcctcctccctcgactcccgtcgcctataccgtcgccccctcctctcgccctatccccgccctatctcccgctccctctacgcgtccgacgccctcccgccgtccgcctcccttcgcttctctcctctccgacccgtctactcccccctcctctcgttatttatacgttactatctacgtataactattctaatctacgtatacgattatcgtaatatattatctatatcttctcgctatattatctcttattcttctattatattaatacgcgatanaaaaaaaaattaaacaacgcacgaaataaaaaatatacccccttataatcgcgtatttatctaaattcataataaactcacgacctaaaaaatattacgaataacccttttaataacgcccccttaacgaaactcaactttaaaaaataacgcgtaccaaacgcttaaaaaataaccgccctaaaaaa

SEQ ID NO: 13535 - DNA, 768 bp, Artificial Sequence
  chemically treated genomic DNA (Homo sapiens) CpG-island No: 13535
  misc_feature (580)..(580): n is either a, c, g or t
gtggttggtttttttttttttttttgttgtgttttttgttcgtttttttttcgttttttttttggtttttggtcgtttcgagtttttttttttgttcgtcgtttttttcgttttgtttttcgtgttttcgtgcgggtttttttcggcgttcggtgtcgcgtttttgtttcgtttttattttgttttttcgtttttttttttgcgttgacgttttttcgtttttttttttgcgcgtttttgtttcgtcgttgtgttcgtttttttcgttttcgttttttggttttcgttttttgttttttttcgttttttttttcggttttcgtcgtttgtgtcgtcgtttttttttttcgttttgttttcgttttgtttttcgttttttttgcgcgttcggcgttttttcgtcgttcgttttttttcgtttttttttttttcggttcgtttgttttttttttttttcgttgtttgtgcgttgttgtttgcgtgtgattgttttggtttgcgtgtgcggttgtcgtggtgtgttgtttgtgttttttcgttgtgttgttttttgtttttttgttgtgttggtgcgcggtgnagaaagagattaggtagcgtacgagatggggagtatgtttttttgtggtcgcgtgtttgtttgggtttatggtagatttacgatttggaaggtgttacggatggtttttttggtaacgtttttttggcggaatttagttttaaagagtggcgcgtgttaaacgtttagaaggtggtcgttttaaggag

SEQ ID NO: 13536 - DNA, 768 bp, Artificial Sequence
  chemically treated genomic DNA (Homo sapiens) CpG-island No: 13536
  misc_feature (189)..(189): n is either a, c, g or t
ctccttaaaacgaccaccttctaaacgtttaacacgcgccactctttaaaactaaattccgccaaaaaaacgttaccaaaaaaaccatccgtaacaccttccaaatcgtaaatctaccataaacccaaacaaacacgcgaccacaaaaaaacatactccccatctcgtacgctacctaatctctttctncaccgcgcaccaacacaacaaaaaaacaaaaaacaacacaacgaaaaaacacaaacaacacaccacgacaaccgcacacgcaaaccaaaacaatcacacgcaaacaacaacgcacaaacaacgaaaaaaaaaaaaaacaaacgaaccgaaaaaaaaaaaaacgaaaaaaaacgaacgacgaaaaaacgccgaacgcgcaaaaaaaacgaaaaacaaaacgaaaacaaaacgaaaaaaaaaaacgacgacacaaacgacgaaaaccgaaaaaaaaaacgaaaaaaaacaaaaaacgaaaaccaaaaaacgaaaacgaaaaaaacgaacacaacgacgaaacaaaaacgcgcaaaaaaaaaaacgaaaaaacgtcaacgcaaaaaaaaaaacgaaaaaacaaaataaaaacgaaacaaaaacgcgacaccgaacgccgaaaaaaacccgcacgaaaacacgaaaaacaaaacgaaaaaaacgacgaacaaaaaaaaaaactcgaaacgaccaaaaaccaaaaaaaaaacgaaaaaaaaacgaacaaaaaacacaacaaaaaaaaaaaaaaaaaccaaccac

SEQ ID NO: 13537 - DNA, 648 bp, Artificial Sequence
  chemically treated genomic DNA (Homo sapiens) CpG-island No: 13537
gagaggaatacggaggggagagagcgaaaggatagacgcggagatagcgaggcgagaaataaagcgagagacgattcgagcgattcgagtagagtagagaacgagagaagggggatagacgggagagggcgagagaggataggagagggaatagagaagaaagcgagagcgacgacggttatcgacgaacgggataaatatatcgcgatatattcgaagagcgtataagatcgaaacgggtttacgacgacgtaagaggcgatagagtagagaggcgaggaggacgttagtagaaagcgagacgcggcgttgaggaggaggaaagatacgaaaaggcgataaaaaacgaataagcgataggagtacgagataagagtacggatttttaaagaacgatgagaagagtcgataagagagagagcggcgaagaagattaggagcgacgtggtcggcgacgcgagggcgtggagaggaggaggtaaaggagagaaaagggtgcgagcgtcgcgagaataagacgggcgggaaggaaacgaagggataatgcgacgaatagaagcgaggagggcgataggagtagggagtaggaagaggtataaggaggtgttaggagcggtattagatagcgattaaagtagagaggtaacg

SEQ ID NO: 13538 - DNA, 648 bp, Artificial Sequence
  chemically treated genomic DNA (Homo sapiens) CpG-island No: 13538
cgttacctctctactttaatcgctatctaataccgctcctaacacctccttatacctcttcctactccctactcctatcgccctcctcgcttctattcgtcgcattatcccttcgtttccttcccgcccgtcttattctcgcgacgctcgcacccttttctctcctttacctcctcctctccacgccctcgcgtcgccgaccacgtcgctcctaatcttcttcgccgctctctctcttatcgactcttctcatcgttctttaaaaatccgtactcttatctcgtactcctatcgcttattcgttttttatcgccttttcgtatctttcctcctcctcaacgccgcgtctcgctttctactaacgtcctcctcgcctctctactctatcgcctcttacgtcgtcgtaaacccgtttcgatcttatacgctcttcgaatatatcgcgatatatttatcccgttcgtcgataaccgtcgtcgctctcgctttcttctctattccctctcctatcctctctcgccctctcccgtctatcccccttctctcgttctctactctactcgaatcgctcgaatcgtctctcgctttatttctcgcctcgctatctccgcgtctatcctttcgctctctcccctccgtattcctctc

SEQ ID NO: 13539 - DNA, 648 bp, Artificial Sequence
  chemically treated genomic DNA (Homo sapiens) CpG-island No: 13539
cgttgtttttttgttttggtcgttgtttagtgtcgtttttggtatttttttgtgtttttttttgttttttgtttttgtcgtttttttcgtttttgttcgtcgtattgttttttcgtttttttttcgttcgttttgttttcgcggcgttcgtattttttttttttttttgtttttttttttttacgttttcgcgtcgtcggttacgtcgtttttggtttttttcgtcgtttttttttttgtcggttttttttatcgttttttgggggttcgtgtttttgtttcgtgtttttgtcgtttattcgttttttgtcgttttttcgtgtttttttttttttttagcgtcgcgtttcgttttttgttggcgtttttttcgtttttttgttttgtcgttttttgcgtcgtcgtgggttcgtttcggttttgtgcgtttttcgggtgtgtcgcggtgtgtttgtttcgttcgtcggtggtcgtcgtcgttttcgtttttttttttgtttttttttttgttttttttcgttttttttcgtttgttttttttttttcgttttttgttttgttcgggtcgttcgggtcgtttttcgttttgtttttcgtttcgttgttttcgcgtttgttttttcgttttttttttttcgtgtttttttt

SEQ ID NO: 13540 - DNA, 648 bp, Artificial Sequence
  chemically treated genomic DNA (Homo sapiens) CpG-island No: 13540
aaaaaaaacacgaaaaaaaaaaaacgaaaaaacaaacgcgaaaacaacgaaacgaaaaacaaaacgaaaaacgacccgaacgacccgaacaaaacaaaaaacgaaaaaaaaaaaacaaacgaaaaaaaacgaaaaaaaacaaaaaaaaaaacaaaaaaaaaaacgaaaacgacgacgaccaccgacgaacgaaacaaacacaccgcgacacacccgaaaaacgcacaaaaccgaaacgaacccacgacgacgcaaaaaacgacaaaacaaaaaaacgaaaaaaacgccaacaaaaaacgaaacgcgacgctaaaaaaaaaaaaaaacacgaaaaaacgacaaaaaacgaataaacgacaaaaacacgaaacaaaaacacgaacccccaaaaaacgataaaaaaaaccgacaaaaaaaaaaacgacgaaaaaaaccaaaaacgacgtaaccgacgacgcgaaaacgtaaaaaaaaaaaaacaaaaaaaaaaaaaaaatacgaacgccgcgaaaacaaaacgaacgaaaaaaaaacgaaaaaacaatacgacgaacaaaaacgaaaaaaacgacaaaaacaaaaaacaaaaaaaaacacaaaaaaataccaaaaacgacactaaacaacgaccaaaacaaaaaaacaacg

SEQ ID NO: 13541 - DNA, 746 bp, Artificial Sequence
  chemically treated genomic DNA (Homo sapiens) CpG-island No: 13541
tcgtacgggttcggttgcgtttgcgttggttggttgttcgtttgcgggttgtgttttgtggggttttgttttcgtgttgcgcgtgttcgagtttttcgtttggtttttgtcgcgcgtggttgtggtggggcgcgttttcgttacggggtcgtggggcgtgttgttttttcgttttgcggttttgtggcgcggtgttggttttttttcgtttttttttcggttcgttcggtcgttcgtgttggttgttttttcgtttttggtgtttcgtcgttttcggtcgttgtcgcgtacgtttcgttttttttgtttttttcgttagcgttttcgtcggtttttcgttttcgttgttcgtattttttcgtgttgttttgcgttgtcgtttgttttttttttggtcgtttttcgcgttttgcgttgttttttcgttgttcgtgtcgtagtcgcgttttgttcgttttcgtgttgtgtgttgtggtgtttgtgtgcgtttttcgtttggtttgttttgttcgtttttcgttttttttttttttcgggttcgttgttgcgcggttttgttttgtttgttttggttcgttttcggttcgcgtttgcgcgtattcgttttgcgtggttttgttgtttttcgttttttttcgttgtcgtcgattaggggaaagaaaatataataaggataatagagggtttttcgtgtgagatggagtatcgttcgtttgttgtggtatttcgttttattttttttttcg

SEQ ID NO: 13542 - DNA, 746 bp, Artificial Sequence
  chemically treated genomic DNA (Homo sapiens) CpG-island No: 13542
cgaaaaaaaaaataaaacgaaataccacaacaaacgaacgatactccatctcacacgaaaaaccctctattatccttattatattttctttcccctaatcgacgacaacgaaaaaaaacgaaaaacaacaaaaccacgcaaaacgaatacgcgcaaacgcgaaccgaaaacgaaccaaaacaaacaaaacaaaaccgcgcaacaacgaacccgaaaaaaaaaaaaaacgaaaaacgaacaaaacaaaccaaacgaaaaacgcacacaaacaccacaacacacaacacgaaaacgaacaaaacgcgactacgacacgaacaacgaaaaaacaacgcaaaacgcgaaaaacgaccaaaaaaaaaacaaacgacaacgcaaaacaacacgaaaaaatacgaacaacgaaaacgaaaaaccgacgaaaacgctaacgaaaaaaacaaaaaaaacgaaacgtacgcgacaacgaccgaaaacgacgaaacaccaaaaacgaaaaaacaaccaacacgaacgaccgaacgaaccgaaaaaaaaacgaaaaaaaaccaacaccgcgccacaaaaccgcaaaacgaaaaaacaacacgccccacgaccccgtaacgaaaacgcgccccaccacaaccacgcgcgacaaaaaccaaacgaaaaactcgaacacgcgcaacacgaaaacaaaaccccacaaaacacaacccgcaaacgaacaaccaaccaacgcaaacgcaaccgaacccgtacga

SEQ ID NO: 13543 - DNA, 746 bp, Artificial Sequence
  chemically treated genomic DNA (Homo sapiens) CpG-island No: 13543
cgagaggggaaatggggcggggtgttataataaacggacggtgttttattttatacgggggattttttgttgtttttgttgtgtttttttttttttgatcgacgatagcggaaaagggcgagagatagtaggattacgtaaagcgaatgcgcgtagacgcgaatcgagagcggattagagtaagtagaataagatcgcgtaataacgaattcgaagagaggaagaagcgaaagacggatagagtagattaggcgaaagacgtatatagatattataatatatagtacgagggcggataagacgcgattgcgatacgaatagcgagaggataacgtagagcgcgagaagcggttaagagaggggtaagcgatagcgtaggatagtacgagggggtgcgagtagcggaggcggagagtcgacgagagcgttggcgaggagggtagagagagcggaacgtgcgcggtagcgatcggaggcggcggagtattaaaggcgaggaagtagttagtacggacggtcgagcgagtcgaggagagagcggaggagagttagtatcgcgttataaggtcgtaaaacgaagagataatacgttttacgatttcgtagcgagggcgcgttttattataattacgcgcgataggggttaaacgaggaattcggatacgcgtaatacggaggtaaggttttataagatataattcgtaagcgaataattagttagcgtagacgtaatcgagttcgtacga

SEQ ID NO: 13544 - DNA, 746 bp, Artificial Sequence
  chemically treated genomic DNA (Homo sapiens) CpG-island No: 13544
tcgtacgaactcgattacgtctacgctaactaattattcgcttacgaattatatcttataaaaccttacctccgtattacgcgtatccgaattcctcgtttaacccctatcgcgcgtaattataataaaacgcgccctcgctacgaaatcgtaaaacgtattatctcttcgttttacgaccttataacgcgatactaactctcctccgctctctcctcgactcgctcgaccgtccgtactaactacttcctcgcctttaatactccgccgcctccgatcgctaccgcgcacgttccgctctctctaccctcctcgccaacgctctcgtcgactctccgcctccgctactcgcaccccctcgtactatcctacgctatcgcttacccctctcttaaccgcttctcgcgctctacgttatcctctcgctattcgtatcgcaatcgcgtcttatccgccctcgtactatatattataatatctatatacgtctttcgcctaatctactctatccgtctttcgcttcttcctctcttcgaattcgttattacgcgatcttattctacttactctaatccgctctcgattcgcgtctacgcgcattcgctttacgtaatcctactatctctcgcccttttccgctatcgtcgatcaaaaaaaaaaaaacacaacaaaaacaacaaaaaatcccccgtataaaataaaacaccgtccgtttattataacaccccgccccatttcccctctcg

SEQ ID NO: 13545 - DNA, 543 bp, Artificial Sequence
  chemically treated genomic DNA (Homo sapiens) CpG-island No: 13545
atcgcgatagatacgatcgagatagtaaaacgtagagcgcgggatatagagcgagattagcgacggtagagaatatcgagaattacgagcgatattatacgcgtaagtttattagtatttatataatattagagattacgtcgcgagttataatagattagacgatagtaattatcgaggtaaaagagattagtagatcgaatatacgaagaggaagacgattacggtttagagagtataagtagttatgagataatacgtaatttcgaataggcgaggtcgtatttaggtatatattatcgtatagttgtaacgtattatatagtgatacgattatatcgttagcgaagtatagaaggacggtatacgaattagtttgagatcggacgtttgtaaatgagaggagggtaagtgaagattagtaatatcgttatcgtacgcgtcgcgcgagtaatacgaagcgcgaatttagaatgttattgttatatagaacgattatgagagaaagaggacgaacgataatataaggtataaatggataat

SEQ ID NO: 13546 - DNA, 543 bp, Artificial Sequence
  chemically treated genomic DNA (Homo sapiens) CpG-island No: 13546
attatccatttataccttatattatcgttcgtcctctttctctcataatcgttctatataacaataacattctaaattcgcgcttcgtattactcgcgcgacgcgtacgataacgatattactaatcttcacttaccctcctctcatttacaaacgtccgatctcaaactaattcgtataccgtccttctatacttcgctaacgatataatcgtatcactatataatacgttacaactatacgataatatatacctaaatacgacctcgcctattcgaaattacgtattatctcataactacttatactctctaaaccgtaatcgtcttcctcttcgtatattcgatctactaatctcttttacctcgataattactatcgtctaatctattataactcgcgacgtaatctctaatattatataaatactaataaacttacgcgtataatatcgctcgtaattctcgatattctctaccgtcgctaatctcgctctatatcccgcgctctacgttttactatctcgatcgtatctatcgcgat

SEQ ID NO: 13547 - DNA, 543 bp, Artificial Sequence
  chemically treated genomic DNA (Homo sapiens) CpG-island No: 13547
gttgtttatttgtgttttatattgtcgttcgtttttttttttttatggtcgttttgtgtagtagtggtattttgagttcgcgtttcgtgttgttcgcgcggcgcgtgcggtagcggtgttgttggtttttatttattttttttttatttatagacgttcggttttagattagttcgtgtgtcgtttttttgtgtttcgttgacggtgtgatcgtgttattgtataatgcgttgtagttgtgcggtggtgtgtgtttgggtgcggtttcgtttgttcgaggttgcgtgttattttatgattatttgtgttttttaggtcgtggtcgttttttttttcgtgtgttcggtttgttggttttttttgtttcggtggttgttgtcgtttggtttgttgtgattcgcggcgtggtttttggtgttgtgtgggtgttggtgggtttgcgcgtgtggtgtcgttcgtgattttcggtgttttttgtcgtcgttggtttcgttttgtgtttcgcgttttgcgttttgttgtttcggtcgtgtttgtcgcgat

SEQ ID NO: 13548 - DNA, 543 bp, Artificial Sequence
  chemically treated genomic DNA (Homo sapiens) CpG-island No: 13548
atcgcgacaaacacgaccgaaacaacaaaacgcaaaacgcgaaacacaaaacgaaaccaacgacgacaaaaaacaccgaaaatcacgaacgacaccacacgcgcaaacccaccaacacccacacaacaccaaaaaccacgccgcgaatcacaacaaaccaaacgacaacaaccaccgaaacaaaaaaaaccaacaaaccgaacacacgaaaaaaaaaacgaccacgacctaaaaaacacaaataatcataaaataacacgcaacctcgaacaaacgaaaccgcacccaaacacacaccaccgcacaactacaacgcattatacaataacacgatcacaccgtcaacgaaacacaaaaaaacgacacacgaactaatctaaaaccgaacgtctataaataaaaaaaaaataaataaaaaccaacaacaccgctaccgcacgcgccgcgcgaacaacacgaaacgcgaactcaaaataccactactacacaaaacgaccataaaaaaaaaaaaacgaacgacaatataaaacacaaataaacaac

SEQ ID NO: 13549 - DNA, 877 bp, Artificial Sequence
  chemically treated genomic DNA (Homo sapiens) CpG-island No: 13549
atatataaatttcgatatattatatatattaacggcgatagaggacgcgattgattttagtttgacgtttcgtcgatatcgtttagcgcggagaggtacgtcgtaacgcggggatagagagcgaacggcggagcggttatagaattaaggtagtcgacgtacgataaggagttcgattaagcgaggatattacgagtaagaacgtacgatatagtaattatatatagagacgtagcgggtatatagtagaagtcgtattttagaggattcgttcggcgaagcgggcgcggtagtagggtatcgatcgcgttaacgatcgttcgtagcgtaagtaggcggcggttaagtgacggcgggtcgaggcggagggcggagtgatttgagtgatagggaggcgcggtatagcgggtgaacggtagaggagcgcgagcgaagacggggagacgacggatagaagacgagaggtcgggcggttgcgagtatagtatcggggatgagcggagaggcgtgattattatatatatatatatatttcgcgtcggtacgtagtatatagttcgatattattacgttagcgtatacgttatttatcgaataagatataatatatatagtcgaaatcgtaaataagcgagcgtagagtatacgttacgtagttttattagggaaagtacgttaaaacgacgtattagatagtttaaataggcgacgtaaagcgtatcgacgcgcgagttttcgttgataggtagtattaggcgggacgcgtataataagaatatagtatatcgatattatagacgatcgtagatatacgtatatcgtttattaggtagattatagttaggatacgatttagaacgattaggaattagattta

SEQ ID NO: 13550 - DNA, 877 bp, Artificial Sequence
  chemically treated genomic DNA (Homo sapiens) CpG-island No: 13550
taaatctaattcctaatcgttctaaatcgtatcctaactataatctacctaataaacgatatacgtatatctacgatcgtctataatatcgatatactatattcttattatacgcgtcccgcctaatactacctatcaacgaaaactcgcgcgtcgatacgctttacgtcgcctatttaaactatctaatacgtcgttttaacgtactttccctaataaaactacgtaacgtatactctacgctcgcttatttacgatttcgactatatatattatatcttattcgataaataacgtatacgctaacgtaataatatcgaactatatactacgtaccgacgcgaaatatatatatatatataataatcacgcctctccgctcatccccgatactatactcgcaaccgcccgacctctcgtcttctatccgtcgtctccccgtcttcgctcgcgctcctctaccgttcacccgctataccgcgcctccctatcactcaaatcactccgccctccgcctcgacccgccgtcacttaaccgccgcctacttacgctacgaacgatcgttaacgcgatcgataccctactaccgcgcccgcttcgccgaacgaatcctctaaaatacgacttctactatatacccgctacgtctctatatataattactatatcgtacgttcttactcgtaatatcctcgcttaatcgaactccttatcgtacgtcgactaccttaattctataaccgctccgccgttcgctctctatccccgcgttacgacgtacctctccgcgctaaacgatatcgacgaaacgtcaaactaaaatcaatcgcgtcctctatcgccgttaatatatataatatatcgaaatttatatat

SEQ ID NO: 13551 - DNA, 877 bp, Artificial Sequence
  chemically treated genomic DNA (Homo sapiens) CpG-island No: 13551
tgaatttggtttttggtcgttttggatcgtgttttggttgtagtttgtttagtgagcggtgtgcgtgtgtttgcggtcgtttgtgatgtcggtgtgttatgtttttgttgtgcgcgtttcgtttagtgttgtttgttagcgaggattcgcgcgtcggtgcgttttgcgtcgtttgtttaggttgtttgatgcgtcgttttggcgtgttttttttggtggggttgcgtagcgtgtgttttgcgttcgtttgtttgcggtttcggttgtgtgtgttgtgttttgttcggtgggtggcgtatgcgttggcgtagtggtgtcgagttgtgtattgcgtgtcggcgcggggtgtgtgtgtgtgtgtggtggttacgttttttcgtttattttcggtgttgtattcgtagtcgttcggtttttcgttttttgttcgtcgttttttcgttttcgttcgcgtttttttatcgtttattcgttgtgtcgcgtttttttgttatttaggttatttcgtttttcgtttcggttcgtcgttatttggtcgtcgtttgtttgcgttgcgggcggtcgttggcgcggtcgatgttttgttgtcgcgttcgtttcgtcgggcgggttttttggggtgcggtttttgttgtgtgttcgttgcgtttttgtgtgtggttgttgtgtcgtgcgtttttgttcgtggtgttttcgtttggtcgggttttttgtcgtgcgtcggttgttttggttttgtggtcgtttcgtcgttcgttttttgttttcgcgttgcggcgtgttttttcgcgttgggcggtgtcggcggggcgttaggttggggttagtcgcgttttttgtcgtcgttgatgtgtgtggtgtgtcggggtttgtgtgt

SEQ ID NO: 13552 - DNA, 877 bp, Artificial Sequence
  chemically treated genomic DNA (Homo sapiens) CpG-island No: 13552
acacacaaaccccgacacaccacacacatcaacgacgacaaaaaacgcgactaaccccaacctaacgccccgccgacaccgcccaacgcgaaaaaacacgccgcaacgcgaaaacaaaaaacgaacgacgaaacgaccacaaaaccaaaacaaccgacgcacgacaaaaaacccgaccaaacgaaaacaccacgaacaaaaacgcacgacacaacaaccacacacaaaaacgcaacgaacacacaacaaaaaccgcaccccaaaaaacccgcccgacgaaacgaacgcgacaacaaaacatcgaccgcgccaacgaccgcccgcaacgcaaacaaacgacgaccaaataacgacgaaccgaaacgaaaaacgaaataacctaaataacaaaaaaacgcgacacaacgaataaacgataaaaaaacgcgaacgaaaacgaaaaaacgacgaacaaaaaacgaaaaaccgaacgactacgaatacaacaccgaaaataaacgaaaaaacgtaaccaccacacacacacacacaccccgcgccgacacgcaatacacaactcgacaccactacgccaacgcatacgccacccaccgaacaaaacacaacacacacaaccgaaaccgcaaacaaacgaacgcaaaacacacgctacgcaaccccaccaaaaaaaacacgccaaaacgacgcatcaaacaacctaaacaaacgacgcaaaacgcaccgacgcgcgaatcctcgctaacaaacaacactaaacgaaacgcgcacaacaaaaacataacacaccgacatcacaaacgaccgcaaacacacgcacaccgctcactaaacaaactacaaccaaaacacgatccaaaacgaccaaaaaccaaattca

SEQ ID NO: 13553 - DNA, 1035 bp, Artificial Sequence
  chemically treated genomic DNA (Homo sapiens) CpG-island No: 13553
  misc_feature (199)..(200): n is either a, c, g or t
  misc_feature (202)..(203): n is either a, c, g or t
ttcgttttagtagtcgattaggtcggtttattcgtattcgtttcgggaaggtttttttggtacgcgtttatttattatgtttcgttttcgaagtggtagttattcgcgcgattttcgttatttcgtttatatttcggcgcgagaggggggatttttttcggggatgtcggttttttgtttcgttggtttttattttttnngnntgttgtcgacgtagagagcgagagattaagggtcgcggaggggcgagtattaggggagaaggtagggagagaggaggatagcgtcgtagcgagcgcggcgcgagaatagtaggagagttagcggtataggtgaaggataggatgagtagcgcggtcggaaggcgagtaacggcgaggttagttagtgatagggcgcgacgaggttacgggcggattcgcgagaacgcgaggtcgcgttagtaggtgaagcgatcgaggtacgggcgggggcgcgagcgacgcgtcgggtacgggaggcgggcgcggtaagagcgcgagtgcgagtcgggttcgagagagaaagtaggcgagcgtaggttacgagcgttaaggaggtagagggagaaggaagcggcgcgacgttatagtacgatcgggcggggatcgagaaggagggcgagcgagcgaagaagacggtagcggacgtaggggaacggcgatcgtcgaggcgcggtagatagagttcggcgagacgcgacgaaggcgttagaaggacggattagtcgtgtacgtttagtagagatcgatagaacgcgtagtttagatcgtttatcggacgtttggtattaagtattaggttttggtgatgttgagttagtagaagtcgttgagttttgtatcgttgatagcgtagtacgattagagacggtacgaaagtagaatagagttgcgttttagttgacgagcgtacgattaaggttaaattataagggggatttgttagttttgaacgtatatgattgcgtaggaaacgtatttcgtttcggaggagaattagagtattatataagta

SEQ ID NO: 13554 - DNA, 1035 bp, Artificial Sequence
  chemically treated genomic DNA (Homo sapiens) CpG-island No: 13554
  misc_feature (833)..(834): n is either a, c, g or t
  misc_feature (836)..(837): n is either a, c, g or t
tacttatataatactctaattctcctccgaaacgaaatacgtttcctacgcaatcatatacgttcaaaactaacaaatcccccttataatttaaccttaatcgtacgctcgtcaactaaaacgcaactctattctactttcgtaccgtctctaatcgtactacgctatcaacgatacaaaactcaacgacttctactaactcaacatcaccaaaacctaatacttaataccaaacgtccgataaacgatctaaactacgcgttctatcgatctctactaaacgtacacgactaatccgtccttctaacgccttcgtcgcgtctcgccgaactctatctaccgcgcctcgacgatcgccgttcccctacgtccgctaccgtcttcttcgctcgctcgccctccttctcgatccccgcccgatcgtactataacgtcgcgccgcttccttctccctctacctccttaacgctcgtaacctacgctcgcctactttctctctcgaacccgactcgcactcgcgctcttaccgcgcccgcctcccgtacccgacgcgtcgctcgcgcccccgcccgtacctcgatcgcttcacctactaacgcgacctcgcgttctcgcgaatccgcccgtaacctcgtcgcgccctatcactaactaacctcgccgttactcgccttccgaccgcgctactcatcctatccttcacctataccgctaactctcctactattctcgcgccgcgctcgctacgacgctatcctcctctctccctaccttctcccctaatactcgcccctccgcgacccttaatctctcgctctctacgtcgacaacanncnnaaaaaataaaaaccaacgaaacaaaaaaccgacatccccgaaaaaaatcccccctctcgcgccgaaatataaacgaaataacgaaaatcgcgcgaataactaccacttcgaaaacgaaacataataaataaacgcgtaccaaaaaaaccttcccgaaacgaatacgaataaaccgacctaatcgactactaaaacgaa

SEQ ID NO: 13555 - DNA, 1035 bp, Artificial Sequence
  chemically treated genomic DNA (Homo sapiens) CpG-island No: 13555
  misc_feature (833)..(834): n is either a, c, g or t
  misc_feature (836)..(837): n is either a, c, g or t
tatttgtatgatgttttgattttttttcgaggcgagatgcgttttttgcgtagttatgtgcgtttaagattgataggttttttttatggtttagttttagtcgtgcgttcgttagttgagacgtagttttgttttgttttcgtgtcgtttttggtcgtattgcgttgttaacggtgtagaatttagcgatttttattagtttaatattattagagtttggtgtttggtgttaggcgttcggtgagcggtttggattgcgcgttttgtcggtttttgttgagcgtatacgattgattcgtttttttggcgttttcgtcgcgtttcgtcgggttttgtttgtcgcgtttcggcggtcgtcgtttttttgcgttcgttgtcgtttttttcgttcgttcgttttttttttcggttttcgttcggtcgtgttgtggcgtcgcgtcgtttttttttttttttgtttttttggcgttcgtggtttgcgttcgtttgttttttttttcgggttcggttcgtattcgcgtttttgtcgcgttcgtttttcgtgttcggcgcgtcgttcgcgttttcgttcgtgtttcggtcgttttatttgttagcgcgatttcgcgttttcgcgggttcgttcgtggtttcgtcgcgttttattattggttggtttcgtcgttgttcgtttttcggtcgcgttgtttattttgttttttatttgtgtcgttggtttttttgttgttttcgcgtcgcgttcgttgcggcgttatttttttttttttttatttttttttttggtattcgttttttcgcggtttttagtttttcgttttttgcgtcgatagtanntnnagaagatagagattagcgaaataaggggtcggtattttcgaagagggttttttttttcgcgtcgaggtgtaagcgggatggcgaaggtcgcgcgggtagttattatttcgggagcgggatatgataggtgaacgcgtgttaggggaattttttcggaacgaatacgggtgggtcggtttaatcgattattggagcgag

SEQ ID NO: 13556 - DNA, 1035 bp, Artificial Sequence
  chemically treated genomic DNA (Homo sapiens) CpG-island No: 13556
  misc_feature (199)..(200): n is either a, c, g or t
  misc_feature (202)..(203): n is either a, c, g or t
ctcgctccaataatcgattaaaccgacccacccgtattcgttccgaaaaaattcccctaacacgcgttcacctatcatatcccgctcccgaaataataactacccgcgcgaccttcgccatcccgcttacacctcgacgcgaaaaaaaaaaccctcttcgaaaataccgaccccttatttcgctaatctctatcttctnnanntactatcgacgcaaaaaacgaaaaactaaaaaccgcgaaaaaacgaataccaaaaaaaaaaataaaaaaaaaaaaaaataacgccgcaacgaacgcgacgcgaaaacaacaaaaaaaccaacgacacaaataaaaaacaaaataaacaacgcgaccgaaaaacgaacaacgacgaaaccaaccaataataaaacgcgacgaaaccacgaacgaacccgcgaaaacgcgaaatcgcgctaacaaataaaacgaccgaaacacgaacgaaaacgcgaacgacgcgccgaacacgaaaaacgaacgcgacaaaaacgcgaatacgaaccgaacccgaaaaaaaaaacaaacgaacgcaaaccacgaacgccaaaaaaacaaaaaaaaaaaaaaacgacgcgacgccacaacacgaccgaacgaaaaccgaaaaaaaaaacgaacgaacgaaaaaaacgacaacgaacgcaaaaaaacgacgaccgccgaaacgcgacaaacaaaacccgacgaaacgcgacgaaaacgccaaaaaaacgaatcaatcgtatacgctcaacaaaaaccgacaaaacgcgcaatccaaaccgctcaccgaacgcctaacaccaaacaccaaactctaataatattaaactaataaaaatcgctaaattctacaccgttaacaacgcaatacgaccaaaaacgacacgaaaacaaaacaaaactacgtctcaactaacgaacgcacgactaaaactaaaccataaaaaaaacctatcaatcttaaacgcacataactacgcaaaaaacgcatctcgcctcgaaaaaaaatcaaaacatcatacaaata

SEQ ID NO: 13557 - DNA, 569 bp, Artificial Sequence
  chemically treated genomic DNA (Homo sapiens) CpG-island No: 13557
gggttcgtcggggtttttggtgcggtgttttggcgttgtgtttcgtatttttcggtttatgtgttgggttcggttcgttgtgggtcgtttttgttagttgtagggttgttcgggtttggtcgcgttttttgggcgttgtttcgcgggggtttgttcggtgtggtgttatttagttgtttacgttattcgtcgagtaacgttttgtcgtaatcgcgttgtttagtttggtgagtacgcgattagatatagttggggagggggagaagtttgcgatacgattatattgttatagtatttgttagtatggcgtttacgtttttcgtcgaattaacgttttgtcgtaatcgtttagattacgttagaggatgagttgtattgtattgttaatatacgtgcgcgggcgattattcggcgggtcggggcggggcggggcggcggggcggggaggggtttcggatatgcgattagtatggcgtttgtacgtatgaaaaggtggggattgtgtttcgaattatgttgtgaagggtaaacggggttttttgtttgattatttatgtgttataggattt

SEQ ID NO: 13558 - DNA, 569 bp, Artificial Sequence
  chemically treated genomic DNA (Homo sapiens) CpG-island No: 13558
aaatcctataacacataaataatcaaacaaaaaaccccgtttacccttcacaacataattcgaaacacaatccccaccttttcatacgtacaaacgccatactaatcgcatatccgaaacccctccccgccccgccgccccgccccgccccgacccgccgaataatcgcccgcgcacgtatattaacaatacaatacaactcatcctctaacgtaatctaaacgattacgacaaaacgttaattcgacgaaaaacgtaaacgccatactaacaaatactataacaatataatcgtatcgcaaacttctccccctccccaactatatctaatcgcgtactcaccaaactaaacaacgcgattacgacaaaacgttactcgacgaataacgtaaacaactaaataacaccacaccgaacaaacccccgcgaaacaacgcccaaaaaacgcgaccaaacccgaacaaccctacaactaacaaaaacgacccacaacgaaccgaacccaacacataaaccgaaaaatacgaaacacaacgccaaaacaccgcaccaaaaaccccgacgaaccc

SEQ ID NO: 13559 - DNA, 569 bp, Artificial Sequence
  chemically treated genomic DNA (Homo sapiens) CpG-island No: 13559
aaattttgtaatatataggtggttaggtaaggagtttcgtttgttttttatagtataattcgggatataatttttatttttttatgcgtataaacgttatattaatcgtatattcggggttttttttcgtttcgtcgtttcgtttcgtttcggttcgtcgggtaatcgttcgcgtacgtgtgttagtaatatagtataatttattttttagcgtggtttaggcggttacggtaaagcgttagttcggcgggaggcgtaggcgttatattagtaaatgttgtaatagtgtggtcgtgtcgtaagtttttttttttttttaattatatttaatcgcgtgtttattaggttaagtaacgcggttgcggtaaagcgttattcggcgggtggcgtaggtaattggatagtattatatcgagtaaattttcgcgggataacgtttaaaaggcgcggttaagttcgaatagttttgtaattaatagagacggtttataacgggtcgagtttaatatatgggtcggaagatgcgaaatataacgttaaagtatcgtattaagggtttcgacgagttt

SEQ ID NO: 13560 - DNA, 569 bp, Artificial Sequence
  chemically treated genomic DNA (Homo sapiens) CpG-island No: 13560
aaactcgtcgaaacccttaatacgatactttaacgttatatttcgcatcttccgacccatatattaaactcgacccgttataaaccgtctctattaattacaaaactattcgaacttaaccgcgccttttaaacgttatcccgcgaaaatttactcgatataatactatccaattacctacgccacccgccgaataacgctttaccgcaaccgcgttacttaacctaataaacacgcgattaaatataattaaaaaaaaaaaaaaacttacgacacgaccacactattacaacatttactaatataacgcctacgcctcccgccgaactaacgctttaccgtaaccgcctaaaccacgctaaaaaataaattatactatattactaacacacgtacgcgaacgattacccgacgaaccgaaacgaaacgaaacgacgaaacgaaaaaaaaccccgaatatacgattaatataacgtttatacgcataaaaaaataaaaattatatcccgaattatactataaaaaacaaacgaaactccttacctaaccacctatatattacaaaattt

SEQ ID NO: 13561 - DNA, 776 bp, Artificial Sequence
  chemically treated genomic DNA (Homo sapiens) CpG-island No: 13561
  misc_feature (632)..(632): n is either a, c, g or t
tatcgtcgtagcggtagcgtattttcggttttttcgcgtaacggtgcgttattattcggttcgggtgttgcgcgttatacgtgaaagcgcgtatttgcgtattgttgcggttatatatcgttagtagtttatcggttttcgtatacgtgtatcgtattagtggcgtagcgggtaggtttttcgggtatgtcgggtcgtgtattagttatatcgtcgaaaggcggatatttttgtcggggtcgtattcggtatcgggtagtgtgtcggggaacgttgaggttgagagagggcgggaattgttagaagaagatagcgaagaggtgcgggtttttttcgtacgttgcgtttgcgtggttagtattagacggaattttcgttcggtatcgttcgttacgtcggtgattttttcggttaggttatcggcggttttacgtcggtacgttagcgttcgttcgaagcggttcgttatttcggtaagtattcggtacggcggtagcggcgttggtagtacgtttttagtattcggtattcgtttagattattttagtatttattacggtttttgtgcgttgttggtcgttaggtaaagatgcgggtttaatcggatattcggcggtagcgttttttatagncgcgttagcgtatggtcgttcggttgtgtttgtttaatatcgcgtattaggtatattgatttattgcgggtgtatatcggtttttttatacgtcgggggtaagattgtagataaaaattatcgtttacgtaaaggtattagttt

SEQ ID NO: 13562 - DNA, 776 bp, Artificial Sequence
  chemically treated genomic DNA (Homo sapiens) CpG-island No: 13562
  misc_feature (145)..(145): n is either a, c, g or t
aaactaatacctttacgtaaacgataatttttatctacaatcttacccccgacgtataaaaaaaccgatatacacccgcaataaatcaatatacctaatacgcgatattaaacaaacacaaccgaacgaccatacgctaacgcgnctataaaaaacgctaccgccgaatatccgattaaacccgcatctttacctaacgaccaacaacgcacaaaaaccgtaataaatactaaaataatctaaacgaataccgaatactaaaaacgtactaccaacgccgctaccgccgtaccgaatacttaccgaaataacgaaccgcttcgaacgaacgctaacgtaccgacgtaaaaccgccgataacctaaccgaaaaaatcaccgacgtaacgaacgataccgaacgaaaattccgtctaatactaaccacgcaaacgcaacgtacgaaaaaaacccgcacctcttcgctatcttcttctaacaattcccgccctctctcaacctcaacgttccccgacacactacccgataccgaatacgaccccgacaaaaatatccgcctttcgacgatataactaatacacgacccgacatacccgaaaaacctacccgctacgccactaatacgatacacgtatacgaaaaccgataaactactaacgatatataaccgcaacaatacgcaaatacgcgctttcacgtataacgcgcaacacccgaaccgaataataacgcaccgttacgcgaaaaaaccgaaaatacgctaccgctacgacgata

SEQ ID NO: 13563 - DNA, 776 bp, Artificial Sequence
  chemically treated genomic DNA (Homo sapiens) CpG-island No: 13563
  misc_feature (145)..(145): n is either a, c, g or t
aaattaatgtttttacgtgggcggtgatttttgtttataattttattttcgacgtataagggagtcggtgtatattcgtagtgagttaatgtgtttggtgcgcggtgttaagtaagtatagtcggacggttatacgttggcgcgnttgtggggggcgttgtcgtcggatattcggttaagttcgtatttttatttggcgattaatagcgtataggggtcgtggtggatattggggtggtttgagcgggtgtcgggtgttgaggacgtattgttagcgtcgttgtcgtcgtatcgggtgtttatcgggatggcggatcgtttcgggcggacgttgacgtatcggcgtgaggtcgtcggtgatttggtcggggaaattatcggcgtgacggacggtgtcgggcgggagtttcgtttggtgttgattacgtaggcgtagcgtgcggaagaggttcgtattttttcgttatttttttttgatagttttcgtttttttttagttttagcgtttttcgatatattgttcggtatcgaatacggtttcgataggggtattcgtttttcggcggtgtggttgatgtacgattcggtatattcggagagtttgttcgttgcgttattggtgcggtatacgtatacggaagtcggtgaattgttggcggtatatgatcgtagtaatacgtaggtgcgcgtttttacgtatgacgcgtagtattcgggtcggatggtggcgtatcgttacgcgggaaggtcggagatgcgttatcgttacgacgata

SEQ ID NO: 13564 - DNA, 776 bp, Artificial Sequence
  chemically treated genomic DNA (Homo sapiens) CpG-island No: 13564
  misc_feature (632)..(632): n is either a, c, g or t
tatcgtcgtaacgataacgcatctccgaccttcccgcgtaacgatacgccaccatccgacccgaatactacgcgtcatacgtaaaaacgcgcacctacgtattactacgatcatataccgccaacaattcaccgacttccgtatacgtataccgcaccaataacgcaacgaacaaactctccgaatataccgaatcgtacatcaaccacaccgccgaaaaacgaatacccctatcgaaaccgtattcgataccgaacaatatatcgaaaaacgctaaaactaaaaaaaaacgaaaactatcaaaaaaaaataacgaaaaaatacgaacctcttccgcacgctacgcctacgtaatcaacaccaaacgaaactcccgcccgacaccgtccgtcacgccgataatttccccgaccaaatcaccgacgacctcacgccgatacgtcaacgtccgcccgaaacgatccgccatcccgataaacacccgatacgacgacaacgacgctaacaatacgtcctcaacacccgacacccgctcaaaccaccccaatatccaccacgacccctatacgctattaatcgccaaataaaaatacgaacttaaccgaatatccgacgacaacgccccccacaancgcgccaacgtataaccgtccgactatacttacttaacaccgcgcaccaaacacattaactcactacgaatatacaccgactcccttatacgtcgaaaataaaattataaacaaaaatcaccgcccacgtaaaaacattaattt

SEQ ID NO: 13565 - DNA, 616 bp, Artificial Sequence
  chemically treated genomic DNA (Homo sapiens) CpG-island No: 13565
ttttatgacgtggtttgtatattattttcgtttttattttttcggtttattttacgtttattacgtatttttatatttattattacgtttaatatattcgttttatcggtaaattcgtaatatattttttcgttcgatatttttcggaaaagtagtcggatcggatttcgcgtgaacgcgttttttcggtattttaatttttgcgtttgcgtttatgtattgttcggttaacgatttcggtatcgttataatcgtttttagcggattttttgcgattattttatcgtcgtgaatatttgcgttcgggttaatgtcgattatatggttagcggcgcgaattgcgttttcgtcgtgttttattataattacggtattatcgagatcgcgtagatggataagcgtatttaataggcgttcgttattacgttggtgtaggtcgatagacggttcgtttagtacgtatataacgttaattaggttcgtattaatttggttcgttagacggatacgttgtgttttatcgttagaaagcgtttttgtcgagcgggaaagcgttaggtaatttaggtcgacgttaacgaggaattttagacgatcgtcgatttttttaaggatt

SEQ ID NO: 13566 - DNA, 616 bp, Artificial Sequence
  chemically treated genomic DNA (Homo sapiens) CpG-island No: 13566
aatccttaaaaaaatcgacgatcgtctaaaattcctcgttaacgtcgacctaaattacctaacgctttcccgctcgacaaaaacgctttctaacgataaaacacaacgtatccgtctaacgaaccaaattaatacgaacctaattaacgttatatacgtactaaacgaaccgtctatcgacctacaccaacgtaataacgaacgcctattaaatacgcttatccatctacgcgatctcgataataccgtaattataataaaacacgacgaaaacgcaattcgcgccgctaaccatataatcgacattaacccgaacgcaaatattcacgacgataaaataatcgcaaaaaatccgctaaaaacgattataacgataccgaaatcgttaaccgaacaatacataaacgcaaacgcaaaaattaaaataccgaaaaaacgcgttcacgcgaaatccgatccgactacttttccgaaaaatatcgaacgaaaaaatatattacgaatttaccgataaaacgaatatattaaacgtaataataaatataaaaatacgtaataaacgtaaaataaaccgaaaaaataaaaacgaaaataatatacaaaccacgtcataaaa

SEQ ID NO: 13567 - DNA, 616 bp, Artificial Sequence
  chemically treated genomic DNA (Homo sapiens) CpG-island No: 13567
aatttttaaagagatcggcgatcgtttgaaatttttcgttaacgtcggtttgaattatttgacgttttttcgttcggtagaaacgttttttggcggtgaagtatagcgtattcgtttggcgagttagattggtgcgggtttggttggcgttatgtacgtgttggacgagtcgtttatcggtttgtattagcgtgataacgagcgtttgttgggtacgtttatttatttgcgcgatttcggtaatatcgtgattgtggtggagtacgacgaagacgtaattcgcgtcgttgattatgtgatcgatattggttcgggcgtaggtgtttacggcggtgaagtggtcgtagaaggttcgttggaagcgattatggcggtgtcggagtcgttgatcgggtagtatatgagcgtaaacgtaagagttgaagtgtcgaagaaacgcgtttacgcgaagttcggttcgattattttttcggggggtgtcgggcgggggggtgtgttgcgggtttgtcggtggggcgggtgtgttgagcgtggtggtgggtgtgggggtgcgtggtgggcgtggggtgggtcggggaggtgaaagcgagagtggtgtgtagattacgttatgggg

SEQ ID NO: 13568 - DNA, 616 bp, Artificial Sequence
  chemically treated genomic DNA (Homo sapiens) CpG-island No: 13568
ccccataacgtaatctacacaccactctcgctttcacctccccgacccaccccacgcccaccacgcacccccacacccaccaccacgctcaacacacccgccccaccgacaaacccgcaacacacccccccgcccgacaccccccgaaaaaataatcgaaccgaacttcgcgtaaacgcgtttcttcgacacttcaactcttacgtttacgctcatatactacccgatcaacgactccgacaccgccataatcgcttccaacgaaccttctacgaccacttcaccgccgtaaacacctacgcccgaaccaatatcgatcacataatcaacgacgcgaattacgtcttcgtcgtactccaccacaatcacgatattaccgaaatcgcgcaaataaataaacgtacccaacaaacgctcgttatcacgctaatacaaaccgataaacgactcgtccaacacgtacataacgccaaccaaacccgcaccaatctaactcgccaaacgaatacgctatacttcaccgccaaaaaacgtttctaccgaacgaaaaaacgtcaaataattcaaaccgacgttaacgaaaaatttcaaacgatcgccgatctctttaaaaatt

SEQ ID NO: 13569 - DNA, 870 bp, Artificial Sequence
  chemically treated genomic DNA (Homo sapiens) CpG-island No: 13569
cggttttgttgcgttggacggtttttgtaaataacgcgatagcgaaggtaattcgacgatgaagttatattgggaaattttttagtaagaggttgacgtttgtttcgtcgttatcgaatggtgttcggcgatttacgaatattttcgtggcggcggttatttttttcgtttttttatcgaaggcggcgtttcgtttattatgattcgtgttaatattattaaaggtttgggatcggtattgtaaatcgcggaaggttggagcgtggaattgtcgaaggatgtgtatgatatttttaataaacgtattaatttaatttggttaattatttggtttgtatcgcgttttatcggtaaagggtcgtttacggatgtgtattcggtaatggcgaattggggcgttaattatggggttttgattatcggttacgttggcgtagattttattattttcgtttttatgttgcgtatttcggtatgtatgtataacgttgaagagattaaagtgtatcgtttttttgtttgggttgcgtacggtatggatattgaaggttaggattatcgcgtttgttagaattacggttcgttgtataagcgttatatattatttttgatgtgatgtcggcgttcgggtacgggttgaataatagatggtagcggaaaataggatcggtaaaggagggcgttttaaataagatttggattacggggcgtttttgttggcggagttgtttttgtgtaatgcgtataaattaggcgcgaaatagttcggattgttcgatatttagtatttcgttatgggtaataatataatatagttagtaaattagcgttagtagttcgtgttttatagcggttgttaggttatgggta

SEQ ID NO: 13570 - DNA, 870 bp, Artificial Sequence
  chemically treated genomic DNA (Homo sapiens) CpG-island No: 13570
tacccataacctaacaaccgctataaaacacgaactactaacgctaatttactaactatattatattattacccataacgaaatactaaatatcgaacaatccgaactatttcgcgcctaatttatacgcattacacaaaaacaactccgccaacaaaaacgccccgtaatccaaatcttatttaaaacgccctcctttaccgatcctattttccgctaccatctattattcaacccgtacccgaacgccgacatcacatcaaaaataatatataacgcttatacaacgaaccgtaattctaacaaacgcgataatcctaaccttcaatatccataccgtacgcaacccaaacaaaaaaacgatacactttaatctcttcaacgttatacatacataccgaaatacgcaacataaaaacgaaaataataaaatctacgccaacgtaaccgataatcaaaaccccataattaacgccccaattcgccattaccgaatacacatccgtaaacgaccctttaccgataaaacgcgatacaaaccaaataattaaccaaattaaattaatacgtttattaaaaatatcatacacatccttcgacaattccacgctccaaccttccgcgatttacaataccgatcccaaacctttaataatattaacacgaatcataataaacgaaacgccgccttcgataaaaaaacgaaaaaaataaccgccgccacgaaaatattcgtaaatcgccgaacaccattcgataacgacgaaacaaacgtcaacctcttactaaaaaatttcccaatataacttcatcgtcgaattaccttcgctatcgcgttatttacaaaaaccgtccaacgcaacaaaaccg

SEQ ID NO: 13571 - DNA, 870 bp, Artificial Sequence
  chemically treated genomic DNA (Homo sapiens) CpG-island No: 13571
tatttataatttggtagtcgttatgaggtacgggttgttggcgttgatttgttggttgtgttgtgttgttgtttatagcgaaatgttgaatgtcgaataattcgggttgtttcgcgtttggtttgtacgtattgtataagaatagtttcgttaataggggcgtttcgtggtttagattttgtttgaggcgtttttttttgtcgattttgtttttcgttattatttgttgtttagttcgtattcgggcgtcggtattatattaggagtaatgtataacgtttgtataacggatcgtagttttggtaagcgcggtaattttggtttttaatatttatgtcgtgcgtagtttaggtagaaggacgatatattttggtttttttaacgttgtgtatatatatcgggatacgtagtatggaggcgagagtgataaagtttgcgttaacgtggtcgatggttagaattttatggttagcgttttagttcgttattatcgagtatatattcgtaaacggttttttatcggtgaggcgcggtgtaaattaggtggttggttaggttgagttggtgcgtttgttgaggatgttatgtatatttttcggtaattttacgttttagtttttcgcgatttgtagtatcggttttaggtttttgatgatgttgatacgagttatggtgaacgggacgtcgttttcggtaaggaagcgggaagagtaatcgtcgttacggaagtattcgtggatcgtcgggtattattcggtagcggcgaggtaagcgttagttttttgttgagagattttttagtgtggttttatcgtcgggttattttcgttgtcgcgttgtttataggaatcgtttagcgtagtagaatcg

SEQ ID NO: 13572 - DNA, 870 bp, Artificial Sequence
  chemically treated genomic DNA (Homo sapiens) CpG-island No: 13572
cgattctactacgctaaacgattcctataaacaacgcgacaacgaaaataacccgacgataaaaccacactaaaaaatctctcaacaaaaaactaacgcttacctcgccgctaccgaataatacccgacgatccacgaatacttccgtaacgacgattactcttcccgcttccttaccgaaaacgacgtcccgttcaccataactcgtatcaacatcatcaaaaacctaaaaccgatactacaaatcgcgaaaaactaaaacgtaaaattaccgaaaaatatacataacatcctcaacaaacgcaccaactcaacctaaccaaccacctaatttacaccgcgcctcaccgataaaaaaccgtttacgaatatatactcgataataacgaactaaaacgctaaccataaaattctaaccatcgaccacgttaacgcaaactttatcactctcgcctccatactacgtatcccgatatatatacacaacgttaaaaaaaccaaaatatatcgtccttctacctaaactacgcacgacataaatattaaaaaccaaaattaccgcgcttaccaaaactacgatccgttatacaaacgttatacattactcctaatataataccgacgcccgaatacgaactaaacaacaaataataacgaaaaacaaaatcgacaaaaaaaaacgcctcaaacaaaatctaaaccacgaaacgcccctattaacgaaactattcttatacaatacgtacaaaccaaacgcgaaacaacccgaattattcgacattcaacatttcgctataaacaacaacacaacacaaccaacaaatcaacgccaacaacccgtacctcataacgactaccaaattataaata

SEQ ID NO: 13573 - DNA, 508 bp, Artificial Sequence
  chemically treated genomic DNA (Homo sapiens) CpG-island No: 13573
aggcgattttttgaacggttttagtgatagttttaatcgtatgggtattatcgagtggatgtttattcgttacgaagaagtggcggtttttgtcgttggcgttgaagtataatttagcggagaattggcggtttgcgtcggatcgtgcggtttcggtaatttgtatttaattaacggtttgttcgattgttatcgtaattacgtttcggtattggcgattgtcgtttatattttttttagcgaaattggtagcggttatttttaggaaatttatttataagagttatttcgcgaatgtagttattattgcgagttggtttttagttcggagtagattttataagtattggcgattgttatgcgtaaagcggtgtttaatcgtggcgtttcggttgttagtgttattaggcgacgtggcgttaaaatttgcgttagaaggggtaattatgtataagtattaggtagggtattagttattttgtcggcgttaggtaaggggttatttaag

SEQ ID NO: 13574 - DNA, 508 bp, Artificial Sequence
  chemically treated genomic DNA (Homo sapiens) CpG-island No: 13574
cttaaataaccccttacctaacgccgacaaaataactaataccctacctaatacttatacataattaccccttctaacgcaaattttaacgccacgtcgcctaataacactaacaaccgaaacgccacgattaaacaccgctttacgcataacaatcgccaatacttataaaatctactccgaactaaaaaccaactcgcaataataactacattcgcgaaataactcttataaataaatttcctaaaaataaccgctaccaatttcgctaaaaaaaatataaacgacaatcgccaataccgaaacgtaattacgataacaatcgaacaaaccgttaattaaatacaaattaccgaaaccgcacgatccgacgcaaaccgccaattctccgctaaattatacttcaacgccaacgacaaaaaccgccacttcttcgtaacgaataaacatccactcgataatacccatacgattaaaactatcactaaaaccgttcaaaaaatcgcct

SEQ ID NO: 13575 - DNA, 508 bp, Artificial Sequence
  chemically treated genomic DNA (Homo sapiens) CpG-island No: 13575
tttgaatggttttttgtttagcgtcgataggatagttggtattttgtttgatatttgtgtatggttgttttttttggcgtaggttttaacgttacgtcgtttggtaatattgataatcgaaacgttacggttaagtatcgttttgcgtatggtaatcgttagtatttgtgggatttgtttcgggttggaaattagttcgtaatagtgattatattcgcggaatagtttttgtgggtgggttttttggaaatagtcgttgttaatttcgttggagggaatatgagcggtaatcgttagtatcggaacgtgattgcggtggtaatcgaataggtcgttgattaagtgtaggttgtcggggtcgtacgattcggcgtagatcgttagtttttcgttaagttgtgttttagcgttagcggtaaaggtcgttattttttcgtggcgggtggatatttattcgatggtgtttatgcgattaagattgttattaagatcgtttagagagtcgttt

SEQ ID NO: 13576 - DNA, 508 bp, Artificial Sequence
  chemically treated genomic DNA (Homo sapiens) CpG-island No: 13576
aaacgactctctaaacgatcttaataacaatcttaatcgcataaacaccatcgaataaatatccacccgccacgaaaaaataacgacctttaccgctaacgctaaaacacaacttaacgaaaaactaacgatctacgccgaatcgtacgaccccgacaacctacacttaatcaacgacctattcgattaccaccgcaatcacgttccgatactaacgattaccgctcatattccctccaacgaaattaacaacgactatttccaaaaaacccacccacaaaaactattccgcgaatataatcactattacgaactaatttccaacccgaaacaaatcccacaaatactaacgattaccatacgcaaaacgatacttaaccgtaacgtttcgattatcaatattaccaaacgacgtaacgttaaaacctacgccaaaaaaaacaaccatacacaaatatcaaacaaaataccaactatcctatcgacgctaaacaaaaaaccattcaaa

SEQ ID NO: 13577 - DNA, 1627 bp, Artificial Sequence
  chemically treated genomic DNA (Homo sapiens) CpG-island No: 13577
aggtcgttgcgtcgttgatgaatatttcgatcgtcgatttatcgacgattattcgtaggcgttgtatggcgtcgaacgatttcgcggcgtagtttttttttaggatttgggggttttcgttatcggcggataacgtcgaatgcgatttgtttacgattatttcgtcgcgcgttcgatcgaagattaatcgcgtgaattcgcggtcgtcgggcgagacgagtacgtcgagttggatgggcgtcgtagcggaaggtgtatcgtcgagttcgattagtagttcgtaggcgttatgttttgcgtcgagcgagatcggatttcgatcgatcgttacgtcggatcggtcgacgatcgcgtttgcgcgtagtagcgttagttcgggagcgggtcgttgttttagggtgcgtttgtcgtcgagtaggtattaggttcgcggtaggttgaaggtatgcgtttagttcgttcgtttttgcgcgagtggcgtgcggcgtttatcgatgatgtttatggttcgtaggtagtcgtcgtcggttcggtttacggtcggggcgagatggttcgggacgaggtttaagagtttgggtgtcggcgagaacggtttgaacgtgtcgtcggattagatgtcggtttagtagatcgtacgcgtgttcggttcgtcgtatttgttgagagagagcggtgttgtaggtcgattttagtttgtttttttcgtttgtgtatttttttggtggttattttcgtaggcgatttgcgtattaggttaagtcgaagttttcgtttcggcggtgggtttatttggtggttacggtggacgtcgtaatcggcgtcgtatcgttttattaaggcgacgagttgattggtatcgggtaaggcgtttttggtatgattttggagttggtatagacgtcgttgcggttggcggtagcgtttacggaaattaagattttggattttacgattaatcggttgaacggcgcgttcgattaggttgtcgtgtatgtcgttgtatttagcgtcgagtagcgtcgattgttgtcgggttcgttatcggtgtcgagcgcggagtcgtcgttggtggtttcggtaacgcgtttcgttaaggatacgttgcgttttcgcgtgtattcgttgtcgtcggttaattggattaatgaattttacggtttgattcgtattggcgatatttggtacgttttttattaacgtatttttaacggttcgtttaagatattgatgtattgggggtatatgattagtcgcgatttggtggtttgggagaattagtttgacgcgttgatgttcgagttgtagagcgacgatttcggtttcgatatgaagggtatttggtcgggttatgttaggcgttagttgatatcggaagatttagtggattttcgggcgtattagaagggtatggaatgggaagaaaattagatcggttgaaagaggcgtgtgaaggggggcggatgaaatgtttggatcgaggtcgtttagagttgcgggtacgcggatgtataagatttgacgtagtatcggatttagtcggatttttgttttatattatttttgttgtcggttgttggcgtattttgtatgggattatggtgggtgcgtaataaaagagaaaaaa

SEQ ID NO: 13578 - DNA, 1627 bp, Artificial Sequence
  chemically treated genomic DNA (Homo sapiens) CpG-island No: 13578
ttttttctcttttattacgcacccaccataatcccatacaaaatacgccaacaaccgacaacaaaaataatataaaacaaaaatccgactaaatccgatactacgtcaaatcttatacatccgcgtacccgcaactctaaacgacctcgatccaaacatttcatccgccccccttcacacgcctctttcaaccgatctaattttcttcccattccatacccttctaatacgcccgaaaatccactaaatcttccgatatcaactaacgcctaacataacccgaccaaatacccttcatatcgaaaccgaaatcgtcgctctacaactcgaacatcaacgcgtcaaactaattctcccaaaccaccaaatcgcgactaatcatatacccccaatacatcaatatcttaaacgaaccgttaaaaatacgttaataaaaaacgtaccaaatatcgccaatacgaatcaaaccgtaaaattcattaatccaattaaccgacgacaacgaatacacgcgaaaacgcaacgtatccttaacgaaacgcgttaccgaaaccaccaacgacgactccgcgctcgacaccgataacgaacccgacaacaatcgacgctactcgacgctaaatacaacgacatacacgacaacctaatcgaacgcgccgttcaaccgattaatcgtaaaatccaaaatcttaatttccgtaaacgctaccgccaaccgcaacgacgtctataccaactccaaaatcataccaaaaacgccttacccgataccaatcaactcgtcgccttaataaaacgatacgacgccgattacgacgtccaccgtaaccaccaaataaacccaccgccgaaacgaaaacttcgacttaacctaatacgcaaatcgcctacgaaaataaccaccaaaaaaatacacaaacgaaaaaaacaaactaaaatcgacctacaacaccgctctctctcaacaaatacgacgaaccgaacacgcgtacgatctactaaaccgacatctaatccgacgacacgttcaaaccgttctcgccgacacccaaactcttaaacctcgtcccgaaccatctcgccccgaccgtaaaccgaaccgacgacgactacctacgaaccataaacatcatcgataaacgccgcacgccactcgcgcaaaaacgaacgaactaaacgcataccttcaacctaccgcgaacctaatacctactcgacgacaaacgcaccctaaaacaacgacccgctcccgaactaacgctactacgcgcaaacgcgatcgtcgaccgatccgacgtaacgatcgatcgaaatccgatctcgctcgacgcaaaacataacgcctacgaactactaatcgaactcgacgatacaccttccgctacgacgcccatccaactcgacgtactcgtctcgcccgacgaccgcgaattcacgcgattaatcttcgatcgaacgcgcgacgaaataatcgtaaacaaatcgcattcgacgttatccgccgataacgaaaacccccaaatcctaaaaaaaaactacgccgcgaaatcgttcgacgccatacaacgcctacgaataatcgtcgataaatcgacgatcgaaatattcatcaacgacgcaacgacct

SEQ ID NO: 13579 - DNA, 1627 bp, Artificial Sequence
  chemically treated genomic DNA (Homo sapiens) CpG-island No: 13579
tttttttttttttattacgtatttattatggttttatataaggtacgttaatagtcggtaataaagataatatagggtaggggttcggttgggttcggtattacgttaagttttatatattcgcgtgttcgtagttttaggcggtttcggtttaagtattttattcgtttttttttatacgttttttttagtcggtttagttttttttttattttatgtttttttaatgcgttcgaaaatttattgggtttttcggtattaattggcgtttgatatggttcgattagatgttttttatgtcgaagtcgaagtcgtcgttttgtagttcgggtattagcgcgttaggttggtttttttagattattaggtcgcggttggttatgtgtttttagtgtattagtgttttgaacgggtcgttgggggtgcgttggtagaagacgtgttaggtgtcgttaatgcggattaggtcgtgaggtttattggtttagttggtcggcggtagcggatgtacgcggggacgtagcgtgtttttggcgaagcgcgttgtcgggattattagcgacggtttcgcgttcggtatcggtgacgggttcgatagtaatcggcgttgttcggcgttgagtgtagcggtatatacggtaatttggtcgaacgcgtcgtttagtcgattgatcgtgaagtttagaattttggttttcgtgggcgttgtcgttagtcgtagcggcgtttgtgttaattttagggttatgttaggggcgttttgttcggtgttaattaattcgtcgttttggtagagcgatgcgacgtcggttgcggcgtttatcgtggttattaggtggatttatcgtcgaagcgggaatttcgatttggtttgatgcgtaggtcgtttgcggaggtggttattagggaagtatataagcgaggagaatagattagagtcgatttgtagtatcgtttttttttagtaagtacggcgaatcgagtacgcgtacggtttattggatcggtatttggttcgacggtacgtttaagtcgttttcgtcgatatttaagtttttggatttcgtttcgggttatttcgtttcgatcgtgggtcgggtcgacgacggttgtttgcgagttatgggtattatcgatgaacgtcgtacgttattcgcgtagagacgggcgggttgggcgtatatttttagtttgtcgcggatttggtatttgttcggcgataagcgtattttggggtaacgattcgttttcgagttggcgttattgcgcgtaagcgcggtcgtcgatcggttcggcgtggcgatcggtcggggttcggtttcgttcgacgtaggatatggcgtttacgaattgttgatcgaattcgacgatgtatttttcgttgcggcgtttatttagttcgacgtgttcgtttcgttcgacggtcgcgagtttacgcggttgattttcgatcgggcgcgcggcgaggtgatcgtggataagtcgtattcgacgttgttcgtcgatggcgaaggtttttagattttgaaggggagttacgtcgcggaatcgttcggcgttatgtagcgtttgcgggtgatcgtcgatggatcgacggtcgaggtgtttattaacgacgtagcggttt

SEQ ID NO: 13580 - DNA, 1627 bp, Artificial Sequence
  chemically treated genomic DNA (Homo sapiens) CpG-island No: 13580
aaaccgctacgtcgttaataaacacctcgaccgtcgatccatcgacgatcacccgcaaacgctacataacgccgaacgattccgcgacgtaactccccttcaaaatctaaaaaccttcgccatcgacgaacaacgtcgaatacgacttatccacgatcacctcgccgcgcgcccgatcgaaaatcaaccgcgtaaactcgcgaccgtcgaacgaaacgaacacgtcgaactaaataaacgccgcaacgaaaaatacatcgtcgaattcgatcaacaattcgtaaacgccatatcctacgtcgaacgaaaccgaaccccgaccgatcgccacgccgaaccgatcgacgaccgcgcttacgcgcaataacgccaactcgaaaacgaatcgttaccccaaaatacgcttatcgccgaacaaataccaaatccgcgacaaactaaaaatatacgcccaacccgcccgtctctacgcgaataacgtacgacgttcatcgataatacccataactcgcaaacaaccgtcgtcgacccgacccacgatcgaaacgaaataacccgaaacgaaatccaaaaacttaaatatcgacgaaaacgacttaaacgtaccgtcgaaccaaataccgatccaataaaccgtacgcgtactcgattcgccgtacttactaaaaaaaaacgatactacaaatcgactctaatctattctcctcgcttatatacttccctaataaccacctccgcaaacgacctacgcatcaaaccaaatcgaaattcccgcttcgacgataaatccacctaataaccacgataaacgccgcaaccgacgtcgcatcgctctaccaaaacgacgaattaattaacaccgaacaaaacgcccctaacataaccctaaaattaacacaaacgccgctacgactaacgacaacgcccacgaaaaccaaaattctaaacttcacgatcaatcgactaaacgacgcgttcgaccaaattaccgtatataccgctacactcaacgccgaacaacgccgattactatcgaacccgtcaccgataccgaacgcgaaaccgtcgctaataatcccgacaacgcgcttcgccaaaaacacgctacgtccccgcgtacatccgctaccgccgaccaactaaaccaataaacctcacgacctaatccgcattaacgacacctaacacgtcttctaccaacgcacccccaacgacccgttcaaaacactaatacactaaaaacacataaccaaccgcgacctaataatctaaaaaaaccaacctaacgcgctaatacccgaactacaaaacgacgacttcgacttcgacataaaaaacatctaatcgaaccatatcaaacgccaattaataccgaaaaacccaataaattttcgaacgcattaaaaaaacataaaataaaaaaaaaactaaaccgactaaaaaaaacgtataaaaaaaaacgaataaaatacttaaaccgaaaccgcctaaaactacgaacacgcgaatatataaaacttaacgtaataccgaacccaaccgaacccctaccctatattatctttattaccgactattaacgtaccttatataaaaccataataaatacgtaataaaaaaaaaaaaa

SEQ ID NO: 13581 - DNA, 640 bp, Artificial Sequence
  chemically treated genomic DNA (Homo sapiens) CpG-island No: 13581
tcgtcgtataggcgatagcgatagattgcggggagattattttatcggtgacgttatcggtggtattggcggtaattagtaatagattagagacgttaatttgttgtgttgcggtggtttgtagcgcggcgaatagggcgttagatgaggtattcgattcggttaggaatatttttagttagtcgaggaacggcgagaagaaggtgaatgtatgatcggtgtgcgttagtgttagcgttagtgttgatgatagttcggaatagttcgaaataaaggcgaatgttagtattatatcgatggagtagatgggtagagttagtttttttagcgtgttgtcgaaggtgttgatagcgttagacggttttatttttagttagataatcgagagtagtgtagtaaatagaatggcggtgtcggtggtagagaattagttaaatttaaatacggcggtataggttgtagtttcgttgattattggcggtatacgggtaattagtttatcgaggtacggtatcggaatattgatttattttatttatatagcgcgttattcgatgcgaatagggttttaaacggcgggatattttatagtgttacgggtagttgttaggatatgaataattttagtagttttttatta

SEQ ID NO: 13582 - DNA, 640 bp, Artificial Sequence
  chemically treated genomic DNA (Homo sapiens) CpG-island No: 13582
taataaaaaactactaaaattattcatatcctaacaactacccgtaacactataaaatatcccgccgtttaaaaccctattcgcatcgaataacgcgctatataaataaaataaatcaatattccgataccgtacctcgataaactaattacccgtataccgccaataatcaacgaaactacaacctataccgccgtatttaaatttaactaattctctaccaccgacaccgccattctatttactacactactctcgattatctaactaaaaataaaaccgtctaacgctatcaacaccttcgacaacacgctaaaaaaactaactctacccatctactccatcgatataatactaacattcgcctttatttcgaactattccgaactatcatcaacactaacgctaacactaacgcacaccgatcatacattcaccttcttctcgccgttcctcgactaactaaaaatattcctaaccgaatcgaatacctcatctaacgccctattcgccgcgctacaaaccaccgcaacacaacaaattaacgtctctaatctattactaattaccgccaataccaccgataacgtcaccgataaaataatctccccgcaatctatcgctatcgcctatacgacga

SEQ ID NO: 13583 - DNA, 640 bp, Artificial Sequence
  chemically treated genomic DNA (Homo sapiens) CpG-island No: 13583
taatagaggattgttggagttatttatgttttgatagttattcgtaatattatggagtatttcgtcgtttaaagttttgttcgtatcgggtggcgcgttgtatgagtagggtagattaatatttcggtgtcgtatttcgataaattggttgttcgtatgtcgttagtggttagcgaggttatagtttatgtcgtcgtgtttaagtttgattggttttttgttatcggtatcgttattttgtttgttgtattgttttcgattgtttggttgaagatgaaatcgtttgacgttattagtattttcggtagtacgttgaaagaattggttttgtttatttattttatcggtatggtgttggtattcgtttttatttcgaattatttcggattgttattaatattggcgttggtattggcgtatatcggttatgtatttatttttttttcgtcgtttttcggttggttgggggtatttttgatcgggtcggatattttatttaacgttttgttcgtcgcgttgtaagttatcgtagtataataaattggcgtttttgatttgttgttggttgtcgttaatattatcggtggcgttatcggtaagatgattttttcgtaatttatcgttatcgtttgtgcggcgg

SEQ ID NO: 13584 - DNA, 640 bp, Artificial Sequence
  chemically treated genomic DNA (Homo sapiens) CpG-island No: 13584
ccgccgcacaaacgataacgataaattacgaaaaaatcatcttaccgataacgccaccgataatattaacgacaaccaacaacaaatcaaaaacgccaatttattatactacgataacttacaacgcgacgaacaaaacgttaaataaaatatccgacccgatcaaaaatacccccaaccaaccgaaaaacgacgaaaaaaaaataaatacataaccgatatacgccaataccaacgccaatattaataacaatccgaaataattcgaaataaaaacgaataccaacaccataccgataaaataaataaacaaaaccaattctttcaacgtactaccgaaaatactaataacgtcaaacgatttcatcttcaaccaaacaatcgaaaacaatacaacaaacaaaataacgataccgataacaaaaaaccaatcaaacttaaacacgacgacataaactataacctcgctaaccactaacgacatacgaacaaccaatttatcgaaatacgacaccgaaatattaatctaccctactcatacaacgcgccacccgatacgaacaaaactttaaacgacgaaatactccataatattacgaataactatcaaaacataaataactccaacaatcctctatta

SEQ ID NO: 13585 - DNA, 1215 bp, Artificial Sequence
  chemically treated genomic DNA (Homo sapiens) CpG-island No: 13585
tagaagtcgttatttttttaattcgcgacgacgcgaagacgtgtatcggtttattaggtattcgaagtacgttaatacgggtacgttcggcgcgttatcgtgttgttaattgatatttttcgtgtttgtcgagacgtgtatattgggtattggcgtttatatggtgcggttcgatgattatcgtataaattgtttttgacggcgatattattcgttatcgttatgataatttatatagtgatttattttgcgtaacggaagatgttatcggtagtcggaaaattatgacgtggagtcgttacggttagttgttgagttttattgattgtttcggttatgtaattcgttatgattatgatcgttttggttaggtgacggcggtgtatcgcgaggaagggttgagttagtatcgcgtatacgatagtcgtggatagttaattgtcgtgaaagatacgtagggttatgaaacgcggtatgaatataacgtcgtcggtgatttgattatcgttattgtttcggacggtagtagaaacgggatatagtacgatgcgtggggaaaagttatttgtattacgtagggcggtttgacgcgtagtatggaatacgatgttgtcggacgggttattcgtttgattagtgaaaacggtagttatattatttttcgttacgatgtattcgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaatcgtagagcggtggtagtatgacgaacgtggttggttgatagatattagttatattagcgaagggtatcgggtggcggtgtataataggtatgatgagaaaggtcggttgatcggtgagcgttagacggtgtattattttgttgaaagagttggacggttttatcgttaaatagtagaagttggcgttgtcgaagttgttggagattgtcgaatcgtatttaggtaaggtattttattgtatcgaaaataattcgtcgttattaaacggcgggttgttttcggtgtagtagagtgttttatttggatgcggttcggtagtttttagtagtttcgagtagagttagtttttgttgtttggcggtgaaatcgtttagtttttt

SEQ ID NO: 13586 - DNA, 1215 bp, Artificial Sequence
  chemically treated genomic DNA (Homo sapiens) CpG-island No: 13586
aaaaaactaaacgatttcaccgccaaacaacaaaaactaactctactcgaaactactaaaaactaccgaaccgcatccaaataaaacactctactacaccgaaaacaacccgccgtttaataacgacgaattattttcgatacaataaaataccttacctaaatacgattcgacaatctccaacaacttcgacaacgccaacttctactatttaacgataaaaccgtccaactctttcaacaaaataatacaccgtctaacgctcaccgatcaaccgacctttctcatcatacctattatacaccgccacccgatacccttcgctaatataactaatatctatcaaccaaccacgttcgtcatactaccaccgctctacgatttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcgaatacatcgtaacgaaaaataatataactaccgttttcactaatcaaacgaataacccgtccgacaacatcgtattccatactacgcgtcaaaccgccctacgtaatacaaataacttttccccacgcatcgtactatatcccgtttctactaccgtccgaaacaataacgataatcaaatcaccgacgacgttatattcataccgcgtttcataaccctacgtatctttcacgacaattaactatccacgactatcgtatacgcgatactaactcaacccttcctcgcgatacaccgccgtcacctaaccaaaacgatcataatcataacgaattacataaccgaaacaatcaataaaactcaacaactaaccgtaacgactccacgtcataattttccgactaccgataacatcttccgttacgcaaaataaatcactatataaattatcataacgataacgaataatatcgccgtcaaaaacaatttatacgataatcatcgaaccgcaccatataaacgccaatacccaatatacacgtctcgacaaacacgaaaaatatcaattaacaacacgataacgcgccgaacgtacccgtattaacgtacttcgaatacctaataaaccgatacacgtcttcgcgtcgtcgcgaattaaaaaaataacgacttcta

SEQ ID NO: 13587 - DNA, 1215 bp, Artificial Sequence
  chemically treated genomic DNA (Homo sapiens) CpG-island No: 13587
aaagagttggacggttttatcgttaaatagtagaagttggttttgttcgaagttgttggagattgtcgaatcgtatttaggtaaggtattttattgtatcgaaaataattcgtcgtttgataacggcgggttgttttcggtgtagtagagtgttttatttggatgcggttcggtagtttttagtagtttcgatagcgttagtttttgttgtttggcggtgaaatcgtttagtttttttagtagggtgatgtatcgtttgacgtttatcggttagtcggttttttttattatatttgttatgtatcgttattcggtgtttttcgttgatatggttgatgtttgttagttagttacgttcgttatattgttatcgttttgcggttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggtcgagtatatcgtaacggaaggtggtgtggttgtcgtttttattggttaggcggatgattcgttcggtagtatcgtattttatattgcgcgttagatcgttttgcgtggtatagatggtttttttttacgtatcgtattgtgtttcgtttttgttgtcgttcggggtaatgacggtggttaggttatcggcggcgttgtatttatatcgcgttttatggttttgcgtgttttttacggtaattaattgtttacggttgtcgtatgcgcggtattgatttagttttttttcgcggtgtatcgtcgttatttgattaaaacggttatggttatagcgggttatataatcggaatagttagtgaagtttagtaattgatcgtaacggttttacgttatggtttttcggttgtcggtggtatttttcgttgcgtagggtaagttattgtgtggattattataacggtagcgggtgatatcgtcgttaggggtagtttatacggtagttatcgaatcgtattatatgggcgttagtatttaatatgtacgtttcggtaggtacgaggggtgttaattaatagtacgatagcgcgtcggacgtgttcgtattaacgtgtttcgggtatttgataaatcggtgtacgttttcgcgtcgtcgcgggttaaaggggtggcggtttttg

SEQ ID NO: 13588 - DNA, 1215 bp, Artificial Sequence
  chemically treated genomic DNA (Homo sapiens) CpG-island No: 13588
caaaaaccgccacccctttaacccgcgacgacgcgaaaacgtacaccgatttatcaaatacccgaaacacgttaatacgaacacgtccgacgcgctatcgtactattaattaacacccctcgtacctaccgaaacgtacatattaaatactaacgcccatataatacgattcgataactaccgtataaactacccctaacgacgatatcacccgctaccgttataataatccacacaataacttaccctacgcaacgaaaaataccaccgacaaccgaaaaaccataacgtaaaaccgttacgatcaattactaaacttcactaactattccgattatataacccgctataaccataaccgttttaatcaaataacgacgatacaccgcgaaaaaaaactaaatcaataccgcgcatacgacaaccgtaaacaattaattaccgtaaaaaacacgcaaaaccataaaacgcgatataaatacaacgccgccgataacctaaccaccgtcattaccccgaacgacaacaaaaacgaaacacaatacgatacgtaaaaaaaaaccatctataccacgcaaaacgatctaacgcgcaatataaaatacgatactaccgaacgaatcatccgcctaaccaataaaaacgacaaccacaccaccttccgttacgatatactcgaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaaccgcaaaacgataacaatataacgaacgtaactaactaacaaacatcaaccatatcaacgaaaaacaccgaataacgatacataacaaatataataaaaaaaaccgactaaccgataaacgtcaaacgatacatcaccctactaaaaaaactaaacgatttcaccgccaaacaacaaaaactaacgctatcgaaactactaaaaactaccgaaccgcatccaaataaaacactctactacaccgaaaacaacccgccgttatcaaacgacgaattattttcgatacaataaaataccttacctaaatacgattcgacaatctccaacaacttcgaacaaaaccaacttctactatttaacgataaaaccgtccaactcttt

SEQ ID NO: 13589 - DNA, 513 bp, Artificial Sequence
  chemically treated genomic DNA (Homo sapiens) CpG-island No: 13589
atcgatatcgcgttaaaggtatcgttatgataattattgcggaaggttagaaaacgttggcgcgtttcgtttttggtttgttagtattgtaacgttatttttatcgttatttttatcgttacggaatcggagttcgcgagaaaaacgtattttagcggttgcggcgttatcgttattagtttgcggtatagtttaatggttggcgtatgggtgatatcgttaaatattatatgcgatatggtattaatttgcgattttatcgtcgtattaagttgcgggtgattgtagtcgtggatcgtcgtttattaggacgatatatcgttaattaggcgtttgtcgttagataaaattatttattggcgattttaatgtcgttgtagatgatttttattcgcgtatcggttaggtatttcgttagttcgaggtaggttgagtcggagtcgagaaaaaagtagtcgttatttttgattattgttcgggtaagggtagttattttttttttcgttatagatt

SEQ ID NO: 13590 - DNA, 513 bp, Artificial Sequence
  chemically treated genomic DNA (Homo sapiens) CpG-island No: 13590
aatctataacgaaaaaaaaaataactacccttacccgaacaataatcaaaaataacgactacttttttctcgactccgactcaacctacctcgaactaacgaaatacctaaccgatacgcgaataaaaatcatctacaacgacattaaaatcgccaataaataattttatctaacgacaaacgcctaattaacgatatatcgtcctaataaacgacgatccacgactacaatcacccgcaacttaatacgacgataaaatcgcaaattaataccatatcgcatataatatttaacgatatcacccatacgccaaccattaaactataccgcaaactaataacgataacgccgcaaccgctaaaatacgtttttctcgcgaactccgattccgtaacgataaaaataacgataaaaataacgttacaatactaacaaaccaaaaacgaaacgcgccaacgttttctaaccttccgcaataattatcataacgatacctttaacgcgatatcgat

SEQ ID NO: 13591 - DNA, 513 bp, Artificial Sequence
  chemically treated genomic DNA (Homo sapiens) CpG-island No: 13591
aatttgtggcgaaaagagaaatagttgtttttgttcgaataatgattaaagatggcgattgtttttttttcgatttcggtttaatttgtttcgaattggcgaaatgtttggtcgatgcgcgggtaaaggttatttgtaacgatattaaaatcgttaatgaatgattttgtttgacggtagacgtttggttgacggtatgtcgttttggtgggcggcgatttacggttataattattcgtagtttaatgcggcgatgaagtcgtaaattgatgttatgtcgtatgtgatgtttggcggtattatttatgcgttagttattgagttgtgtcgtaaattggtggcgatgacgtcgtaatcgttggagtgcgtttttttcgcggatttcggtttcgtagcggtggaagtggcgatgaaaatggcgttgtagtattggtaagttaaaggcgaagcgcgttagcgttttttgatttttcgtaatggttattatggcgatatttttggcgcgatgtcggt

SEQ ID NO: 13592 - DNA, 513 bp, Artificial Sequence
  chemically treated genomic DNA (Homo sapiens) CpG-island No: 13592
accgacatcgcgccaaaaatatcgccataataaccattacgaaaaatcaaaaaacgctaacgcgcttcgcctttaacttaccaatactacaacgccattttcatcgccacttccaccgctacgaaaccgaaatccgcgaaaaaaacgcactccaacgattacgacgtcatcgccaccaatttacgacacaactcaataactaacgcataaataataccgccaaacatcacatacgacataacatcaatttacgacttcatcgccgcattaaactacgaataattataaccgtaaatcgccgcccaccaaaacgacataccgtcaaccaaacgtctaccgtcaaacaaaatcattcattaacgattttaatatcgttacaaataacctttacccgcgcatcgaccaaacatttcgccaattcgaaacaaattaaaccgaaatcgaaaaaaaaacaatcgccatctttaatcattattcgaacaaaaacaactatttctcttttcgccacaaatt

SEQ ID NO: 13593 - DNA, 516 bp, Artificial Sequence
  chemically treated genomic DNA (Homo sapiens) CpG-island No: 13593
tacgtacgtatttatgttggggtatttacgtttttatatattgagatacgtacgtatgttcgttggggtatttatgtttttatatattgagatatgtacgtatatatgttggggtatttacgtttttatatattgagatacgtacgtatattcgttggggtattgatgtttttatatattgagatatgtacgtatttatgttgggtatttacgtttttatatattgagatacgtacgtatattcgttgggatattgacgtttttatatattgagatacgtacgtatttatgttggggtatttacgtttttatatattgagatacgtatgtattttcgttggggtacgtacgtttttataaattgagatacgtatatattttcgttggggtattgacgtttttatatattgagatacgtacgcgtttatgttggggtatttacgtttttatatattgagatatgtatgtatttatgttggggtatttacgtttttatatattgagatacgtttatat

SEQ ID NO: 13594 - DNA, 516 bp, Artificial Sequence
  chemically treated genomic DNA (Homo sapiens) CpG-island No: 13594
atataaacgtatctcaatatataaaaacgtaaataccccaacataaatacatacatatctcaatatataaaaacgtaaataccccaacataaacgcgtacgtatctcaatatataaaaacgtcaataccccaacgaaaatatatacgtatctcaatttataaaaacgtacgtaccccaacgaaaatacatacgtatctcaatatataaaaacgtaaataccccaacataaatacgtacgtatctcaatatataaaaacgtcaatatcccaacgaatatacgtacgtatctcaatatataaaaacgtaaatacccaacataaatacgtacatatctcaatatataaaaacatcaataccccaacgaatatacgtacgtatctcaatatataaaaacgtaaataccccaacatatatacgtacatatctcaatatataaaaacataaataccccaacgaacatacgtacgtatctcaatatataaaaacgtaaataccccaacataaatacgtacgta

SEQ ID NO: 13595 - DNA, 516 bp, Artificial Sequence
  chemically treated genomic DNA (Homo sapiens) CpG-island No: 13595
atgtgggcgtattttagtgtgtgagagcgtgggtattttagtatgaatgtatgtatattttagtgtgtgagagcgtgggtattttagtatgaacgcgtgcgtattttagtgtgtgagagcgttagtattttagcgggaatgtgtgcgtattttagtttgtgagagcgtgcgtattttagcgggaatgtatgcgtattttagtgtgtgagagcgtgggtattttagtatgaatgcgtgcgtattttagtgtgtgagagcgttagtattttagcggatatgcgtgcgtattttagtgtgtgagagcgtgggtatttagtatgaatgcgtgtatattttagtgtgtgagagtattagtattttagcggatatgcgtgcgtattttagtgtgtgagagcgtgagtattttagtatgtatgcgtgtatattttagtgtgtgagagtatgagtattttagcggatatgcgtgcgtattttagtgtgtgagagcgtgggtattttagtatgaatgcgtgcgta

SEQ ID NO: 13596 - DNA, 516 bp, Artificial Sequence
  chemically treated genomic DNA (Homo sapiens) CpG-island No: 13596
tacgcacgcattcatactaaaatacccacgctctcacacactaaaatacgcacgcatatccgctaaaatactcatactctcacacactaaaatatacacgcatacatactaaaatactcacgctctcacacactaaaatacgcacgcatatccgctaaaatactaatactctcacacactaaaatatacacgcattcatactaaatacccacgctctcacacactaaaatacgcacgcatatccgctaaaatactaacgctctcacacactaaaatacgcacgcattcatactaaaatacccacgctctcacacactaaaatacgcatacattcccgctaaaatacgcacgctctcacaaactaaaatacgcacacattcccgctaaaatactaacgctctcacacactaaaatacgcacgcgttcatactaaaatacccacgctctcacacactaaaatatacatacattcatactaaaatacccacgctctcacacactaaaatacgcccacat

SEQ ID NO: 13597 - DNA, 566 bp, Artificial Sequence
  chemically treated genomic DNA (Homo sapiens) CpG-island No: 13597
cgaattcgcgaaagaatatatcggttaaggggtaagaacgacgatacgagaattcgcgaaatgtcgacgaacgattaaaatacgatttatagtttacgttttagtaagacgtaatatatgtacgaatatagagtaataatattattgatgtcgtggatgttgtttattttgtaattcgtttggtagcgtattgattgtaatgattcgcgttgttcgttaggtagtttttgcggatcgagaatagaaggatcgttttagatagcgggatttgttttacgtagttgcgtatcgggtgagagtaggaaattggtaattattttcgtcgtagtattggtattcgcgttggtaggaatggtgacgaaatgtacgttgttaattattttttcgcgaaagttaaaattgtaattgtttgtaggtaaatcgtcgttggcgattttttgttgcgtatgcgcggggttaaaggttagcgataggcgtaatgtgtcggtttttagtagagtatttattcgcgcgggtgaaggcgggaaattttttttttcgcgttataaatattttaaatttttggt

SEQ ID NO: 13598 - DNA, 566 bp, Artificial Sequence
  chemically treated genomic DNA (Homo sapiens) CpG-island No: 13598
accaaaaatttaaaatatttataacgcgaaaaaaaaaatttcccgccttcacccgcgcgaataaatactctactaaaaaccgacacattacgcctatcgctaacctttaaccccgcgcatacgcaacaaaaaatcgccaacgacgatttacctacaaacaattacaattttaactttcgcgaaaaaataattaacaacgtacatttcgtcaccattcctaccaacgcgaataccaatactacgacgaaaataattaccaatttcctactctcacccgatacgcaactacgtaaaacaaatcccgctatctaaaacgatccttctattctcgatccgcaaaaactacctaacgaacaacgcgaatcattacaatcaatacgctaccaaacgaattacaaaataaacaacatccacgacatcaataatattattactctatattcgtacatatattacgtcttactaaaacgtaaactataaatcgtattttaatcgttcgtcgacatttcgcgaattctcgtatcgtcgttcttaccccttaaccgatatattctttcgcgaattcg

SEQ ID NO: 13599 - DNA, 566 bp, Artificial Sequence
  chemically treated genomic DNA (Homo sapiens) CpG-island No: 13599
gttaagagtttaagatatttgtggcgcgaaggaaaggatttttcgtttttattcgcgcggatggatgttttgttgaaagtcggtatattgcgtttgtcgttgatttttaatttcgcgtatgcgtagtaaaaaatcgttagcggcgatttgtttgtaagtagttatagttttggttttcgcgaggggatgattggtaacgtgtatttcgttattatttttgttaacgcgaatgttagtgttgcggcgaaggtagttgttaattttttgtttttattcgatgcgtaattgcgtaaagtagatttcgttgtttggggcgatttttttgttttcgattcgtaaaaattgtttgacgggtagcgcgaattattgtaattaatgcgttgttaggcgggttgtaggataaatagtatttacggtattagtggtattgttgttttgtgttcgtgtatgtgttgcgttttgttgaggcgtgggttatgggtcgtgttttggtcgttcgtcggtatttcgcgggttttcgtgtcgtcgtttttgttttttagtcggtgtgttttttcgcgggttcg

SEQ ID NO: 13600 - DNA, 566 bp, Artificial Sequence
  chemically treated genomic DNA (Homo sapiens) CpG-island No: 13600
cgaacccgcgaaaaaacacaccgactaaaaaacaaaaacgacgacacgaaaacccgcgaaataccgacgaacgaccaaaacacgacccataacccacgcctcaacaaaacgcaacacatacacgaacacaaaacaacaataccactaataccgtaaatactatttatcctacaacccgcctaacaacgcattaattacaataattcgcgctacccgtcaaacaatttttacgaatcgaaaacaaaaaaatcgccccaaacaacgaaatctactttacgcaattacgcatcgaataaaaacaaaaaattaacaactaccttcgccgcaacactaacattcgcgttaacaaaaataataacgaaatacacgttaccaatcatcccctcgcgaaaaccaaaactataactacttacaaacaaatcgccgctaacgattttttactacgcatacgcgaaattaaaaatcaacgacaaacgcaatataccgactttcaacaaaacatccatccgcgcgaataaaaacgaaaaatcctttccttcgcgccacaaatatcttaaactcttaac

SEQ ID NO: 13601 - DNA, 789 bp, Artificial Sequence
  chemically treated genomic DNA (Homo sapiens) CpG-island No: 13601
gcgcgcgtgacgtagcggtcgaagattggttgtggtagtataaggcggggtttttttcgggcggcgttagcgcggtcggggcggtttagtgcgagtcggggagagtcgaattcggagtagggttttattcgagcgtggattggcggtaggatgtttagttggatggggcggtaggcgggcgggcgcgaagtttggcggtcggacgcggtgtagacggtgacgggcgggttgtttcgttttatttgcgtaaggtgttgtcgttggaggaggcgtatcgtttttacgagttttattcgtttgcgttggaggacgtcgatttcgagaataagtttatgattttgttggtgggttagtatagtatcggtaagattatttttattaggtatcgttatcgtttttcgttcggttttcgtttcgtttcgttttttttacgtgtgcgtcgtagtcggtcgtttttcgtcgttgtttttttcggtcggcgcgatttcggggatttttttcggagttcggcgttcggtgttttcggtttcgtttcggttggttagtttcgcgcgttggagggtttcgcgaattcgcgttttgcgatttcgagttttttttttttgcggttcggaaggcgttgttttcgttggtttcgttcggtcgttttggcgggagggtttaagggagagagggggcgcgagttataattagtatatttttgacgagggagtgatgtttagggatggaaatggggggagaggcgtagggtattcgaatgggatagagttttagttggagagtttgttt

SEQ ID NO: 13602 - DNA, 789 bp, Artificial Sequence
  chemically treated genomic DNA (Homo sapiens) CpG-island No: 13602
aaacaaactctccaactaaaactctatcccattcgaataccctacgcctctccccccatttccatccctaaacatcactccctcgtcaaaaatatactaattataactcgcgccccctctctcccttaaaccctcccgccaaaacgaccgaacgaaaccaacgaaaacaacgccttccgaaccgcaaaaaaaaaaaactcgaaatcgcaaaacgcgaattcgcgaaaccctccaacgcgcgaaactaaccaaccgaaacgaaaccgaaaacaccgaacgccgaactccgaaaaaaatccccgaaatcgcgccgaccgaaaaaaacaacgacgaaaaacgaccgactacgacgcacacgtaaaaaaaacgaaacgaaacgaaaaccgaacgaaaaacgataacgatacctaataaaaataatcttaccgatactatactaacccaccaacaaaatcataaacttattctcgaaatcgacgtcctccaacgcaaacgaataaaactcgtaaaaacgatacgcctcctccaacgacaacaccttacgcaaataaaacgaaacaacccgcccgtcaccgtctacaccgcgtccgaccgccaaacttcgcgcccgcccgcctaccgccccatccaactaaacatcctaccgccaatccacgctcgaataaaaccctactccgaattcgactctccccgactcgcactaaaccgccccgaccgcgctaacgccgcccgaaaaaaaccccgccttatactaccacaaccaatcttcgaccgctacgtcacgcgcgc

SEQ ID NO: 13603 - DNA, 789 bp, Artificial Sequence
  chemically treated genomic DNA (Homo sapiens) CpG-island No: 13603
aaataaattttttaattaggattttgttttattcggatattttacgtttttttttttatttttatttttaggtattattttttcgttaagaatatgttgattatggttcgcgtttttttttttttttggattttttcgttagggcgatcggacgaggttagcgggagtaacgtttttcgaatcgtaaggaaggagggttcggagtcgtagggcgcgggttcgcgggattttttagcgcgcggggttggttagtcggggcggggtcgagggtatcgggcgtcgagtttcgggaggggttttcgaggtcgcgtcggtcgggaggggtagcggcgggaggcggtcgattgcggcgtatacgtggggagggcggagcggggcgggggtcgggcgaggggcggtgacggtatttgatgaaggtggttttgtcggtgttgtattggtttattagtaggattatgggtttgttttcgaagtcggcgttttttagcgtaggcgagtggaattcgtggaagcggtacgttttttttagcggtagtattttgcgtaggtagagcgaggtagttcgttcgttatcgtttgtatcgcgttcggtcgttaggtttcgcgttcgttcgtttgtcgttttatttagttgaatattttgtcgttagtttacgttcggatgggattttgtttcgggttcgatttttttcggttcgtattgagtcgtttcggtcgcgttggcgtcgttcgaggagggtttcgttttgtgttgttatagttagttttcggtcgttacgttacgcgcgt

SEQ ID NO: 13604 - DNA, 789 bp, Artificial Sequence
  chemically treated genomic DNA (Homo sapiens) CpG-island No: 13604
acgcgcgtaacgtaacgaccgaaaactaactataacaacacaaaacgaaaccctcctcgaacgacgccaacgcgaccgaaacgactcaatacgaaccgaaaaaaatcgaacccgaaacaaaatcccatccgaacgtaaactaacgacaaaatattcaactaaataaaacgacaaacgaacgaacgcgaaacctaacgaccgaacgcgatacaaacgataacgaacgaactacctcgctctacctacgcaaaatactaccgctaaaaaaaacgtaccgcttccacgaattccactcgcctacgctaaaaaacgccgacttcgaaaacaaacccataatcctactaataaaccaatacaacaccgacaaaaccaccttcatcaaataccgtcaccgcccctcgcccgacccccgccccgctccgccctccccacgtatacgccgcaatcgaccgcctcccgccgctacccctcccgaccgacgcgacctcgaaaacccctcccgaaactcgacgcccgataccctcgaccccgccccgactaaccaaccccgcgcgctaaaaaatcccgcgaacccgcgccctacgactccgaaccctccttccttacgattcgaaaaacgttactcccgctaacctcgtccgatcgccctaacgaaaaaatccaaaaaaaaaaaaaaacgcgaaccataatcaacatattcttaacgaaaaaataatacctaaaaataaaaataaaaaaaaaaacgtaaaatatccgaataaaacaaaatcctaattaaaaaatttattt

SEQ ID NO: 13605 - DNA, 864 bp, Artificial Sequence
  chemically treated genomic DNA (Homo sapiens) CpG-island No: 13605
tcgttttcggttgaggcggaattttgtgaggagtttgtaatttcgcgtaatattattcgtgaggtgtttcgttcgttgatggcgaagcggttgattgaaatgaaacgttatcgcggggcgtttgtggtatcgcgtattagtggaattatttcgatattgacgtattgtaatgggtgttggaaaatgattacgatttacggtttattagtgttatgagcgaagtgcgaaatttggtggaatcggcgattgttcgttgggtagtagagcgcgcgatttttagcgatttggcgtagattgaatcggcgttgaacgagatgattgttaataattaggatcgcgaagcgtttaacgaagcggatattcgttattacgaggcggtgttgtagtcggtgtataattcggtgttatagtaatttagtattgcgattagttcgttgtagcggcgggtttttgaacgaatttggatgggcgatgaggttaattatgtcgtaaacgttttaggaatataaggcgttgttcgatgcgatacgatattaggacggcgatgcggtagagtaggcggcgtttattatgatcgttagttcgatacgaaggttaaaggaaattatatgatagttcgttatatcgtaattgattggggatcgattaatttgcgcgtttggttttattagggcgattattgtttggagagtaggtaattagaagtaggcgttacgcgtttgaacggaaaattttcggttgcggtgttagtagaagttacgatcgattggcgtgaagagaaaacgttagtggtaatggtaggaatggttggtagtaacgtcggttggaaagttgtatcgtattatttgtttttgtttgtttttt

SEQ ID NO: 13606 - DNA, 864 bp, Artificial Sequence
  chemically treated genomic DNA (Homo sapiens) CpG-island No: 13606
aaaaaacaaacaaaaacaaataatacgatacaactttccaaccgacgttactaccaaccattcctaccattaccactaacgttttctcttcacgccaatcgatcgtaacttctactaacaccgcaaccgaaaattttccgttcaaacgcgtaacgcctacttctaattacctactctccaaacaataatcgccctaataaaaccaaacgcgcaaattaatcgatccccaatcaattacgatataacgaactatcatataatttcctttaaccttcgtatcgaactaacgatcataataaacgccgcctactctaccgcatcgccgtcctaatatcgtatcgcatcgaacaacgccttatattcctaaaacgtttacgacataattaacctcatcgcccatccaaattcgttcaaaaacccgccgctacaacgaactaatcgcaatactaaattactataacaccgaattatacaccgactacaacaccgcctcgtaataacgaatatccgcttcgttaaacgcttcgcgatcctaattattaacaatcatctcgttcaacgccgattcaatctacgccaaatcgctaaaaatcgcgcgctctactacccaacgaacaatcgccgattccaccaaatttcgcacttcgctcataacactaataaaccgtaaatcgtaatcattttccaacacccattacaatacgtcaatatcgaaataattccactaatacgcgataccacaaacgccccgcgataacgtttcatttcaatcaaccgcttcgccatcaacgaacgaaacacctcacgaataatattacgcgaaattacaaactcctcacaaaattccgcctcaaccgaaaacga

SEQ ID NO: 13607 - DNA, 864 bp, Artificial Sequence
  chemically treated genomic DNA (Homo sapiens) CpG-island No: 13607
gaaaaataggtaggaatagataatacggtgtaattttttagtcgacgttgttgttaattatttttgttattattattggcgttttttttttacgttagtcggtcgtgatttttgttaatatcgtagtcggagatttttcgtttaggcgcgtgacgtttgtttttgattgtttgttttttaggtagtggtcgttttgataaagttaggcgcgtagattggtcgatttttagttaattgcgatgtagcgagttgttatgtgattttttttaattttcgtgtcgagttggcgattatggtaagcgtcgtttgttttgtcgtatcgtcgttttgatgtcgtatcgtatcgaatagcgttttatgtttttggagcgtttgcggtatggttggttttatcgtttatttaggttcgtttaaaaattcgtcgttgtagcgaattgatcgtaatgttaagttgttgtaatatcgggttatgtatcgattgtagtatcgtttcgtggtagcgaatattcgtttcgttaaacgtttcgcggttttgattgttggtaattatttcgtttagcgtcgatttaatttgcgttagatcgttggaagtcgcgcgttttgttgtttaacgggtaatcgtcggttttattagatttcgtatttcgtttatggtattgataagtcgtgggtcgtagttattttttagtatttattgtagtacgttagtgtcgaggtaattttattggtacgcggtgttataaacgtttcgcgataacgttttattttaattagtcgtttcgttattagcgaacggaatattttacggatgatgttgcgcgaggttgtaaattttttatagagtttcgttttagtcggaagcgg

SEQ ID NO: 13608 - DNA, 864 bp, Artificial Sequence
  chemically treated genomic DNA (Homo sapiens) CpG-island No: 13608
ccgcttccgactaaaacgaaactctataaaaaatttacaacctcgcgcaacatcatccgtaaaatattccgttcgctaataacgaaacgactaattaaaataaaacgttatcgcgaaacgtttataacaccgcgtaccaataaaattacctcgacactaacgtactacaataaatactaaaaaataactacgacccacgacttatcaataccataaacgaaatacgaaatctaataaaaccgacgattacccgttaaacaacaaaacgcgcgacttccaacgatctaacgcaaattaaatcgacgctaaacgaaataattaccaacaatcaaaaccgcgaaacgtttaacgaaacgaatattcgctaccacgaaacgatactacaatcgatacataacccgatattacaacaacttaacattacgatcaattcgctacaacgacgaatttttaaacgaacctaaataaacgataaaaccaaccataccgcaaacgctccaaaaacataaaacgctattcgatacgatacgacatcaaaacgacgatacgacaaaacaaacgacgcttaccataatcgccaactcgacacgaaaattaaaaaaaatcacataacaactcgctacatcgcaattaactaaaaatcgaccaatctacgcgcctaactttatcaaaacgaccactacctaaaaaacaaacaatcaaaaacaaacgtcacgcgcctaaacgaaaaatctccgactacgatattaacaaaaatcacgaccgactaacgtaaaaaaaaaacgccaataataataacaaaaataattaacaacaacgtcgactaaaaaattacaccgtattatctattcctacctatttttc

SEQ ID NO: 13609 - DNA, 728 bp, Artificial Sequence
  chemically treated genomic DNA (Homo sapiens) CpG-island No: 13609
  misc_feature (351)..(351): n is either a, c, g or t
gcgtaaagttgcgtaattcgatgttaattacggcgacgttttttagtaatgacggtgtgtgttgttgtgcggtaggcgagagcggatggaattaacgttgtcgttagtaaggtggttttcggtagcgaatttacgatcgtaattttcgtattttttagcgtggcgatttgttgcgagcggtattgcgggttacgtttagtgtttgttatcgtggtaatggtatatagtggttgattatttaaacgcgcggtataggttttttgttaggcgtttattagcgaggcggtaggatcggcggtcgtatcgaagttaattacgatattaagtagtaatacgcgtatttgcggttangcgtcgagatcggtaattaattggttgcgtaaggttgggtcgattatcggatggggacgttcgacggtgtagaaattatcgtcgaggttaataatttggtggttatcggcgtttagtattatgttatgttgatgggtatcgtcggtttttacgttaaggtgttcggtaagtaatttcgtcgtttcggtagttagcgtatcgatcggtatataaatcgtaaataaattcgttgttgataggcgttattgcgttacgtcgcgtcgtgacgcgtgaaagtaggtaagttaggcgtgcggttttatttagcgaagtgttggtatttgttttaaaattatttgtcgaagttgtgcgtttgaaaattgttaatgttatgaaag

SEQ ID NO: 13610 - DNA, 728 bp, Artificial Sequence
  chemically treated genomic DNA (Homo sapiens) CpG-island No: 13610
  misc_feature (378)..(378): n is either a, c, g or t
ctttcataacattaacaattttcaaacgcacaacttcgacaaataattttaaaacaaataccaacacttcgctaaataaaaccgcacgcctaacttacctactttcacgcgtcacgacgcgacgtaacgcaataacgcctatcaacaacgaatttatttacgatttatataccgatcgatacgctaactaccgaaacgacgaaattacttaccgaacaccttaacgtaaaaaccgacgatacccatcaacataacataatactaaacgccgataaccaccaaattattaacctcgacgataatttctacaccgtcgaacgtccccatccgataatcgacccaaccttacgcaaccaattaattaccgatctcgacgcntaaccgcaaatacgcgtattactacttaatatcgtaattaacttcgatacgaccgccgatcctaccgcctcgctaataaacgcctaacaaaaaacctataccgcgcgtttaaataatcaaccactatataccattaccacgataacaaacactaaacgtaacccgcaataccgctcgcaacaaatcgccacgctaaaaaatacgaaaattacgatcgtaaattcgctaccgaaaaccaccttactaacgacaacgttaattccatccgctctcgcctaccgcacaacaacacacaccgtcattactaaaaaacgtcgccgtaattaacatcgaattacgcaactttacgc

SEQ ID NO: 13611 - DNA, 728 bp, Artificial Sequence
  chemically treated genomic DNA (Homo sapiens) CpG-island No: 13611
  misc_feature (378)..(378): n is either a, c, g or t
tttttatggtattaataatttttagacgtatagtttcggtaggtggttttgaaataaatgttagtatttcgttggatgaggtcgtacgtttggtttgtttgtttttacgcgttacggcgcgacgtaacgtaatagcgtttgttagtagcggatttatttgcggtttgtatatcggtcggtacgttggttgtcgaagcggcgggattatttgtcggatattttggcgtggaagtcgacgatatttattaatatggtatgatgttggacgtcgatagttattagattattgatttcggcgatgatttttatatcgtcgggcgtttttattcgatgatcgatttaattttacgtaattagttaattgtcgatttcggcgtntaatcgtaagtgcgcgtgttgttgtttgatgtcgtgattggtttcggtgcgatcgtcgattttgtcgtttcgttggtgagcgtttggtaaaaagtttgtgtcgcgcgtttagataattaattattgtatgttattgttacggtgataggtattgaacgtgattcgtaatgtcgttcgtagtaaatcgttacgttggaagatgcggggattgcggtcgtgagttcgttatcggaagttattttgttggcggtagcgttaattttattcgttttcgtttgtcgtatagtaatatatatcgttattattggaaaacgtcgtcgtgattaatatcggattacgtagttttgcgt

SEQ ID NO: 13612 - DNA, 728 bp, Artificial Sequence
  chemically treated genomic DNA (Homo sapiens) CpG-island No: 13612
  misc_feature (351)..(351): n is either a, c, g or t
acgcaaaactacgtaatccgatattaatcacgacgacgttttccaataataacgatatatattactatacgacaaacgaaaacgaataaaattaacgctaccgccaacaaaataacttccgataacgaactcacgaccgcaatccccgcatcttccaacgtaacgatttactacgaacgacattacgaatcacgttcaatacctatcaccgtaacaataacatacaataattaattatctaaacgcgcgacacaaactttttaccaaacgctcaccaacgaaacgacaaaatcgacgatcgcaccgaaaccaatcacgacatcaaacaacaacacgcgcacttacgattanacgccgaaatcgacaattaactaattacgtaaaattaaatcgatcatcgaataaaaacgcccgacgatataaaaatcatcgccgaaatcaataatctaataactatcgacgtccaacatcataccatattaataaatatcgtcgacttccacgccaaaatatccgacaaataatcccgccgcttcgacaaccaacgtaccgaccgatatacaaaccgcaaataaatccgctactaacaaacgctattacgttacgtcgcgccgtaacgcgtaaaaacaaacaaaccaaacgtacgacctcatccaacgaaatactaacatttatttcaaaaccacctaccgaaactatacgtctaaaaattattaataccataaaaa

SEQ ID NO: 13613 - DNA, 1009 bp, Artificial Sequence
  chemically treated genomic DNA (Homo sapiens) CpG-island No: 13613
  misc_feature (940)..(940): n is either a, c, g or t
tcgttgcgggaattgatgcgcgatattattgagcggggttatgagggttattgtacggtggagttggtgacgatgtatatgaacgagtttagattttatgttcgttaggcgttggaacgttttcgcgcgttgttgtcggaggatgagagatgaaaattttggcgataatcggcgataattgcgtcgatatttattcgtaattgaataaagcgttttttggcggtaatgcggttaatgtggcggtgtattgtattcgttacggtatatagtcgggatgtattatttgggtgggtgacgatgattacggtataaagttgaagtaggatttcgttcgtatgggcgtcgatattagttatgtttatacgaaatacggcgttatcgtataaatttaggtggaattgtacgataatgatcgcgtttttggcgattatatcgaaggcgtgatggtcgaattttgttttgagtgaagaggattacgtttggttggcgtagtatgatattgtgtacgcggtaatttggggatatgcggaagacgtatttttatagttgtacgttgcgggtaaatttatcgttttcgattttttcgataagtgggatagttcgttttggtagatattggtgtcgtatttcgattttgtttttgttttcgtatcgtaagaagacgaaacgttgcgtttgaagatgaaagcgattgttgttcgtggcgtaggaatagtgattgttacgttgggtgaaaacggtagtattgtttgggatggcgcgtagttttggcgttaggtttttgaatcggtgacggttatcgatattatgggtgtcggagattcgtttattgtcggatttttttgcggttggtttgcggggatgatattatcgtaggcgatagcgtagggaacggcgtgcgcggcgaaaattatttagtattacggtgtttggtaggtantacgttggcgtgagtatttttacgttaacgtgttgttatttgtcggaaaacgattttataattcgagta

SEQ ID NO: 13614 - DNA, 1009 bp, Artificial Sequence
  chemically treated genomic DNA (Homo sapiens) CpG-island No: 13614
  misc_feature (70)..(70): n is either a, c, g or t
tactcgaattataaaatcgttttccgacaaataacaacacgttaacgtaaaaatactcacgccaacgtantacctaccaaacaccgtaatactaaataattttcgccgcgcacgccgttccctacgctatcgcctacgataatatcatccccgcaaaccaaccgcaaaaaaatccgacaataaacgaatctccgacacccataatatcgataaccgtcaccgattcaaaaacctaacgccaaaactacgcgccatcccaaacaatactaccgttttcacccaacgtaacaatcactattcctacgccacgaacaacaatcgctttcatcttcaaacgcaacgtttcgtcttcttacgatacgaaaacaaaaacaaaatcgaaatacgacaccaatatctaccaaaacgaactatcccacttatcgaaaaaatcgaaaacgataaatttacccgcaacgtacaactataaaaatacgtcttccgcatatccccaaattaccgcgtacacaatatcatactacgccaaccaaacgtaatcctcttcactcaaaacaaaattcgaccatcacgccttcgatataatcgccaaaaacgcgatcattatcgtacaattccacctaaatttatacgataacgccgtatttcgtataaacataactaatatcgacgcccatacgaacgaaatcctacttcaactttataccgtaatcatcgtcacccacccaaataatacatcccgactatataccgtaacgaatacaatacaccgccacattaaccgcattaccgccaaaaaacgctttattcaattacgaataaatatcgacgcaattatcgccgattatcgccaaaattttcatctctcatcctccgacaacaacgcgcgaaaacgttccaacgcctaacgaacataaaatctaaactcgttcatatacatcgtcaccaactccaccgtacaataaccctcataaccccgctcaataatatcgcgcatcaattcccgcaacga

SEQ ID NO: 13615 - DNA, 1009 bp, Artificial Sequence
  chemically treated genomic DNA (Homo sapiens) CpG-island No: 13615
  misc_feature (70)..(70): n is either a, c, g or t
tattcggattatagggtcgtttttcggtaagtaatagtacgttggcgtgaagatgtttacgttaacgtantatttattaggtatcgtggtattgaatggttttcgtcgcgtacgtcgttttttgcgttatcgtttgcggtaatgttattttcgtagattagtcgtaaaggaattcggtaatgaacgaattttcggtatttatggtgtcgataatcgttatcggtttaggagtttgacgttagaattgcgcgttattttaggtaatgttgtcgtttttatttagcgtgataattattgtttttgcgttacgggtaataatcgtttttatttttagacgtagcgtttcgtttttttgcggtgcggaggtaaaggtaaaatcgagatgcggtattagtgtttgttagagcgggttgttttatttgtcggagaagtcgaaagcggtaagtttgttcgtagcgtgtagttgtgggaatgcgtttttcgtatgtttttagattgtcgcgtgtataatgttatattgcgttagttaggcgtaattttttttatttagggtaaaattcggttattacgttttcggtgtagtcgttaaaaacgcgattattgtcgtgtagttttatttgagtttgtgcggtaacgtcgtgtttcgtatggatatggttgatatcgacgtttatgcgggcgagattttgttttagttttgtgtcgtagttatcgttatttatttaggtaatgtatttcggttgtatgtcgtagcgagtgtagtatatcgttatattgatcgtattatcgttagaaaacgttttatttagttgcgggtagatatcgacgtagttatcgtcgattgtcgttagggtttttattttttatttttcggtagtagcgcgcgaaagcgttttagcgtttggcgggtatagagtttgggttcgtttatatatatcgttattagttttatcgtatagtaatttttatagtttcgtttaataatatcgcgtattagttttcgtagcgg

SEQ ID NO: 13616 - DNA, 1009 bp, Artificial Sequence
  chemically treated genomic DNA (Homo sapiens) CpG-island No: 13616
  misc_feature (940)..(940): n is either a, c, g or t
ccgctacgaaaactaatacgcgatattattaaacgaaactataaaaattactatacgataaaactaataacgatatatataaacgaacccaaactctatacccgccaaacgctaaaacgctttcgcgcgctactaccgaaaaataaaaaataaaaaccctaacgacaatcgacgataactacgtcgatatctacccgcaactaaataaaacgttttctaacgataatacgatcaatataacgatatactacactcgctacgacatacaaccgaaatacattacctaaataaataacgataactacgacacaaaactaaaacaaaatctcgcccgcataaacgtcgatatcaaccatatccatacgaaacacgacgttaccgcacaaactcaaataaaactacacgacaataatcgcgtttttaacgactacaccgaaaacgtaataaccgaattttaccctaaataaaaaaaattacgcctaactaacgcaatataacattatacacgcgacaatctaaaaacatacgaaaaacgcattcccacaactacacgctacgaacaaacttaccgctttcgacttctccgacaaataaaacaacccgctctaacaaacactaataccgcatctcgattttacctttacctccgcaccgcaaaaaaacgaaacgctacgtctaaaaataaaaacgattattacccgtaacgcaaaaacaataattatcacgctaaataaaaacgacaacattacctaaaataacgcgcaattctaacgtcaaactcctaaaccgataacgattatcgacaccataaataccgaaaattcgttcattaccgaattcctttacgactaatctacgaaaataacattaccgcaaacgataacgcaaaaaacgacgtacgcgacgaaaaccattcaataccacgatacctaataaatantacgttaacgtaaacatcttcacgccaacgtactattacttaccgaaaaacgaccctataatccgaata

SEQ ID NO: 13617 - DNA, 722 bp, Artificial Sequence
  chemically treated genomic DNA (Homo sapiens) CpG-island No: 13617
  misc_feature (139)..(139): n is either a, c, g or t
  misc_feature (196)..(196): n is either a, c, g or t
  misc_feature (347)..(347): n is either a, c, g or t
  misc_feature (359)..(360): n is either a, c, g or t
  misc_feature (593)..(593): n is either a, c, g or t
  misc_feature (605)..(605): n is either a, c, g or t
  misc_feature (647)..(647): n is either a, c, g or t
  misc_feature (656)..(656): n is either a, c, g or t
  misc_feature (669)..(669): n is either a, c, g or t
  misc_feature (677)..(678): n is either a, c, g or t
tggcgttggttttttggtatggaaaaaagtatcgggataatacgtttagtatgaaacgtttttttaacggtcgcgggttttggtgtttgggtggtaaagcggcgaaaaattatcgtgagaaatcggtcgatgtcgtcgngtttacgatgaacgtggcggtattcgatgaacgatattgagataagagggatttttngacgttgtttgggtgataaacgtattgaggggtttgtttggtttaaatttattcgcggtttaacgttaaaaataaaggggatttgttagattgagcgtgttgttagcgagttcgggtattttatgcgtttttatgttgtttgttcgtattngtggtgaacganngtagtattttaaatttcggcgataaagagatttcgttcgggttgaaatggatatcgggcgaattttttaggcgttttttatttcgtgtgtgatatataatgtttgcgttattaagtagtaggagttggattttattgaagttcgttatatttgcgatattatcgggatttggacgcgcgacggtttattttggtttttattaataggtatcgaaatcgattcgttagatagtngtgacgttttantatcgtggacggcgatacgagtcgcggtttattatcgtaggnggttttagnagttcgggttaanagggacgnntggttataaaacgaaaggggatataggaaagcgtaaaattttcg

SEQ ID NO: 13618 - DNA, 722 bp, Artificial Sequence
  chemically treated genomic DNA (Homo sapiens) CpG-island No: 13618
  misc_feature (45)..(46): n is either a, c, g or t
  misc_feature (54)..(54): n is either a, c, g or t
  misc_feature (67)..(67): n is either a, c, g or t
  misc_feature (76)..(76): n is either a, c, g or t
  misc_feature (118)..(118): n is either a, c, g or t
  misc_feature (130)..(130): n is either a, c, g or t
  misc_feature (363)..(364): n is either a, c, g or t
  misc_feature (376)..(376): n is either a, c, g or t
  misc_feature (527)..(527): n is either a, c, g or t
  misc_feature (584)..(584): n is either a, c, g or t
cgaaaattttacgctttcctatatcccctttcgttttataaccanncgtccctnttaacccgaactnctaaaaccncctacgataataaaccgcgactcgtatcgccgtccacgatantaaaacgtcacnactatctaacgaatcgatttcgatacctattaataaaaaccaaaataaaccgtcgcgcgtccaaatcccgataatatcgcaaatataacgaacttcaataaaatccaactcctactacttaataacgcaaacattatatatcacacacgaaataaaaaacgcctaaaaaattcgcccgatatccatttcaacccgaacgaaatctctttatcgccgaaatttaaaatactacnntcgttcaccacnaatacgaacaaacaacataaaaacgcataaaatacccgaactcgctaacaacacgctcaatctaacaaatcccctttatttttaacgttaaaccgcgaataaatttaaaccaaacaaacccctcaatacgtttatcacccaaacaacgtcnaaaaatccctcttatctcaatatcgttcatcgaataccgccacgttcatcgtaaacncgacgacatcgaccgatttctcacgataatttttcgccgctttaccacccaaacaccaaaacccgcgaccgttaaaaaaacgtttcatactaaacgtattatcccgatacttttttccataccaaaaaaccaacgcca

SEQ ID NO: 13619 - DNA, 722 bp, Artificial Sequence
  chemically treated genomic DNA (Homo sapiens) CpG-island No: 13619
  misc_feature (45)..(46): n is either a, c, g or t
  misc_feature (54)..(54): n is either a, c, g or t
  misc_feature (67)..(67): n is either a, c, g or t
  misc_feature (76)..(76): n is either a, c, g or t
  misc_feature (118)..(118): n is either a, c, g or t
  misc_feature (130)..(130): n is either a, c, g or t
  misc_feature (363)..(364): n is either a, c, g or t
  misc_feature (376)..(376): n is either a, c, g or t
  misc_feature (527)..(527): n is either a, c, g or t
  misc_feature (584)..(584): n is either a, c, g or t
cgaaggttttacgtttttttgtattttttttcgttttgtagttanncgtttttnttaattcggattnttggaattntttacggtggtaaatcgcggttcgtatcgtcgtttacgatgntgaaacgttatngttgtttggcgggtcgatttcggtgtttgttgatgaaaattaggataaatcgtcgcgcgtttagatttcggtggtgtcgtagatgtaacgagttttagtgaaatttagtttttgttgtttaatgacgtaggtattatgtattatatacggggtaaaagacgtttggagggttcgttcggtgtttattttagttcgaacggggtttttttgtcgtcgaagtttaaggtattgtnntcgtttattatnagtgcggataggtaatatgaaaacgtatgaaatgttcggattcgttggtagtacgtttaatttggtaggttttttttgtttttggcgttgagtcgcgaatagatttgggttagatagattttttaatacgtttattatttaggtaacgttnggggattttttttgttttaatatcgtttatcgaatgtcgttacgtttatcgtgaatncggcgatatcgatcgattttttacgatagtttttcgtcgttttattatttagatattagaattcgcgatcgttggagaagcgttttatattgagcgtattgtttcggtgtttttttttatattagggggttagcgtta

SEQ ID NO: 13620 - DNA, 722 bp, Artificial Sequence
  chemically treated genomic DNA (Homo sapiens) CpG-island No: 13620
  misc_feature (139)..(139): n is either a, c, g or t
  misc_feature (196)..(196): n is either a, c, g or t
  misc_feature (347)..(347): n is either a, c, g or t
  misc_feature (359)..(360): n is either a, c, g or t
  misc_feature (593)..(593): n is either a, c, g or t
  misc_feature (605)..(605): n is either a, c, g or t
  misc_feature (647)..(647): n is either a, c, g or t
  misc_feature (656)..(656): n is either a, c, g or t
  misc_feature (669)..(669): n is either a, c, g or t
  misc_feature (677)..(678): n is either a, c, g or t
taacgctaaccccctaatataaaaaaaaacaccgaaacaatacgctcaatataaaacgcttctccaacgatcgcgaattctaatatctaaataataaaacgacgaaaaactatcgtaaaaaatcgatcgatatcgccgnattcacgataaacgtaacgacattcgataaacgatattaaaacaaaaaaaatccccnaacgttacctaaataataaacgtattaaaaaatctatctaacccaaatctattcgcgactcaacgccaaaaacaaaaaaaacctaccaaattaaacgtactaccaacgaatccgaacatttcatacgttttcatattacctatccgcactnataataaacgannacaataccttaaacttcgacgacaaaaaaaccccgttcgaactaaaataaacaccgaacgaaccctccaaacgtcttttaccccgtatataatacataatacctacgtcattaaacaacaaaaactaaatttcactaaaactcgttacatctacgacaccaccgaaatctaaacgcgcgacgatttatcctaattttcatcaacaaacaccgaaatcgacccgccaaacaacnataacgtttcancatcgtaaacgacgatacgaaccgcgatttaccaccgtaaanaattccaanaatccgaattaanaaaaacgnntaactacaaaacgaaaaaaaatacaaaaaaacgtaaaaccttcg

SEQ ID NO: 13621 - DNA, 568 bp, Artificial Sequence
  chemically treated genomic DNA (Homo sapiens) CpG-island No: 13621
tacggggtagttttatttttagttgttttgttggattcggtattttattcgacgagttgatttcgattagattttcgtcgttatgttgtatgtgtcgtagttgttgttgtacgttagtcgttcggttcgttgggatagcgattacgtagtgttgttggatgatgaaatttaggtaattgttagtgagattgtgcgttacgatttgtttgatcgggtgtatatcggttttgattttttcgatgtttttattaatcgtattgtcgcgtgggttattggtatacgtaatatgaaaaaagttttgttgcgtgcgttgttggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaaataatgtcggatgcggcgcgagcgttttattcggtttataatttttatatattt

SEQ ID NO: 13622 - DNA, 568 bp, Artificial Sequence
  chemically treated genomic DNA (Homo sapiens) CpG-island No: 13622
aaatatataaaaattataaaccgaataaaacgctcgcgccgcatccgacattatttacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattccaacaacgcacgcaacaaaacttttttcatattacgtataccaataacccacgcgacaatacgattaataaaaacatcgaaaaaatcaaaaccgatatacacccgatcaaacaaatcgtaacgcacaatctcactaacaattacctaaatttcatcatccaacaacactacgtaatcgctatcccaacgaaccgaacgactaacgtacaacaacaactacgacacatacaacataacgacgaaaatctaatcgaaatcaactcgtcgaataaaataccgaatccaacaaaacaactaaaaataaaactaccccgta

SEQ ID NO: 13623 - DNA, 568 bp, Artificial Sequence
  chemically treated genomic DNA (Homo sapiens) CpG-island No: 13623
aaatatgtgaaaattgtaggtcggataaggcgttcgcgtcgtattcggtattgtttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggttttagtaacgtacgtagtagggttttttttatattgcgtgtattaatgatttacgcggtaatgcggttgatagaggtatcgaagaagttaaggtcgatatgtattcggttaaatagatcgtgacgtataattttattggtaattgtttgggttttattatttagtagtattacgtgatcgttgttttagcgaatcggacggttgacgtgtagtagtaattgcggtatatatagtatggcggcggaaatttggtcggaattaattcgtcgggtgaaatgtcgggtttagtaaggtagttgggggtggggttatttcgta

SEQ ID NO: 13624 - DNA, 568 bp, Artificial Sequence
  chemically treated genomic DNA (Homo sapiens) CpG-island No: 13624
tacgaaataaccccacccccaactaccttactaaacccgacatttcacccgacgaattaattccgaccaaatttccgccgccatactatatataccgcaattactactacacgtcaaccgtccgattcgctaaaacaacgatcacgtaatactactaaataataaaacccaaacaattaccaataaaattatacgtcacgatctatttaaccgaatacatatcgaccttaacttcttcgatacctctatcaaccgcattaccgcgtaaatcattaatacacgcaatataaaaaaaaccctactacgtacgttactaaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataaacaataccgaatacgacgcgaacgccttatccgacctacaattttcacatattt

SEQ ID NO: 13625 - DNA, 588 bp, Artificial Sequence
  chemically treated genomic DNA (Homo sapiens) CpG-island No: 13625
tgcgtgtcgcgtaaaattattatcggcggtaatttggagaatggcggtacggtttaaatgaatagcgaaggggggaaatcggggaatgtattgatcgttaacggtaattatatcggaaataatggtttgatgacgtttaacgcgacgttgggcggcgatattcgtttatcgatagatgaacgtgaaaggcgatatttaaggggaatattcgcgttcgggttgataatattggcggcgtcggtgtataaacggttacggtattgaatttattgaggttggcggtaattttgtaggtatttcggttgattagcggattgtcgatgttgggtttagtttataggttggtacgggacgggaatgaggagaaaatggtatttgatagtaatggggagggtatgttcgggatagtatcgatttattaagaagtttttggagtggattcgaagcgtataaagtaacggtcgaggcggaggttatattttattatggcggttcgacgcgggcgcgtaataacggtggggagcgcgattatgattgcgtatagggggtacgaatagatgcgcgtggggataacgcggggtgcggttt

SEQ ID NO: 13626 - DNA, 588 bp, Artificial Sequence
  chemically treated genomic DNA (Homo sapiens) CpG-island No: 13626
aaaccgcaccccgcgttatccccacgcgcatctattcgtaccccctatacgcaatcataatcgcgctccccaccgttattacgcgcccgcgtcgaaccgccataataaaatataacctccgcctcgaccgttactttatacgcttcgaatccactccaaaaacttcttaataaatcgatactatcccgaacataccctccccattactatcaaataccattttctcctcattcccgtcccgtaccaacctataaactaaacccaacatcgacaatccgctaatcaaccgaaatacctacaaaattaccgccaacctcaataaattcaataccgtaaccgtttatacaccgacgccgccaatattatcaacccgaacgcgaatattccccttaaatatcgcctttcacgttcatctatcgataaacgaatatcgccgcccaacgtcgcgttaaacgtcatcaaaccattatttccgatataattaccgttaacgatcaatacattccccgatttccccccttcgctattcatttaaaccgtaccgccattctccaaattaccgccgataataattttacgcgacacgca

SEQ ID NO: 13627 - DNA, 588 bp, Artificial Sequence
  chemically treated genomic DNA (Homo sapiens) CpG-island No: 13627
gggtcgtatttcgcgttgtttttacgcgtatttattcgtgttttttgtacgtagttatgatcgcgttttttatcgttgttacgcgttcgcgtcgggtcgttatggtggagtatggttttcgtttcggtcgttattttgtgcgtttcggatttattttagggattttttgatggatcggtgttatttcgggtatattttttttattattgttagatattattttttttttattttcgtttcgtattagtttgtaaattaagtttagtatcgatagttcgttgattagtcgaagtatttgtagaattatcgttaattttaatgagtttaatatcgtgatcgtttgtgtatcgacgtcgttaatgttattaattcgaacgcgagtgttttttttgggtatcgttttttacgtttatttatcggtgggcgaatatcgtcgtttagcgtcgcgttgaacgttattaggttattgttttcggtatagttgtcgttaacggttagtatatttttcggtttttttttttcgttatttatttgaatcgtgtcgttattttttaggttgtcgtcgatagtggttttacgcgatacgta

SEQ ID NO: 13628 - DNA, 588 bp, Artificial Sequence
  chemically treated genomic DNA (Homo sapiens) CpG-island No: 13628
tacgtatcgcgtaaaaccactatcgacgacaacctaaaaaataacgacacgattcaaataaataacgaaaaaaaaaaaccgaaaaatatactaaccgttaacgacaactataccgaaaacaataacctaataacgttcaacgcgacgctaaacgacgatattcgcccaccgataaataaacgtaaaaaacgatacccaaaaaaaacactcgcgttcgaattaataacattaacgacgtcgatacacaaacgatcacgatattaaactcattaaaattaacgataattctacaaatacttcgactaatcaacgaactatcgatactaaacttaatttacaaactaatacgaaacgaaaataaaaaaaaaataatatctaacaataataaaaaaaatatacccgaaataacaccgatccatcaaaaaatccctaaaataaatccgaaacgcacaaaataacgaccgaaacgaaaaccatactccaccataacgacccgacgcgaacgcgtaacaacgataaaaaacgcgatcataactacgtacaaaaaacacgaataaatacgcgtaaaaacaacgcgaaatacgaccc

SEQ ID NO: 13629 - DNA, 643 bp, Artificial Sequence
  chemically treated genomic DNA (Homo sapiens) CpG-island No: 13629
  misc_feature (595)..(595): n is either a, c, g or t
  misc_feature (602)..(603): n is either a, c, g or t
  misc_feature (606)..(606): n is either a, c, g or t
  misc_feature (631)..(631): n is either a, c, g or t
cgtttcgtttgtcgtcgttatagttgatcgtaattgttttttcgtttcgttttatagtgttttaaagtttggtgatatggttaaagtgagaattgtcgttgtatttcgttttttagacggatttgtagtttatcgagattcgtttcgtagcgttcgatttttttttgttgacgtagtgcggtttgtattaggtttaggtgattattggtcgtttgataattcgtttttagatcgttttcggtatcgttgtgttttgttagtttacgcgttatatcgacgtgtttgtattgtttagtcgttagttgttgcgcgaagtattagttcgcgacgaaattttagggttttgtcgagatggatacggcgttcgttggcgtgacgtatgtagttcgtcgttacgtagttggtggtttcgttgattagatgtttaaataggtcgcggttcgattgggtgatacgaatcgtttttagcgttatacggtttttacgtagcgtcgtttttatgttttggaacgttttacgtacgtcgttgttttttggtaataggtagtcgcgtagagaacgggtaatggtattggagtcgtattcgttgttgttnggaattnngtngacgcggatgagattaatgttgtantattaggaaatt

SEQ ID NO: 13630 - DNA, 643 bp, Artificial Sequence
  chemically treated genomic DNA (Homo sapiens) CpG-island No: 13630
  misc_feature (13)..(13): n is either a, c, g or t
  misc_feature (38)..(38): n is either a, c, g or t
  misc_feature (41)..(42): n is either a, c, g or t
  misc_feature (49)..(49): n is either a, c, g or t
aatttcctaatantacaacattaatctcatccgcgtcnacnnaattccnaacaacaacgaatacgactccaataccattacccgttctctacgcgactacctattaccaaaaaacaacgacgtacgtaaaacgttccaaaacataaaaacgacgctacgtaaaaaccgtataacgctaaaaacgattcgtatcacccaatcgaaccgcgacctatttaaacatctaatcaacgaaaccaccaactacgtaacgacgaactacatacgtcacgccaacgaacgccgtatccatctcgacaaaaccctaaaatttcgtcgcgaactaatacttcgcgcaacaactaacgactaaacaatacaaacacgtcgatataacgcgtaaactaacaaaacacaacgataccgaaaacgatctaaaaacgaattatcaaacgaccaataatcacctaaacctaatacaaaccgcactacgtcaacaaaaaaaaatcgaacgctacgaaacgaatctcgataaactacaaatccgtctaaaaaacgaaatacaacgacaattctcactttaaccatatcaccaaactttaaaacactataaaacgaaacgaaaaaacaattacgatcaactataacgacgacaaacgaaacg

SEQ ID NO: 13631 - DNA, 643 bp, Artificial Sequence
  chemically treated genomic DNA (Homo sapiens) CpG-island No: 13631
  misc_feature (13)..(13): n is either a, c, g or t
  misc_feature (38)..(38): n is either a, c, g or t
  misc_feature (41)..(42): n is either a, c, g or t
  misc_feature (49)..(49): n is either a, c, g or t
ggttttttggtgntgtaatattggttttattcgcgttnatnnaattttnagtaataacgagtacgattttagtgttattattcgttttttgcgcgattatttgttgttagaaaatagcggcgtgcgtaaagcgttttaggatatggaagcggcgttgcgtgaaaatcgtatgacgttggaagcgattcgtgttatttagtcggatcgcgatttgtttaagtatttgattagcgaagttattaattacgtggcggcggattatatgcgttacgttaacgagcgtcgtgtttatttcgataaagttttggagtttcgtcgcgagttaatatttcgcgtagtaattggcggttgagtagtataaatacgtcgatatggcgcgtgagttggtagagtataacggtgtcgaaggcgatttggaagcggattattaggcggttagtgattatttgaatttggtgtaaatcgtattgcgttagtaggagaagatcgaacgttacgaagcggatttcgatgagttgtagattcgtttgaagagcggggtatagcgatagtttttattttagttatattattaggttttggggtattgtagagcgagacggagaaatagttgcggttaattatggcggcggtaggcggagcg

SEQ ID NO: 13632 - DNA, 643 bp, Artificial Sequence
  chemically treated genomic DNA (Homo sapiens) CpG-island No: 13632
  misc_feature (595)..(595): n is either a, c, g or t
  misc_feature (602)..(603): n is either a, c, g or t
  misc_feature (606)..(606): n is either a, c, g or t
  misc_feature (631)..(631): n is either a, c, g or t
cgctccgcctaccgccgccataattaaccgcaactatttctccgtctcgctctacaataccccaaaacctaataatataactaaaataaaaactatcgctataccccgctcttcaaacgaatctacaactcatcgaaatccgcttcgtaacgttcgatcttctcctactaacgcaatacgatttacaccaaattcaaataatcactaaccgcctaataatccgcttccaaatcgccttcgacaccgttatactctaccaactcacgcgccatatcgacgtatttatactactcaaccgccaattactacgcgaaatattaactcgcgacgaaactccaaaactttatcgaaataaacacgacgctcgttaacgtaacgcatataatccgccgccacgtaattaataacttcgctaatcaaatacttaaacaaatcgcgatccgactaaataacacgaatcgcttccaacgtcatacgattttcacgcaacgccgcttccatatcctaaaacgctttacgcacgccgctattttctaacaacaaataatcgcgcaaaaaacgaataataacactaaaatcgtactcgttattactnaaaattnnatnaacgcgaataaaaccaatattacancaccaaaaaacc

SEQ ID NO: 13633 - DNA, 555 bp, Artificial Sequence
  chemically treated genomic DNA (Homo sapiens) CpG-island No: 13633
cggcgggcggggggggcgttgttttttcgggacggcggggtgtttcgttggcgggcgcgggggtcgcgcggcgacgttcggcggattcggtagagtttggtcgcggcgcgtcgtcgttttcgtcgggtcggtacggtgtcgagttttttgtgttgaatcggcgggacgattggtgttcgggcgcgttagagcggggtaagcgttttaggttagggttgtttttggcgaagttcgattttcgttcggtatttatttcgtttttgttgcgcgttttttttgtttatttttttcgttcggatttatttttttcgttcgcgtcgcgattatcggcgtttcgtcgtttttcgtttggttttttatttagttttatgtttttaatacgttattcgggtgagtttcgcgttgtttgtggagggattgaggcgttcgttgtttttagagggagcgttttagtcgatgtagcgttttttttttttagatgcgatttcggaggggagatcgcggcgttcggggattgttggggtgtttttggaagtttttagttttttttttttt

SEQ ID NO: 13634 - DNA, 555 bp, Artificial Sequence
  chemically treated genomic DNA (Homo sapiens) CpG-island No: 13634
aaaaaaaaaaaaactaaaaacttccaaaaacaccccaacaatccccgaacgccgcgatctcccctccgaaatcgcatctaaaaaaaaaaaacgctacatcgactaaaacgctccctctaaaaacaacgaacgcctcaatccctccacaaacaacgcgaaactcacccgaataacgtattaaaaacataaaactaaataaaaaaccaaacgaaaaacgacgaaacgccgataatcgcgacgcgaacgaaaaaaataaatccgaacgaaaaaaataaacaaaaaaaacgcgcaacaaaaacgaaataaataccgaacgaaaatcgaacttcgccaaaaacaaccctaacctaaaacgcttaccccgctctaacgcgcccgaacaccaatcgtcccgccgattcaacacaaaaaactcgacaccgtaccgacccgacgaaaacgacgacgcgccgcgaccaaactctaccgaatccgccgaacgtcgccgcgcgacccccgcgcccgccaacgaaacaccccgccgtcccgaaaaaacaacgccccccccgcccgccg

SEQ ID NO: 13635 - DNA, 555 bp, Artificial Sequence
  chemically treated genomic DNA (Homo sapiens) CpG-island No: 13635
ggagagggggaagttgggaatttttaaggatattttaataattttcgggcgtcgcggtttttttttcggagtcgtatttgggagggaagggcgttgtatcggttggggcgttttttttggaggtaacgagcgttttagtttttttataaatagcgcggggtttattcgggtgacgtgttgggggtatggggttgaataaggggttaagcgaggggcggcggggcgtcggtggtcgcggcgcgggcggggaggatgggttcggacgaagggagtgagtaaagaggacgcgtagtaagagcgagataaatgtcgggcgaaggtcgggtttcgttaggggtagttttggtttggggcgtttatttcgttttggcgcgttcgagtattagtcgtttcgtcgatttagtataaaaggttcgatatcgtgtcggttcgacgaggacggcggcgcgtcgcggttagattttatcgagttcgtcgggcgtcgtcgcgcgattttcgcgttcgttagcgggatatttcgtcgtttcggaggagtagcgtttttttcgttcgtcg

SEQ ID NO: 13636 - DNA, 555 bp, Artificial Sequence
  chemically treated genomic DNA (Homo sapiens) CpG-island No: 13636
cgacgaacgaaaaaaacgctactcctccgaaacgacgaaatatcccgctaacgaacgcgaaaatcgcgcgacgacgcccgacgaactcgataaaatctaaccgcgacgcgccgccgtcctcgtcgaaccgacacgatatcgaaccttttatactaaatcgacgaaacgactaatactcgaacgcgccaaaacgaaataaacgccccaaaccaaaactacccctaacgaaacccgaccttcgcccgacatttatctcgctcttactacgcgtcctctttactcactcccttcgtccgaacccatcctccccgcccgcgccgcgaccaccgacgccccgccgcccctcgcttaaccccttattcaaccccatacccccaacacgtcacccgaataaaccccgcgctatttataaaaaaactaaaacgctcgttacctccaaaaaaaacgccccaaccgatacaacgcccttccctcccaaatacgactccgaaaaaaaaaccgcgacgcccgaaaattattaaaatatccttaaaaattcccaacttccccctctcc

SEQ ID NO: 13637 - DNA, 907 bp, Artificial Sequence
  chemically treated genomic DNA (Homo sapiens) CpG-island No: 13637
gcggttgttcggttgtgggggaaggcgttttgtgtatggacggtcggagattattcgggttgtttttttcggtgttcggcgttcggcgtttgttgcgtgttgttttttttttcgcgtacgatgtcgtgtttatcgttgtttaggttttgtttttttttttacgtttttttttttcgagttttcgcgtttttgtttgtgtttttgtttttttatttttttcggttgcgtttgtcgttttttcgcgttttcgttttcgtaggacgtatagggagcgaggttcggagttgcgttggttgtcgggttggcgggcggagggcgtgggtagagcgaggggcggggagtgggggcgggggcggggaggcgggcgttggggttttcggcgcggagacgtcgttatgagattgggagaggcggagacggggggggagggggtgtggagtaggaggcgggggcggggatttagagtcggggcgtcgaattggggatcgaggtgatcgaggttcggttgtgtagggcgggtttggggatttagcggcggggcgaggtcgttttgtgtcgtttacgtcggatgtatagtcggtttttttggcgtttacgtatttacgtgagcgtttcgtcggcgatatttttttttttttttattttttcgagttgagagaggagttttataattacgtataagtatataaagatatagaagcgtacggacgtgtatacgcgtttaaataattacggggacgttcgttgtttatatttaggttttgtggtgttggacgtgtgaatgttagtagtgagtcgggaaaagttagcgaaggttgggttgtgcggttttttttgtgcgtgtatttgattttcgtatagtgtgtatttaaggcgggtttgagagcgtggggttttgtagggattt

SEQ ID NO: 13638 - DNA, 907 bp, Artificial Sequence
  chemically treated genomic DNA (Homo sapiens) CpG-island No: 13638
aaatccctacaaaaccccacgctctcaaacccgccttaaatacacactatacgaaaatcaaatacacgcacaaaaaaaaccgcacaacccaaccttcgctaacttttcccgactcactactaacattcacacgtccaacaccacaaaacctaaatataaacaacgaacgtccccgtaattatttaaacgcgtatacacgtccgtacgcttctatatctttatatacttatacgtaattataaaactcctctctcaactcgaaaaaataaaaaaaaaaaaaaatatcgccgacgaaacgctcacgtaaatacgtaaacgccaaaaaaaccgactatacatccgacgtaaacgacacaaaacgacctcgccccgccgctaaatccccaaacccgccctacacaaccgaacctcgatcacctcgatccccaattcgacgccccgactctaaatccccgcccccgcctcctactccacaccccctccccccccgtctccgcctctcccaatctcataacgacgtctccgcgccgaaaaccccaacgcccgcctccccgcccccgcccccactccccgcccctcgctctacccacgccctccgcccgccaacccgacaaccaacgcaactccgaacctcgctccctatacgtcctacgaaaacgaaaacgcgaaaaaacgacaaacgcaaccgaaaaaaataaaaaaacaaaaacacaaacaaaaacgcgaaaactcgaaaaaaaaaaacgtaaaaaaaaaaacaaaacctaaacaacgataaacacgacatcgtacgcgaaaaaaaaaacaacacgcaacaaacgccgaacgccgaacaccgaaaaaaacaacccgaataatctccgaccgtccatacacaaaacgccttcccccacaaccgaacaaccgc

SEQ ID NO: 13639 - DNA, 907 bp, Artificial Sequence
  chemically treated genomic DNA (Homo sapiens) CpG-island No: 13639
agatttttgtagagttttacgtttttaggttcgttttaagtgtatattatacgggagttagatgtacgtatagaagaagtcgtatagtttagttttcgttaatttttttcggtttattgttaatatttatacgtttagtattataaggtttgagtatgggtaacgggcgttttcgtagttgtttaggcgcgtgtgtacgttcgtgcgtttttgtgtttttgtgtatttgtgcgtggttgtgaaattttttttttagttcggaggggtgggggagagaaggaatgtcgtcggcggggcgtttacgtgggtacgtgggcgttaagagggtcggttgtgtattcggcgtgggcggtatagaacgatttcgtttcgtcgttgggtttttaagttcgttttgtatagtcgggtttcggttatttcggtttttaattcggcgtttcggttttgaattttcgttttcgttttttgttttatatttttttttttttcgttttcgttttttttagttttatagcggcgttttcgcgtcgagagttttagcgttcgttttttcgttttcgtttttatttttcgtttttcgttttgtttacgtttttcgttcgttagttcggtagttagcgtagtttcgggtttcgttttttgtgcgttttgcgggggcggaggcgcggagaggcggtaagcgtagtcggggagggtgggggggtagaggtatagatagaggcgcggaggttcggagagagaagacgtggagggagggatagagtttggatagcggtggatacggtatcgtgcgcggggaagagggtagtacgtagtaggcgtcgagcgtcgggtatcgagaagggtagttcgggtgattttcggtcgtttatgtatagagcgtttttttttatagtcgagtagtcgt

SEQ ID NO: 13640 - DNA, 907 bp, Artificial Sequence
  chemically treated genomic DNA (Homo sapiens) CpG-island No: 13640
acgactactcgactataaaaaaaaacgctctatacataaacgaccgaaaatcacccgaactacccttctcgatacccgacgctcgacgcctactacgtactaccctcttccccgcgcacgataccgtatccaccgctatccaaactctatccctccctccacgtcttctctctccgaacctccgcgcctctatctatacctctacccccccaccctccccgactacgcttaccgcctctccgcgcctccgcccccgcaaaacgcacaaaaaacgaaacccgaaactacgctaactaccgaactaacgaacgaaaaacgtaaacaaaacgaaaaacgaaaaataaaaacgaaaacgaaaaaacgaacgctaaaactctcgacgcgaaaacgccgctataaaactaaaaaaaacgaaaacgaaaaaaaaaaaaatataaaacaaaaaacgaaaacgaaaattcaaaaccgaaacgccgaattaaaaaccgaaataaccgaaacccgactatacaaaacgaacttaaaaacccaacgacgaaacgaaatcgttctataccgcccacgccgaatacacaaccgaccctcttaacgcccacgtacccacgtaaacgccccgccgacgacattccttctctcccccacccctccgaactaaaaaaaaaatttcacaaccacgcacaaatacacaaaaacacaaaaacgcacgaacgtacacacgcgcctaaacaactacgaaaacgcccgttacccatactcaaaccttataatactaaacgtataaatattaacaataaaccgaaaaaaattaacgaaaactaaactatacgacttcttctatacgtacatctaactcccgtataatatacacttaaaacgaacctaaaaacgtaaaactctacaaaaatct

SEQ ID NO: 13641 - DNA, 593 bp, Artificial Sequence
  chemically treated genomic DNA (Homo sapiens) CpG-island No: 13641
gtcgtattcgatatgtttttttttaaattagaataatagcgttagttcgtcgataattatattagatattgttattatcgtttttgttagttataaggttttcgtcgggaacgttttgcgtagtataattagtgacggtaaatttattgtcgggagcgttattaataatgttagcgtcggagcggtttttatatttgttagtattatcgtttgtataatcggaatttttgttgtcgtgggaatgataaataagtattttgttatcgttatcgttattatttatattaggttgttatcgatagtattatcggtatgggggaataattagacgcgagcggtatttaatattagtattgtaaggatgtaaatcgggatcgtattttagaaaagcgtttatagcgttttgttttagcggttaaaaaattcgttttgtgttttcggtatgttaatttcgatcggtgtttgcgtttgcggtgttttacgtatttatttttgtattagcgttttattaggaaaatattaataggtcggttattagaagaattggcggaaaaattcggcgaggattaaagtttatataaattaggtttttt

SEQ ID NO: 13642 - DNA, 593 bp, Artificial Sequence
  chemically treated genomic DNA (Homo sapiens) CpG-island No: 13642
aaaaaacctaatttatataaactttaatcctcgccgaatttttccgccaattcttctaataaccgacctattaatattttcctaataaaacgctaatacaaaaataaatacgtaaaacaccgcaaacgcaaacaccgatcgaaattaacataccgaaaacacaaaacgaattttttaaccgctaaaacaaaacgctataaacgcttttctaaaatacgatcccgatttacatccttacaatactaatattaaataccgctcgcgtctaattattcccccataccgataatactatcgataacaacctaatataaataataacgataacgataacaaaatacttatttatcattcccacgacaacaaaaattccgattatacaaacgataatactaacaaatataaaaaccgctccgacgctaacattattaataacgctcccgacaataaatttaccgtcactaattatactacgcaaaacgttcccgacgaaaaccttataactaacaaaaacgataataacaatatctaatataattatcgacgaactaacgctattattctaatttaaaaaaaaacatatcgaatacgac

SEQ ID NO: 13643 - DNA, 593 bp, Artificial Sequence
  chemically treated genomic DNA (Homo sapiens) CpG-island No: 13643
ggggaatttggtttatatgggttttggttttcgtcgggttttttcgttaatttttttggtggtcggtttgttaatgtttttttgatgggacgttggtgtaaaaatgggtgcgtgaaatatcgtaaacgtaggtatcggtcgaaattgatatatcggaagtatagggcgggttttttagtcgttggggtagggcgttatggacgtttttttggagtacgatttcggtttatatttttgtagtattggtgttgggtgtcgttcgcgtttggttatttttttatgtcgatggtgttgtcgataatagtttgatgtgggtggtggcgatggcggtagtaggatgtttgtttgttatttttacggtagtagaaatttcgattgtataaacgatgatgttggtaggtatgggaatcgtttcggcgttggtattgttgatgacgttttcggtagtgagtttgtcgttattgattatgttgcgtaaagcgttttcggcgaaagttttatggttgataggggcgatggtggtagtgtttggtgtgattgtcggcgggttggcgttgttgttttgatttgagggaaaatatgtcggatgcggt

SEQ ID NO: 13644 - DNA, 593 bp, Artificial Sequence
  chemically treated genomic DNA (Homo sapiens) CpG-island No: 13644
accgcatccgacatattttccctcaaatcaaaacaacaacgccaacccgccgacaatcacaccaaacactaccaccatcgcccctatcaaccataaaactttcgccgaaaacgctttacgcaacataatcaataacgacaaactcactaccgaaaacgtcatcaacaataccaacgccgaaacgattcccatacctaccaacatcatcgtttatacaatcgaaatttctactaccgtaaaaataacaaacaaacatcctactaccgccatcgccaccacccacatcaaactattatcgacaacaccatcgacataaaaaaataaccaaacgcgaacgacacccaacaccaatactacaaaaatataaaccgaaatcgtactccaaaaaaacgtccataacgccctaccccaacgactaaaaaacccgccctatacttccgatatatcaatttcgaccgatacctacgtttacgatatttcacgcacccatttttacaccaacgtcccatcaaaaaaacattaacaaaccgaccaccaaaaaaattaacgaaaaaacccgacgaaaaccaaaacccatataaaccaaattcccc

SEQ ID NO: 13645 - DNA, 529 bp, Artificial Sequence
  chemically treated genomic DNA (Homo sapiens) CpG-island No: 13645
tggtggcgtagttgttaatattacgttggttattttcgaattttggcgtgataaagcgatcggcgagatgaaagaatagattgaatggtatcgcgttgtgttgttcggtaaattggtagaagtggcgagcgaatatttgcgttaaggtttttaggtgtatatcggaaggttaggtgcgtattcgtaattggatcgattaattcggttaggatcgttatattataagaagtcgtggtgaacgttggcggtattattaaatgtgagtggacgtaaggtggggggttcggtagatggaaaacgggggggttatcgaaggcggtgaggtagtttaaaatcgtaggggtaacgtttacggggttaatcgacgtaatatatcggagacgttaaggcgagagagaaaagtatttaagacgatttagacgcgtattttgggttttttcgtataacgaggagggcgtaagtaagttgaggaataattatagaaggagtattacgtttaagatttaacgcgtttttttatagtgtatat

SEQ ID NO: 13646 - DNA, 529 bp, Artificial Sequence
  chemically treated genomic DNA (Homo sapiens) CpG-island No: 13646
atatacactataaaaaaacgcgttaaatcttaaacgtaatactccttctataattattcctcaacttacttacgccctcctcgttatacgaaaaaacccaaaatacgcgtctaaatcgtcttaaatacttttctctctcgccttaacgtctccgatatattacgtcgattaaccccgtaaacgttacccctacgattttaaactacctcaccgccttcgataacccccccgttttccatctaccgaaccccccaccttacgtccactcacatttaataataccgccaacgttcaccacgacttcttataatataacgatcctaaccgaattaatcgatccaattacgaatacgcacctaaccttccgatatacacctaaaaaccttaacgcaaatattcgctcgccacttctaccaatttaccgaacaacacaacgcgataccattcaatctattctttcatctcgccgatcgctttatcacgccaaaattcgaaaataaccaacgtaatattaacaactacgccacca

SEQ ID NO: 13647 - DNA, 529 bp, Artificial Sequence
  chemically treated genomic DNA (Homo sapiens) CpG-island No: 13647
gtgtatattgtggaaaaacgcgttggattttaggcgtagtgttttttttatgattgttttttagtttatttgcgtttttttcgttatgcggagagatttaaaatgcgcgtttagatcgttttgagtgtttttttttttcgttttgacgttttcggtgtgttgcgtcggttggtttcgtggacgttgtttttgcggttttgggttgttttatcgttttcggtgattttttcgttttttatttgtcgggttttttattttgcgtttatttatatttgatggtgtcgttaacgtttattacggttttttgtggtgtaacgattttgatcggattgatcggtttagttacgggtacgtatttgatttttcgatatatatttgagaattttgacgtagatattcgttcgttatttttgttagtttgtcgaatagtataacgcggtgttatttagtttgtttttttatttcgtcggtcgttttattacgttaggattcggaagtagttagcgtaatgttggtaattgcgttatta

SEQ ID NO: 13648 - DNA, 529 bp, Artificial Sequence
  chemically treated genomic DNA (Homo sapiens) CpG-island No: 13648
taataacgcaattaccaacattacgctaactacttccgaatcctaacgtaataaaacgaccgacgaaataaaaaaacaaactaaataacaccgcgttatactattcgacaaactaacaaaaataacgaacgaatatctacgtcaaaattctcaaatatatatcgaaaaatcaaatacgtacccgtaactaaaccgatcaatccgatcaaaatcgttacaccacaaaaaaccgtaataaacgttaacgacaccatcaaatataaataaacgcaaaataaaaaacccgacaaataaaaaacgaaaaaatcaccgaaaacgataaaacaacccaaaaccgcaaaaacaacgtccacgaaaccaaccgacgcaacacaccgaaaacgtcaaaacgaaaaaaaaaaacactcaaaacgatctaaacgcgcattttaaatctctccgcataacgaaaaaaacgcaaataaactaaaaaacaatcataaaaaaaacactacgcctaaaatccaacgcgtttttccacaatatacac

SEQ ID NO: 13649 - DNA, 522 bp, Artificial Sequence
  chemically treated genomic DNA (Homo sapiens) CpG-island No: 13649
cgttggtcgtaagtgttgcgcggttggtttttatcgtcggggtagagatatcgtataaggtgagacgaattttcggcgaatggcgcgtaaaggtaattgaaagtacgttcgcgttatagtcgatatttagtattttatttttcgtgtgcggagttaacgtcgagagtagtaattggttatcgatatttagaacgtcgcggttaaatacgttaggtagagttttgatcgttaggttatcgacgttgtattcgttttagaattttttcgaattaatatcgggtgtaatttagagatttaaataacggtacgcgacgaggcggcgaattattaacggggatatcggtagtacggtcgggttggtaatagaggggtttgtaggtaaaatttggtttcggagagagaataatttatggagggtacggaggaaggtaaaatacgtgaatgagaaacgggaataaaagggatttagttaatcgggacggaatagcggtatggacgtattaagggtatattatttcgtag

SEQ ID NO: 13650 - DNA, 522 bp, Artificial Sequence
  chemically treated genomic DNA (Homo sapiens) CpG-island No: 13650
ctacgaaataatatacccttaatacgtccataccgctattccgtcccgattaactaaatcccttttattcccgtttctcattcacgtattttaccttcctccgtaccctccataaattattctctctccgaaaccaaattttacctacaaacccctctattaccaacccgaccgtactaccgatatccccgttaataattcgccgcctcgtcgcgtaccgttatttaaatctctaaattacacccgatattaattcgaaaaaattctaaaacgaatacaacgtcgataacctaacgatcaaaactctacctaacgtatttaaccgcgacgttctaaatatcgataaccaattactactctcgacgttaactccgcacacgaaaaataaaatactaaatatcgactataacgcgaacgtactttcaattacctttacgcgccattcgccgaaaattcgtctcaccttatacgatatctctaccccgacgataaaaaccaaccgcgcaacacttacgaccaacg

SEQ ID NO: 13651 - DNA, 522 bp, Artificial Sequence
  chemically treated genomic DNA (Homo sapiens) CpG-island No: 13651
ttacggggtaatgtatttttgatacgtttatgtcgttatttcgtttcggttgattggattttttttgttttcgttttttatttacgtgttttgttttttttcgtgttttttatggattatttttttttcggggttaaattttgtttgtagatttttttgttgttagttcgatcgtgttgtcgatattttcgttgataattcgtcgtttcgtcgcgtgtcgttatttgggtttttggattatattcggtattgattcggagaaattttggggcgaatatagcgtcgatggtttgacggttaaaattttgtttggcgtgtttagtcgcgacgttttggatgtcggtagttagttgttgttttcgacgttaatttcgtatacgaaaggtaaagtgttggatgtcggttgtggcgcgggcgtgtttttagttgtttttgcgcgttattcgtcgaaaattcgttttattttgtgcgatgtttttgtttcggcggtagaagttagtcgcgtaatatttgcggttaacg

SEQ ID NO: 13652 - DNA, 522 bp, Artificial Sequence
  chemically treated genomic DNA (Homo sapiens) CpG-island No: 13652
cgttaaccgcaaatattacgcgactaacttctaccgccgaaacaaaaacatcgcacaaaataaaacgaattttcgacgaataacgcgcaaaaacaactaaaaacacgcccgcgccacaaccgacatccaacactttacctttcgtatacgaaattaacgtcgaaaacaacaactaactaccgacatccaaaacgtcgcgactaaacacgccaaacaaaattttaaccgtcaaaccatcgacgctatattcgccccaaaatttctccgaatcaataccgaatataatccaaaaacccaaataacgacacgcgacgaaacgacgaattatcaacgaaaatatcgacaacacgatcgaactaacaacaaaaaaatctacaaacaaaatttaaccccgaaaaaaaaataatccataaaaaacacgaaaaaaaacaaaacacgtaaataaaaaacgaaaacaaaaaaaatccaatcaaccgaaacgaaataacgacataaacgtatcaaaaatacattaccccgtaa

SEQ ID NO: 13653 - DNA, 742 bp, Artificial Sequence
  chemically treated genomic DNA (Homo sapiens) CpG-island No: 13653
gtcgcgacgcgtcgtaatttggaaattatttagaatttggcgggtggtgcggaaaatacgttggtttttgtgttcgattgtatcgttacgtcgatgggtagtcgtatgttgaaacgttggttgtatatgttagtgcgcgatattcgcgtgttgtttgagcgttagtaaattattggcgtattgtaggattttatcgtcgggttatagtcggtattgcgttaggtcggcgatttggaacgtattttggtacgtttggttttacgaattgttcgtttacgcgatttggttcgtatgcgttacgttttttagtaattgtcggagttgcgtgcgtagttagaaattgtcgatagtgtatcggtataggcgttacgtgagaagatgggcgagtttgtcgagttgcgcgatttgttggagcgagtaattaatcgatatatcgtcggtgttggtacgcgacggtggtgttatcgtatcgggtataattaaaagcggatgatggggcgtttagatgaagggtttatcgatattaggaacgttggaaattttaatttatagttcgttggaattcgatagtgtttaaacgggacgaagtatttaattacgcgtcgtatatgggttatataaaggttattagtattaaacggcgttttttcgttagagaaaatttataatattcgtttattttgtatacgttgtttaagaagaacgaggagtgtaattatttttttttcgttcgtttcgtttt

SEQ ID NO: 13654 - DNA, 742 bp, Artificial Sequence
  chemically treated genomic DNA (Homo sapiens) CpG-island No: 13654
aaaacgaaacgaacgaaaaaaaaataattacactcctcgttcttcttaaacaacgtatacaaaataaacgaatattataaattttctctaacgaaaaaacgccgtttaatactaataacctttatataacccatatacgacgcgtaattaaatacttcgtcccgtttaaacactatcgaattccaacgaactataaattaaaatttccaacgttcctaatatcgataaacccttcatctaaacgccccatcatccgcttttaattatacccgatacgataacaccaccgtcgcgtaccaacaccgacgatatatcgattaattactcgctccaacaaatcgcgcaactcgacaaactcgcccatcttctcacgtaacgcctataccgatacactatcgacaatttctaactacgcacgcaactccgacaattactaaaaaacgtaacgcatacgaaccaaatcgcgtaaacgaacaattcgtaaaaccaaacgtaccaaaatacgttccaaatcgccgacctaacgcaataccgactataacccgacgataaaatcctacaatacgccaataatttactaacgctcaaacaacacgcgaatatcgcgcactaacatatacaaccaacgtttcaacatacgactacccatcgacgtaacgatacaatcgaacacaaaaaccaacgtattttccgcaccacccgccaaattctaaataatttccaaattacgacgcgtcgcgac

SEQ ID NO: 13655 - DNA, 742 bp, Artificial Sequence
  chemically treated genomic DNA (Homo sapiens) CpG-island No: 13655
ggaacgaggcgagcgagaaaagagtgattgtatttttcgttttttttaggtagcgtgtataaggtgagcgagtgttgtaaattttttttggcgggagagcgtcgtttgatgttggtagtttttgtgtggtttatatgcggcgcgtggttgggtgtttcgtttcgtttgagtattgtcgggttttagcgggttgtaggttggggtttttagcgtttttgatatcggtgggttttttatttgggcgttttattattcgtttttggttatgttcgatgcgataatattatcgtcgcgtattagtatcggcggtgtgtcgattgattgttcgttttagtagatcgcgtagttcggtaaattcgtttatttttttacgtagcgtttgtatcggtgtattatcgatagtttttaattgcgtacgtagtttcggtagttgttggaaagcgtggcgtatacgggttagatcgcgtgggcgagtagttcgtaaagttagacgtgttagaatacgttttaggtcgtcgatttgacgtagtatcggttgtagttcggcggtgaaattttgtaatgcgttaatagtttgttggcgtttaagtaatacgcgggtatcgcgtattggtatatgtagttagcgttttagtatacggttgtttatcggcgtgacggtgtagtcgagtatagaagttagcgtatttttcgtattattcgttaggttttgggtgatttttagattacgacgcgtcgcggt

SEQ ID NO: 13656 - DNA, 742 bp, Artificial Sequence
  chemically treated genomic DNA (Homo sapiens) CpG-island No: 13656
accgcgacgcgtcgtaatctaaaaatcacccaaaacctaacgaataatacgaaaaatacgctaacttctatactcgactacaccgtcacgccgataaacaaccgtatactaaaacgctaactacatataccaatacgcgatacccgcgtattacttaaacgccaacaaactattaacgcattacaaaatttcaccgccgaactacaaccgatactacgtcaaatcgacgacctaaaacgtattctaacacgtctaactttacgaactactcgcccacgcgatctaacccgtatacgccacgctttccaacaactaccgaaactacgtacgcaattaaaaactatcgataatacaccgatacaaacgctacgtaaaaaaataaacgaatttaccgaactacgcgatctactaaaacgaacaatcaatcgacacaccgccgatactaatacgcgacgataatattatcgcatcgaacataaccaaaaacgaataataaaacgcccaaataaaaaacccaccgatatcaaaaacgctaaaaaccccaacctacaacccgctaaaacccgacaatactcaaacgaaacgaaacacccaaccacgcgccgcatataaaccacacaaaaactaccaacatcaaacgacgctctcccgccaaaaaaaatttacaacactcgctcaccttatacacgctacctaaaaaaaacgaaaaatacaatcactcttttctcgctcgcctcgttcc

SEQ ID NO: 13657 - DNA, 629 bp, Artificial Sequence
  chemically treated genomic DNA (Homo sapiens) CpG-island No: 13657
gtcgttttatttaattggcgtagggtaatcgggaatagtgtgtcgttaattagcgtcgatttatcggaatttgaaatttcggtgatgtaggtaaatagatttatcggtagcgttagcgttacgttttttaggattgttgtcgtagtgacgttatgttagattttagtatttttttcggattcgtcggaacgcgttttttcggtattttaattttgcgtttgtcgtttatgtattgttcggttaacgatttcggtatcgttataatcgtttttagcggattttttgcgattattttatcgtcgtgaatatttgcgttcgggttaatgtcgattatatggttagcggcgcgaattgcgttttcgtcgtgttttattataattacggtattatcgagatcgcgtagatggataagcgtatttaataggcgttcgttattacgttggtgtaggtcgatagacggttcgtttagtacgtatataacgttaattaggttcgtattaatttggttcgttagacggatacgttgtgttttatcgttagaaagcgtttttgtcgagcgggaaagcgttaggtaatttaggtcgacgttaacgaggaattttagacgatcgtcgatttttttaaggatt

SEQ ID NO: 13658 - DNA, 629 bp, Artificial Sequence
  chemically treated genomic DNA (Homo sapiens) CpG-island No: 13658
aatccttaaaaaaatcgacgatcgtctaaaattcctcgttaacgtcgacctaaattacctaacgctttcccgctcgacaaaaacgctttctaacgataaaacacaacgtatccgtctaacgaaccaaattaatacgaacctaattaacgttatatacgtactaaacgaaccgtctatcgacctacaccaacgtaataacgaacgcctattaaatacgcttatccatctacgcgatctcgataataccgtaattataataaaacacgacgaaaacgcaattcgcgccgctaaccatataatcgacattaacccgaacgcaaatattcacgacgataaaataatcgcaaaaaatccgctaaaaacgattataacgataccgaaatcgttaaccgaacaatacataaacgacaaacgcaaaattaaaataccgaaaaaacgcgttccgacgaatccgaaaaaaatactaaaatctaacataacgtcactacgacaacaatcctaaaaaacgtaacgctaacgctaccgataaatctatttacctacatcaccgaaatttcaaattccgataaatcgacgctaattaacgacacactattcccgattaccctacgccaattaaataaaacgac

SEQ ID NO: 13659 - DNA, 629 bp, Artificial Sequence
  chemically treated genomic DNA (Homo sapiens) CpG-island No: 13659
aatttttaaagagatcggcgatcgtttgaaatttttcgttaacgtcggtttgaattatttgacgttttttcgttcggtagaaacgttttttggcggtgaagtatagcgtattcgtttggcgagttagattggtgcgggtttggttggcgttatgtacgtgttggacgagtcgtttatcggtttgtattagcgtgataacgagcgtttgttgggtacgtttatttatttgcgcgatttcggtaatatcgtgattgtggtggagtacgacgaagacgtaattcgcgtcgttgattatgtgatcgatattggttcgggcgtaggtgtttacggcggtgaagtggtcgtagaaggttcgttggaagcgattatggcggtgtcggagtcgttgatcgggtagtatatgagcggtaaacgtaagattgaagtgtcgaagaaacgcgtttcggcgaattcggaaaaagtgttgaagtttgatatggcgttattgcggtaataattttgaaggacgtgacgttgacgttgtcggtgggtttgtttatttgtattatcggggttttaggtttcggtaaatcgacgttgattaacgatatattgttttcgattgttttacgttagttgaatggggcgat

SEQ ID NO: 13660 - DNA, 629 bp, Artificial Sequence
  chemically treated genomic DNA (Homo sapiens) CpG-island No: 13660
atcgccccattcaactaacgtaaaacaatcgaaaacaatatatcgttaatcaacgtcgatttaccgaaacctaaaaccccgataatacaaataaacaaacccaccgacaacgtcaacgtcacgtccttcaaaattattaccgcaataacgccatatcaaacttcaacactttttccgaattcgccgaaacgcgtttcttcgacacttcaatcttacgtttaccgctcatatactacccgatcaacgactccgacaccgccataatcgcttccaacgaaccttctacgaccacttcaccgccgtaaacacctacgcccgaaccaatatcgatcacataatcaacgacgcgaattacgtcttcgtcgtactccaccacaatcacgatattaccgaaatcgcgcaaataaataaacgtacccaacaaacgctcgttatcacgctaatacaaaccgataaacgactcgtccaacacgtacataacgccaaccaaacccgcaccaatctaactcgccaaacgaatacgctatacttcaccgccaaaaaacgtttctaccgaacgaaaaaacgtcaaataattcaaaccgacgttaacgaaaaatttcaaacgatcgccgatctctttaaaaatt

SEQ ID NO: 13661 - DNA, 618 bp, Artificial Sequence
  chemically treated genomic DNA (Homo sapiens) CpG-island No: 13661
acgttttcggttatggtttgacgtttggcgtttatacgcgtattgatgaaattatcgtttaggttattggttcggtttatgttgggtaatttgtatgttaatcgtaatatggtgggcgtagtggttggtgtgtagtcgttcggcggcgaagggttgttcggtatcgggtcgaaagtaggcggttcgttttatttttatcgtttgttggcgaatcgttcggaaagtgcgttggtagtgacgttcgcgcgttaggatgtaaagtattcggtcgatgcgtagttgaaagtcgtattgatttagtcgttaaatgtattgcgggaatgggtagtaaatcgtttagaattgtaggcgttatgtacgtaatatggcgagttggcgtaggtaggaatataacgattgttgtcggggtcgacgggtgaacgtaatatttggacgttgttgtcgcgtgagcgcgtgttgtgtattgtcgtagaattgtacgaggggttagttagatagggtagattgcgggggttattttttggttcgaataacgtttatcggttaagagtgttcgggaaatagtaatttttcgagggtaaaatttttttagtgtaattttttatattttatttaaag

SEQ ID NO: 13662 - DNA, 618 bp, Artificial Sequence
  chemically treated genomic DNA (Homo sapiens) CpG-island No: 13662
ctttaaataaaatataaaaaattacactaaaaaaattttaccctcgaaaaattactatttcccgaacactcttaaccgataaacgttattcgaaccaaaaaataacccccgcaatctaccctatctaactaacccctcgtacaattctacgacaatacacaacacgcgctcacgcgacaacaacgtccaaatattacgttcacccgtcgaccccgacaacaatcgttatattcctacctacgccaactcgccatattacgtacataacgcctacaattctaaacgatttactacccattcccgcaatacatttaacgactaaatcaatacgactttcaactacgcatcgaccgaatactttacatcctaacgcgcgaacgtcactaccaacgcactttccgaacgattcgccaacaaacgataaaaataaaacgaaccgcctactttcgacccgataccgaacaacccttcgccgccgaacgactacacaccaaccactacgcccaccatattacgattaacatacaaattacccaacataaaccgaaccaataacctaaacgataatttcatcaatacgcgtataaacgccaaacgtcaaaccataaccgaaaacgt

SEQ ID NO: 13663 - DNA, 618 bp, Artificial Sequence
  chemically treated genomic DNA (Homo sapiens) CpG-island No: 13663
ttttaagtggggtgtggagaattatattgggaggattttgttttcggagaattgttgtttttcgagtatttttagtcgatggacgttattcggattagagggtgattttcgtagtttgttttatttgattagtttttcgtgtaattttgcgataatatataatacgcgtttacgcggtagtagcgtttaggtgttgcgtttattcgtcggtttcggtagtaatcgttgtgtttttgtttgcgttagttcgttatattgcgtatataacgtttgtaattttggacgatttgttgtttattttcgtagtgtatttagcggttgagttaatgcggtttttaattgcgtatcgatcggatattttgtattttgacgcgcgagcgttattgttagcgtatttttcgggcgattcgttagtagacggtagagatagagcggatcgtttgttttcggttcggtatcggataatttttcgtcgtcgaacggttgtatattaattattgcgtttattatattacggttaatatataggttatttaatatgggtcgagttagtgatttgggcgatggttttattaatgcgcgtatggacgttaagcgttagattataatcggaagcgt

SEQ ID NO: 13664 - DNA, 618 bp, Artificial Sequence
  chemically treated genomic DNA (Homo sapiens) CpG-island No: 13664
acgcttccgattataatctaacgcttaacgtccatacgcgcattaataaaaccatcgcccaaatcactaactcgacccatattaaataacctatatattaaccgtaatataataaacgcaataattaatatacaaccgttcgacgacgaaaaattatccgataccgaaccgaaaacaaacgatccgctctatctctaccgtctactaacgaatcgcccgaaaaatacgctaacaataacgctcgcgcgtcaaaatacaaaatatccgatcgatacgcaattaaaaaccgcattaactcaaccgctaaatacactacgaaaataaacaacaaatcgtccaaaattacaaacgttatatacgcaatataacgaactaacgcaaacaaaaacacaacgattactaccgaaaccgacgaataaacgcaacacctaaacgctactaccgcgtaaacgcgtattatatattatcgcaaaattacacgaaaaactaatcaaataaaacaaactacgaaaatcaccctctaatccgaataacgtccatcgactaaaaatactcgaaaaacaacaattctccgaaaacaaaatcctcccaatataattctccacaccccacttaaaa

SEQ ID NO: 13665 - DNA, 507 bp, Artificial Sequence
  chemically treated genomic DNA (Homo sapiens) CpG-island No: 13665
gtagattcgcgatattttggcgcgttcggcgttttattttatcgtttcgtagtaacgttgggaagaatatttgaagaaagggttaattaattcggatgcgacgtcggaatagacgcgcgtcgcggtgaaagcgatcgaaacgtttaacggtaattggcgtttatcgggcggtgcggtgaaatttaatatcgttatatcgtcggtgatcgggcgttggtttttcggtaattagatttggtcgtgggatatttggaagtaggcgtttgcgatggcgtattttaattcggatatcgttaaagagaatattcgcgcggtttttttttggtagatttagtttggcgatagcgtgcgttcgtaggatgtgggttttgttttcgaattgatagcgtgggaatttagattcgagcgtggtggcgatggcgggaattgggaataacgtgatatttaaatcgattttgttttgtgttcgaatggatgttataggtttttaaataaatttgggttgga

SEQ ID NO: 13666 - DNA, 507 bp, Artificial Sequence
  chemically treated genomic DNA (Homo sapiens) CpG-island No: 13666
tccaacccaaatttatttaaaaacctataacatccattcgaacacaaaacaaaatcgatttaaatatcacgttattcccaattcccgccatcgccaccacgctcgaatctaaattcccacgctatcaattcgaaaacaaaacccacatcctacgaacgcacgctatcgccaaactaaatctaccaaaaaaaaaccgcgcgaatattctctttaacgatatccgaattaaaatacgccatcgcaaacgcctacttccaaatatcccacgaccaaatctaattaccgaaaaaccaacgcccgatcaccgacgatataacgatattaaatttcaccgcaccgcccgataaacgccaattaccgttaaacgtttcgatcgctttcaccgcgacgcgcgtctattccgacgtcgcatccgaattaattaaccctttcttcaaatattcttcccaacgttactacgaaacgataaaataaaacgccgaacgcgccaaaatatcgcgaatctac

SEQ ID NO: 13667 - DNA, 507 bp, Artificial Sequence
  chemically treated genomic DNA (Homo sapiens) CpG-island No: 13667
tttaatttaggtttatttggggatttataatatttattcgagtatagagtaaagtcggtttggatattacgttgtttttagttttcgttatcgttattacgttcgggtttaagtttttacgttattagttcggggataaagtttatattttgcggacgtacgttatcgttaggttggatttgttaggagaagatcgcgcggatattttttttggcgatgttcggattgaaatgcgttatcgtaaacgtttgtttttaggtattttacggttaggtttgattgtcggagaattagcgttcggttatcgacggtgtaacggtgttaaattttatcgtatcgttcggtgagcgttagttatcgttgagcgtttcgatcgtttttatcgcgacgcgcgtttgtttcggcgtcgtattcggattggttaattttttttttaggtattttttttagcgttgttgcgaggcggtgagataaaacgtcggacgcgttagaatatcgcggatttgt

SEQ ID NO: 13668 - DNA, 507 bp, Artificial Sequence
  chemically treated genomic DNA (Homo sapiens) CpG-island No: 13668
acaaatccgcgatattctaacgcgtccgacgttttatctcaccgcctcgcaacaacgctaaaaaaaatacctaaaaaaaaaattaaccaatccgaatacgacgccgaaacaaacgcgcgtcgcgataaaaacgatcgaaacgctcaacgataactaacgctcaccgaacgatacgataaaatttaacaccgttacaccgtcgataaccgaacgctaattctccgacaatcaaacctaaccgtaaaatacctaaaaacaaacgtttacgataacgcatttcaatccgaacatcgccaaaaaaaatatccgcgcgatcttctcctaacaaatccaacctaacgataacgtacgtccgcaaaatataaactttatccccgaactaataacgtaaaaacttaaacccgaacgtaataacgataacgaaaactaaaaacaacgtaatatccaaaccgactttactctatactcgaataaatattataaatccccaaataaacctaaattaaa

SEQ ID NO: 13669 - DNA, 543 bp, Artificial Sequence
  chemically treated genomic DNA (Homo sapiens) CpG-island No: 13669
cgcgcgggtgaataggacggttatgcgtttattggcgttattattatatcgttatttattagatttatttcgatttcgtttgacgatttcgggttcgtatcggtttagcgtcgcgcgacgcgttattatagattatttttataaagggcgggtatttaacgtgttaatttttattcgaatttttcgtgcggattaatcgttaatggtatttaaaaatttgttgacgttattaacgtggtatatttatatacgtgtaacggaaatttcgtatatacgacggttcgtcgatatagttaggtcgttttataattaaatacggtaatcgagatatttttgatcggacggatttaattataattatacgacggatatttatagttatattacgtttgtagttaaatacgtaataggatcgaatttttagattatttagaaagatatgttttttttgttatagcgtttattcgaatgcgataacgattatgattacgaaaatattgtcggttaaattattaatattcgattttcgtataatttatttta

SEQ ID NO: 13670 - DNA, 543 bp, Artificial Sequence
  chemically treated genomic DNA (Homo sapiens) CpG-island No: 13670
taaaataaattatacgaaaatcgaatattaataatttaaccgacaatattttcgtaatcataatcgttatcgcattcgaataaacgctataacaaaaaaaacatatctttctaaataatctaaaaattcgatcctattacgtatttaactacaaacgtaatataactataaatatccgtcgtataattataattaaatccgtccgatcaaaaatatctcgattaccgtatttaattataaaacgacctaactatatcgacgaaccgtcgtatatacgaaatttccgttacacgtatataaatataccacgttaataacgtcaacaaatttttaaataccattaacgattaatccgcacgaaaaattcgaataaaaattaacacgttaaatacccgccctttataaaaataatctataataacgcgtcgcgcgacgctaaaccgatacgaacccgaaatcgtcaaacgaaatcgaaataaatctaataaataacgatataataataacgccaataaacgcataaccgtcctattcacccgcgcg

SEQ ID NO: 13671 - DNA, 543 bp, Artificial Sequence
  chemically treated genomic DNA (Homo sapiens) CpG-island No: 13671
tgggatagattgtgcggaaatcgggtattgatggtttagtcggtaatgttttcgtgattatgatcgttgtcgtattcgagtggacgttgtagtagggggggtatatttttttgggtagtttgggagttcggttttgttgcgtgtttggttgtaagcgtggtgtgattgtgagtgttcgtcgtatggttgtggttgagttcgttcggttaagggtgtttcggttgtcgtgtttggttgtagagcggtttagttatatcggcgggtcgtcgtgtgtacggggttttcgttgtacgtgtgtgggtgtgttacgttggtggcgttaataagtttttaggtgttattggcggttagttcgtacgggaggttcgggtgggaattaatacgttaggtattcgttttttgtgaaggtgatttgtgatgacgcgtcgcgcgacgttaagtcggtacggattcggagtcgttaggcgaggtcgaggtgagtttgatggatagcggtatagtagtagcgttaatgaacgtataatcgttttgtttattcgcgcg

SEQ ID NO: 13672 - DNA, 543 bp, Artificial Sequence
  chemically treated genomic DNA (Homo sapiens) CpG-island No: 13672
cgcgcgaataaacaaaacgattatacgttcattaacgctactactataccgctatccatcaaactcacctcgacctcgcctaacgactccgaatccgtaccgacttaacgtcgcgcgacgcgtcatcacaaatcaccttcacaaaaaacgaatacctaacgtattaattcccacccgaacctcccgtacgaactaaccgccaataacacctaaaaacttattaacgccaccaacgtaacacacccacacacgtacaacgaaaaccccgtacacacgacgacccgccgatataactaaaccgctctacaaccaaacacgacaaccgaaacacccttaaccgaacgaactcaaccacaaccatacgacgaacactcacaatcacaccacgcttacaaccaaacacgcaacaaaaccgaactcccaaactacccaaaaaaatataccccccctactacaacgtccactcgaatacgacaacgatcataatcacgaaaacattaccgactaaaccatcaatacccgatttccgcacaatctatccca

SEQ ID NO: 13673 - DNA, 1048 bp, Artificial Sequence
  chemically treated genomic DNA (Homo sapiens) CpG-island No: 13673
  misc_feature (1004)..(1007): n is either a, c, g or t
tgtcgaacgtcgaggttagtatatttacgacgatttgttcggttagtgttgaagaatcgataattatcgcgtttatgtcgtcggttttagcgatgagcggaatagggcgattttgagcgtttaggcggttggcgatattgcgttgtagtaacgtagcgatttcggttgaatcggtaaatattatttcgcgtacgcgattattattcgttagttgcgcgtttacggttttatttcgatttggtagtaattgtattacgtttggcggtatattcgtttttagtaaaatggcgattttttgcgcggtaattagcggcgtttgttttgtcggttttgttagtacgttgttatttgtcgttagtgcggcggcgatttgttcggtgaaaatagttagcgggaagttttacggattgatatatattataggttttaatggacggtgggtttcgttagcgaaattatttcgtatttgttcggcgtagtagtggagaaaatcgatcgtttcgcgtatttcggtaatggcgttattgaaggttttttcggttttacgtattagaatattaattagttgttgtatttggttttttattagtacggtagcgcggtgtaaaatcgttgcgcgtttagtcggaggcgtggtaaattagattggcgcgttattaatcgtattttttagcgtttgttttattttacgcggcgtggttttacggtatatagtttataatatttttcgggttcgtcgggtttatacggggcgagtttatttggcggtatcggtgttttttttggtaggtcgttatttgtagtgttaattatacgtcgaggaaacgagtatcgggttagtaaaaattaatcgtttatgtttgtcgtacgtaaatttcgggtaatttagcggatatgtttaggggcgaatattagattttgttattatcgaaagtgtacgaataggttttacgggcgtaacggtcgttaatatgggggacgttcggtatattttatttttgttnnnnttacgaattcgtaaagtggtatttatttgtaacgtgggtta

SEQ ID NO: 13674 - DNA, 1048 bp, Artificial Sequence
  chemically treated genomic DNA (Homo sapiens) CpG-island No: 13674
  misc_feature (42)..(45): n is either a, c, g or t
taacccacgttacaaataaataccactttacgaattcgtaannnnaacaaaaataaaatataccgaacgtcccccatattaacgaccgttacgcccgtaaaacctattcgtacactttcgataataacaaaatctaatattcgcccctaaacatatccgctaaattacccgaaatttacgtacgacaaacataaacgattaatttttactaacccgatactcgtttcctcgacgtataattaacactacaaataacgacctaccaaaaaaaacaccgataccgccaaataaactcgccccgtataaacccgacgaacccgaaaaatattataaactatataccgtaaaaccacgccgcgtaaaataaaacaaacgctaaaaaatacgattaataacgcgccaatctaatttaccacgcctccgactaaacgcgcaacgattttacaccgcgctaccgtactaataaaaaaccaaatacaacaactaattaatattctaatacgtaaaaccgaaaaaaccttcaataacgccattaccgaaatacgcgaaacgatcgattttctccactactacgccgaacaaatacgaaataatttcgctaacgaaacccaccgtccattaaaacctataatatatatcaatccgtaaaacttcccgctaactattttcaccgaacaaatcgccgccgcactaacgacaaataacaacgtactaacaaaaccgacaaaacaaacgccgctaattaccgcgcaaaaaatcgccattttactaaaaacgaatataccgccaaacgtaatacaattactaccaaatcgaaataaaaccgtaaacgcgcaactaacgaataataatcgcgtacgcgaaataatatttaccgattcaaccgaaatcgctacgttactacaacgcaatatcgccaaccgcctaaacgctcaaaatcgccctattccgctcatcgctaaaaccgacgacataaacgcgataattatcgattcttcaacactaaccgaacaaatcgtcgtaaatatactaacctcgacgttcgaca

SEQ ID NO: 13675 - DNA, 1048 bp, Artificial Sequence
  chemically treated genomic DNA (Homo sapiens) CpG-island No: 13675
  misc_feature (42)..(45): n is either a, c, g or t
taatttacgttgtaggtaaatgttattttgcggattcgtggnnnnaatagaggtgaaatatatcgagcgttttttatgttagcgatcgttgcgttcgtgggatttgttcgtgtattttcggtggtggtagggtttggtattcgtttttggatatgttcgttggattgttcgggatttacgtacggtaaatatggacggttgatttttattaattcggtgttcgttttttcggcgtgtaattggtattgtaaatggcggtttgttaagggggatatcggtatcgttaggtagattcgtttcgtatagattcggcggattcgagagatattgtgggttatgtgtcgtgaagttacgtcgcgtgaagtagaataggcgttggaaagtgcggttaataacgcgttaatttggtttgttacgttttcggttgaacgcgtagcgattttgtatcgcgttgtcgtgttgatggaaagttagatgtagtaattgattggtattttggtgcgtgaggtcggaaaaatttttagtaacgttattgtcgaagtgcgcgaagcggtcgattttttttattattacgtcggataggtgcgggatgatttcgttaacgaaatttatcgtttattagggtttgtggtgtgtattagttcgtggaatttttcgttggttatttttatcgggtagatcgtcgtcgtattggcggtaggtaatagcgtgttggtaaaatcggtagaataaacgtcgttgattgtcgcgtaagggatcgttattttgttggaagcgggtgtatcgttaggcgtggtgtaattgttgttaggtcggggtgaaatcgtgggcgcgtaattgacgggtgatgatcgcgtgcgcggggtgatgtttatcggtttaatcgaagtcgttacgttattgtagcgtaatatcgttagtcgtttggacgtttagggtcgttttatttcgtttatcgttgaaatcggcggtatgaacgcgatgattgtcgattttttagtattgatcgaataggtcgtcgtggatgtattggtttcggcgttcgata

SEQ ID NO: 13676 - DNA, 1048 bp, Artificial Sequence
  chemically treated genomic DNA (Homo sapiens) CpG-island No: 13676
  misc_feature (1004)..(1007): n is either a, c, g or t
tatcgaacgccgaaaccaatacatccacgacgacctattcgatcaatactaaaaaatcgacaatcatcgcgttcataccgccgatttcaacgataaacgaaataaaacgaccctaaacgtccaaacgactaacgatattacgctacaataacgtaacgacttcgattaaaccgataaacatcaccccgcgcacgcgatcatcacccgtcaattacgcgcccacgatttcaccccgacctaacaacaattacaccacgcctaacgatacacccgcttccaacaaaataacgatcccttacgcgacaatcaacgacgtttattctaccgattttaccaacacgctattacctaccgccaatacgacgacgatctacccgataaaaataaccaacgaaaaattccacgaactaatacacaccacaaaccctaataaacgataaatttcgttaacgaaatcatcccgcacctatccgacgtaataataaaaaaaatcgaccgcttcgcgcacttcgacaataacgttactaaaaatttttccgacctcacgcaccaaaataccaatcaattactacatctaactttccatcaacacgacaacgcgatacaaaatcgctacgcgttcaaccgaaaacgtaacaaaccaaattaacgcgttattaaccgcactttccaacgcctattctacttcacgcgacgtaacttcacgacacataacccacaatatctctcgaatccgccgaatctatacgaaacgaatctacctaacgataccgatatcccccttaacaaaccgccatttacaataccaattacacgccgaaaaaacgaacaccgaattaataaaaatcaaccgtccatatttaccgtacgtaaatcccgaacaatccaacgaacatatccaaaaacgaataccaaaccctaccaccaccgaaaatacacgaacaaatcccacgaacgcaacgatcgctaacataaaaaacgctcgatatatttcacctctattnnnnccacgaatccgcaaaataacatttacctacaacgtaaatta

SEQ ID NO: 13677 - DNA, 519 bp, Artificial Sequence
  chemically treated genomic DNA (Homo sapiens) CpG-island No: 13677
gttggtcgcgacgaaacgtggtaaagcgttggtagtacggttaagtgtgtaattgaatgcggcgttggtgaacgatgttacggcggtggatattgtcgatggttatatttgcgtcgaatatcggatgtatggcgggttagcgttcgtttaggaaaagattaatagttcgttggcgattattatttttgtattcggtgtttaggaatcgtgtattagtgatattttttattagtgttcgatagaaacggtattttatgttgtttcgcgttatgaaattttttgtcgcgaacgtcgtgcgaaagtcgtaagtagcgtggatttgagtaaagtaaaacgtgtggttggcgtcggtcgtggattggcggcgtaggatgatttaaaaatggtttacgaattggcggcggtgttgaatgttgaagtcggttgtttacgtttaattgtcgaaggcgagaattggatggagcgtgaattgatgtaatattatattattttgtatcgtttttcgcgtgttttttttat

SEQ ID NO: 13678 - DNA, 519 bp, Artificial Sequence
  chemically treated genomic DNA (Homo sapiens) CpG-island No: 13678
ataaaaaaaacacgcgaaaaacgatacaaaataatataatattacatcaattcacgctccatccaattctcgccttcgacaattaaacgtaaacaaccgacttcaacattcaacaccgccgccaattcgtaaaccatttttaaatcatcctacgccgccaatccacgaccgacgccaaccacacgttttactttactcaaatccacgctacttacgactttcgcacgacgttcgcgacaaaaaatttcataacgcgaaacaacataaaataccgtttctatcgaacactaataaaaaatatcactaatacacgattcctaaacaccgaatacaaaaataataatcgccaacgaactattaatcttttcctaaacgaacgctaacccgccatacatccgatattcgacgcaaatataaccatcgacaatatccaccgccgtaacatcgttcaccaacgccgcattcaattacacacttaaccgtactaccaacgctttaccacgtttcgtcgcgaccaac

SEQ ID NO: 13679 - DNA, 519 bp, Artificial Sequence
  chemically treated genomic DNA (Homo sapiens) CpG-island No: 13679
gtgaagaggatacgcgaaaaacggtgtagggtaatgtgatgttgtattaatttacgttttatttagttttcgttttcggtaattggacgtgaatagtcgattttagtatttagtatcgtcgttagttcgtggattatttttaggttattttgcgtcgttagtttacgatcgacgttaattatacgttttgttttgtttaggtttacgttgtttgcggttttcgtacggcgttcgcgatagagaattttatgacgcggagtaatataaggtatcgtttttgtcgggtattgatgagaggtattattggtgtacggtttttgaatatcgggtgtaagggtaatgatcgttagcgggttgttgatttttttttgagcgaacgttaattcgttatatattcggtgttcggcgtaaatgtgattatcgataatatttatcgtcgtggtatcgtttattagcgtcgtatttagttgtatatttaatcgtgttgttagcgttttattacgtttcgtcgcggttaat

SEQ ID NO: 13680 - DNA, 519 bp, Artificial Sequence
  chemically treated genomic DNA (Homo sapiens) CpG-island No: 13680
attaaccgcgacgaaacgtaataaaacgctaacaacacgattaaatatacaactaaatacgacgctaataaacgataccacgacgataaatattatcgataatcacatttacgccgaacaccgaatatataacgaattaacgttcgctcaaaaaaaaatcaacaacccgctaacgatcattacccttacacccgatattcaaaaaccgtacaccaataatacctctcatcaatacccgacaaaaacgataccttatattactccgcgtcataaaattctctatcgcgaacgccgtacgaaaaccgcaaacaacgtaaacctaaacaaaacaaaacgtataattaacgtcgatcgtaaactaacgacgcaaaataacctaaaaataatccacgaactaacgacgatactaaatactaaaatcgactattcacgtccaattaccgaaaacgaaaactaaataaaacgtaaattaatacaacatcacattaccctacaccgtttttcgcgtatcctcttcac

SEQ ID NO: 13681 - DNA, 765 bp, Artificial Sequence
  chemically treated genomic DNA (Homo sapiens) CpG-island No: 13681
gtgacgtcgattaaagtgggcgatatttttttattgtgtatcgtttattagcgtttgtttgcgtttgatgtcgagatggacggtatcgttacgttgaaagagattaaagcgttaaattcggtaatttcggtgttgattatgattgcgtattttagcgtcgagacggcggtagaggtattgaaaattggggcgttggattattttattaagtcgttggatttcgataatttataggcgacgttggaaaaagcgttcgcgtatacgtatagtattgatgttgaaatatttgcggtgattgttagttagttcggtatggtcggtaaaagttcggcgatgtaatatttgtttagtgaaatcgttttcgtcgcgttatcggaagttacggtattgatttacggcgatttcggtatcggtaaagagttggtcgttagggcgatttacgttagtagcgtacgtagcgaaaaatcgttggtaacgtttaattgtgcggtatttaacgaatttttgttggaatttgaattgttcggttacgaaaaaggggcgtttattggagtcgataaacgtcgggaagggcgttttgttgaggcggacggcggtacgttgtttttcgatgaaattggcgatatttcgtcgatgatgtaggtgcgtttgttgcgtgcgatttaggagcgcgaagtttagcgtgtcggtagtaattagattatttcggttgattttgttattgggtatcggtaatttgattatttcggttttgtggttgttaga

SEQ ID NO: 13682 - DNA, 765 bp, Artificial Sequence
  chemically treated genomic DNA (Homo sapiens) CpG-island No: 13682
tctaacaaccacaaaaccgaaataatcaaattaccgatacccaataacaaaatcaaccgaaataatctaattactaccgacacgctaaacttcgcgctcctaaatcgcacgcaacaaacgcacctacatcatcgacgaaatatcgccaatttcatcgaaaaacaacgtaccgccgtccgcctcaacaaaacgcccttcccgacgtttatcgactccaataaacgcccctttttcgtaaccgaacaattcaaattccaacaaaaattcgttaaataccgcacaattaaacgttaccaacgatttttcgctacgtacgctactaacgtaaatcgccctaacgaccaactctttaccgataccgaaatcgccgtaaatcaataccgtaacttccgataacgcgacgaaaacgatttcactaaacaaatattacatcgccgaacttttaccgaccataccgaactaactaacaatcaccgcaaatatttcaacatcaatactatacgtatacgcgaacgctttttccaacgtcgcctataaattatcgaaatccaacgacttaataaaataatccaacgccccaattttcaatacctctaccgccgtctcgacgctaaaatacgcaatcataatcaacaccgaaattaccgaatttaacgctttaatctctttcaacgtaacgataccgtccatctcgacatcaaacgcaaacaaacgctaataaacgatacacaataaaaaaatatcgcccactttaatcgacgtcac

SEQ ID NO: 13683 - DNA, 765 bp, Artificial Sequence
  chemically treated genomic DNA (Homo sapiens) CpG-island No: 13683
tttggtaattataaaatcgagatagttaggttatcgatatttagtggtaggattaatcgagataatttggttgttatcgatacgttgaatttcgcgtttttgaatcgtacgtagtagacgtatttgtattatcggcgagatatcgttaattttatcgagaaatagcgtgtcgtcgttcgttttaataaagcgtttttttcggcgtttatcggttttagtaaacgtttttttttcgtgatcgaataatttagattttagtaaggattcgttgagtgtcgtatagttgagcgttattagcggtttttcgttacgtgcgttattggcgtgaatcgttttggcgattagttttttatcggtgtcggaatcgtcgtggattagtatcgtggttttcgatggcgcgacgagggcgattttattgagtaggtgttgtatcgtcgggtttttatcgattatatcgaattggttggtagttatcgtaggtgttttagtattaatattgtgcgtatgcgcgagcgttttttttagcgtcgtttgtaggttatcgaaatttagcggtttgatgagataatttagcgttttagtttttagtgtttttatcgtcgtttcgacgttggagtacgtagttataattagtatcggaattgtcgggtttaacgttttgattttttttagcgtggcgatgtcgtttatttcggtattaagcgtaaataggcgttggtgagcggtatatagtaaaggggtgtcgtttattttaatcggcgttat

SEQ ID NO: 13684 - DNA, 765 bp, Artificial Sequence
  chemically treated genomic DNA (Homo sapiens) CpG-island No: 13684
ataacgccgattaaaataaacgacacccctttactatataccgctcaccaacgcctatttacgcttaataccgaaataaacgacatcgccacgctaaaaaaaatcaaaacgttaaacccgacaattccgatactaattataactacgtactccaacgtcgaaacgacgataaaaacactaaaaactaaaacgctaaattatctcatcaaaccgctaaatttcgataacctacaaacgacgctaaaaaaaacgctcgcgcatacgcacaatattaatactaaaacacctacgataactaccaaccaattcgatataatcgataaaaacccgacgatacaacacctactcaataaaatcgccctcgtcgcgccatcgaaaaccacgatactaatccacgacgattccgacaccgataaaaaactaatcgccaaaacgattcacgccaataacgcacgtaacgaaaaaccgctaataacgctcaactatacgacactcaacgaatccttactaaaatctaaattattcgatcacgaaaaaaaaacgtttactaaaaccgataaacgccgaaaaaaacgctttattaaaacgaacgacgacacgctatttctcgataaaattaacgatatctcgccgataatacaaatacgtctactacgtacgattcaaaaacgcgaaattcaacgtatcgataacaaccaaattatctcgattaatcctaccactaaatatcgataacctaactatctcgattttataattaccaaa

SEQ ID NO: 13685 - DNA, 603 bp, Artificial Sequence
  chemically treated genomic DNA (Homo sapiens) CpG-island No: 13685
agtcgcgtagatcggtggttagtaatgcgttaacgacgtttaacggaataattaatattatcgagaacggaattgattagtttttatagagtgcggcgagggcgaggaatattacgattagtgaaatcgtatatagcgtaggagtttgatttgaggataacgttttttgatacgatagttcggtttatgagtagtcgacgtttgtcggaagtttagcgattaggtttgttataaattttatggcgttatcggtatttttttcggtcgtcgttttatttaaaatttttattgacgggatgtcgttgtagcgttttagtcgcggtgaattataggtttattcggtagacgagtaggtagaaagcggtgttatcgtgttagaggcgttgcgtatatattattggttgatgttattcggtaatatacggaacggcgtgtttgtttggatatatattttttttattcgtttttggttgaggaagtcgtttacgtagttgttgtcgaaggcggtggaaattgtttggttgatattagatagcgttacgtttatcgttttagttttcgtagcgttgacgtttattttgaatatggtatcgcggtaatata

SEQ ID NO: 13686 - DNA, 603 bp, Artificial Sequence
  chemically treated genomic DNA (Homo sapiens) CpG-island No: 13686
tatattaccgcgataccatattcaaaataaacgtcaacgctacgaaaactaaaacgataaacgtaacgctatctaatatcaaccaaacaatttccaccgccttcgacaacaactacgtaaacgacttcctcaaccaaaaacgaataaaaaaaatatatatccaaacaaacacgccgttccgtatattaccgaataacatcaaccaataatatatacgcaacgcctctaacacgataacaccgctttctacctactcgtctaccgaataaacctataattcaccgcgactaaaacgctacaacgacatcccgtcaataaaaattttaaataaaacgacgaccgaaaaaaataccgataacgccataaaatttataacaaacctaatcgctaaacttccgacaaacgtcgactactcataaaccgaactatcgtatcaaaaaacgttatcctcaaatcaaactcctacgctatatacgatttcactaatcgtaatattcctcgccctcgccgcactctataaaaactaatcaattccgttctcgataatattaattattccgttaaacgtcgttaacgcattactaaccaccgatctacgcgact

SEQ ID NO: 13687 - DNA, 603 bp, Artificial Sequence
  chemically treated genomic DNA (Homo sapiens) CpG-island No: 13687
tatattgtcgcggtattatgtttaaagtgaacgttaacgttgcgaaagttgaagcgatgggcgtggcgttgtttgatattaattagataatttttatcgttttcggtagtagttacgtgaacgatttttttaattaggggcgggtgaaaaaagtgtatgtttaggtaggtacgtcgtttcgtatgttgtcggataatattaattaatggtatgtacgtaacgtttttggtacgatggtatcgttttttgtttattcgtttatcgaatggatttatggtttatcgcgattggaacgttataacggtatttcgttaatggagattttaggtgaagcggcggtcgggaaaagtatcggtgacgttatgaaatttatggtagatttggtcgttaaattttcggtaggcgtcggttatttatggatcggattatcgtattaggaagcgttatttttaaattaggtttttgcgttgtatgcgattttattggtcgtggtgtttttcgttttcgtcgtattttatgagagttggttaatttcgttttcggtgatgttggttgtttcgttaggcgtcgttggcgtattattggttatcgatttgcgcggtt

SEQ ID NO: 13688 - DNA, 603 bp, Artificial Sequence
  chemically treated genomic DNA (Homo sapiens) CpG-island No: 13688
aaccgcgcaaatcgataaccaataatacgccaacgacgcctaacgaaacaaccaacatcaccgaaaacgaaattaaccaactctcataaaatacgacgaaaacgaaaaacaccacgaccaataaaatcgcatacaacgcaaaaacctaatttaaaaataacgcttcctaatacgataatccgatccataaataaccgacgcctaccgaaaatttaacgaccaaatctaccataaatttcataacgtcaccgatacttttcccgaccgccgcttcacctaaaatctccattaacgaaataccgttataacgttccaatcgcgataaaccataaatccattcgataaacgaataaacaaaaaacgataccatcgtaccaaaaacgttacgtacataccattaattaatattatccgacaacatacgaaacgacgtacctacctaaacatacacttttttcacccgcccctaattaaaaaaatcgttcacgtaactactaccgaaaacgataaaaattatctaattaatatcaaacaacgccacgcccatcgcttcaactttcgcaacgttaacgttcactttaaacataataccgcgacaatata

SEQ ID NO: 13689 - DNA, 705 bp, Artificial Sequence
  chemically treated genomic DNA (Homo sapiens) CpG-island No: 13689
  misc_feature (467)..(468): n is either a, c, g or t
  misc_feature (565)..(565): n is either a, c, g or t
ttgtcgcgagggattttcgttcgtttttcgttttcgtttttcggtgttcgaagttttcgaggttagggtttcggggaaggagcggcgttaggtagtattaggtgtagtcgttttcgtttcgttagcggttatttttttagatttagtaattttatttcgtttagtagcgtggggggcggcgagggcggcgttgtagttgtttttggcggcgtttttcgcgtttttcggtttcggttcgttatcgttcgcgtcgaagaagtttgttgtcggtttgaagtagacgaagggcgtttcgggtggttgcgtaggttgtaaagtagggagggcgcggggttaggtaggtagaaggtgttcgggaacgcggggttggagtatcgtcgttgttattatcgttgtcgttatcgtttttcgcgtttagcgtagttcgagttttaggttttttgaggcgcggcggtggttgcgggcgnnggggtttcgaggatttaaaggttgtaggtttagcggggcggcgcggcgggcggcgcggcggtatagtagtaagggttgggcggcggcgcgttggttnttgatttcgtagttgttcgttttgtttttttattttgcgtattagtttttgtagtttttttatttttagtttcgcgtttaatatcggttcggagttcgttttagagttgatttttgtcgaggcgtattttatttgtttcg

SEQ ID NO: 13690 - DNA, 705 bp, Artificial Sequence
  chemically treated genomic DNA (Homo sapiens) CpG-island No: 13690
  misc_feature (141)..(141): n is either a, c, g or t
  misc_feature (238)..(239): n is either a, c, g or t
cgaaacaaataaaatacgcctcgacaaaaatcaactctaaaacgaactccgaaccgatattaaacgcgaaactaaaaataaaaaaactacaaaaactaatacgcaaaataaaaaaacaaaacgaacaactacgaaatcaanaaccaacgcgccgccgcccaacccttactactataccgccgcgccgcccgccgcgccgccccgctaaacctacaacctttaaatcctcgaaaccccnncgcccgcaaccaccgccgcgcctcaaaaaacctaaaactcgaactacgctaaacgcgaaaaacgataacgacaacgataataacaacgacgatactccaaccccgcgttcccgaacaccttctacctacctaaccccgcgccctccctactttacaacctacgcaaccacccgaaacgcccttcgtctacttcaaaccgacaacaaacttcttcgacgcgaacgataacgaaccgaaaccgaaaaacgcgaaaaacgccgccaaaaacaactacaacgccgccctcgccgccccccacgctactaaacgaaataaaattactaaatctaaaaaaataaccgctaacgaaacgaaaacgactacacctaatactacctaacgccgctccttccccgaaaccctaacctcgaaaacttcgaacaccgaaaaacgaaaacgaaaaacgaacgaaaatccctcgcgacaa

SEQ ID NO: 13691 - DNA, 705 bp, Artificial Sequence
  chemically treated genomic DNA (Homo sapiens) CpG-island No: 13691
  misc_feature (141)..(141): n is either a, c, g or t
  misc_feature (238)..(239): n is either a, c, g or t
cggagtaggtgaaatgcgtttcggtaggggttagttttggagcgggtttcgggtcggtgttgaacgcggagttggaggtgaagaagttgtaggagttggtgcgtaagatggagaagtagaacgagtagttgcggagttagnagttagcgcgtcgtcgtttagtttttgttgttgtgtcgtcgcgtcgttcgtcgcgtcgtttcgttaggtttgtagtttttgggttttcggagttttnncgttcgtagttatcgtcgcgttttagggggtttggggttcgggttgcgttgggcgcggggggcggtggcggtagcggtagtggtagcggcggtgttttagtttcgcgttttcgggtattttttgtttgtttagtttcgcgttttttttgttttgtagtttgcgtagttattcgaggcgtttttcgtttattttaagtcggtagtaggttttttcggcgcgggcggtggcgggtcggagtcggggggcgcggggaacgtcgttaggggtagttgtagcgtcgttttcgtcgttttttacgttgttggacgaggtggaattgttggatttggagaggtagtcgttggcgggacgaggacgattatatttggtattgtttagcgtcgtttttttttcgagattttggtttcgggggtttcgggtatcggggagcgggggcggggggcggacgggggtttttcgcggtag

SEQ ID NO: 13692 - DNA, 705 bp, Artificial Sequence
  chemically treated genomic DNA (Homo sapiens) CpG-island No: 13692
  misc_feature (467)..(468): n is either a, c, g or t
  misc_feature (565)..(565): n is either a, c, g or t
ctaccgcgaaaaacccccgtccgccccccgcccccgctccccgatacccgaaacccccgaaaccaaaatctcgaaaaaaaaacgacgctaaacaataccaaatataatcgtcctcgtcccgccaacgactacctctccaaatccaacaattccacctcgtccaacaacgtaaaaaacgacgaaaacgacgctacaactacccctaacgacgttccccgcgccccccgactccgacccgccaccgcccgcgccgaaaaaacctactaccgacttaaaataaacgaaaaacgcctcgaataactacgcaaactacaaaacaaaaaaaacgcgaaactaaacaaacaaaaaatacccgaaaacgcgaaactaaaacaccgccgctaccactaccgctaccgccaccgccccccgcgcccaacgcaacccgaaccccaaaccccctaaaacgcgacgataactacgaacgnnaaaactccgaaaacccaaaaactacaaacctaacgaaacgacgcgacgaacgacgcgacgacacaacaacaaaaactaaacgacgacgcgctaactnctaactccgcaactactcgttctacttctccatcttacgcaccaactcctacaacttcttcacctccaactccgcgttcaacaccgacccgaaacccgctccaaaactaacccctaccgaaacgcatttcacctactccg

SEQ ID NO: 13693 - DNA, 544 bp, Artificial Sequence
  chemically treated genomic DNA (Homo sapiens) CpG-island No: 13693
tggttggggtcgcgtgtgagagattggttggtcgcgagcgaaggggttgtagttcggggttgcgaggtcgcggttagggggcgagaggtatgggatgggatttgggtcgacgggggcgttgggttgatggttttcgtgattacgggggtggcgttcggttatgggcgtcggcggagtttagtcgtcgtgggtgtgggatggttgaagagggtcgttggttaaagtgtgggatgcgagtaaggtaaggcgcgcgtgggtatcgatggaggggaggggattgttttgggagggagtagcgtggaggagtgcggcgatggcgggaggtgtgggcgttagtgttaggggcggcgcggttttggagttgacgtcgtggattggggaggttgggggggcgcgttgtgtgaaggggtagcgtgggggcggttttgggggggaggttgggtggggcgggtaggtggagtgtggggggattgtgtggggtataggtggcggtgtattgtgagataggtggggttgtagggtttcgggggttatggagaggtta

SEQ ID NO: 13694 - DNA, 544 bp, Artificial Sequence
  chemically treated genomic DNA (Homo sapiens) CpG-island No: 13694
taacctctccataacccccgaaaccctacaaccccacctatctcacaatacaccgccacctataccccacacaatccccccacactccacctacccgccccacccaacctcccccccaaaaccgcccccacgctaccccttcacacaacgcgcccccccaacctccccaatccacgacgtcaactccaaaaccgcgccgcccctaacactaacgcccacacctcccgccatcgccgcactcctccacgctactccctcccaaaacaatcccctcccctccatcgatacccacgcgcgccttaccttactcgcatcccacactttaaccaacgaccctcttcaaccatcccacacccacgacgactaaactccgccgacgcccataaccgaacgccacccccgtaatcacgaaaaccatcaacccaacgcccccgtcgacccaaatcccatcccatacctctcgccccctaaccgcgacctcgcaaccccgaactacaaccccttcgctcgcgaccaaccaatctctcacacgcgaccccaacca

SEQ ID NO: 13695 - DNA, 544 bp, Artificial Sequence
  chemically treated genomic DNA (Homo sapiens) CpG-island No: 13695
taatttttttataattttcgaaattttataattttatttattttataatatatcgttatttatgttttatataatttttttatattttatttattcgttttatttaattttttttttaaaatcgtttttacgttatttttttatataacgcgtttttttaatttttttaatttacggcgttagttttaaggtcgcgtcgtttttaatattaacgtttatatttttcgttatcgtcgtatttttttacgttgtttttttttagggtagtttttttttttttatcggtatttacgcgcgttttattttgttcgtattttatattttggttaacggttttttttagttattttatatttacgacggttggatttcgtcggcgtttataatcgggcgttattttcgtagttacgaggattattaatttagcgttttcgtcggtttaaattttattttatatttttcgttttttgatcgcggtttcgtaatttcgggttatagttttttcgttcgcggttaattaattttttatacgcggttttaatta

SEQ ID NO: 13696 - DNA, 544 bp, Artificial Sequence
  chemically treated genomic DNA (Homo sapiens) CpG-island No: 13696
taattaaaaccgcgtataaaaaattaattaaccgcgaacgaaaaaactataacccgaaattacgaaaccgcgatcaaaaaacgaaaaatataaaataaaatttaaaccgacgaaaacgctaaattaataatcctcgtaactacgaaaataacgcccgattataaacgccgacgaaatccaaccgtcgtaaatataaaataactaaaaaaaaccgttaaccaaaatataaaatacgaacaaaataaaacgcgcgtaaataccgataaaaaaaaaaaaactaccctaaaaaaaaacaacgtaaaaaaatacgacgataacgaaaaatataaacgttaatattaaaaacgacgcgaccttaaaactaacgccgtaaattaaaaaaattaaaaaaacgcgttatataaaaaaataacgtaaaaacgattttaaaaaaaaaattaaataaaacgaataaataaaatataaaaaaattatataaaacataaataacgatatattataaaataaataaaattataaaatttcgaaaattataaaaaaatta

SEQ ID NO: 13697 - DNA, 620 bp, Artificial Sequence
  chemically treated genomic DNA (Homo sapiens) CpG-island No: 13697
gcgcggttttacgtcgtagaggttaaattaatttcgttattaaggtttcgtttatacgtttagagtttcgtttacgaggagagaggcgtcgttatatcgttaaggtttcgttttcgtttacgcgtaacgttatgatttcgtttataatggttttttttagttatcgttaaggatttcgttttacgtcgagggtttgtttttaggtttcgtttttcgaggtttcgtttttcggtttcgtttttagtcgtttagttttcgggagtggcggtagttgggtagaggcgtagcgatattttcgttttcgaggtttttgtcgaagcgtagagtcgttttgtttcgtagtcgacgggtttcgttttacgtttatcgtcgaggttcgcggtcgtcggtaagtgtggttttcgcgggttcggagcggtagaggcgtagagttcgggcggtggcgcgtttgttgtagtgcgggtacggtcgcgcgtgggtgtgggttttagattcggttttttgcgtttggtagggttcgtgcgagcgggtttcgggtcgtaggtggaggtcgaatggttatcgttgttagtttagtcggtttagggtcgttttggaagtttagtttttgttgggtaggg

SEQ ID NO: 13698 - DNA, 620 bp, Artificial Sequence
  chemically treated genomic DNA (Homo sapiens) CpG-island No: 13698
ccctacccaacaaaaactaaacttccaaaacgaccctaaaccgactaaactaacaacgataaccattcgacctccacctacgacccgaaacccgctcgcacgaaccctaccaaacgcaaaaaaccgaatctaaaacccacacccacgcgcgaccgtacccgcactacaacaaacgcgccaccgcccgaactctacgcctctaccgctccgaacccgcgaaaaccacacttaccgacgaccgcgaacctcgacgataaacgtaaaacgaaacccgtcgactacgaaacaaaacgactctacgcttcgacaaaaacctcgaaaacgaaaatatcgctacgcctctacccaactaccgccactcccgaaaactaaacgactaaaaacgaaaccgaaaaacgaaacctcgaaaaacgaaacctaaaaacaaaccctcgacgtaaaacgaaatccttaacgataactaaaaaaaaccattataaacgaaatcataacgttacgcgtaaacgaaaacgaaaccttaacgatataacgacgcctctctcctcgtaaacgaaactctaaacgtataaacgaaaccttaataacgaaattaatttaacctctacgacgtaaaaccgcgc

SEQ ID NO: 13699 - DNA, 620 bp, Artificial Sequence
  chemically treated genomic DNA (Homo sapiens) CpG-island No: 13699
ttttgtttaataaaggttgagtttttagaacggttttgggtcggttaggttgatagcggtggttattcgatttttatttgcggttcgaggttcgttcgtacggattttgttaggcgtagaaggtcgggtttgaagtttatatttacgcgcggtcgtattcgtattgtagtagacgcgttatcgttcgagttttacgtttttgtcgtttcgggttcgcggggattatatttatcggcggtcgcggatttcggcggtgggcgtgggacggagttcgtcggttgcgggataaggcggttttgcgtttcggtagagatttcgaaggcggaggtatcgttgcgtttttgtttagttgtcgttattttcgggaattgggcggttgggggcggggtcggaaggcgggatttcggggggcgggatttggaggtaggttttcggcgtggggcggggtttttagcggtgattgggaggggttattgtaggcggggttatgacgttgcgcgtgaacgggggcggagttttaacggtatggcggcgttttttttttcgtgggcgggattttaggcgtgtgggcggggttttggtggcggggttggtttggtttttgcggcgtggggtcgcgt

SEQ ID NO: 13700 - DNA, 620 bp, Artificial Sequence
  chemically treated genomic DNA (Homo sapiens) CpG-island No: 13700
acgcgaccccacgccgcaaaaaccaaaccaaccccgccaccaaaaccccgcccacacgcctaaaatcccgcccacgaaaaaaaaaacgccgccataccgttaaaactccgcccccgttcacgcgcaacgtcataaccccgcctacaataacccctcccaatcaccgctaaaaaccccgccccacgccgaaaacctacctccaaatcccgccccccgaaatcccgccttccgaccccgcccccaaccgcccaattcccgaaaataacgacaactaaacaaaaacgcaacgatacctccgccttcgaaatctctaccgaaacgcaaaaccgccttatcccgcaaccgacgaactccgtcccacgcccaccgccgaaatccgcgaccgccgataaatataatccccgcgaacccgaaacgacaaaaacgtaaaactcgaacgataacgcgtctactacaatacgaatacgaccgcgcgtaaatataaacttcaaacccgaccttctacgcctaacaaaatccgtacgaacgaacctcgaaccgcaaataaaaatcgaataaccaccgctatcaacctaaccgacccaaaaccgttctaaaaactcaacctttattaaacaaaa

SEQ ID NO: 13701 - DNA, 926 bp, Artificial Sequence
  chemically treated genomic DNA (Homo sapiens) CpG-island No: 13701
gtgggggaagggtgcggaaaacgttttcggacggtagcgatagaggtttttttttttgggttagcgcgcgacggcggggataagggaggttacgtcggtttgtagtagtttcgaggtttcgatttcggtttcggattttgttcggatagggttttcgattttttcggcggcgcgggcgggaaacggcggggggcgcgtagagggttatttttcgtttttcggtttagaggtttagcgggtggataaacggtattaggcgttcgtttcgtcgcgatttagtagtttatttcgagcgtcgcggatttggtcggggtacgaattacgggcgttagacgtaagggttcgggcgttagcgcgtcgtcgatttatatttttttacgcggtgtttattttgtttggggggtgcggcggtgacgtagttacgaggttttcgcggtcgggttggggaaagagggaggggagaggaggagggagtcgggttcgggtaggtgcgtacgtttaggtgcgagagaggaagcgagaggaaggagaggggtagagggacgagggatacgaggttgatagaaagcgagcgatacgggagcggggaggggcgggaataatttaggggcgaggtttgagcggggcgtcgagcggaaggggcgggagtttttaagataggcgttgttattttcggtaggtagcggcgtgtattggcggaacggcgtaaaggagcgaagtaattgataggggcgcgggaattattcgtcgtaagtaatatgggtatcgttagattgcgcgttacggggttaaataaacgggacgattggaggggattgaggtaaacggggcgcgtcgtttgttttaattatatttgtaatagaggagaaagtcggtagggaggagaggtaagtaggagtattaggtgagtaggcgagagaggagag

SEQ ID NO: 13702 - DNA, 926 bp, Artificial Sequence
  chemically treated genomic DNA (Homo sapiens) CpG-island No: 13702
ctctcctctctcgcctactcacctaatactcctacttacctctcctccctaccgactttctcctctattacaaatataattaaaacaaacgacgcgccccgtttacctcaatcccctccaatcgtcccgtttatttaaccccgtaacgcgcaatctaacgatacccatattacttacgacgaataattcccgcgcccctatcaattacttcgctcctttacgccgttccgccaatacacgccgctacctaccgaaaataacaacgcctatcttaaaaactcccgccccttccgctcgacgccccgctcaaacctcgcccctaaattattcccgcccctccccgctcccgtatcgctcgctttctatcaacctcgtatccctcgtccctctacccctctccttcctctcgcttcctctctcgcacctaaacgtacgcacctacccgaacccgactccctcctcctctcccctccctctttccccaacccgaccgcgaaaacctcgtaactacgtcaccgccgcaccccccaaacaaaataaacaccgcgtaaaaaaatataaatcgacgacgcgctaacgcccgaacccttacgtctaacgcccgtaattcgtaccccgaccaaatccgcgacgctcgaaataaactactaaatcgcgacgaaacgaacgcctaataccgtttatccacccgctaaacctctaaaccgaaaaacgaaaaataaccctctacgcgccccccgccgtttcccgcccgcgccgccgaaaaaatcgaaaaccctatccgaacaaaatccgaaaccgaaatcgaaacctcgaaactactacaaaccgacgtaacctcccttatccccgccgtcgcgcgctaacccaaaaaaaaaaacctctatcgctaccgtccgaaaacgttttccgcacccttcccccac

SEQ ID NO: 13703 - DNA, 926 bp, Artificial Sequence
  chemically treated genomic DNA (Homo sapiens) CpG-island No: 13703
tttttttttttcgtttatttatttgatatttttgtttgttttttttttttgtcggtttttttttttgttgtagatatgattaaagtagacgacgcgtttcgtttgttttaattttttttagtcgtttcgtttgtttggtttcgtggcgcgtagtttggcggtatttatgttgtttgcgacggatgattttcgcgtttttattagttgtttcgtttttttgcgtcgtttcgttagtgtacgtcgttgtttgtcggaagtgatagcgtttgttttgggagttttcgtttttttcgttcggcgtttcgtttaggtttcgtttttaggttgttttcgttttttttcgttttcgtgtcgttcgttttttgttagtttcgtgtttttcgtttttttgttttttttttttttttcgttttttttttcgtatttgagcgtacgtatttgttcgggttcggtttttttttttttttttttttttttttttttagttcggtcgcgggagtttcgtggttgcgttatcgtcgtattttttagataagatggatatcgcgtgaggaagtgtaagtcggcgacgcgttggcgttcgagtttttgcgtttggcgttcgtggttcgtatttcggttaggttcgcggcgttcgaggtgggttgttggatcgcggcggggcggacgtttggtgtcgtttgtttattcgttgggtttttgggtcggggagcggaaggtgattttttgcgcgtttttcgtcgtttttcgttcgcgtcgtcgagggggtcggggattttgttcgggtagggttcggggtcggggtcggggtttcggggttattgtaggtcggcgtggttttttttgttttcgtcgtcgcgcgttggtttagaaaagggggtttttgtcgttgtcgttcgggggcgtttttcgtattttttttttat

SEQ ID NO: 13704 - DNA, 926 bp, Artificial Sequence
  chemically treated genomic DNA (Homo sapiens) CpG-island No: 13704
ataaaaaaaaaatacgaaaaacgcccccgaacgacaacgacaaaaacccccttttctaaaccaacgcgcgacgacgaaaacaaaaaaaaccacgccgacctacaataaccccgaaaccccgaccccgaccccgaaccctacccgaacaaaatccccgaccccctcgacgacgcgaacgaaaaacgacgaaaaacgcgcaaaaaatcaccttccgctccccgacccaaaaacccaacgaataaacaaacgacaccaaacgtccgccccgccgcgatccaacaacccacctcgaacgccgcgaacctaaccgaaatacgaaccacgaacgccaaacgcaaaaactcgaacgccaacgcgtcgccgacttacacttcctcacgcgatatccatcttatctaaaaaatacgacgataacgcaaccacgaaactcccgcgaccgaactaaaaaaaaaaaaaaaaaaaaaaaaaaaaaaaccgaacccgaacaaatacgtacgctcaaatacgaaaaaaaaaacgaaaaaaaaaaaaaaaacaaaaaaacgaaaaacacgaaactaacaaaaaacgaacgacacgaaaacgaaaaaaaacgaaaacaacctaaaaacgaaacctaaacgaaacgccgaacgaaaaaaacgaaaactcccaaaacaaacgctatcacttccgacaaacaacgacgtacactaacgaaacgacgcaaaaaaacgaaacaactaataaaaacgcgaaaatcatccgtcgcaaacaacataaataccgccaaactacgcgccacgaaaccaaacaaacgaaacgactaaaaaaaattaaaacaaacgaaacgcgtcgtctactttaatcatatctacaacaaaaaaaaaaaccgacaaaaaaaaaaaacaaacaaaaatatcaaataaataaacgaaaaaaaaaaa

SEQ ID NO: 13705 - DNA, 700 bp, Artificial Sequence
  chemically treated genomic DNA (Homo sapiens) CpG-island No: 13705
gcgtttagcgttaggttcgcggattattagagggttatcgcgatattagcggttttcgatggtaaagacgttatcgtacggtagtagtgatgttaacggatgatttttacgtatcgtttttacgtttatacgcgttttatcgttggtatcgaaacgcgttacgtagcgtagtattagttttatttcgcgggtcgtttttagtcgttgtattatttgttcgtttagtttatcgttatttttaaagaaatggtcgatgttgtcgttttcgtaatgagtaggtattagcgattttatacgtatttgattcggttcgatgttgtaatttgttttacgcgttagaattattagtttgcgtattacgtttttgttagagagatcgttacgcgggttaggttcggttaagttttgttgttacgtttgatttattagttcggtaaacggtacgttatcgtcgaattgtaggaatagttaggagagcgtgtcggagaagatttcgttgatcgataaaatagtatcgtcgttgtcgattagatcgcgtacgggtggttattcggtaagttcgtatcgacgggtgtgtttgtacgtttagtatgatttcgcgttttaaagcgttgtaattcgataatatttataggaggggtttttttaatgtggcgcgaatagtgaatagggggggatatattatgttcgcgtgtgggga

SEQ ID NO: 13706 - DNA, 700 bp, Artificial Sequence
  chemically treated genomic DNA (Homo sapiens) CpG-island No: 13706
tccccacacgcgaacataatatatccccccctattcactattcgcgccacattaaaaaaacccctcctataaatattatcgaattacaacgctttaaaacgcgaaatcatactaaacgtacaaacacacccgtcgatacgaacttaccgaataaccacccgtacgcgatctaatcgacaacgacgatactattttatcgatcaacgaaatcttctccgacacgctctcctaactattcctacaattcgacgataacgtaccgtttaccgaactaataaatcaaacgtaacaacaaaacttaaccgaacctaacccgcgtaacgatctctctaacaaaaacgtaatacgcaaactaataattctaacgcgtaaaacaaattacaacatcgaaccgaatcaaatacgtataaaatcgctaatacctactcattacgaaaacgacaacatcgaccatttctttaaaaataacgataaactaaacgaacaaataatacaacgactaaaaacgacccgcgaaataaaactaatactacgctacgtaacgcgtttcgataccaacgataaaacgcgtataaacgtaaaaacgatacgtaaaaatcatccgttaacatcactactaccgtacgataacgtctttaccatcgaaaaccgctaatatcgcgataaccctctaataatccgcgaacctaacgctaaacgc

SEQ ID NO: 13707 - DNA, 700 bp, Artificial Sequence
  chemically treated genomic DNA (Homo sapiens) CpG-island No: 13707
tttttatacgcgaatatgatgtgtttttttttgtttattgttcgcgttatattggggggattttttttataaatattgtcgagttatagcgttttgaaacgcggggttatattgggcgtataaatatattcgtcggtgcgggtttgtcgaataattattcgtgcgcgatttgatcgatagcggcgatattattttgtcgattagcgggatttttttcggtacgtttttttggttgtttttgtaattcgacggtagcgtgtcgtttatcgagttggtggattaggcgtggtagtagggtttaatcgaatttgattcgcgtgacgatttttttggtaaagacgtgatgcgtaagttggtgattttggcgcgtgaagtaggttataatatcgaatcggattaggtacgtgtggaatcgttggtgtttgtttattgcgaaggcggtagtatcgattatttttttgaaaatggcgatgaattgaacgagtagatggtgtaacggttggaagcggttcgcgaaatggggttggtgttgcgttacgtggcgcgtttcgatgttaacggtaaagcgcgtgtaggcgtggaagcggtgcgtgaagattattcgttggtattattgttgtcgtgcgataacgtttttgttatcgaaagtcgttggtatcgcgataattttttggtgattcgcggatttggcgttgggcgt

SEQ ID NO: 13708 - DNA, 700 bp, Artificial Sequence
  chemically treated genomic DNA (Homo sapiens) CpG-island No: 13708
acgcccaacgccaaatccgcgaatcaccaaaaaattatcgcgataccaacgactttcgataacaaaaacgttatcgcacgacaacaataataccaacgaataatcttcacgcaccgcttccacgcctacacgcgctttaccgttaacatcgaaacgcgccacgtaacgcaacaccaaccccatttcgcgaaccgcttccaaccgttacaccatctactcgttcaattcatcgccattttcaaaaaaataatcgatactaccgccttcgcaataaacaaacaccaacgattccacacgtacctaatccgattcgatattataacctacttcacgcgccaaaatcaccaacttacgcatcacgtctttaccaaaaaaatcgtcacgcgaatcaaattcgattaaaccctactaccacgcctaatccaccaactcgataaacgacacgctaccgtcgaattacaaaaacaaccaaaaaaacgtaccgaaaaaaatcccgctaatcgacaaaataatatcgccgctatcgatcaaatcgcgcacgaataattattcgacaaacccgcaccgacgaatatatttatacgcccaatataaccccgcgtttcaaaacgctataactcgacaatatttataaaaaaaatccccccaatataacgcgaacaataaacaaaaaaaaacacatcatattcgcgtataaaaa

SEQ ID NO: 13709 - DNA, 755 bp, Artificial Sequence
  chemically treated genomic DNA (Homo sapiens) CpG-island No: 13709
gttgtcggtatcgaagcgcgtggttttttgtttggcgtttcggtagttttgggtttgggcgttggttttgtatcggttcgtaaatcgggtaaattgtcgcgtgaaattattagtgaaatttacgatttggaatacggtatcgattagttggagatttacgttgatgttattaaatcgggcgataaagttttggtggtggacgatttgttggtaatcggcggtattatcgaagcgatcgttaaattgattcgtcgtttgggtggtgaagtggttgacgttgcgtttattattaatttgttcgatttcggcggcgaatagcgtttcgaaaaatagggtattattagttatagttttgtttcgttttcgggttattaattatcgttagttttgtgttgtttacgttacggatagtataagatgtgtatttagtttcgtcgttttgacggggttgtgttagtattattttttcgtgaatttattttttagcgttttagagtttgttaatgagttattaggttttagttcgaaaatggcgtttataaatttttgttgacgtcgtcggttaggaatatgtgttgatcgtattggcgaacggtttgtcgttagggcgtatttattatgtttatttttttttcggtattcgtggcgtcggaaaaatttttattcgtttcgattgttggcgaaggggttaaattgcgaaattcggtattatcgcgacgtcgtgcggcgtgtgcgataattgtcgtgaaatcgag

SEQ ID NO: 13710 - DNA, 755 bp, Artificial Sequence
  chemically treated genomic DNA (Homo sapiens) CpG-island No: 13710
ctcgatttcacgacaattatcgcacacgccgcacgacgtcgcgataataccgaatttcgcaatttaaccccttcgccaacaatcgaaacgaataaaaatttttccgacgccacgaataccgaaaaaaaaataaacataataaatacgccctaacgacaaaccgttcgccaatacgatcaacacatattcctaaccgacgacgtcaacaaaaatttataaacgccattttcgaactaaaacctaataactcattaacaaactctaaaacgctaaaaaataaattcacgaaaaaataatactaacacaaccccgtcaaaacgacgaaactaaatacacatcttatactatccgtaacgtaaacaacacaaaactaacgataattaataacccgaaaacgaaacaaaactataactaataataccctatttttcgaaacgctattcgccgccgaaatcgaacaaattaataataaacgcaacgtcaaccacttcaccacccaaacgacgaatcaatttaacgatcgcttcgataataccgccgattaccaacaaatcgtccaccaccaaaactttatcgcccgatttaataacatcaacgtaaatctccaactaatcgataccgtattccaaatcgtaaatttcactaataatttcacgcgacaatttacccgatttacgaaccgatacaaaaccaacgcccaaacccaaaactaccgaaacgccaaacaaaaaaccacgcgcttcgataccgacaac

SEQ ID NO: 13711 - DNA, 755 bp, Artificial Sequence
  chemically treated genomic DNA (Homo sapiens) CpG-island No: 13711
ttcgattttacgatagttatcgtatacgtcgtacggcgtcgcggtaatgtcgggtttcgtagtttagttttttcgttagtagtcggggcggatagaggttttttcgacgttacgggtgtcggaaaaaagataagtatgatgaatacgttttaacgataagtcgttcgttagtgcggttagtatatgtttttggtcgacgacgttagtaaaggtttgtgggcgttattttcgggttaagatttgataatttattggtaggttttgaaacgttggaaggtggatttacgaaggggtaatgttaatatagtttcgttagaacggcgaggttgaatgtatattttgtgttgttcgtagcgtgggtagtataagattggcgataattaatggttcgggaacgggataaggttgtagttggtaatgttttgtttttcgagacgttgttcgtcgtcgagatcgaataggttgataatgaacgtagcgttagttattttattatttagacgacggattagtttaacggtcgtttcgatagtgtcgtcggttgttagtaggtcgtttattattagaattttgtcgttcggtttgatggtattaacgtggatttttagttgatcggtgtcgtattttaggtcgtaagttttattgatggttttacgcggtagtttgttcggtttacggatcggtataaagttaacgtttagatttagagttatcggagcgttaaataagaagttacgcgtttcggtgtcgataat

SEQ ID NO: 13712 - DNA, 755 bp, Artificial Sequence
  chemically treated genomic DNA (Homo sapiens) CpG-island No: 13712
attatcgacaccgaaacgcgtaacttcttatttaacgctccgataactctaaatctaaacgttaactttataccgatccgtaaaccgaacaaactaccgcgtaaaaccatcaataaaacttacgacctaaaatacgacaccgatcaactaaaaatccacgttaataccatcaaaccgaacgacaaaattctaataataaacgacctactaacaaccgacgacactatcgaaacgaccgttaaactaatccgtcgtctaaataataaaataactaacgctacgttcattatcaacctattcgatctcgacgacgaacaacgtctcgaaaaacaaaacattaccaactacaaccttatcccgttcccgaaccattaattatcgccaatcttatactacccacgctacgaacaacacaaaatatacattcaacctcgccgttctaacgaaactatattaacattaccccttcgtaaatccaccttccaacgtttcaaaacctaccaataaattatcaaatcttaacccgaaaataacgcccacaaacctttactaacgtcgtcgaccaaaaacatatactaaccgcactaacgaacgacttatcgttaaaacgtattcatcatacttatcttttttccgacacccgtaacgtcgaaaaaacctctatccgccccgactactaacgaaaaaactaaactacgaaacccgacattaccgcgacgccgtacgacgtatacgataactatcgtaaaatcgaa

SEQ ID NO: 13713 - DNA, 512 bp, Artificial Sequence
  chemically treated genomic DNA (Homo sapiens) CpG-island No: 13713
tacgtttattgcgggtgtcgataattattagttcgtttggttcgacgcggtttttttcgattatttcgttaggttggtaattttagatatcgattttagaggcgtaggtgatgagtttatttttggtgatgacgtagcgcgtcggacgtagatcgttacggtcgaggttataggcggtaaaacgatcgtcggatattacgatgttcgtcgggttattttacggttttatatgcgtggagttaaagtcgaggaaggtacgtagtttcgggtttatattcggggttgtttttgtaggcgggtggtattaatagacgtatggcgcggatgatatttatttcggtcgatagatagtagttttagtatgttatttttcggattgcggttcgaagcggggttcgttgaataacggggcgcgtcggtaagttaagataatcgcggttcggagtttaaattcgttcggttattggggggacgcgtaggggtgaatatcggtatcgtaaatagagacggtg

SEQ ID NO: 13714 - DNA, 512 bp, Artificial Sequence
  chemically treated genomic DNA (Homo sapiens) CpG-island No: 13714
caccgtctctatttacgataccgatattcacccctacgcgtccccccaataaccgaacgaatttaaactccgaaccgcgattatcttaacttaccgacgcgccccgttattcaacgaaccccgcttcgaaccgcaatccgaaaaataacatactaaaactactatctatcgaccgaaataaatatcatccgcgccatacgtctattaataccacccgcctacaaaaacaaccccgaatataaacccgaaactacgtaccttcctcgactttaactccacgcatataaaaccgtaaaataacccgacgaacatcgtaatatccgacgatcgttttaccgcctataacctcgaccgtaacgatctacgtccgacgcgctacgtcatcaccaaaaataaactcatcacctacgcctctaaaatcgatatctaaaattaccaacctaacgaaataatcgaaaaaaaccgcgtcgaaccaaacgaactaataattatcgacacccgcaataaacgta

SEQ ID NO: 13715 - DNA, 512 bp, Artificial Sequence
  chemically treated genomic DNA (Homo sapiens) CpG-island No: 13715
tatcgtttttatttgcgatatcggtgtttatttttgcgcgtttttttagtggtcgggcgaatttaaatttcgagtcgcggttattttgatttgtcgacgcgtttcgttgtttaacgaatttcgtttcgaatcgtagttcgagggataatatgttggaattgttgtttgtcggtcgggatggatattattcgcgttatgcgtttattagtattattcgtttgtaagaataatttcggatatggattcggaattgcgtgtttttttcgattttaattttacgtatatggagtcgtgggatggttcggcgggtatcgtgatgttcgacggtcgttttgtcgtttgtaatttcgatcgtaacggtttgcgttcggcgcgttacgttattattaaagataagtttattatttgcgtttttgaagtcggtatttgggattattagtttgacgaagtggtcgaaaaaggtcgcgtcgggttaggcgaattgatggttatcgatattcgtagtgggcgta

SEQ ID NO: 13716 - DNA, 512 bp, Artificial Sequence
  chemically treated genomic DNA (Homo sapiens) CpG-island No: 13716
tacgcccactacgaatatcgataaccatcaattcgcctaacccgacgcgacctttttcgaccacttcgtcaaactaataatcccaaataccgacttcaaaaacgcaaataataaacttatctttaataataacgtaacgcgccgaacgcaaaccgttacgatcgaaattacaaacgacaaaacgaccgtcgaacatcacgatacccgccgaaccatcccacgactccatatacgtaaaattaaaatcgaaaaaaacacgcaattccgaatccatatccgaaattattcttacaaacgaataatactaataaacgcataacgcgaataatatccatcccgaccgacaaacaacaattccaacatattatccctcgaactacgattcgaaacgaaattcgttaaacaacgaaacgcgtcgacaaatcaaaataaccgcgactcgaaatttaaattcgcccgaccactaaaaaaacgcgcaaaaataaacaccgatatcgcaaataaaaacgata

SEQ ID NO: 13717 - DNA, 596 bp, Artificial Sequence
  chemically treated genomic DNA (Homo sapiens) CpG-island No: 13717
agcggtaggggaggagggatagcggaagaaggatacgggaggataaggaaggcggtggtaaggaaagggaggagcgaagagcgggaatagggtagggggaaatgagcggaagaaaaggcgagacgacgcggacggaggagatagcgattaataggagagagaaaagaataagatagaagtagtatcgatcgcgtacgagtacgtcgacgtaggtagtcgtagggaaacgataggtacgtagtcgggaaacgaaaataagcgtgggacgagcgcgcgtcgatacgcggtggaggaaggaagagaaatataagaaagtcgaagataaagggatttatttattagcgtaacgaaagtaaaaaaatattaggagtaggtacgggaattaacggttaggtagagaacgaaaggaacgacgtatgaagtaaagaggacgacggacgaggaagataaaatgaacgagatagggcggataagaaacgaacgtcgcgaaaggacggttaagacgaaatagcgcgagataaagatacggagggataaaacgtatacgtaacgttacgagatagacgtaaatataataggaagaagaaaggaaacgt

SEQ ID NO: 13718 - DNA, 596 bp, Artificial Sequence
  chemically treated genomic DNA (Homo sapiens) CpG-island No: 13718
acgtttcctttcttcttcctattatatttacgtctatctcgtaacgttacgtatacgttttatccctccgtatctttatctcgcgctatttcgtcttaaccgtcctttcgcgacgttcgtttcttatccgccctatctcgttcattttatcttcctcgtccgtcgtcctctttacttcatacgtcgttcctttcgttctctacctaaccgttaattcccgtacctactcctaatatttttttactttcgttacgctaataaataaatccctttatcttcgactttcttatatttctcttccttcctccaccgcgtatcgacgcgcgctcgtcccacgcttattttcgtttcccgactacgtacctatcgtttccctacgactacctacgtcgacgtactcgtacgcgatcgatactacttctatcttattcttttctctctcctattaatcgctatctcctccgtccgcgtcgtctcgccttttcttccgctcatttccccctaccctattcccgctcttcgctcctccctttccttaccaccgccttccttatcctcccgtatccttcttccgctatccctcctcccctaccgct

SEQ ID NO: 13719 - DNA, 596 bp, Artificial Sequence
  chemically treated genomic DNA (Homo sapiens) CpG-island No: 13719
gcgtttttttttttttttttgttgtgtttacgtttgtttcgtggcgttgcgtgtgcgttttgttttttcgtgtttttatttcgcgttgtttcgttttagtcgttttttcgcggcgttcgttttttgttcgttttgtttcgtttattttgtttttttcgttcgtcgttttttttgttttatgcgtcgtttttttcgttttttgtttagtcgttggttttcgtgtttgtttttggtgtttttttgttttcgttgcgttgatgggtggatttttttgttttcggtttttttgtgtttttttttttttttttatcgcgtgtcggcgcgcgttcgttttacgtttgttttcgtttttcggttgcgtgtttgtcgtttttttgcggttgtttgcgtcggcgtgttcgtgcgcggtcggtgttgtttttgttttgttttttttttttttttgttagtcgttgtttttttcgttcgcgtcgtttcgttttttttttcgtttatttttttttgttttgttttcgtttttcgtttttttttttttttgttatcgttttttttgttttttcgtgtttttttttcgttgtttttttttttttgtcgtt

SEQ ID NO: 13720 - DNA, 596 bp, Artificial Sequence
  chemically treated genomic DNA (Homo sapiens) CpG-island No: 13720
aacgacaaaaaaaaaaaaacaacgaaaaaaaaacacgaaaaaacaaaaaaaacgataacaaaaaaaaaaaaaaacgaaaaacgaaaacaaaacaaaaaaaaataaacgaaaaaaaaaacgaaacgacgcgaacgaaaaaaacaacgactaacaaaaaaaaaaaaaaaacaaaacaaaaacaacaccgaccgcgcacgaacacgccgacgcaaacaaccgcaaaaaaacgacaaacacgcaaccgaaaaacgaaaacaaacgtaaaacgaacgcgcgccgacacgcgataaaaaaaaaaaaaaaaacacaaaaaaaccgaaaacaaaaaaatccacccatcaacgcaacgaaaacaaaaaaacaccaaaaacaaacacgaaaaccaacgactaaacaaaaaacgaaaaaaacgacgcataaaacaaaaaaaacgacgaacgaaaaaaacaaaataaacgaaacaaaacgaacaaaaaacgaacgccgcgaaaaaacgactaaaacgaaacaacgcgaaataaaaacacgaaaaaacaaaacgcacacgcaacgccacgaaacaaacgtaaacacaacaaaaaaaaaaaaaaaaacgc

SEQ ID NO: 13721 - DNA, 559 bp, Artificial Sequence
  chemically treated genomic DNA (Homo sapiens) CpG-island No: 13721
ttgtcggttcggtatcgtcgttatcgttgatatattttttattacgtagtgttagtattagagaattgaatatcgttttgtcgaagaatttcggcgcgttgatgtcgtgtagtacggagagacgttgcgcgacggtgcggttttttttttttagcgtatcgcggttgatcgacgggttggtatttaataattagaaggtgatggtataacgttgtagcgtttcgcgcgcgtttgcggttagtagttgtagcgtgcgagaatgcgtcgggttgatatgtaatttattattttgtagggtaattagtttttgacgttgtattttatttgttagcgtattaataacgttcggtaattcgtcgcgattttagcgtaggaatagtttcgtttttagtattgggtaaagtatattgacgtgttttattaatacgtcgcgggagatgtggcgatgttgggtgacgattgtcgttattagcgaaggtagtataatatatgttttatgttggtgcgatagtaggtttttttttgaatttcgtttttgtattcgtttgattatgagtga

SEQ ID NO: 13722 - DNA, 559 bp, Artificial Sequence
  chemically treated genomic DNA (Homo sapiens) CpG-island No: 13722
tcactcataatcaaacgaatacaaaaacgaaattcaaaaaaaaacctactatcgcaccaacataaaacatatattatactaccttcgctaataacgacaatcgtcacccaacatcgccacatctcccgcgacgtattaataaaacacgtcaatatactttacccaatactaaaaacgaaactattcctacgctaaaatcgcgacgaattaccgaacgttattaatacgctaacaaataaaatacaacgtcaaaaactaattaccctacaaaataataaattacatatcaacccgacgcattctcgcacgctacaactactaaccgcaaacgcgcgcgaaacgctacaacgttataccatcaccttctaattattaaataccaacccgtcgatcaaccgcgatacgctaaaaaaaaaaaaccgcaccgtcgcgcaacgtctctccgtactacacgacatcaacgcgccgaaattcttcgacaaaacgatattcaattctctaatactaacactacgtaataaaaaatatatcaacgataacgacgataccgaaccgacaa

SEQ ID NO: 13723 - DNA, 559 bp, Artificial Sequence
  chemically treated genomic DNA (Homo sapiens) CpG-island No: 13723
ttatttatgattaggcgaatgtaggaacgaagtttaaaggaggatttattatcgtattaatatggggtatatgttgtgttgttttcgttgatggcggtaatcgttatttagtatcgttatatttttcgcgacgtattgatggagtacgttaatgtgttttatttaatgttgaaagcggagttgtttttgcgttgggatcgcgacgagttgtcggacgttattgatgcgttggtaaatgagatgtaacgttaggggttgattattttgtaagatgatgagttgtatattaattcggcgtattttcgtacgttatagttgttggtcgtaggcgcgcgcgaaacgttgtaacgttatgttattattttttggttgttgagtgttaattcgtcgattaatcgcggtacgttggagaaagagagtcgtatcgtcgcgtaacgttttttcgtgttgtacggtattaacgcgtcggagtttttcgataaggcggtgtttagttttttggtgttgatattgcgtgatgaagggtatattagcgatagcggcgatgtcgaatcggtag

SEQ ID NO: 13724 - DNA, 559 bp, Artificial Sequence
  chemically treated genomic DNA (Homo sapiens) CpG-island No: 13724
ctaccgattcgacatcgccgctatcgctaatatacccttcatcacgcaatatcaacaccaaaaaactaaacaccgccttatcgaaaaactccgacgcgttaataccgtacaacacgaaaaaacgttacgcgacgatacgactctctttctccaacgtaccgcgattaatcgacgaattaacactcaacaaccaaaaaataataacataacgttacaacgtttcgcgcgcgcctacgaccaacaactataacgtacgaaaatacgccgaattaatatacaactcatcatcttacaaaataatcaacccctaacgttacatctcatttaccaacgcatcaataacgtccgacaactcgtcgcgatcccaacgcaaaaacaactccgctttcaacattaaataaaacacattaacgtactccatcaatacgtcgcgaaaaatataacgatactaaataacgattaccgccatcaacgaaaacaacacaacatataccccatattaatacgataataaatcctcctttaaacttcgttcctacattcgcctaatcataaataa

SEQ ID NO: 13725 - DNA, 570 bp, Artificial Sequence
  chemically treated genomic DNA (Homo sapiens) CpG-island No: 13725
taacgtcgtgaatttgggatatagttttggcggatatttaaattgaagatcgcgacgttattcgtatttttttttttaattattcgacgtataagttatttatagatagacggaagagtgagagaagggaggaagagcgggggggcgcgtcggaagggagggcggggggcgagggagggagaaggagagacgggggggtatacgcggcgggtacgtcggcgaacggatggcgtagcgcgtaatcggttacgaggaggacgagatcgggggatatattttgagaattcgcggaagcgcgagatataacgtattcgttaagcgtatcgcgtgtcggttatcgtaaaaatcgtagcgttaggaggaagaagaaaaaaagttagggggacgaagggataaagaagggagatacgagacggaggcgtaacgagtatcgagttaaagattatgtaagagagaggaagtttatacgttatacgttatgtaagtagtttcgaattttttagacggcgtattatttacgattatcgcgttattatttcgggtatcggtgaaatttttttttattaaaaa

SEQ ID NO: 13726 - DNA, 570 bp, Artificial Sequence
  chemically treated genomic DNA (Homo sapiens) CpG-island No: 13726
tttttaataaaaaaaaatttcaccgatacccgaaataataacgcgataatcgtaaataatacgccgtctaaaaaattcgaaactacttacataacgtataacgtataaacttcctctctcttacataatctttaactcgatactcgttacgcctccgtctcgtatctcccttctttatcccttcgtccccctaactttttttcttcttcctcctaacgctacgatttttacgataaccgacacgcgatacgcttaacgaatacgttatatctcgcgcttccgcgaattctcaaaatatatcccccgatctcgtcctcctcgtaaccgattacgcgctacgccatccgttcgccgacgtacccgccgcgtatacccccccgtctctccttctccctccctcgccccccgccctcccttccgacgcgcccccccgctcttcctcccttctctcactcttccgtctatctataaataacttatacgtcgaataattaaaaaaaaaaatacgaataacgtcgcgatcttcaatttaaatatccgccaaaactatatcccaaattcacgacgtta

SEQ ID NO: 13727 - DNA, 570 bp, Artificial Sequence
  chemically treated genomic DNA (Homo sapiens) CpG-island No: 13727
tttttagtagagaagagttttatcggtattcggggtggtggcgcggtgatcgtgggtagtgcgtcgtttggggggttcgggattgtttgtatggcgtgtggcgtgtgggtttttttttttttgtatggtttttggttcggtgttcgttgcgttttcgtttcgtattttttttttttgttttttcgtttttttggttttttttttttttttttttgacgttgcggtttttgcggtggtcggtacgcgatgcgtttggcgggtgcgttgtgtttcgcgttttcgcgggtttttagggtgtgtttttcggtttcgtttttttcgtggtcggttgcgcgttgcgttattcgttcgtcggcgtgttcgtcgcgtgtgttttttcgtttttttttttttttttttcgtttttcgttttttttttcggcgcgttttttcgttttttttttttttttttattttttcgtttgtttgtgagtagtttgtgcgtcgggtggttgggggggggggtgcgggtggcgtcgcgatttttagtttgggtattcgttagggttgtgttttaggtttacgacgttg

SEQ ID NO: 13728 - DNA, 570 bp, Artificial Sequence
  chemically treated genomic DNA (Homo sapiens) CpG-island No: 13728
caacgtcgtaaacctaaaacacaaccctaacgaatacccaaactaaaaatcgcgacgccacccgcacccccccccccaaccacccgacgcacaaactactcacaaacaaacgaaaaaataaaaaaaaaaaaaaaaaacgaaaaaacgcgccgaaaaaaaaaacgaaaaacgaaaaaaaaaaaaaaaaaaacgaaaaaacacacgcgacgaacacgccgacgaacgaataacgcaacgcgcaaccgaccacgaaaaaaacgaaaccgaaaaacacaccctaaaaacccgcgaaaacgcgaaacacaacgcacccgccaaacgcatcgcgtaccgaccaccgcaaaaaccgcaacgtcaaaaaaaaaaaaaaaaaaaaccaaaaaaacgaaaaaacaaaaaaaaaaaatacgaaacgaaaacgcaacgaacaccgaaccaaaaaccatacaaaaaaaaaaaaacccacacgccacacgccatacaaacaatcccgaaccccccaaacgacgcactacccacgatcaccgcgccaccaccccgaataccgataaaactcttctctactaaaaa

SEQ ID NO: 13729 - DNA, 1121 bp, Artificial Sequence
  chemically treated genomic DNA (Homo sapiens) CpG-island No: 13729
cgataatcggatcgtttattattttgtcgtttagggaaattacgtcgaggttttcgcgagcggcggttttagcggtttttacgacgcggcgggcgtgatttatttttttttgggtcggtgcgtagaggttgtgtagtagattaatttgacgcgggttgattagcgatttgtcgttaaagtttagttgtttgatgtgggcggttttttgtagaaattcggtttcgttgttagcgtcggaatagacggtatcgaacgtttgaatattcgtagagcgcgcggtttgtaaaatggaatagcgtgcgaatagtagtttagtttttttcggggagcgttttgtacgtaggttgcgtatatagttttttgtatcgagggcgatatcgattaaacgttcggaagcgtgagcgatttttattgcgcgggtaatttttagcggagatttaatcgtcgttagtaggtcggtgttgtcgggtttacgattataggttttttcgatacgtaggattttttttttaatatttagaatattttgagcggtatcggttttcggtagacgtataacgttcgtattatcgcgaacgacggtttttaggtcgttaatattttattcggaatttagcgcgttgatacgtataatggttttaatatcgcgatatagcggatgttgtagcgcgtggtaaattatgcggcgggcggtgttttttttacgtaatgttacggagttttcgaggttaaatattagggtattagtcgggtagatgaaggagttgttgattatcgcggtattggtattaggtataaataatatgttgcggcgggtgcgagttttttatgggtttgaaggcgttattatcgattcgtatattggagatcgtcgatcgttaacggaagatattttggcgattgttggaaaaaatcgtttttttcgtatataaaattggtgtatcgagcgcgattgaggttttgtatcgttaggtcgttagcggtttgaatgaagcgtagttaatgcgcgatttcgtcgtcgatggcggttcgttgattgggttggtgaaaaagtattgtgagatttgggtcggtgattaagtcgggaattgttttatagaagaatatttttgataatggtg

SEQ ID NO: 13730 - DNA, 1121 bp, Artificial Sequence
  chemically treated genomic DNA (Homo sapiens) CpG-island No: 13730
caccattatcaaaaatattcttctataaaacaattcccgacttaatcaccgacccaaatctcacaatactttttcaccaacccaatcaacgaaccgccatcgacgacgaaatcgcgcattaactacgcttcattcaaaccgctaacgacctaacgatacaaaacctcaatcgcgctcgatacaccaattttatatacgaaaaaaacgattttttccaacaatcgccaaaatatcttccgttaacgatcgacgatctccaatatacgaatcgataataacgccttcaaacccataaaaaactcgcacccgccgcaacatattatttatacctaataccaataccgcgataatcaacaactccttcatctacccgactaataccctaatatttaacctcgaaaactccgtaacattacgtaaaaaaaacaccgcccgccgcataatttaccacgcgctacaacatccgctatatcgcgatattaaaaccattatacgtatcaacgcgctaaattccgaataaaatattaacgacctaaaaaccgtcgttcgcgataatacgaacgttatacgtctaccgaaaaccgataccgctcaaaatattctaaatattaaaaaaaaaatcctacgtatcgaaaaaacctataatcgtaaacccgacaacaccgacctactaacgacgattaaatctccgctaaaaattacccgcgcaataaaaatcgctcacgcttccgaacgtttaatcgatatcgccctcgatacaaaaaactatatacgcaacctacgtacaaaacgctccccgaaaaaaactaaactactattcgcacgctattccattttacaaaccgcgcgctctacgaatattcaaacgttcgataccgtctattccgacgctaacaacgaaaccgaatttctacaaaaaaccgcccacatcaaacaactaaactttaacgacaaatcgctaatcaacccgcgtcaaattaatctactacacaacctctacgcaccgacccaaaaaaaaataaatcacgcccgccgcgtcgtaaaaaccgctaaaaccgccgctcgcgaaaacctcgacgtaatttccctaaacgacaaaataataaacgatccgattatcg

SEQ ID NO: 13731 - DNA, 1121 bp, Artificial Sequence
  chemically treated genomic DNA (Homo sapiens) CpG-island No: 13731
tattattgttagggatatttttttgtaaggtaattttcggtttagttatcggtttagattttataatgtttttttattagtttaattagcgagtcgttatcggcgacgaaatcgcgtattagttgcgttttatttagatcgttgacgatttggcgatgtagggttttaatcgcgttcgatgtattaattttatgtgcggaaggggcgattttttttagtaatcgttaaggtatttttcgttagcggtcgacgatttttagtgtgcggatcggtgatgacgtttttaagtttatagaaaattcgtattcgtcgtagtatgttgtttgtgtttggtgttaatgtcgcgatggttagtaatttttttatttattcggttgatgttttgatgtttgatttcgaagatttcgtagtattgcgtgaaaaagatatcgttcgtcgtatggtttattacgcgttgtaatattcgttgtatcgcgatattgaaattattgtgcgtgttaacgcgttggatttcgaatggggtgttaacgatttggaagtcgtcgttcgcggtggtgcggacgttgtgcgtttgtcgaaaatcgatatcgtttaggatgttttggatattgaaaaagagattttgcgtatcgaaaaagtttgtggtcgtgaattcggtagtatcggtttgttggcggcgattgaattttcgttggggattattcgcgtagtggaaatcgtttacgttttcgagcgtttgatcggtatcgttttcggtgtagaagattatgtgcgtaatttgcgtatagaacgtttttcggaaggaattgaattgttgttcgtacgttgttttattttgtaggtcgcgcgttttgcgggtatttaggcgttcgatatcgtttatttcgacgttaataacgaagtcggatttttgtaagaagtcgtttatattaaatagttgggttttgacggtaaatcgttgattaattcgcgttagattgatttgttgtataatttttacgtatcgatttagaaagaagtggattacgttcgtcgcgtcgtagaagtcgttgaagtcgtcgttcgcgaaggtttcggcgtggtttttttgaacggtaagatggtggacggttcggttatcg

SEQ ID NO: 13732 - DNA, 1121 bp, Artificial Sequence
  chemically treated genomic DNA (Homo sapiens) CpG-island No: 13732
cgataaccgaaccgtccaccatcttaccgttcaaaaaaaccacgccgaaaccttcgcgaacgacgacttcaacgacttctacgacgcgacgaacgtaatccacttctttctaaatcgatacgtaaaaattatacaacaaatcaatctaacgcgaattaatcaacgatttaccgtcaaaacccaactatttaatataaacgacttcttacaaaaatccgacttcgttattaacgtcgaaataaacgatatcgaacgcctaaatacccgcaaaacgcgcgacctacaaaataaaacaacgtacgaacaacaattcaattccttccgaaaaacgttctatacgcaaattacgcacataatcttctacaccgaaaacgataccgatcaaacgctcgaaaacgtaaacgatttccactacgcgaataatccccaacgaaaattcaatcgccgccaacaaaccgatactaccgaattcacgaccacaaactttttcgatacgcaaaatctctttttcaatatccaaaacatcctaaacgatatcgattttcgacaaacgcacaacgtccgcaccaccgcgaacgacgacttccaaatcgttaacaccccattcgaaatccaacgcgttaacacgcacaataatttcaatatcgcgatacaacgaatattacaacgcgtaataaaccatacgacgaacgatatctttttcacgcaatactacgaaatcttcgaaatcaaacatcaaaacatcaaccgaataaataaaaaaattactaaccatcgcgacattaacaccaaacacaaacaacatactacgacgaatacgaattttctataaacttaaaaacgtcatcaccgatccgcacactaaaaatcgtcgaccgctaacgaaaaataccttaacgattactaaaaaaaatcgccccttccgcacataaaattaatacatcgaacgcgattaaaaccctacatcgccaaatcgtcaacgatctaaataaaacgcaactaatacgcgatttcgtcgccgataacgactcgctaattaaactaataaaaaaacattataaaatctaaaccgataactaaaccgaaaattaccttacaaaaaaatatccctaacaataata

SEQ ID NO: 13733 - DNA, 636 bp, Artificial Sequence
  chemically treated genomic DNA (Homo sapiens) CpG-island No: 13733
  misc_feature (117)..(117): n is either a, c, g or t
gatttcggttggagaagtggttaggggtcgttgcgaaaggagaggagcgtgtatgacgttatattcggcgcgcggcggaattggttttttttgttttcgcggcggggtcggaagtangagcggcggcggcggcggcggcggcggtcgaaagcggagtgaaagaaggaagttaggagtcggagagtcggaatcggagtcgtagcggcggtaatagtgcgagatttttttaagttatcgtttttagcgcgggatcgcggggttcgacgggagttagcgggggtgcggttaggtcgttggacgtcggggggttttggggtcgatgtgaggggaggcgggggtgggggagtcgggtcggttttagaatcgagttgttcgtttcgagtttcggacggatattgattcgcgggttcgttttggttttttttaggagatttttgtgcggtgcggagggggcggcggtttcgattttgattcgcgtcgggggtgggttatggcggagattagcgatttggatcggtagatcgagtagttgcgtcgttgcgagtttattaaggagagcgaagttaaggttttgtgcgttaaggttaggtgagttcgttggttttggggaagggaggttaagtcgtcgtttacggg

SEQ ID NO: 13734 - DNA, 636 bp, Artificial Sequence
  chemically treated genomic DNA (Homo sapiens) CpG-island No: 13734
  misc_feature (520)..(520): n is either a, c, g or t
cccgtaaacgacgacttaacctcccttccccaaaaccaacgaactcacctaaccttaacgcacaaaaccttaacttcgctctccttaataaactcgcaacgacgcaactactcgatctaccgatccaaatcgctaatctccgccataacccacccccgacgcgaatcaaaatcgaaaccgccgccccctccgcaccgcacaaaaatctcctaaaaaaaaccaaaacgaacccgcgaatcaatatccgtccgaaactcgaaacgaacaactcgattctaaaaccgacccgactcccccacccccgcctcccctcacatcgaccccaaaaccccccgacgtccaacgacctaaccgcacccccgctaactcccgtcgaaccccgcgatcccgcgctaaaaacgataacttaaaaaaatctcgcactattaccgccgctacgactccgattccgactctccgactcctaacttccttctttcactccgctttcgaccgccgccgccgccgccgccgccgctcntacttccgaccccgccgcgaaaacaaaaaaaaccaattccgccgcgcgccgaatataacgtcatacacgctcctctcctttcgcaacgacccctaaccacttctccaaccgaaatc

SEQ ID NO: 13735 - DNA, 636 bp, Artificial Sequence
  chemically treated genomic DNA (Homo sapiens) CpG-island No: 13735
  misc_feature (520)..(520): n is either a, c, g or t
ttcgtgggcggcggtttggttttttttttttagggttaacgagtttatttggttttagcgtatagggttttgatttcgttttttttgatgagttcgtagcgacgtagttgttcgatttgtcggtttaggtcgttgattttcgttatggtttattttcggcgcgggttagagtcggggtcgtcgtttttttcgtatcgtataggggttttttgggaaaggttaagacgagttcgcggattagtgttcgttcggggttcggagcggataattcgattttagagtcggttcggtttttttattttcgtttttttttatatcggttttaggatttttcggcgtttaacggtttggtcgtattttcgttaattttcgtcgaatttcgcggtttcgcgttaaggacggtgatttagaggagtttcgtattattatcgtcgttgcgatttcggtttcggtttttcggtttttggttttttttttttatttcgttttcgatcgtcgtcgtcgtcgtcgtcgtcgtttntattttcggtttcgtcgcggaagtaaaggaggttagtttcgtcgcgcgtcggatgtggcgttatatacgttttttttttttcgtagcgatttttgattatttttttagtcgagatt

SEQ ID NO: 13736 - DNA, 636 bp, Artificial Sequence
  chemically treated genomic DNA (Homo sapiens) CpG-island No: 13736
  misc_feature (117)..(117): n is either a, c, g or t
aatctcgactaaaaaaataatcaaaaatcgctacgaaaaaaaaaaaacgtatataacgccacatccgacgcgcgacgaaactaacctcctttacttccgcgacgaaaccgaaaatanaaacgacgacgacgacgacgacgacgatcgaaaacgaaataaaaaaaaaaaaccaaaaaccgaaaaaccgaaaccgaaatcgcaacgacgataataatacgaaactcctctaaatcaccgtccttaacgcgaaaccgcgaaattcgacgaaaattaacgaaaatacgaccaaaccgttaaacgccgaaaaatcctaaaaccgatataaaaaaaaacgaaaataaaaaaaccgaaccgactctaaaatcgaattatccgctccgaaccccgaacgaacactaatccgcgaactcgtcttaacctttcccaaaaaacccctatacgatacgaaaaaaacgacgaccccgactctaacccgcgccgaaaataaaccataacgaaaatcaacgacctaaaccgacaaatcgaacaactacgtcgctacgaactcatcaaaaaaaacgaaatcaaaaccctatacgctaaaaccaaataaactcgttaaccctaaaaaaaaaaaaccaaaccgccgcccacgaa

SEQ ID NO: 13737 - DNA, 957 bp, Artificial Sequence
  chemically treated genomic DNA (Homo sapiens) CpG-island No: 13737
gttcgggaacgcgttttttttataaaatttaaatcgttgtttggaaaggtagcgatattacgtttttagcgtattttcgcgggggaggtttcgtttttaattttaggtggttttatttaaggttcgcggatttattttttttagaggtatttttttttatttttatttattcgaacgtgttgaaggcggtagggaggcggaggcgggagagacggatttggggtaggtgtttggggtcggggatgcggtttggaaagtattagggtggtcgtcggtgacgttttgagataagtcggaaaagggtcgggttcgtcgaaggtcgcgtaatttatttggtcgttgaggaggaaagagtcgtcgttcgagaagacggtcgaggtggcgtagtggacgtgagattcgtcgtcgtcgtcgttcgttttagtacgttcgggaagtcgtacgtcggttcggattttaggaagtcgtagttcgcgtttttagttgtcgcgtaggtgcggtattaggttcgtagggtttttttagggtgtattgcgcgtattgggggcgcgtcggaagattatcggacggtcggggggggcgcgggtcgaaaggcgagggtcgggcggcggtaggggtagatagttgacgaaggcgcgtcgcgttgttagaggaaaggcggttgtagagtacgggtcgggcgtcggagcggtagaatttggtgttagttgagtcgtcgtcgcgattcgtcgttgtgttgatgaacgtatttaggtagaagttatgtttcggtttattttttgaggcgtagcgggcgagtatcgagtcggtagagtttaatagattgcgtcgtttgttcgtttcgtagtttttttattcgagttgtttttttaattattcgagttagcggagtaaattattgtttatatatcgcggggcgttatttggcgggtattagttttaattttattaagttat

SEQ ID NO: 13738 - DNA, 957 bp, Artificial Sequence
  chemically treated genomic DNA (Homo sapiens) CpG-island No: 13738
ataacttaataaaattaaaactaatacccgccaaataacgccccgcgatatataaacaataatttactccgctaactcgaataattaaaaaaacaactcgaataaaaaaactacgaaacgaacaaacgacgcaatctattaaactctaccgactcgatactcgcccgctacgcctcaaaaaataaaccgaaacataacttctacctaaatacgttcatcaacacaacgacgaatcgcgacgacgactcaactaacaccaaattctaccgctccgacgcccgacccgtactctacaaccgcctttcctctaacaacgcgacgcgccttcgtcaactatctacccctaccgccgcccgaccctcgcctttcgacccgcgccccccccgaccgtccgataatcttccgacgcgcccccaatacgcgcaatacaccctaaaaaaaccctacgaacctaataccgcacctacgcgacaactaaaaacgcgaactacgacttcctaaaatccgaaccgacgtacgacttcccgaacgtactaaaacgaacgacgacgacgacgaatctcacgtccactacgccacctcgaccgtcttctcgaacgacgactctttcctcctcaacgaccaaataaattacgcgaccttcgacgaacccgacccttttccgacttatctcaaaacgtcaccgacgaccaccctaatactttccaaaccgcatccccgaccccaaacacctaccccaaatccgtctctcccgcctccgcctccctaccgccttcaacacgttcgaataaataaaaataaaaaaaaatacctctaaaaaaaataaatccgcgaaccttaaataaaaccacctaaaattaaaaacgaaacctcccccgcgaaaatacgctaaaaacgtaatatcgctacctttccaaacaacgatttaaattttataaaaaaaacgcgttcccgaac

SEQ ID NO: 13739 - DNA, 957 bp, Artificial Sequence
  chemically treated genomic DNA (Homo sapiens) CpG-island No: 13739
atgatttgatagaattggagttggtattcgttaagtggcgtttcgcggtatataggtaataatttatttcgttaattcgaatggttggagaggtagttcgggtagagaggttgcggagcgggtagacggcgtagtttgttaagttttgtcggttcggtattcgttcgttgcgttttagaaagtgggtcgaaatatgatttttatttgagtacgtttattagtatagcggcgggtcgcggcgacggtttagttggtattaagttttgtcgtttcgacgttcggttcgtgttttgtagtcgttttttttttggtaacgcgacgcgttttcgttagttgtttgtttttgtcgtcgttcgattttcgtttttcggttcgcgtttttttcggtcgttcggtaatttttcggcgcgtttttagtacgcgtagtgtattttggaggggttttacgaatttggtgtcgtatttgcgcggtagttgggggcgcggattacggttttttggggttcgggtcggcgtacgatttttcgggcgtgttggggcgggcggcgacgacggcgggttttacgtttattacgttatttcggtcgttttttcgggcggcggtttttttttttttagcggttaggtggattacgcggttttcggcgaattcggttttttttcggtttgttttaaagcgttatcgacggttattttggtgttttttagatcgtattttcggttttaggtatttattttaagttcgtttttttcgttttcgtttttttgtcgtttttagtacgttcgagtggatgaaagtgaagaggaatgtttttaagaaaggtaagttcgcgggttttggatggggttatttggggttggggacggagtttttttcgcggaaatgcgttgggagcgtggtgtcgttgtttttttagatagcggtttgggttttgtggaggagacgcgttttcgggt

SEQ ID NO: 13740 - DNA, 957 bp, Artificial Sequence
  chemically treated genomic DNA (Homo sapiens) CpG-island No: 13740
acccgaaaacgcgtctcctccacaaaacccaaaccgctatctaaaaaaacaacgacaccacgctcccaacgcatttccgcgaaaaaaactccgtccccaaccccaaataaccccatccaaaacccgcgaacttacctttcttaaaaacattcctcttcactttcatccactcgaacgtactaaaaacgacaaaaaaacgaaaacgaaaaaaacgaacttaaaataaatacctaaaaccgaaaatacgatctaaaaaacaccaaaataaccgtcgataacgctttaaaacaaaccgaaaaaaaaccgaattcgccgaaaaccgcgtaatccacctaaccgctaaaaaaaaaaaaaccgccgcccgaaaaaacgaccgaaataacgtaataaacgtaaaacccgccgtcgtcgccgcccgccccaacacgcccgaaaaatcgtacgccgacccgaaccccaaaaaaccgtaatccgcgcccccaactaccgcgcaaatacgacaccaaattcgtaaaacccctccaaaatacactacgcgtactaaaaacgcgccgaaaaattaccgaacgaccgaaaaaaacgcgaaccgaaaaacgaaaatcgaacgacgacaaaaacaaacaactaacgaaaacgcgtcgcgttaccaaaaaaaaaacgactacaaaacacgaaccgaacgtcgaaacgacaaaacttaataccaactaaaccgtcgccgcgacccgccgctatactaataaacgtactcaaataaaaatcatatttcgacccactttctaaaacgcaacgaacgaataccgaaccgacaaaacttaacaaactacgccgtctacccgctccgcaacctctctacccgaactacctctccaaccattcgaattaacgaaataaattattacctatataccgcgaaacgccacttaacgaataccaactccaattctatcaaatcat

SEQ ID NO: 13741 - DNA, 504 bp, Artificial Sequence
  chemically treated genomic DNA (Homo sapiens) CpG-island No: 13741
agtcgcgtcggcgtttcgtaggacggcgcgggggcggggtcggcggaagcgttcgagtgtcgttgtcggtgcgtcggaagtttttagttaggtttggcggtaattttgggggttttattgtagtcgtcgttgttgttggagtgggttttgcgagtttgaacgttggcggggttaggttcgttaattgtcgagagttttcgggtttgcggtggaggacgttgaggttcgtggggggtaggtattcgggcgtcggttttttagtcgatatgtttttagtggcggaagttttcgttttttagattgtaggtagcgcggttggtcgtagatttagaaggtggcggcgcggtttcggggagtcgcgtggggtatagggttggagtttttttttagttttgcggtattatacgttgaattcggttcggatggtggaggcgggtacggattattaattttattttatatatgggaaaattgagaaggagatatttggttaaggttatttcg

SEQ ID NO: 13742 - DNA, 504 bp, Artificial Sequence
  chemically treated genomic DNA (Homo sapiens) CpG-island No: 13742
cgaaataaccttaaccaaatatctccttctcaattttcccatatataaaataaaattaataatccgtacccgcctccaccatccgaaccgaattcaacgtataataccgcaaaactaaaaaaaaactccaaccctataccccacgcgactccccgaaaccgcgccgccaccttctaaatctacgaccaaccgcgctacctacaatctaaaaaacgaaaacttccgccactaaaaacatatcgactaaaaaaccgacgcccgaatacctaccccccacgaacctcaacgtcctccaccgcaaacccgaaaactctcgacaattaacgaacctaaccccgccaacgttcaaactcgcaaaacccactccaacaacaacgacgactacaataaaacccccaaaattaccgccaaacctaactaaaaacttccgacgcaccgacaacgacactcgaacgcttccgccgaccccgcccccgcgccgtcctacgaaacgccgacgcgact

SEQ ID NO: 13743 - DNA, 504 bp, Artificial Sequence
  chemically treated genomic DNA (Homo sapiens) CpG-island No: 13743
cggggtgattttggttaagtgttttttttttagtttttttatatgtgagataaggttggtagttcgtgttcgtttttattattcgggtcgggtttagcgtataatgtcgtaaggttggaggaaagttttagttttgtattttacgcggtttttcgagatcgcgtcgttattttttgggtttgcggttagtcgcgttatttgtaatttgggagacgaaggttttcgttattagagatatgtcggttgggaggtcggcgttcgggtgtttgttttttacgggttttagcgttttttatcgtaaattcggaggttttcggtagttaacgagtttagtttcgttaacgtttagattcgtaaagtttattttaatagtagcggcggttgtagtgaggtttttaaggttatcgttaggtttggttagggattttcggcgtatcgataacggtattcgagcgttttcgtcggtttcgttttcgcgtcgttttacggggcgtcggcgcggtt

SEQ ID NO: 13744 - DNA, 504 bp, Artificial Sequence
  chemically treated genomic DNA (Homo sapiens) CpG-island No: 13744
aaccgcgccgacgccccgtaaaacgacgcgaaaacgaaaccgacgaaaacgctcgaataccgttatcgatacgccgaaaatccctaaccaaacctaacgataaccttaaaaacctcactacaaccgccgctactattaaaataaactttacgaatctaaacgttaacgaaactaaactcgttaactaccgaaaacctccgaatttacgataaaaaacgctaaaacccgtaaaaaacaaacacccgaacgccgacctcccaaccgacatatctctaataacgaaaaccttcgtctcccaaattacaaataacgcgactaaccgcaaacccaaaaaataacgacgcgatctcgaaaaaccgcgtaaaatacaaaactaaaactttcctccaaccttacgacattatacgctaaacccgacccgaataataaaaacgaacacgaactaccaaccttatctcacatataaaaaaactaaaaaaaaaacacttaaccaaaatcaccccg

SEQ ID NO: 13745 - DNA, 655 bp, Artificial Sequence
  chemically treated genomic DNA (Homo sapiens) CpG-island No: 13745
ggcgggggcgcgtgcgcggggttttaggtttaatttcgtagtggcgttcgttggttgggcgttggggtagggttgggatcgcggcggatcgtcgcgttttattattatcgttatcgttcgtatcgttcgggaagtcgggtagcggtttatttaggagcgtacgtagcggtcgggttcggaggtagaggcggttaggggcggcgggggaacgtacgggtggtagagtcgtttatcgtcgtcgttgtcgggggttgggagggtatcgcggattacgaggtagagaatacggtcgatttgggggtaaaattatacgaggcgaattcggcggcggtggcggtcggttattagttatatttgtaggtcgttttgcgtttggttttcggtcgaagcgtcgcgaatatttcgtcgtttttatggtttataagcgagtttacgtagtagttgttgagggtgttattggaagatattttgaggcgtttcgtatttttatttaatattatattgttcgtcgtcgagtagtttttcgtcggcgttcgagttatcgattagttcgtaggttgtagtttttattattggtcgcgcggtttacgtgattatatttattaatatcgggagtaaattagttcgttaaattgggggttgttgtgattaaaaa

SEQ ID NO: 13746 - DNA, 655 bp, Artificial Sequence
  chemically treated genomic DNA (Homo sapiens) CpG-island No: 13746
tttttaatcacaacaacccccaatttaacgaactaatttactcccgatattaataaatataatcacgtaaaccgcgcgaccaataataaaaactacaacctacgaactaatcgataactcgaacgccgacgaaaaactactcgacgacgaacaatataatattaaataaaaatacgaaacgcctcaaaatatcttccaataacaccctcaacaactactacgtaaactcgcttataaaccataaaaacgacgaaatattcgcgacgcttcgaccgaaaaccaaacgcaaaacgacctacaaatataactaataaccgaccgccaccgccgccgaattcgcctcgtataattttacccccaaatcgaccgtattctctacctcgtaatccgcgataccctcccaacccccgacaacgacgacgataaacgactctaccacccgtacgttcccccgccgcccctaaccgcctctacctccgaacccgaccgctacgtacgctcctaaataaaccgctacccgacttcccgaacgatacgaacgataacgataataataaaacgcgacgatccgccgcgatcccaaccctaccccaacgcccaaccaacgaacgccactacgaaattaaacctaaaaccccgcgcacgcgcccccgcc

SEQ ID NO: 13747 - DNA, 655 bp, Artificial Sequence
  chemically treated genomic DNA (Homo sapiens) CpG-island No: 13747
tttttaattatagtagtttttagtttagcggattgatttattttcggtattggtaaatatgattacgtgggtcgcgcgattaatggtggaggttgtagtttgcgaattagtcggtggttcgggcgtcggcggggagttgttcggcggcggatagtgtaatgttgggtgggagtgcgggacgttttaaaatgttttttagtggtatttttagtaattattacgtggattcgtttataggttatgagggcgacgaggtgttcgcggcgtttcggtcgggggttaggcgtagggcggtttgtaggtgtggttgatggtcggtcgttatcgtcgtcgagttcgtttcgtgtagttttgtttttagatcggtcgtgttttttgtttcgtggttcgcggtgtttttttagttttcggtagcggcggcgatgagcggttttattattcgtacgttttttcgtcgtttttggtcgtttttgttttcgagttcggtcgttacgtgcgtttttggatggatcgttgttcggtttttcgggcggtgcgggcggtggcggtggtggtggagcgcggcggttcgtcgcggttttagttttgttttagcgtttagttaacgggcgttattacgggattaagtttgaaatttcgcgtacgcgttttcgtt

SEQ ID NO: 13748 - DNA, 655 bp, Artificial Sequence
  chemically treated genomic DNA (Homo sapiens) CpG-island No: 13748
aacgaaaacgcgtacgcgaaatttcaaacttaatcccgtaataacgcccgttaactaaacgctaaaacaaaactaaaaccgcgacgaaccgccgcgctccaccaccaccgccaccgcccgcaccgcccgaaaaaccgaacaacgatccatccaaaaacgcacgtaacgaccgaactcgaaaacaaaaacgaccaaaaacgacgaaaaaacgtacgaataataaaaccgctcatcgccgccgctaccgaaaactaaaaaaacaccgcgaaccacgaaacaaaaaacacgaccgatctaaaaacaaaactacacgaaacgaactcgacgacgataacgaccgaccatcaaccacacctacaaaccgccctacgcctaacccccgaccgaaacgccgcgaacacctcgtcgccctcataacctataaacgaatccacgtaataattactaaaaataccactaaaaaacattttaaaacgtcccgcactcccacccaacattacactatccgccgccgaacaactccccgccgacgcccgaaccaccgactaattcgcaaactacaacctccaccattaatcgcgcgacccacgtaatcatatttaccaataccgaaaataaatcaatccgctaaactaaaaactactataattaaaaa

SEQ ID NO: 13749 - DNA, 586 bp, Artificial Sequence
  chemically treated genomic DNA (Homo sapiens) CpG-island No: 13749
tcgcggtttgggttgtttacggcgtttttttttgacgttcgtagtcgtcgggttatgtaatgtgtgattttttttttttttttttttcgttatcgcgtttcggtcgtcgttagttttacgtgtttagtcgatttttggcgtacggttttttttttcgcgtcgcgtattttcggattcggttagatcgcgtcgtaaatttttttttatttgcggcgttcggtcggttatttagttcgcgttatttatattagcgcgcgttcgggcgttcgttttataagcgtttgtagaatgttattcgttatcgtcgtttttattcgtattttagttatagcgttttttcgtatttcgttttcgacgttttcggtgtattttagaatcggtcggaatgttcgaaggcggttgttgtttttttgtttttttttgttgtttgttcgttcgttaaatacgttgggcgtcgttttttaattgttttttcgagagttttttgtttatttttgtattgttatagtgacgtcgttttgggttatcgagcggcgttgtgtttcgttgttttttttatttatttttagtttgtaaagaaataatt

SEQ ID NO: 13750 - DNA, 586 bp, Artificial Sequence
  chemically treated genomic DNA (Homo sapiens) CpG-island No: 13750
aattatttctttacaaactaaaaataaataaaaaaaacaacgaaacacaacgccgctcgataacccaaaacgacgtcactataacaatacaaaaataaacaaaaaactctcgaaaaaacaattaaaaaacgacgcccaacgtatttaacgaacgaacaaacaacaaaaaaaaacaaaaaaacaacaaccgccttcgaacattccgaccgattctaaaatacaccgaaaacgtcgaaaacgaaatacgaaaaaacgctataactaaaatacgaataaaaacgacgataacgaataacattctacaaacgcttataaaacgaacgcccgaacgcgcgctaatataaataacgcgaactaaataaccgaccgaacgccgcaaataaaaaaaaatttacgacgcgatctaaccgaatccgaaaatacgcgacgcgaaaaaaaaaaccgtacgccaaaaatcgactaaacacgtaaaactaacgacgaccgaaacgcgataacgaaaaaaaaaaaaaaaaaaaatcacacattacataacccgacgactacgaacgtcaaaaaaaaacgccgtaaacaacccaaaccgcga

SEQ ID NO: 13751 - DNA, 586 bp, Artificial Sequence
  chemically treated genomic DNA (Homo sapiens) CpG-island No: 13751
gattatttttttataaattgagaataggtaggaagagtagcgaaatatagcgtcgttcggtggtttagagcggcgttattgtaatagtatagaagtgggtaaggggttttcggaaggatagttggggaacggcgtttagcgtatttagcgaacggataagtagtaaggaaaaataagggagtaataatcgttttcggatatttcgatcggttttgggatgtatcggggacgtcgaaggcggggtgcggaaaaacgttgtggttggagtgcgggtgggagcggcggtgacgggtgatattttataaacgtttgtggaacgaacgttcgaacgcgcgttgatatgaatggcgcgaattgaatggtcggtcgagcgtcgtaggtaggaaggagtttgcggcgcggtttgatcgggttcggagatgcgcggcgcggagggaagggtcgtgcgttaggggtcggttgggtacgtggggttggcggcggtcggggcgcgatgacggaagggaaggggaggggaggttatatattatataattcggcggttgcgagcgttaggggaaggcgtcgtggatagtttaggtcgcga

SEQ ID NO: 13752 - DNA, 586 bp, Artificial Sequence
  chemically treated genomic DNA (Homo sapiens) CpG-island No: 13752
tcgcgacctaaactatccacgacgccttcccctaacgctcgcaaccgccgaattatataatatataacctcccctccccttcccttccgtcatcgcgccccgaccgccgccaaccccacgtacccaaccgacccctaacgcacgacccttccctccgcgccgcgcatctccgaacccgatcaaaccgcgccgcaaactccttcctacctacgacgctcgaccgaccattcaattcgcgccattcatatcaacgcgcgttcgaacgttcgttccacaaacgtttataaaatatcacccgtcaccgccgctcccacccgcactccaaccacaacgtttttccgcaccccgccttcgacgtccccgatacatcccaaaaccgatcgaaatatccgaaaacgattattactcccttatttttccttactacttatccgttcgctaaatacgctaaacgccgttccccaactatccttccgaaaaccccttacccacttctatactattacaataacgccgctctaaaccaccgaacgacgctatatttcgctactcttcctacctattctcaatttataaaaaaataatc

SEQ ID NO: 13753 - DNA, 512 bp, Artificial Sequence
  chemically treated genomic DNA (Homo sapiens) CpG-island No: 13753
atcgtttttatatttattaggtaatatgtcgggtggaagacgtggcggttttcgtttagtagttatttttttattttttcgggttcgtttgattcgagagggcgggcgaggtaagtatttcgttggtggataaggtagcgatttcggcgggcgaaggttgcgcgtcgggggcgaaggattttagttgttttaggtttttgtgattcgcgtttttggtttcgagcgcggtttgttgacgacggcgttttcgcggttgtttggatacggttaattatagcgcggtttttggagtcgtttcgtttatagatcgcgtttttattggggcgatggttgcggatcgtggttaagaggtcggggtcgtcgaggtcgttatcgagttaggtgcggaaagtcggcgttcggaattattcgggtcgggacgatttttattttagatttttaaatagaggttacgttagagggatagggcgagtggcgttgttttttgcgtttattgttaatgggaaaattaa

SEQ ID NO: 13754 - DNA, 512 bp, Artificial Sequence
  chemically treated genomic DNA (Homo sapiens) CpG-island No: 13754
ttaattttcccattaacaataaacgcaaaaaacaacgccactcgccctatccctctaacgtaacctctatttaaaaatctaaaataaaaatcgtcccgacccgaataattccgaacgccgactttccgcacctaactcgataacgacctcgacgaccccgacctcttaaccacgatccgcaaccatcgccccaataaaaacgcgatctataaacgaaacgactccaaaaaccgcgctataattaaccgtatccaaacaaccgcgaaaacgccgtcgtcaacaaaccgcgctcgaaaccaaaaacgcgaatcacaaaaacctaaaacaactaaaatccttcgcccccgacgcgcaaccttcgcccgccgaaatcgctaccttatccaccaacgaaatacttacctcgcccgccctctcgaatcaaacgaacccgaaaaaataaaaaaataactactaaacgaaaaccgccacgtcttccacccgacatattacctaataaatataaaaacgat

SEQ ID NO: 13755 - DNA, 512 bp, Artificial Sequence
  chemically treated genomic DNA (Homo sapiens) CpG-island No: 13755
ttaatttttttattgatagtaggcgtaaggggtaacgttattcgttttgtttttttagcgtggtttttgtttgggggtttggggtggaggtcgtttcggttcgggtggtttcggacgtcggtttttcgtatttggttcggtgacggtttcggcggtttcggttttttggttacggttcgtagttatcgttttagtgagggcgcggtttgtgggcggggcggttttaggagtcgcgttgtgattggtcgtgtttaggtaatcgcggagacgtcgtcgttaatagatcgcgttcggaattagaggcgcgggttatagagatttagaatagttggaatttttcgttttcggcgcgtagttttcgttcgtcggaatcgttgttttatttattagcgggatgtttatttcgttcgttttttcgggttaggcgggttcgggaggatgggagggtggttgttgagcgggagtcgttacgttttttattcgatatattgtttagtaagtgtgggagcgat

SEQ ID NO: 13756 - DNA, 512 bp, Artificial Sequence
  chemically treated genomic DNA (Homo sapiens) CpG-island No: 13756
atcgctcccacacttactaaacaatatatcgaataaaaaacgtaacgactcccgctcaacaaccaccctcccatcctcccgaacccgcctaacccgaaaaaacgaacgaaataaacatcccgctaataaataaaacaacgattccgacgaacgaaaactacgcgccgaaaacgaaaaattccaactattctaaatctctataacccgcgcctctaattccgaacgcgatctattaacgacgacgtctccgcgattacctaaacacgaccaatcacaacgcgactcctaaaaccgccccgcccacaaaccgcgccctcactaaaacgataactacgaaccgtaaccaaaaaaccgaaaccgccgaaaccgtcaccgaaccaaatacgaaaaaccgacgtccgaaaccacccgaaccgaaacgacctccaccccaaacccccaaacaaaaaccacgctaaaaaaacaaaacgaataacgttaccccttacgcctactatcaataaaaaaattaa

SEQ ID NO: 13757 - DNA, 527 bp, Artificial Sequence
  chemically treated genomic DNA (Homo sapiens) CpG-island No: 13757
taggcgggaaaggtgtggggcgaggcggtcgcgggtttttggtatttttttttttacgtttaggttaagttggcgttgttgttggtgacgttggtggcggttacggttttttatttgcggatggagtagaagttgcggcggggcgtggtttcgcggtagtttcgtatttcgcggttttagtataaggtgcgcggttatcgttatttggaggaggataattcggacgagagcgacgcggagggcgattttggggacggcgaggaggcggaggcggaggtttcgttcgtagggtttaggtttggtttcgagttcgttggattcggtcgtcggttttgttcgtacgaataggcgtagggggcgatgggtcggaggagtagtgaggggtcgtttggttttcggatttagttttttttttcgtcggttttagtttattacgttttaggtcggggggatttttttcgagtttcgcgttgtttttaaaggtttttgtttttttttttttacgttggggacgttttttttagagt

SEQ ID NO: 13758 - DNA, 527 bp, Artificial Sequence
  chemically treated genomic DNA (Homo sapiens) CpG-island No: 13758
actctaaaaaaaacgtccccaacgtaaaaaaaaaaaaacaaaaacctttaaaaacaacgcgaaactcgaaaaaaatccccccgacctaaaacgtaataaactaaaaccgacgaaaaaaaaaactaaatccgaaaaccaaacgacccctcactactcctccgacccatcgccccctacgcctattcgtacgaacaaaaccgacgaccgaatccaacgaactcgaaaccaaacctaaaccctacgaacgaaacctccgcctccgcctcctcgccgtccccaaaatcgccctccgcgtcgctctcgtccgaattatcctcctccaaataacgataaccgcgcaccttatactaaaaccgcgaaatacgaaactaccgcgaaaccacgccccgccgcaacttctactccatccgcaaataaaaaaccgtaaccgccaccaacgtcaccaacaacaacgccaacttaacctaaacgtaaaaaaaaaaataccaaaaacccgcgaccgcctcgccccacacctttcccgccta

SEQ ID NO: 13759 - DNA, 527 bp, Artificial Sequence
  chemically treated genomic DNA (Homo sapiens) CpG-island No: 13759
gttttgggaggggcgtttttaacgtgggggaggggagataggggtttttgaagatagcgcgggattcggagggggttttttcgatttaagacgtggtaaattgaggtcggcgaggagggaggttgagttcggggattaggcggttttttattgttttttcggtttatcgttttttgcgtttgttcgtacgggtagggtcggcggtcgagtttagcgggttcggggttaggtttgggttttgcgggcggagttttcgttttcgttttttcgtcgtttttaagatcgtttttcgcgtcgttttcgttcgagttgtttttttttaagtagcggtaatcgcgtattttgtgttggggtcgcgggatgcggggttgtcgcggggttacgtttcgtcgtagtttttgttttattcgtaggtaggagatcgtggtcgttattagcgttattagtagtaacgttagtttagtttgggcgtaaggagagggatgttagggattcgcggtcgtttcgttttatatttttttcgttta

SEQ ID NO: 13760 - DNA, 527 bp, Artificial Sequence
  chemically treated genomic DNA (Homo sapiens) CpG-island No: 13760
taaacgaaaaaaatataaaacgaaacgaccgcgaatccctaacatccctctccttacgcccaaactaaactaacgttactactaataacgctaataacgaccacgatctcctacctacgaataaaacaaaaactacgacgaaacgtaaccccgcgacaaccccgcatcccgcgaccccaacacaaaatacgcgattaccgctacttaaaaaaaaacaactcgaacgaaaacgacgcgaaaaacgatcttaaaaacgacgaaaaaacgaaaacgaaaactccgcccgcaaaacccaaacctaaccccgaacccgctaaactcgaccgccgaccctacccgtacgaacaaacgcaaaaaacgataaaccgaaaaaacaataaaaaaccgcctaatccccgaactcaacctccctcctcgccgacctcaatttaccacgtcttaaatcgaaaaaaccccctccgaatcccgcgctatcttcaaaaacccctatctcccctcccccacgttaaaaacgcccctcccaaaac

SEQ ID NO: 13761 - DNA, 540 bp, Artificial Sequence
  chemically treated genomic DNA (Homo sapiens) CpG-island No: 13761
atggcgttcggttatagcgttcgtatttttgcgttgcggcgtttcgtttgttagtttgatcgcgttttttgttatcgatgtttttgtatgatgacggcggatcggttatttttattgttttgattcgtgagattcgtatcgtcgatacgattttttgtggtttttcgcgtgttcggcgcggcgacgggtcgttttcgtattgtcgtcgcgttggagtcgttttgatgacggggagttagtcgttattgggtgttacgtatcggtttggtcgtgcgttcggcgcggacgttgggcgcgcggtgtgttagggttggatggttttttttttgtgtttttttgtagtgtggggcggtgtcgttttatcgtttggttggtttattagttcggtcgatgcgattcgatcgtttttcgtgagagcgaattacgagttcgcggtgagttaagcggcgcgttggtgtgtgtttattatgtatagtcgtgttggcgttttggtggtcgttatatcgcgtcgtagtcgtagtagcgtatgatgtttagcgg

SEQ ID NO: 13762 - DNA, 540 bp, Artificial Sequence
  chemically treated genomic DNA (Homo sapiens) CpG-island No: 13762
ccgctaaacatcatacgctactacgactacgacgcgatataacgaccaccaaaacgccaacacgactatacataataaacacacaccaacgcgccgcttaactcaccgcgaactcgtaattcgctctcacgaaaaacgatcgaatcgcatcgaccgaactaataaaccaaccaaacgataaaacgacaccgccccacactacaaaaaaacacaaaaaaaaaaccatccaaccctaacacaccgcgcgcccaacgtccgcgccgaacgcacgaccaaaccgatacgtaacacccaataacgactaactccccgtcatcaaaacgactccaacgcgacgacaatacgaaaacgacccgtcgccgcgccgaacacgcgaaaaaccacaaaaaatcgtatcgacgatacgaatctcacgaatcaaaacaataaaaataaccgatccgccgtcatcatacaaaaacatcgataacaaaaaacgcgatcaaactaacaaacgaaacgccgcaacgcaaaaatacgaacgctataaccgaacgccat

SEQ ID NO: 13763 - DNA, 540 bp, Artificial Sequence
  chemically treated genomic DNA (Homo sapiens) CpG-island No: 13763
tcgttaaatattatgcgttattgcgattgcgacgcgatgtgacggttattagaacgttagtacggttatgtatggtggatatatattagcgcgtcgtttagtttatcgcgaattcgtggttcgtttttacggaggacgatcgagtcgtatcggtcggattggtaggttaattagacgatggaacggtatcgttttatattatagggagatataaagagaagattatttagttttagtatatcgcgcgtttagcgttcgcgtcgagcgtacggttaggtcggtgcgtagtatttagtaacggttagtttttcgttattagagcgattttagcgcggcggtagtgcggggacggttcgtcgtcgcgtcgggtacgcgaggggttatagaaagtcgtgtcgacggtgcgagttttacggattagggtaatagggatagtcgattcgtcgttattatatagaggtatcggtagtaagaaacgcggttaagttgatagacgaagcgtcgtaacgtaagagtgcgagcgttgtgatcgagcgttat

SEQ ID NO: 13764 - DNA, 540 bp, Artificial Sequence
  chemically treated genomic DNA (Homo sapiens) CpG-island No: 13764
ataacgctcgatcacaacgctcgcactcttacgttacgacgcttcgtctatcaacttaaccgcgtttcttactaccgatacctctatataataacgacgaatcgactatccctattaccctaatccgtaaaactcgcaccgtcgacacgactttctataacccctcgcgtacccgacgcgacgacgaaccgtccccgcactaccgccgcgctaaaatcgctctaataacgaaaaactaaccgttactaaatactacgcaccgacctaaccgtacgctcgacgcgaacgctaaacgcgcgatatactaaaactaaataatcttctctttatatctccctataatataaaacgataccgttccatcgtctaattaacctaccaatccgaccgatacgactcgatcgtcctccgtaaaaacgaaccacgaattcgcgataaactaaacgacgcgctaatatatatccaccatacataaccgtactaacgttctaataaccgtcacatcgcgtcgcaatcgcaataacgcataatatttaacga

SEQ ID NO: 13765 - DNA, 763 bp, Artificial Sequence
  chemically treated genomic DNA (Homo sapiens) CpG-island No: 13765
cgtgacggcgcggggtggtttgtggtgagtggggggttagagttttcgcgcggggttatatttttatcgtcgtgtaagttgtagcgcggttagagtcgggttaagttttttaaagttcgtgttttcgtagtaaagtttgtaagaagttggggggacgttcgggttcgcgtgggttttttatcgattttcgggtcgcgtttttgtagcggttagagtttgcgagcgtggattcgttcggtcggggcgcgttgttcggggaaggcgggcgtttcggggaaggggcggcgggtacgaggcgcggggtatttatcgttttttttttggtgggtttattgcggacggcgttcggagcgcgcgagtttcgttcggcgttggtggtggtggcggcggcggtcgggttcggggggtcgcggcgacgagtttgtaagatagagtagcgggggttatggttcggtcggcgttcgggtagtcgcgcgttttttcgcggtttcgtttcgtttttagagggcggcgttgacggtagtcggcggtcgcgggcgttaggattgtacgggttaggcgcggggcggacgggtttcgttcgtcgtttttttggggagcgtgttaggattcgttcggcgttttcggcggcggtttcgatttttcgttgtttgtttgttttttttttttaggtttcgggtagtttcggggaaagtttgggtcgcggcgtaggttttttatcgtgcgttttttttcggggttgggtgtcgggttttttgaggtt

SEQ ID NO: 13766 - DNA, 763 bp, Artificial Sequence
  chemically treated genomic DNA (Homo sapiens) CpG-island No: 13766
aacctcaaaaaacccgacacccaaccccgaaaaaaaacgcacgataaaaaacctacgccgcgacccaaactttccccgaaactacccgaaacctaaaaaaaaaaaacaaacaaacaacgaaaaatcgaaaccgccgccgaaaacgccgaacgaatcctaacacgctccccaaaaaaacgacgaacgaaacccgtccgccccgcgcctaacccgtacaatcctaacgcccgcgaccgccgactaccgtcaacgccgccctctaaaaacgaaacgaaaccgcgaaaaaacgcgcgactacccgaacgccgaccgaaccataacccccgctactctatcttacaaactcgtcgccgcgaccccccgaacccgaccgccgccgccaccaccaccaacgccgaacgaaactcgcgcgctccgaacgccgtccgcaataaacccaccaaaaaaaaaacgataaataccccgcgcctcgtacccgccgccccttccccgaaacgcccgccttccccgaacaacgcgccccgaccgaacgaatccacgctcgcaaactctaaccgctacaaaaacgcgacccgaaaatcgataaaaaacccacgcgaacccgaacgtccccccaacttcttacaaactttactacgaaaacacgaactttaaaaaacttaacccgactctaaccgcgctacaacttacacgacgataaaaatataaccccgcgcgaaaactctaaccccccactcaccacaaaccaccccgcgccgtcacg

SEQ ID NO: 13767 - DNA, 763 bp, Artificial Sequence
  chemically treated genomic DNA (Homo sapiens) CpG-island No: 13767
ggttttagggagttcggtatttagtttcggagaggggcgtacggtggggagtttacgtcgcggtttaaatttttttcgggattgttcggggtttggagggaggaaataggtaagtagcgaggggtcgggatcgtcgtcgagggcgtcgggcgggttttggtacgttttttagggaggcgacgggcgggattcgttcgtttcgcgtttggttcgtgtaattttggcgttcgcggtcgtcggttgtcgttagcgtcgttttttaggagcggggcgggatcgcgggaaggcgcgcggttgttcgagcgtcggtcgggttatgattttcgttgttttgttttgtaggttcgtcgtcgcggtttttcgagttcgatcgtcgtcgttattattattagcgtcgggcggggttcgcgcgtttcgggcgtcgttcgtagtgagtttattaagaaggaagcggtgagtgtttcgcgtttcgtgttcgtcgtttttttttcgggacgttcgtttttttcgagtaacgcgtttcggtcgggcgggtttacgttcgtaagttttagtcgttgtaggggcgcggttcgggggtcggtgggagatttacgcgggttcgggcgtttttttaattttttgtagattttgttgcggagatacgggttttgggaaatttggttcggttttggtcgcgttgtaatttgtacggcggtgggggtgtgatttcgcgcggaagttttggttttttatttattataggttatttcgcgtcgttacg

SEQ ID NO: 13768 - DNA, 763 bp, Artificial Sequence
  chemically treated genomic DNA (Homo sapiens) CpG-island No: 13768
cgtaacgacgcgaaataacctataataaataaaaaaccaaaacttccgcgcgaaatcacacccccaccgccgtacaaattacaacgcgaccaaaaccgaaccaaatttcccaaaacccgtatctccgcaacaaaatctacaaaaaattaaaaaaacgcccgaacccgcgtaaatctcccaccgacccccgaaccgcgcccctacaacgactaaaacttacgaacgtaaacccgcccgaccgaaacgcgttactcgaaaaaaacgaacgtcccgaaaaaaaaacgacgaacacgaaacgcgaaacactcaccgcttccttcttaataaactcactacgaacgacgcccgaaacgcgcgaaccccgcccgacgctaataataataacgacgacgatcgaactcgaaaaaccgcgacgacgaacctacaaaacaaaacaacgaaaatcataacccgaccgacgctcgaacaaccgcgcgccttcccgcgatcccgccccgctcctaaaaaacgacgctaacgacaaccgacgaccgcgaacgccaaaattacacgaaccaaacgcgaaacgaacgaatcccgcccgtcgcctccctaaaaaacgtaccaaaacccgcccgacgccctcgacgacgatcccgacccctcgctacttacctatttcctccctccaaaccccgaacaatcccgaaaaaaatttaaaccgcgacgtaaactccccaccgtacgcccctctccgaaactaaataccgaactccctaaaacc

SEQ ID NO: 13769 - DNA, 750 bp, Artificial Sequence
  chemically treated genomic DNA (Homo sapiens) CpG-island No: 13769
gtcgcgcggcgttttagtcgagaagcgggacgaggcggcggcgattgatggcgcggcgcgggttggcgggggattttttaggttcggtttcgtttgggtttcggtttttggaaaagcgattcgcgtttttgggaagtcgtagttttagattttagtcgcgtttttcgttcggcgtcgtcggaaagtagtttttttaacgtttgtcggaaagtagttcggttcggtattttacgacgttcgtagcgttattttttttcgttttacggtgattttcgtgcggtcgggtgcgggcggagtttttttcgatttcgtggtgttcgcgcgcggttttgttttttttcggtcgcgggatatcgggtgtagagggcggtcgcggcgggtagtggcggtaggtgagataggaggtggtcggatgcgcgtcgttaggtcgggtcgggtcgggggtcgggagttattaagtttgtacgttcgtagtttggtcgttcggttttagtaggaagtatcgaatgggtttcggagttaggtgatattgaggtcggtcgtggggatttcgggttcggtggttttaggttcggggggtcgtttcgaagtgttcggtttattttattcggtttcgtagcggttgcggatcggtttcgggtattgattttggagcgttcgttggtcgagggtttaggttgcggggaggcgggttcgcgttttgtgtttgtagttttcgtttttgtttttttaaaaggtttttgtgtaatt

SEQ ID NO: 13770 - DNA, 750 bp, Artificial Sequence
  chemically treated genomic DNA (Homo sapiens) CpG-island No: 13770
aattacacaaaaaccttttaaaaaaacaaaaacgaaaactacaaacacaaaacgcgaacccgcctccccgcaacctaaaccctcgaccaacgaacgctccaaaatcaatacccgaaaccgatccgcaaccgctacgaaaccgaataaaataaaccgaacacttcgaaacgaccccccgaacctaaaaccaccgaacccgaaatccccacgaccgacctcaatatcacctaactccgaaacccattcgatacttcctactaaaaccgaacgaccaaactacgaacgtacaaacttaataactcccgacccccgacccgacccgacctaacgacgcgcatccgaccacctcctatctcacctaccgccactacccgccgcgaccgccctctacacccgatatcccgcgaccgaaaaaaaacaaaaccgcgcgcgaacaccacgaaatcgaaaaaaactccgcccgcacccgaccgcacgaaaatcaccgtaaaacgaaaaaaaataacgctacgaacgtcgtaaaataccgaaccgaactactttccgacaaacgttaaaaaaactactttccgacgacgccgaacgaaaaacgcgactaaaatctaaaactacgacttcccaaaaacgcgaatcgcttttccaaaaaccgaaacccaaacgaaaccgaacctaaaaaatcccccgccaacccgcgccgcgccatcaatcgccgccgcctcgtcccgcttctcgactaaaacgccgcgcgac

SEQ ID NO: 13771 - DNA, 750 bp, Artificial Sequence
  chemically treated genomic DNA (Homo sapiens) CpG-island No: 13771
ggttgtatagggattttttgaaggagtaagggcggaggttgtaggtatagagcgcgggttcgttttttcgtagtttgagttttcggttagcgggcgttttaaggttagtgttcgaggtcggttcgtagtcgttgcgagatcgggtaagatggatcgggtatttcggggcggtttttcgagtttggagttatcgagttcggagtttttacggtcggttttaatgttatttggtttcgaggtttattcggtgttttttgttgaagtcgagcggttaggttgcggacgtgtagatttgatggttttcggttttcgattcggttcggtttggcggcgcgtattcggttattttttgttttatttgtcgttattgttcgtcgcgatcgttttttatattcggtgtttcgcgatcggaagagagtaaggtcgcgcgcgagtattacgggatcgaggaagatttcgttcgtattcggtcgtacggaggttatcgtggagcggaaaagggtagcgttgcgaacgtcgtaaaatgtcgggtcgggttgtttttcggtaggcgttggagaggttgtttttcggcggcgtcgggcgagaagcgcgattggagtttggggttgcggttttttagaggcgcgagtcgtttttttaggagtcgaggtttaaacggggtcgggtttgaagggtttttcgttagttcgcgtcgcgttattaatcgtcgtcgtttcgtttcgtttttcggttgaggcgtcgcgcggt

SEQ ID NO: 13772 - DNA, 750 bp, Artificial Sequence
  chemically treated genomic DNA (Homo sapiens) CpG-island No: 13772
accgcgcgacgcctcaaccgaaaaacgaaacgaaacgacgacgattaataacgcgacgcgaactaacgaaaaacccttcaaacccgaccccgtttaaacctcgactcctaaaaaaacgactcgcgcctctaaaaaaccgcaaccccaaactccaatcgcgcttctcgcccgacgccgccgaaaaacaacctctccaacgcctaccgaaaaacaacccgacccgacattttacgacgttcgcaacgctacccttttccgctccacgataacctccgtacgaccgaatacgaacgaaatcttcctcgatcccgtaatactcgcgcgcgaccttactctcttccgatcgcgaaacaccgaatataaaaaacgatcgcgacgaacaataacgacaaataaaacaaaaaataaccgaatacgcgccgccaaaccgaaccgaatcgaaaaccgaaaaccatcaaatctacacgtccgcaacctaaccgctcgacttcaacaaaaaacaccgaataaacctcgaaaccaaataacattaaaaccgaccgtaaaaactccgaactcgataactccaaactcgaaaaaccgccccgaaatacccgatccatcttacccgatctcgcaacgactacgaaccgacctcgaacactaaccttaaaacgcccgctaaccgaaaactcaaactacgaaaaaacgaacccgcgctctatacctacaacctccgcccttactccttcaaaaaatccctatacaacc

SEQ ID NO: 13773 - DNA, 601 bp, Artificial Sequence
  chemically treated genomic DNA (Homo sapiens) CpG-island No: 13773
ggtgtacgcgtcgtttgcgtcgtaggtagaagtgtttttgtagtaggtagtcgtaggcgatcgtacgtagcgtcgcgaggtttagcgtaggtttaggttcgggttcgggttcgggttcgggtttcgttgggggcggcggtagattcgataggaatacggttttggtgaagtattggtattagcggtcggtatttagcgcgaaggtttgcgggtaaattatgtattttataaattgtattttggtgaggattcgtagtttttcgtttatcgatttcgtagcgtgtatcgtcgtttgttagcgttcgattcgtcgtagtcgtgtagttttgttgtcggttgttatggaggttataatcggcgggtatcgcgcgacgggggtcgtcgcgacgttttggtaggtcgtttttgtagtcgtggcggcggtattagtcgcggtgtgtaatgaaagtttcggatcgcgtagtaaaggtttttaatatttggtcgtcgttatttttgttcgcgatttcggatttagaggttaatttaagtaattgtttttgtttttttgttgtagggattaatcggaaagcggaatttgagttagtttgggaaaggacga

SEQ ID NO: 13774 - DNA, 601 bp, Artificial Sequence
  chemically treated genomic DNA (Homo sapiens) CpG-island No: 13774
tcgtcctttcccaaactaactcaaattccgctttccgattaatccctacaacaaaaaaacaaaaacaattacttaaattaacctctaaatccgaaatcgcgaacaaaaataacgacgaccaaatattaaaaacctttactacgcgatccgaaactttcattacacaccgcgactaataccgccgccacgactacaaaaacgacctaccaaaacgtcgcgacgacccccgtcgcgcgatacccgccgattataacctccataacaaccgacaacaaaactacacgactacgacgaatcgaacgctaacaaacgacgatacacgctacgaaatcgataaacgaaaaactacgaatcctcaccaaaatacaatttataaaatacataatttacccgcaaaccttcgcgctaaataccgaccgctaataccaatacttcaccaaaaccgtattcctatcgaatctaccgccgcccccaacgaaacccgaacccgaacccgaacccgaacctaaacctacgctaaacctcgcgacgctacgtacgatcgcctacgactacctactacaaaaacacttctacctacgacgcaaacgacgcgtacacc

SEQ ID NO: 13775 - DNA, 601 bp, Artificial Sequence
  chemically treated genomic DNA (Homo sapiens) CpG-island No: 13775
tcgtttttttttagattggtttagatttcgtttttcgattggtttttatagtaagagggtaaggataattgtttaagttgatttttgggttcggaatcgcgggtaaagatggcggcggttaggtgttggaggtttttgttacgcggttcgaggtttttattgtatatcgcggttaatgtcgtcgttacggttatagaaacgatttgttaagacgtcgcggcgattttcgtcgcgcggtattcgtcgattgtggtttttatgatagtcgatagtaaagttgtacggttgcggcggatcgagcgttggtaggcgacggtgtacgttgcggagtcggtagacgagaagttgcgaatttttattaagatgtagtttatgaagtatatggtttattcgtagattttcgcgttgaatgtcgatcgttggtattagtattttattaagatcgtgtttttgtcgggtttgtcgtcgtttttagcggagttcgagttcgagttcgaattcgaatttgaatttgcgttggatttcgcggcgttgcgtgcggtcgtttgcgattgtttgttgtaggagtatttttatttgcggcgtaggcggcgcgtgtatt

SEQ ID NO: 13776 - DNA, 601 bp, Artificial Sequence
  chemically treated genomic DNA (Homo sapiens) CpG-island No: 13776
aatacacgcgccgcctacgccgcaaataaaaatactcctacaacaaacaatcgcaaacgaccgcacgcaacgccgcgaaatccaacgcaaattcaaattcgaattcgaactcgaactcgaactccgctaaaaacgacgacaaacccgacaaaaacacgatcttaataaaatactaataccaacgatcgacattcaacgcgaaaatctacgaataaaccatatacttcataaactacatcttaataaaaattcgcaacttctcgtctaccgactccgcaacgtacaccgtcgcctaccaacgctcgatccgccgcaaccgtacaactttactatcgactatcataaaaaccacaatcgacgaataccgcgcgacgaaaatcgccgcgacgtcttaacaaatcgtttctataaccgtaacgacgacattaaccgcgatatacaataaaaacctcgaaccgcgtaacaaaaacctccaacacctaaccgccgccatctttacccgcgattccgaacccaaaaatcaacttaaacaattatccttaccctcttactataaaaaccaatcgaaaaacgaaatctaaaccaatctaaaaaaaaacga

SEQ ID NO: 13777 - DNA, 591 bp, Artificial Sequence
  chemically treated genomic DNA (Homo sapiens) CpG-island No: 13777
aaagaagtaagtttcgggtattagggttcgtagtgattagtcgtcggttttttacgtttttagaggagacgatttggaattgattcgggagggttaagaaatatttttcgagtattaggttaaatttcgttagggagagagatcgggacgaaggttttaggttagtgcgatatcgtaggtcggggttttttggttggaggagcgcggtgggttgggaggggcgcgttggtgcgtattggaataggggttttcggtttgagtagcgcggtgagatagagttttcgcgttggaggggcgcggtgagatagaggttttgggttggagaggtgcgttggggcgtattggaatcggggtttcgggtttgagtggcgcggtgggatagagttttcgggttggaggggcgtagtgggatagaagattcgggttagaggggcgcggtgggacggagttttcgggatggacgggcgtagtgggataagggtttcggattggaggggcgcgttggggagtattggaataggggttttgagtaggaggggcgaggtgggttgggaggggcgcggtagggcgtattggaataggggttttggg

SEQ ID NO: 13778 - DNA, 591 bp, Artificial Sequence
  chemically treated genomic DNA (Homo sapiens) CpG-island No: 13778
cccaaaacccctattccaatacgccctaccgcgcccctcccaacccacctcgcccctcctactcaaaacccctattccaatactccccaacgcgcccctccaatccgaaacccttatcccactacgcccgtccatcccgaaaactccgtcccaccgcgcccctctaacccgaatcttctatcccactacgcccctccaacccgaaaactctatcccaccgcgccactcaaacccgaaaccccgattccaatacgccccaacgcacctctccaacccaaaacctctatctcaccgcgcccctccaacgcgaaaactctatctcaccgcgctactcaaaccgaaaacccctattccaatacgcaccaacgcgcccctcccaacccaccgcgctcctccaaccaaaaaaccccgacctacgatatcgcactaacctaaaaccttcgtcccgatctctctccctaacgaaatttaacctaatactcgaaaaatatttcttaaccctcccgaatcaattccaaatcgtctcctctaaaaacgtaaaaaaccgacgactaatcactacgaaccctaatacccgaaacttacttcttt

SEQ ID NO: 13779 - DNA, 591 bp, Artificial Sequence
  chemically treated genomic DNA (Homo sapiens) CpG-island No: 13779
tttaggatttttgttttagtgcgttttatcgcgttttttttagtttatttcgttttttttgtttaggatttttgttttaatgttttttaacgcgtttttttagttcgggatttttgttttattgcgttcgtttatttcgggagtttcgttttatcgcgtttttttagttcggattttttgttttattgcgtttttttagttcgggaattttgttttatcgcgttatttaagttcgggatttcggttttagtgcgttttaacgtatttttttagtttaggatttttgttttatcgcgtttttttagcgcgggaattttgttttatcgcgttgtttaagtcggggatttttgttttagtgcgtattaacgcgttttttttagtttatcgcgtttttttaattagggaatttcgatttgcggtgtcgtattagtttgggattttcgtttcggtttttttttttggcggggtttagtttggtattcggaaggtgttttttggttttttcgggttagttttaaatcgttttttttggaagcgtggaggatcggcggttggttattgcggattttggtgttcggggtttgttttttt

SEQ ID NO: 13780 - DNA, 591 bp, Artificial Sequence
  chemically treated genomic DNA (Homo sapiens) CpG-island No: 13780
aaaaaaacaaaccccgaacaccaaaatccgcaataaccaaccgccgatcctccacgcttccaaaaaaaacgatttaaaactaacccgaaaaaaccaaaaaacaccttccgaataccaaactaaaccccgccaaaaaaaaaaaccgaaacgaaaatcccaaactaatacgacaccgcaaatcgaaattccctaattaaaaaaacgcgataaactaaaaaaaacgcgttaatacgcactaaaacaaaaatccccgacttaaacaacgcgataaaacaaaattcccgcgctaaaaaaacgcgataaaacaaaaatcctaaactaaaaaaatacgttaaaacgcactaaaaccgaaatcccgaacttaaataacgcgataaaacaaaattcccgaactaaaaaaacgcaataaaacaaaaaatccgaactaaaaaaacgcgataaaacgaaactcccgaaataaacgaacgcaataaaacaaaaatcccgaactaaaaaaacgcgttaaaaaacattaaaacaaaaatcctaaacaaaaaaaacgaaataaactaaaaaaaacgcgataaaacgcactaaaacaaaaatcctaaa

SEQ ID NO: 13781 - DNA, 702 bp, Artificial Sequence
  chemically treated genomic DNA (Homo sapiens) CpG-island No: 13781
tcgggtttgggcggcgcggtgagacggagttttcgggttggaggggcgcggtgggataggggattcgggttggaggggcgcggcgagatcggggttttaggttggaaaggtgtaagtcgaggttggaggatcggcgggagggaatcgggaattcggcggagttaaggggcgtagagtgggggtggggtcgtgttgtcgggggagtttttttacgtaggaaggatcggggtcgcggattttatcgtttttatatttcgtcgtcgcggagttcgggtcgtttcggttgcgttcgggttttatttgttttcgttggtcgtgattacgtcgttttttttggggatgagtagcgcggtcgtgacggcgttttggtgtttttcgattttgtttagtagtatcgggcggttgttttgcggtttggagtggatttcggtcgttatgttcgcgcggcgattgttgcggttttttcggtaggtagtttattagttgacgtttgggcgggcgggggacgcgtcggttttttttcggttgttggggttttttgggcgtcgcgtcgtcgtaagttttcgagtgttgtcgtcgtatcgttcgtattgtttggggatgtcgcgtaagttgaaagtttgtggttgggagaggatgttacggggcgtttgcggagaaatggggaaagtaaggaaggtttaaaagtaaagttatttattt

SEQ ID NO: 13782 - DNA, 702 bp, Artificial Sequence
  chemically treated genomic DNA (Homo sapiens) CpG-island No: 13782
aaataaataactttacttttaaaccttccttactttccccatttctccgcaaacgccccgtaacatcctctcccaaccacaaactttcaacttacgcgacatccccaaacaatacgaacgatacgacgacaacactcgaaaacttacgacgacgcgacgcccaaaaaaccccaacaaccgaaaaaaaaccgacgcgtcccccgcccgcccaaacgtcaactaataaactacctaccgaaaaaaccgcaacaatcgccgcgcgaacataacgaccgaaatccactccaaaccgcaaaacaaccgcccgatactactaaacaaaatcgaaaaacaccaaaacgccgtcacgaccgcgctactcatccccaaaaaaaacgacgtaatcacgaccaacgaaaacaaataaaacccgaacgcaaccgaaacgacccgaactccgcgacgacgaaatataaaaacgataaaatccgcgaccccgatccttcctacgtaaaaaaactcccccgacaacacgaccccacccccactctacgccccttaactccgccgaattcccgattccctcccgccgatcctccaacctcgacttacacctttccaacctaaaaccccgatctcgccgcgcccctccaacccgaatcccctatcccaccgcgcccctccaacccgaaaactccgtctcaccgcgccgcccaaacccga

SEQ ID NO: 13783 - DNA, 702 bp, Artificial Sequence
  chemically treated genomic DNA (Homo sapiens) CpG-island No: 13783
gggtgaatggttttatttttaaattttttttattttttttattttttcgtaggcgtttcgtggtatttttttttagttatagatttttagtttgcgcggtatttttaggtaatacgggcggtgcggcggtagtattcgggggtttacggcggcgcggcgtttaagaggttttagtagtcgaagggaaatcggcgcgtttttcgttcgtttaggcgttagttgatgggttgtttgtcgaggaggtcgtagtagtcgtcgcgcgaatatggcggtcgaaatttattttaggtcgtagagtagtcgttcggtgttgttgagtaagatcgaggggtattaggacgtcgttacggtcgcgttgtttatttttaaggaggacggcgtgattacggttagcgaggataggtagggttcgggcgtagtcggggcggttcgaatttcgcgacgacggggtgtgggggcggtggggttcgcggtttcggttttttttgcgtgagggggttttttcggtagtacggttttatttttattttgcgttttttagtttcgtcgggttttcggttttttttcgtcggttttttagtttcgatttgtatttttttagtttgggatttcggtttcgtcgcgtttttttagttcggattttttgttttatcgcgtttttttagttcgggaatttcgttttatcgcgtcgtttaagttcgg

SEQ ID NO: 13784 - DNA, 702 bp, Artificial Sequence
  chemically treated genomic DNA (Homo sapiens) CpG-island No: 13784
ccgaacttaaacgacgcgataaaacgaaattcccgaactaaaaaaacgcgataaaacaaaaaatccgaactaaaaaaacgcgacgaaaccgaaatcccaaactaaaaaaatacaaatcgaaactaaaaaaccgacgaaaaaaaaccgaaaacccgacgaaactaaaaaacgcaaaataaaaataaaaccgtactaccgaaaaaaccccctcacgcaaaaaaaaccgaaaccgcgaaccccaccgcccccacaccccgtcgtcgcgaaattcgaaccgccccgactacgcccgaaccctacctatcctcgctaaccgtaatcacgccgtcctccttaaaaataaacaacgcgaccgtaacgacgtcctaatacccctcgatcttactcaacaacaccgaacgactactctacgacctaaaataaatttcgaccgccatattcgcgcgacgactactacgacctcctcgacaaacaacccatcaactaacgcctaaacgaacgaaaaacgcgccgatttcccttcgactactaaaacctcttaaacgccgcgccgccgtaaacccccgaatactaccgccgcaccgcccgtattacctaaaaataccgcgcaaactaaaaatctataactaaaaaaaaataccacgaaacgcctacgaaaaaataaaaaaaataaaaaaaatttaaaaataaaaccattcaccc

SEQ ID NO: 13785 - DNA, 1061 bp, Artificial Sequence
  chemically treated genomic DNA (Homo sapiens) CpG-island No: 13785
ttcggcggcgcgtagtttaagttcggggtaggggttgtcggcgagtagttggaaattttaggtttagggttagggtcggttcggatggtcgggtaggagttacgtcggtttcggtgtttttagttgcgggtattattggacgttatttcggggcggtttcgttttgttttgttcgggtttcgttcggggttttcggcgggcgggatcgggatgttcggcgagtatttagtttcggttaaggcggttcgcgggaggttgagaaagttttttgtttttcgacgtcggcgttttagggtttcgttggtttcgtagtttttcggtcgggcgtaaggttagggagtagggtcggtggcgcgcggagtttcggggagcgtttttcgtcgagggtagcgtcggtcgcgttcgggatttatcgcgtagtttgtatttatcgcgttcgttggatttttagggggcggtcgcggagggcggtgcggtcgtaatcggagcgggagtttggtttcggcggcgcggggagtcggaggacgtagttaagcggcggcggcgaggagggttatagtcggaaagaggtagcggtggcgtttgtagacgtcgcgtagttcgggtagttttatagcgtaagttggttgtcgcggcggcgggggttttatcggcggcgtcgcgcgggttttcgtttttttttgtcgttttcgttttcggttcgttttgtttcgttttttcgtcgttttttttgtgtggtcgcgggtcgtagcgttttcgcgttcggtttttaggacgtttttttttcgtttgcgatttttcggatgtcgtttcgttaggggttcgtgtcgtggggttgcgttcggaacgcgtcggggagacgcgtagatttcgaggtgcggcgttagttcgggtttagttgtacgtgggtttttcggatgggggtgtgtgaggtggcggggggaatattagggttcgtatcgcgtttttgagacgtagggtatgtcgttttggttgttttttggaagagatagagggcgttttgagatagcgtttagtttttcgggtgatggggaaacggt

SEQ ID NO: 13786 - DNA, 1061 bp, Artificial Sequence
  chemically treated genomic DNA (Homo sapiens) CpG-island No: 13786
accgtttccccatcacccgaaaaactaaacgctatctcaaaacgccctctatctcttccaaaaaacaaccaaaacgacataccctacgtctcaaaaacgcgatacgaaccctaatattccccccgccacctcacacacccccatccgaaaaacccacgtacaactaaacccgaactaacgccgcacctcgaaatctacgcgtctccccgacgcgttccgaacgcaaccccacgacacgaacccctaacgaaacgacatccgaaaaatcgcaaacgaaaaaaaaacgtcctaaaaaccgaacgcgaaaacgctacgacccgcgaccacacaaaaaaaacgacgaaaaaacgaaacaaaacgaaccgaaaacgaaaacgacaaaaaaaaacgaaaacccgcgcgacgccgccgataaaacccccgccgccgcgacaaccaacttacgctataaaactacccgaactacgcgacgtctacaaacgccaccgctacctctttccgactataaccctcctcgccgccgccgcttaactacgtcctccgactccccgcgccgccgaaaccaaactcccgctccgattacgaccgcaccgccctccgcgaccgccccctaaaaatccaacgaacgcgataaatacaaactacgcgataaatcccgaacgcgaccgacgctaccctcgacgaaaaacgctccccgaaactccgcgcgccaccgaccctactccctaaccttacgcccgaccgaaaaactacgaaaccaacgaaaccctaaaacgccgacgtcgaaaaacaaaaaactttctcaacctcccgcgaaccgccttaaccgaaactaaatactcgccgaacatcccgatcccgcccgccgaaaaccccgaacgaaacccgaacaaaacaaaacgaaaccgccccgaaataacgtccaataatacccgcaactaaaaacaccgaaaccgacgtaactcctacccgaccatccgaaccgaccctaaccctaaacctaaaatttccaactactcgccgacaacccctaccccgaacttaaactacgcgccgccgaa

SEQ ID NO: 13787 - DNA, 1061 bp, Artificial Sequence
  chemically treated genomic DNA (Homo sapiens) CpG-island No: 13787
atcgtttttttattattcggaggattgagcgttgttttagggcgttttttgttttttttagggggtagttaagacgatatgttttgcgttttagggacgcggtacgagttttggtatttttttcgttattttatatatttttattcgggagatttacgtgtagttgggttcgggttggcgtcgtatttcggggtttgcgcgttttttcggcgcgtttcgggcgtagttttacgatacggatttttggcggggcggtattcgagaagtcgtaggcggagagggggcgttttggaggtcgggcgcggggacgttgcggttcgcggttatataaaggaggcggcgggaaggcggggtaaggcgggtcgggggcgggggcggtaggaaggggcgggggttcgcgcggcgtcgtcgataaagttttcgtcgtcgcggtagttagtttgcgttgtggggttgttcgggttgcgcggcgtttgtaggcgttatcgttgttttttttcggttgtgatttttttcgtcgtcgtcgtttggttgcgtttttcgatttttcgcgtcgtcgagattaggttttcgtttcggttgcggtcgtatcgtttttcgcggtcgttttttggggatttagcgagcgcggtgagtataggttgcgcggtgagtttcgggcgcggtcggcgttgttttcggcgggggacgtttttcggggtttcgcgcgttatcggttttgttttttgattttgcgttcggtcgggaagttgcggggttagcgggattttggggcgtcgacgtcggggagtagagaatttttttagtttttcgcgggtcgttttggtcggggttgggtgttcgtcgggtatttcggtttcgttcgtcgggagtttcgagcgggattcgggtagggtaaggcggggtcgtttcggggtggcgtttagtgatattcgtagttgggagtatcggggtcggcgtggtttttgttcggttattcgagtcggttttgattttgaatttgaggtttttagttgttcgtcggtaatttttatttcggatttaggttgcgcgtcgtcgga

SEQ ID NO: 13788 - DNA, 1061 bp, Artificial Sequence
  chemically treated genomic DNA (Homo sapiens) CpG-island No: 13788
tccgacgacgcgcaacctaaatccgaaataaaaattaccgacgaacaactaaaaacctcaaattcaaaatcaaaaccgactcgaataaccgaacaaaaaccacgccgaccccgatactcccaactacgaatatcactaaacgccaccccgaaacgaccccgccttaccctacccgaatcccgctcgaaactcccgacgaacgaaaccgaaatacccgacgaacacccaaccccgaccaaaacgacccgcgaaaaactaaaaaaattctctactccccgacgtcgacgccccaaaatcccgctaaccccgcaacttcccgaccgaacgcaaaatcaaaaaacaaaaccgataacgcgcgaaaccccgaaaaacgtcccccgccgaaaacaacgccgaccgcgcccgaaactcaccgcgcaacctatactcaccgcgctcgctaaatccccaaaaaacgaccgcgaaaaacgatacgaccgcaaccgaaacgaaaacctaatctcgacgacgcgaaaaatcgaaaaacgcaaccaaacgacgacgacgaaaaaaatcacaaccgaaaaaaaacaacgataacgcctacaaacgccgcgcaacccgaacaaccccacaacgcaaactaactaccgcgacgacgaaaactttatcgacgacgccgcgcgaacccccgccccttcctaccgcccccgcccccgacccgccttaccccgccttcccgccgcctcctttatataaccgcgaaccgcaacgtccccgcgcccgacctccaaaacgccccctctccgcctacgacttctcgaataccgccccgccaaaaatccgtatcgtaaaactacgcccgaaacgcgccgaaaaaacgcgcaaaccccgaaatacgacgccaacccgaacccaactacacgtaaatctcccgaataaaaatatataaaataacgaaaaaaataccaaaactcgtaccgcgtccctaaaacgcaaaacatatcgtcttaactaccccctaaaaaaaacaaaaaacgccctaaaacaacgctcaatcctccgaataataaaaaaacgat

SEQ ID NO: 13789 - DNA, 710 bp, Artificial Sequence
  chemically treated genomic DNA (Homo sapiens) CpG-island No: 13789
ttaggattttttgttcgtcgcggttttttgttttttgtcgtcgcggttttttttgttttcgcggttttttgttcgattcggttttttgttttttcggtcgttgtggttttttgtcgtcgcggttttttgtcgtcgcggttttttgttttttcgtcgttatggtttttttatgtcgcggttttttgttcgtttcggttttttgttttttagttatcgcggtttattgatttatcgtcgcgcggttttttgttttttgcgtcgcggttttttgtttttttagcgtcgcggttttttttttcgtagttttttgtattttcgtcgtcgtcgtggttttttgtttcgcggttttttcgttacgtcgtcgcggtttgttgtcggttgcggttttttgttattttttacgttattgtggttttttgcgtttttgtgttttcgtcgttttggttttttgttcgcgttattattgttttttgtatttttaagtttttcgcgtcgcggttatttgtttttcgtcgtcgcgacgttatatggttttttgtttttattgttttttgtttcgcgtcgcggttttttgtttttttattatcgtagttttttgcgtttcggttttttgttttattaggtcgcggttttttttttatggttatcgttagaagtgtgagtggaatagagtgaagggaaagttgtttttttcgaaagtttaaaaattt

SEQ ID NO: 13790 - DNA, 710 bp, Artificial Sequence
  chemically treated genomic DNA (Homo sapiens) CpG-island No: 13790
aaatttttaaactttcgaaaaaaacaactttcccttcactctattccactcacacttctaacgataaccataaaaaaaaaaccgcgacctaataaaacaaaaaaccgaaacgcaaaaaactacgataataaaaaaacaaaaaaccgcgacgcgaaacaaaaaacaataaaaacaaaaaaccatataacgtcgcgacgacgaaaaacaaataaccgcgacgcgaaaaacttaaaaatacaaaaaacaataataacgcgaacaaaaaaccaaaacgacgaaaacacaaaaacgcaaaaaaccacaataacgtaaaaaataacaaaaaaccgcaaccgacaacaaaccgcgacgacgtaacgaaaaaaccgcgaaacaaaaaaccacgacgacgacgaaaatacaaaaaactacgaaaaaaaaaaccgcgacgctaaaaaaacaaaaaaccgcgacgcaaaaaacaaaaaaccgcgcgacgataaatcaataaaccgcgataactaaaaaacaaaaaaccgaaacgaacaaaaaaccgcgacataaaaaaaccataacgacgaaaaaacaaaaaaccgcgacgacaaaaaaccgcgacgacaaaaaaccacaacgaccgaaaaaacaaaaaaccgaatcgaacaaaaaaccgcgaaaacaaaaaaaaccgcgacgacaaaaaacaaaaaaccgcgacgaacaaaaaatcctaa

SEQ ID NO: 13791 - DNA, 710 bp, Artificial Sequence
  chemically treated genomic DNA (Homo sapiens) CpG-island No: 13791
agatttttgagttttcgaagaaaatagttttttttttattttgttttatttatatttttgacgatggttatggggaaaaagtcgcggtttggtggggtaaaaagtcgaggcgtaaaaagttgcggtggtgggggggtaaaaagtcgcggcgcgaggtaaaaagtagtgggagtaaaaaattatataacgtcgcggcggcggggggtaaatagtcgcggcgcggggggtttaaaggtgtaaaaagtagtggtggcgcgggtaaaaagttagggcgacggggatataaagacgtaaaaagttatagtggcgtggggggtggtaaaaagtcgtagtcggtaataagtcgcggcggcgtggcgaaaaagtcgcgggataaaaaattacggcggcggcggggatgtaaaaagttgcggaggaaaaagtcgcggcgttaggggggtaaaaagtcgcggcgtagggggtaaaaagtcgcgcggcggtgggttaataagtcgcggtggttggggggtaaaaagtcggggcgggtaaaaagtcgcggtatgaaaaagttatggcggcgggggggtaaaaagtcgcggcgataaaaagtcgcggcggtaaaaagttatagcggtcgggggggtaaaaagtcgggtcgggtaaaaagtcgcggaggtaaaaaaagtcgcggcggtagggggtaaaaagtcgcggcgggtagaaagttttgg

SEQ ID NO: 13792 - DNA, 710 bp, Artificial Sequence
  chemically treated genomic DNA (Homo sapiens) CpG-island No: 13792
ccaaaactttctacccgccgcgactttttaccccctaccgccgcgactttttttacctccgcgactttttacccgacccgactttttacccccccgaccgctataactttttaccgccgcgactttttatcgccgcgactttttacccccccgccgccataactttttcataccgcgactttttacccgccccgactttttaccccccaaccaccgcgacttattaacccaccgccgcgcgactttttaccccctacgccgcgactttttacccccctaacgccgcgactttttcctccgcaactttttacatccccgccgccgccgtaattttttatcccgcgactttttcgccacgccgccgcgacttattaccgactacgactttttaccaccccccacgccactataactttttacgtctttatatccccgtcgccctaactttttacccgcgccaccactactttttacacctttaaaccccccgcgccgcgactatttaccccccgccgccgcgacgttatataattttttactcccactactttttacctcgcgccgcgactttttacccccccaccaccgcaactttttacgcctcgactttttaccccaccaaaccgcgactttttccccataaccatcgtcaaaaatataaataaaacaaaataaaaaaaaaactattttcttcgaaaactcaaaaatct

SEQ ID NO: 13793 - DNA, 1298 bp, Artificial Sequence
  chemically treated genomic DNA (Homo sapiens) CpG-island No: 13793
gtaaaaaattgtagcggtgggcgtaaaaagtcggggcggtgggggaaaaggttagggcgacgggggtaataagttatggcggcggggttaaaaagtcgcggtggcggaggtaaaaagttgtggtggcggagtaaaaagttacggtgatgggtataaaaagtcgtaaaaagtcgtagtattgggggtaaaaagtcgcgacgcggtggtaaaaagtcgcggcgtataaaagatgcggcggcgggggtagaaagcggttgcgtgggggggcggtaaaaagtaggggcggtaaaaagtcgggttgggaaaaatttgttgcggcgggggaaaaaagtcgtggcgcgggttattaaaagtttgaaaaaggtgtcgtggacgggtgttaaaagtcgtaaaaaaattacggttgagggggtaataagttacggtcgtaaaagttatgatagcggggatataaagtcgtaaaaattttcgtcggtaggggtagatagtcgcggcgcgggtggtaaaaagtaacgtcggcgggggttaaaattcgcggcggggcgttaataaagcggtcggggtgataaaaagtcgtggcgcgtgggtcggaagtcgtatacggggtaaaatttcgcggtggtaggtgtaaatagtcgtaaatagtcgcggcggtgggggtaaaaagttcgggcggtgggggtaagaagtcggggtaggagaaatttgcggcgataggggaaaaaagtcgcggcggcgggggttaaaagtcgcggcggtaaaaagtcgaaaaagtcggggcgcggtgggtaagaagtcgcgacgggaaaaatttgcggcggcgggggcgaaaagtcgtaaaaagtcgcgggtcgggggttaaaagttataaaaagtcgcggcggcggtggtaaaaagtcgcggcggaaaaagtcgcggtggcgggggtaaaaagttgtagcggcgggggaaaaaagtcgtaaaaagtcgcggcggtggggggagaaagacgtaaaaagttgcggcggtaaaaagtcgcggttgcgagggtaaatatttttaaaaagtcgcggtagtaggggttaaatttcgggaggtcgggggtagaaagttgtggtggtcggggtagaaagtaacggaggcgggggtaaaaagtcgaggcggcggaggtataaagtcgtaaaatacgtagtagcgggggtaaaaatttatggcggtaaaaagcgcgtcggcgggggtaaagtagtggaaatggggtagaaggttagtatagtttggtatttttggagtgtgatgtggaaggaaaagtgtagaggaag

SEQ ID NO: 13794 - DNA, 1298 bp, Artificial Sequence
  chemically treated genomic DNA (Homo sapiens) CpG-island No: 13794
cttcctctacacttttccttccacatcacactccaaaaataccaaactatactaaccttctaccccatttccactactttacccccgccgacgcgctttttaccgccataaatttttacccccgctactacgtattttacgactttatacctccgccgcctcgactttttacccccgcctccgttactttctaccccgaccaccacaactttctacccccgacctcccgaaatttaacccctactaccgcgactttttaaaaatatttaccctcgcaaccgcgactttttaccgccgcaactttttacgtctttctccccccaccgccgcgactttttacgacttttttcccccgccgctacaactttttacccccgccaccgcgactttttccgccgcgactttttaccaccgccgccgcgactttttataacttttaacccccgacccgcgactttttacgacttttcgcccccgccgccgcaaatttttcccgtcgcgacttcttacccaccgcgccccgactttttcgactttttaccgccgcgacttttaacccccgccgccgcgacttttttcccctatcgccgcaaatttctcctaccccgacttcttacccccaccgcccgaactttttacccccaccgccgcgactatttacgactatttacacctaccaccgcgaaattttaccccgtatacgacttccgacccacgcgccacgactttttatcaccccgaccgctttattaacgccccgccgcgaattttaacccccgccgacgttactttttaccacccgcgccgcgactatctacccctaccgacgaaaatttttacgactttatatccccgctatcataacttttacgaccgtaacttattaccccctcaaccgtaatttttttacgacttttaacacccgtccacgacacctttttcaaacttttaataacccgcgccacgacttttttcccccgccgcaacaaatttttcccaacccgactttttaccgcccctactttttaccgcccccccacgcaaccgctttctacccccgccgccgcatcttttatacgccgcgactttttaccaccgcgtcgcgactttttacccccaatactacgactttttacgactttttatacccatcaccgtaactttttactccgccaccacaactttttacctccgccaccgcgactttttaaccccgccgccataacttattacccccgtcgccctaaccttttcccccaccgccccgactttttacgcccaccgctacaattttttac

SEQ ID NO: 13795 - DNA, 1298 bp, Artificial Sequence
  chemically treated genomic DNA (Homo sapiens) CpG-island No: 13795
ttttttttgtatttttttttttatattatattttaggaatgttaagttgtgttggttttttattttatttttattattttgttttcgtcgacgcgttttttgtcgttatggatttttgttttcgttgttgcgtgttttgcggttttatgttttcgtcgtttcgattttttgttttcgttttcgttgttttttgtttcggttattatagttttttgttttcggtttttcggaatttagtttttgttgtcgcggttttttggggatgtttgttttcgtagtcgcggttttttgtcgtcgtagttttttgcgtttttttttttttatcgtcgcggttttttgcggtttttttttttcgtcgttgtagttttttgttttcgttatcgcgatttttttcgtcgcggttttttgttatcgtcgtcgcggttttttatgatttttggttttcggttcgcggttttttacggtttttcgttttcgtcgtcgtaggtttttttcgtcgcggttttttgtttatcgcgtttcggttttttcggttttttgtcgtcgcggtttttggttttcgtcgtcgcgattttttttttttgtcgtcgtaggttttttttgtttcggttttttgtttttatcgttcgagttttttgtttttatcgtcgcggttatttgcggttatttgtatttgttatcgcggagttttgtttcgtatgcggttttcggtttacgcgttacggttttttattatttcggtcgttttattggcgtttcgtcgcgggttttagttttcgtcgacgttgttttttattattcgcgtcgcggttatttgtttttgtcgacgagggtttttgcggttttatattttcgttgttatagtttttgcggtcgtagtttattgtttttttagtcgtggtttttttgcggtttttggtattcgtttacgatattttttttaggtttttggtgattcgcgttacggtttttttttttcgtcgtagtagattttttttagttcggttttttgtcgtttttgttttttgtcgtttttttacgtagtcgttttttgttttcgtcgtcgtattttttatgcgtcgcggttttttgttatcgcgtcgcggttttttgtttttaatgttgcggttttttacggttttttgtgtttattatcgtagttttttgtttcgttattatagttttttgttttcgttatcgcggttttttgatttcgtcgttatggtttgttgttttcgtcgttttggtttttttttttatcgtttcggttttttgcgtttatcgttgtagttttttgt

SEQ ID NO: 13796 - DNA, 1298 bp, Artificial Sequence
  chemically treated genomic DNA (Homo sapiens) CpG-island No: 13796
acaaaaaactacaacgataaacgcaaaaaaccgaaacgataaaaaaaaaaaccaaaacgacgaaaacaacaaaccataacgacgaaatcaaaaaaccgcgataacgaaaacaaaaaactataataacgaaacaaaaaactacgataataaacacaaaaaaccgtaaaaaaccgcaacattaaaaacaaaaaaccgcgacgcgataacaaaaaaccgcgacgcataaaaaatacgacgacgaaaacaaaaaacgactacgtaaaaaaacgacaaaaaacaaaaacgacaaaaaaccgaactaaaaaaaatctactacgacgaaaaaaaaaaaccgtaacgcgaatcaccaaaaacctaaaaaaaatatcgtaaacgaataccaaaaaccgcaaaaaaaccacgactaaaaaaacaataaactacgaccgcaaaaactataacaacgaaaatataaaaccgcaaaaaccctcgtcgacaaaaacaaataaccgcgacgcgaataataaaaaacaacgtcgacgaaaactaaaacccgcgacgaaacgccaataaaacgaccgaaataataaaaaaccgtaacgcgtaaaccgaaaaccgcatacgaaacaaaactccgcgataacaaatacaaataaccgcaaataaccgcgacgataaaaacaaaaaactcgaacgataaaaacaaaaaaccgaaacaaaaaaaacctacgacgacaaaaaaaaaaaatcgcgacgacgaaaaccaaaaaccgcgacgacaaaaaaccgaaaaaaccgaaacgcgataaacaaaaaaccgcgacgaaaaaaacctacgacgacgaaaacgaaaaaccgtaaaaaaccgcgaaccgaaaaccaaaaatcataaaaaaccgcgacgacgataacaaaaaaccgcgacgaaaaaaatcgcgataacgaaaacaaaaaactacaacgacgaaaaaaaaaaaccgcaaaaaaccgcgacgataaaaaaaaaaaaacgcaaaaaactacgacgacaaaaaaccgcgactacgaaaacaaacatccccaaaaaaccgcgacaacaaaaactaaattccgaaaaaccgaaaacaaaaaactataataaccgaaacaaaaaacaacgaaaacgaaaacaaaaaatcgaaacgacgaaaacataaaaccgcaaaacacgcaacaacgaaaacaaaaatccataacgacaaaaaacgcgtcgacgaaaacaaaataataaaaataaaataaaaaaccaacacaacttaacattcctaaaatataatataaaaaaaaaaatacaaaaaaaa

SEQ ID NO: 13797 - DNA, 761 bp, Artificial Sequence
  chemically treated genomic DNA (Homo sapiens) CpG-island No: 13797
gtggtggtcgtagaggttaggatcgtatagttggatgaatattcggttgtgattggaattggggtgaggaagtaggcgtgagagattggagtattcgaggtcgggtttgttttttttagcgtcgtagtttggcgttttggggcggttcgcggggttagaaggtatggcgtagttcggagttgggtatttatcggaggatggacgattcgaataacgtgtgtagtatatttaggcgggttatacgagaggttgttgcgagttagttttgattacgggtattcgttgttgagtttataagtaggatagtcgggttgtcgtgtttcgggtatttggtgttttgcgtttcggggtttttcgcgtcgtttgttatttgtcgtcgttatcggtgttcgagggtttggttgttgcggtcgtcgtcgcgtcgttattgtcgtcgcgtcgtcgtcgcgtcgtagtcgggtttttagttttagacgcgttcgttcggcgcggttggttgggagtcgtcgggtgggttatagttcgcgttcggggcgtataggagcgaggtacgttaggcgtcgggtgtttaacgggtggatagggtttttatttgcggtagtttggtttttgttacgttcgattcggttttttttttttgcgttttttttggtcgtcgtagttattagaagttgcgttgcggttgtttttttttgtagtcgaagttcggttttaggatgttgtcgatgaaaaagttggtggtgcggtgtagttgggtcgtt

SEQ ID NO: 13798 - DNA, 761 bp, Artificial Sequence
  chemically treated genomic DNA (Homo sapiens) CpG-island No: 13798
aacgacccaactacaccgcaccaccaactttttcatcgacaacatcctaaaaccgaacttcgactacaaaaaaaaacaaccgcaacgcaacttctaataactacgacgaccaaaaaaaacgcaaaaaaaaaaaaccgaatcgaacgtaacaaaaaccaaactaccgcaaataaaaaccctatccacccgttaaacacccgacgcctaacgtacctcgctcctatacgccccgaacgcgaactataacccacccgacgactcccaaccaaccgcgccgaacgaacgcgtctaaaactaaaaacccgactacgacgcgacgacgacgcgacgacaataacgacgcgacgacgaccgcaacaaccaaaccctcgaacaccgataacgacgacaaataacaaacgacgcgaaaaaccccgaaacgcaaaacaccaaatacccgaaacacgacaacccgactatcctacttataaactcaacaacgaatacccgtaatcaaaactaactcgcaacaacctctcgtataacccgcctaaatatactacacacgttattcgaatcgtccatcctccgataaatacccaactccgaactacgccataccttctaaccccgcgaaccgccccaaaacgccaaactacgacgctaaaaaaaacaaacccgacctcgaatactccaatctctcacgcctacttcctcaccccaattccaatcacaaccgaatattcatccaactatacgatcctaacctctacgaccaccac

SEQ ID NO: 13799 - DNA, 761 bp, Artificial Sequence
  chemically treated genomic DNA (Homo sapiens) CpG-island No: 13799
agcggtttagttgtatcgtattattaatttttttatcgataatattttgaggtcggatttcggttgtaaaaaggagtagtcgtaacgtagtttttggtggttgcggcggttagaggaggcgtaggaggaggaggtcgggtcgagcgtgatagaggttagattgtcgtaggtagagattttgtttattcgttgggtattcggcgtttagcgtgtttcgtttttgtgcgtttcggacgcgaattgtggtttattcgacggtttttagttagtcgcgtcgggcgggcgcgtttaaagttgggaattcggttgcggcgcggcggcggcgcggcggtagtggcggcgcggcggcggtcgtagtagttaagttttcggatatcggtggcggcggtagatggtaggcggcgcggggagtttcggagcgtagggtattaaatattcggagtacggtaattcggttattttatttatgggtttagtaacgggtgttcgtggttaaaattgattcgtagtagtttttcgtatggttcgtttgggtgtattgtatacgttattcggatcgtttatttttcggtgagtatttaatttcgggttgcgttatgttttttggtttcgcggatcgttttagaacgttaagttgcggcgttagggagagtaaattcggtttcgggtattttagttttttacgtttgtttttttattttagttttagttataatcgaatgtttatttagttatgcgattttggtttttgcggttattat

SEQ ID NO: 13800 - DNA, 761 bp, Artificial Sequence
  chemically treated genomic DNA (Homo sapiens) CpG-island No: 13800
ataataaccgcaaaaaccaaaatcgcataactaaataaacattcgattataactaaaactaaaataaaaaaacaaacgtaaaaaactaaaatacccgaaaccgaatttactctccctaacgccgcaacttaacgttctaaaacgatccgcgaaaccaaaaaacataacgcaacccgaaattaaatactcaccgaaaaataaacgatccgaataacgtatacaatacacccaaacgaaccatacgaaaaactactacgaatcaattttaaccacgaacacccgttactaaacccataaataaaataaccgaattaccgtactccgaatatttaataccctacgctccgaaactccccgcgccgcctaccatctaccgccgccaccgatatccgaaaacttaactactacgaccgccgccgcgccgccactaccgccgcgccgccgccgcgccgcaaccgaattcccaactttaaacgcgcccgcccgacgcgactaactaaaaaccgtcgaataaaccacaattcgcgtccgaaacgcacaaaaacgaaacacgctaaacgccgaatacccaacgaataaacaaaatctctacctacgacaatctaacctctatcacgctcgacccgacctcctcctcctacgcctcctctaaccgccgcaaccaccaaaaactacgttacgactactcctttttacaaccgaaatccgacctcaaaatattatcgataaaaaaattaataatacgatacaactaaaccgct

SEQ ID NO: 13801 - DNA, 536 bp, Artificial Sequence
  chemically treated genomic DNA (Homo sapiens) CpG-island No: 13801
ttttatcgtaagcgtagggttttaggtatatattttttcgtagtttcgaatatttcgagggcgttatatagacgtagtttttattggcgtcgataggtggcgcgttttttatagggaagtcggtttttagtcgttcgcgagtttattagattcggttttttgcgttatcgtcggtttcgggtcgttttatggaaagaaaggggattggaagcggtgcggcgggggagttcgggtttggtgtcgaatggtttaaaataaaattcgagaaatttagattttagtttttcggtttagagcggttttacggttttattgtttaaggggtcgttgcgcgtcgggtgtagaggataaggtttcgtcggtttcgcggagagtatacgggatttattggggttatttttagggggcgcgatgtttttttcgtaaatttttttacgtatcggtttttttatgcgcgtttttgtagttttttcggttgttagttttagtttttattttttcgtttatttttttttttttttataaatgggggtggg

SEQ ID NO: 13802 - DNA, 536 bp, Artificial Sequence
  chemically treated genomic DNA (Homo sapiens) CpG-island No: 13802
cccacccccatttataaaaaaaaaaaaaaataaacgaaaaaataaaaactaaaactaacaaccgaaaaaactacaaaaacgcgcataaaaaaaccgatacgtaaaaaaatttacgaaaaaaacatcgcgccccctaaaaataaccccaataaatcccgtatactctccgcgaaaccgacgaaaccttatcctctacacccgacgcgcaacgaccccttaaacaataaaaccgtaaaaccgctctaaaccgaaaaactaaaatctaaatttctcgaattttattttaaaccattcgacaccaaacccgaactcccccgccgcaccgcttccaatcccctttctttccataaaacgacccgaaaccgacgataacgcaaaaaaccgaatctaataaactcgcgaacgactaaaaaccgacttccctataaaaaacgcgccacctatcgacgccaataaaaactacgtctatataacgccctcgaaatattcgaaactacgaaaaaatatatacctaaaaccctacgcttacgataaaa

SEQ ID NO: 13803 - DNA, 536 bp, Artificial Sequence
  chemically treated genomic DNA (Homo sapiens) CpG-island No: 13803
tttatttttatttataaaagaaaaaaaaaataggcggaaggatgggggttggggttggtagtcgaggaggttgtagggacgcgtatggaagagtcggtgcgtgggagggtttgcgggggggatatcgcgttttttaggggtgattttagtgggtttcgtgtgtttttcgcggagtcggcggagttttgttttttgtattcggcgcgtagcggttttttaaatagtggaatcgtgaggtcgttttaagtcgaagggttggaatttgggtttttcgggttttattttagattattcggtattaagttcgagttttttcgtcgtatcgtttttagttttttttttttttatagagcgattcgaagtcggcggtggcgtagggagtcgagtttgatgagttcgcgggcggttgaaggtcggtttttttgtggggaacgcgttatttgtcggcgttagtgagaattgcgtttgtgtggcgttttcggggtattcggggttgcggggagatgtgtgtttgaagttttgcgtttgcggtgggg

SEQ ID NO: 13804 - DNA, 536 bp, Artificial Sequence
  chemically treated genomic DNA (Homo sapiens) CpG-island No: 13804
ccccaccgcaaacgcaaaacttcaaacacacatctccccgcaaccccgaataccccgaaaacgccacacaaacgcaattctcactaacgccgacaaataacgcgttccccacaaaaaaaccgaccttcaaccgcccgcgaactcatcaaactcgactccctacgccaccgccgacttcgaatcgctctataaaaaaaaaaaaaactaaaaacgatacgacgaaaaaactcgaacttaataccgaataatctaaaataaaacccgaaaaacccaaattccaacccttcgacttaaaacgacctcacgattccactatttaaaaaaccgctacgcgccgaatacaaaaaacaaaactccgccgactccgcgaaaaacacacgaaacccactaaaatcacccctaaaaaacgcgatatcccccccgcaaaccctcccacgcaccgactcttccatacgcgtccctacaacctcctcgactaccaaccccaacccccatccttccgcctattttttttttcttttataaataaaaataaa

SEQ ID NO: 13805 - DNA, 566 bp, Artificial Sequence
  chemically treated genomic DNA (Homo sapiens) CpG-island No: 13805
cggatagtcggagcgttcggatgtttagttgagtcgcggcgcgggtagtcgggggcgtaaagttggaggtagggttgggcgacgaggagagagggagggtcgggagtcgaaggacgttcgggtgtatttcgttgtagaggtcgagttcgagcggtcggagaaggttggtcgtagaagggcggttttcggtgtaaaaaacggaaattttggagtagaggatgaggaggaatacggaggcggggagttatagaaaaagatgttgaggaaagaagaggagatttcggtttaaataaatcgaaattgtgtaatgaacgtggttcgggagaatcgggggtgaggggcgatggttggagttgcggtttaagtatagtttttagacgtttgttcggattttggcgcggggaggcggtcgggattgtttttttgcgcgcgtttttggagagcgggtgggtaggatttgcgtttcgcggtgggtaagaagatttggggtttcgtagtttttggggtcgggggcgggggtgaagtgtttttagagatttcggcggagttttagttgcgtttttatt

SEQ ID NO: 13806 - DNA, 566 bp, Artificial Sequence
  chemically treated genomic DNA (Homo sapiens) CpG-island No: 13806
aataaaaacgcaactaaaactccgccgaaatctctaaaaacacttcacccccgcccccgaccccaaaaactacgaaaccccaaatcttcttacccaccgcgaaacgcaaatcctacccacccgctctccaaaaacgcgcgcaaaaaaacaatcccgaccgcctccccgcgccaaaatccgaacaaacgtctaaaaactatacttaaaccgcaactccaaccatcgcccctcacccccgattctcccgaaccacgttcattacacaatttcgatttatttaaaccgaaatctcctcttctttcctcaacatctttttctataactccccgcctccgtattcctcctcatcctctactccaaaatttccgttttttacaccgaaaaccgcccttctacgaccaaccttctccgaccgctcgaactcgacctctacaacgaaatacacccgaacgtccttcgactcccgaccctccctctctcctcgtcgcccaaccctacctccaactttacgcccccgactacccgcgccgcgactcaactaaacatccgaacgctccgactatccg

SEQ ID NO: 13807 - DNA, 566 bp, Artificial Sequence
  chemically treated genomic DNA (Homo sapiens) CpG-island No: 13807
gatgggagcgtaattggggtttcgtcgaggtttttgagggtattttattttcgttttcgattttaggaattgcgaaattttaaatttttttgtttatcgcggggcgtaggttttgtttattcgttttttagggacgcgcgtagaaaggtagtttcggtcgttttttcgcgttagggttcgggtaagcgtttgaaagttgtgtttgggtcgtagttttagttatcgttttttattttcggttttttcgggttacgtttattgtatagtttcgatttgtttaggtcggggtttttttttttttttttaatatttttttttgtggtttttcgttttcgtatttttttttattttttgttttaaggttttcgttttttgtatcggaggtcgtttttttgcgattagtttttttcggtcgttcggattcggtttttgtagcggggtgtattcgggcgtttttcggttttcggtttttttttttttttcgtcgtttagttttgtttttaattttgcgttttcggttgttcgcgtcgcggtttaattggatattcgaacgtttcgattgttcg

SEQ ID NO: 13808 - DNA, 566 bp, Artificial Sequence
  chemically treated genomic DNA (Homo sapiens) CpG-island No: 13808
cgaacaatcgaaacgttcgaatatccaattaaaccgcgacgcgaacaaccgaaaacgcaaaattaaaaacaaaactaaacgacgaaaaaaaaaaaaaaaccgaaaaccgaaaaacgcccgaatacaccccgctacaaaaaccgaatccgaacgaccgaaaaaaactaatcgcaaaaaaacgacctccgatacaaaaaacgaaaaccttaaaacaaaaaataaaaaaaaatacgaaaacgaaaaaccacaaaaaaaaatattaaaaaaaaaaaaaaaaaccccgacctaaacaaatcgaaactatacaataaacgtaacccgaaaaaaccgaaaataaaaaacgataactaaaactacgacccaaacacaactttcaaacgcttacccgaaccctaacgcgaaaaaacgaccgaaactacctttctacgcgcgtccctaaaaaacgaataaacaaaacctacgccccgcgataaacaaaaaaatttaaaatttcgcaattcctaaaatcgaaaacgaaaataaaataccctcaaaaacctcgacgaaaccccaattacgctcccatc

SEQ ID NO: 13809 - DNA, 736 bp, Artificial Sequence
  chemically treated genomic DNA (Homo sapiens) CpG-island No: 13809
tcggcgttggcgcgcgttaggttagtcgcgacgtatcgttcgattttttattttttttcgtagttttcggcgcggggttcggcgagaaggggaggggaggggagcggagaatcgggttttcggacgcgtgtggtatttgaagtattattagcgagcgagagttagagagaaggaaagcgatcgattttatcgttttcgagttgtttcgggtcgcgggtttgtagcgttttcggtttttcgcgtttatagtttaagttatattcgaagggtgagggagtcgggagttgcgcgcggggtcgtcggagggaggggtggtatttttacgtcggggtttacgaagggcggggtagcgggcgcggtcgtcgtggtagagggataggatttgtattttttacgaggagtgtgatcgttgtgttttttgaggttcgtttacgcgaagtatgatcgttttattatgttttcgttttcgtatttagttgtcgtaggtagatagttagttttgtagatataggtagatgttatatggtcgcgattatttacgtaatttatttggttgatgagcgggatacggggagatttagaggatagtttgacgcgttgcgtgttagtatgtagtagattcgacggattgcgcgggtgatagttgatataaatgttataggtcggggaggcgtgatgtttaaattttaagatacgagtagggttgtaattacgttggggttacgcggtcgggatt

SEQ ID NO: 13810 - DNA, 736 bp, Artificial Sequence
  chemically treated genomic DNA (Homo sapiens) CpG-island No: 13810
aatcccgaccgcgtaaccccaacgtaattacaaccctactcgtatcttaaaatttaaacatcacgcctccccgacctataacatttatatcaactatcacccgcgcaatccgtcgaatctactacatactaacacgcaacgcgtcaaactatcctctaaatctccccgtatcccgctcatcaaccaaataaattacgtaaataatcgcgaccatataacatctacctatatctacaaaactaactatctacctacgacaactaaatacgaaaacgaaaacataataaaacgatcatacttcgcgtaaacgaacctcaaaaaacacaacgatcacactcctcgtaaaaaatacaaatcctatccctctaccacgacgaccgcgcccgctaccccgcccttcgtaaaccccgacgtaaaaataccacccctccctccgacgaccccgcgcgcaactcccgactccctcacccttcgaatataacttaaactataaacgcgaaaaaccgaaaacgctacaaacccgcgacccgaaacaactcgaaaacgataaaatcgatcgctttccttctctctaactctcgctcgctaataatacttcaaataccacacgcgtccgaaaacccgattctccgctcccctcccctccccttctcgccgaaccccgcgccgaaaactacgaaaaaaaataaaaaatcgaacgatacgtcgcgactaacctaacgcgcgccaacgccga

SEQ ID NO: 13811 - DNA, 736 bp, Artificial Sequence
  chemically treated genomic DNA (Homo sapiens) CpG-island No: 13811
ggtttcggtcgcgtggttttagcgtggttgtaattttgttcgtattttaaagtttgggtattacgttttttcgatttgtagtatttatgttagttattattcgcgtagttcgtcgggtttgttgtatgttagtacgtagcgcgttaggttattttttgaattttttcgtgtttcgtttattaattagatgagttgcgtgagtggtcgcgattatgtagtatttgtttgtatttataggattagttgtttgtttacgatagttaggtgcggagacggaggtatggtgagacgattatgtttcgcgtaagcgggttttagagagtatagcggttatatttttcgtggagagtgtaggttttgtttttttgttacggcggtcgcgttcgttgtttcgtttttcgtgagtttcggcgtgggggtgttattttttttttcggcggtttcgcgcgtagttttcggtttttttatttttcggatgtggtttgagttgtaggcgcggagggtcggagacgttgtagattcgcgattcggagtagttcggaggcggtgaagtcggtcgttttttttttttttagttttcgttcgttggtagtgttttagatgttatacgcgttcgggggttcggtttttcgttttttttttttttttttttcgtcggatttcgcgtcgggagttgcgggaaggagtggagggtcgggcggtgcgtcgcggttggtttggcgcgcgttagcgtcgg

SEQ ID NO: 13812 - DNA, 736 bp, Artificial Sequence
  chemically treated genomic DNA (Homo sapiens) CpG-island No: 13812
ccgacgctaacgcgcgccaaaccaaccgcgacgcaccgcccgaccctccactccttcccgcaactcccgacgcgaaatccgacgaaaaaaaaaaaaaaaaaaaacgaaaaaccgaacccccgaacgcgtataacatctaaaacactaccaacgaacgaaaactaaaaaaaaaaaaaacgaccgacttcaccgcctccgaactactccgaatcgcgaatctacaacgtctccgaccctccgcgcctacaactcaaaccacatccgaaaaataaaaaaaccgaaaactacgcgcgaaaccgccgaaaaaaaaaataacacccccacgccgaaactcacgaaaaacgaaacaacgaacgcgaccgccgtaacaaaaaaacaaaacctacactctccacgaaaaatataaccgctatactctctaaaacccgcttacgcgaaacataatcgtctcaccatacctccgtctccgcacctaactatcgtaaacaaacaactaatcctataaatacaaacaaatactacataatcgcgaccactcacgcaactcatctaattaataaacgaaacacgaaaaaattcaaaaaataacctaacgcgctacgtactaacatacaacaaacccgacgaactacgcgaataataactaacataaatactacaaatcgaaaaaacgtaatacccaaactttaaaatacgaacaaaattacaaccacgctaaaaccacgcgaccgaaacc

SEQ ID NO: 13813 - DNA, 672 bp, Artificial Sequence
  chemically treated genomic DNA (Homo sapiens) CpG-island No: 13813
tttttacggaggcggttggtcgatttttattgaggcgttaacggtttcgttatgttttttttaataatttattgattttaaattcgttatttttatcgcggatttagtcgttttagttcgatttttcgtagtcgagcgagatgagagagattttcgcggacgaatacgaatcggattcgttttggcgttgtagtgagaattgtcgttgttcgagaaataattttgcgaggagtattttcgtacgggattcggcgttgttgttattgtcgttagagtcgttgtcgtcgtttttttagaatttttttttttattaacgcgtttttcgttacgttaggtcgtcgcgtaaacgttttattcgtcgttaatggcgggaaggttttacgttttattttacgttaaatgcgtattttttttatttttgcggttagagatagtattcgacgttattttcgtaaatgcgtttaatgaattgcggaaggttagagttttgttagttattattttttggaatagggtttcgttttttgttttggcgtaaggtaggtgagaaacggtcgcgtagtttgaaattaacgtcgacgggaggggtttaattcgtagtttggagatttagtttttttaattcgggaggtggtttttgtagttacgttaatgataattttcgttagaaaa

SEQ ID NO: 13814 - DNA, 672 bp, Artificial Sequence
  chemically treated genomic DNA (Homo sapiens) CpG-island No: 13814
ttttctaacgaaaattatcattaacgtaactacaaaaaccacctcccgaattaaaaaaactaaatctccaaactacgaattaaacccctcccgtcgacgttaatttcaaactacgcgaccgtttctcacctaccttacgccaaaacaaaaaacgaaaccctattccaaaaaataataactaacaaaactctaaccttccgcaattcattaaacgcatttacgaaaataacgtcgaatactatctctaaccgcaaaaataaaaaaaatacgcatttaacgtaaaataaaacgtaaaaccttcccgccattaacgacgaataaaacgtttacgcgacgacctaacgtaacgaaaaacgcgttaataaaaaaaaaaattctaaaaaaacgacgacaacgactctaacgacaataacaacaacgccgaatcccgtacgaaaatactcctcgcaaaattatttctcgaacaacgacaattctcactacaacgccaaaacgaatccgattcgtattcgtccgcgaaaatctctctcatctcgctcgactacgaaaaatcgaactaaaacgactaaatccgcgataaaaataacgaatttaaaatcaataaattattaaaaaaaacataacgaaaccgttaacgcctcaataaaaatcgaccaaccgcctccgtaaaaa

SEQ ID NO: 13815 - DNA, 672 bp, Artificial Sequence
  chemically treated genomic DNA (Homo sapiens) CpG-island No: 13815
ttttttggcgggggttattattggcgtaattgtagggattatttttcgggttgagggggttggatttttaggttgcggattaagtttttttcgtcggcgttaattttaaattgcgcgatcgttttttatttgttttgcgttaaggtagggggcgggattttattttaagaggtagtaattagtaggattttagtttttcgtaatttattgagcgtatttacggaagtaacgtcgggtattgtttttggtcgtaagggtgggaggagtacgtatttggcgtaaggtggggcgtagagttttttcgttattggcggcggatagggcgtttacgcgacggtttgacgtagcggaagacgcgttagtgggggggaaggttttagaaaagcggcggtagcggttttagcggtagtagtagtagcgtcgggtttcgtgcggaggtgtttttcgtagagttgtttttcgagtagcggtagtttttattatagcgttaggacgagttcggttcgtgttcgttcgcggagattttttttatttcgttcggttgcgggaaatcgggttgaagcgattgagttcgcgatggaggtaacgggtttgaaattaatgagttattgaaaagggtatggcgaggtcgttggcgttttagtggaagtcggttagtcgttttcgtgggag

SEQ ID NO: 13816 - DNA, 672 bp, Artificial Sequence
  chemically treated genomic DNA (Homo sapiens) CpG-island No: 13816
ctcccacgaaaacgactaaccgacttccactaaaacgccaacgacctcgccatacccttttcaataactcattaatttcaaacccgttacctccatcgcgaactcaatcgcttcaacccgatttcccgcaaccgaacgaaataaaaaaaatctccgcgaacgaacacgaaccgaactcgtcctaacgctataataaaaactaccgctactcgaaaaacaactctacgaaaaacacctccgcacgaaacccgacgctactactactaccgctaaaaccgctaccgccgcttttctaaaaccttcccccccactaacgcgtcttccgctacgtcaaaccgtcgcgtaaacgccctatccgccgccaataacgaaaaaactctacgccccaccttacgccaaatacgtactcctcccacccttacgaccaaaaacaatacccgacgttacttccgtaaatacgctcaataaattacgaaaaactaaaatcctactaattactacctcttaaaataaaatcccgccccctaccttaacgcaaaacaaataaaaaacgatcgcgcaatttaaaattaacgccgacgaaaaaaacttaatccgcaacctaaaaatccaaccccctcaacccgaaaaataatccctacaattacgccaataataacccccgccaaaaaa

SEQ ID NO: 13817 - DNA, 929 bp, Artificial Sequence
  chemically treated genomic DNA (Homo sapiens) CpG-island No: 13817
gagcgtcgaggtgtagggcgtaagttgggaagttaacgttatcggtgtaggtttcgtttcgttaggttggcgtttttggttttcgtttttagttgttcgtttcgtttagcgtttatttcgggtagtcgcggtttttgtcgtttagaagtatagttttagttacgggagttagcgcgcgttttttcgtcgtcgtttgcgtgcgcgtcgttttttttatgtttttcgtcgcgtttcggaggcggtttttttttacgtttcgggagttcgggaaagggtcggcgatgagggtttcgagtcgaatgggtttcgggagtttttagagagtgattttgttttacgatcgttttttaaagtagcggggtagggagtttcgagtcgtcgttgaatgggtatttcgagaaagggcgcgtttttatagttttttacggcgcggcgatcgttgtcgttagcgcggatgtcggagtcgttcgtagttttcgtcgcgtagtttttagttttcgcgtcgttgtcgggtttcgaattacggagcggaggcgagagttcgtatcgttaatgagattttcgtagtcgtttttttttttttttttcgagcggtagttaatgagtcgggttggggcggggtcgcgggaggggcggtgacgcggcggcgttgggttggggttcgggaggcgtaggtgagttagaggtcgttttacgtgttttcggggcgtttcgggtttcgtttgtagttttttttttcgttcgcggagagaggaagcgggttgggagtcgggcggcggggatgcggttacgtcgcggggagttgagcggagtcggttggttttttggggcgaacgtcgtatagatatgtgggtatttcggttgtttaatttagttatttgtttttaggagattttcgttttgtttatttattttgagtttttttaaag

SEQ ID NO: 13818 - DNA, 929 bp, Artificial Sequence
  chemically treated genomic DNA (Homo sapiens) CpG-island No: 13818
ctttaaaaaaactcaaaataaataaacaaaacgaaaatctcctaaaaacaaataactaaattaaacaaccgaaatacccacatatctatacgacgttcgccccaaaaaaccaaccgactccgctcaactccccgcgacgtaaccgcatccccgccgcccgactcccaacccgcttcctctctccgcgaacgaaaaaaaaaactacaaacgaaacccgaaacgccccgaaaacacgtaaaacgacctctaactcacctacgcctcccgaaccccaacccaacgccgccgcgtcaccgcccctcccgcgaccccgccccaacccgactcattaactaccgctcgaaaaaaaaaaaaaaaaacgactacgaaaatctcattaacgatacgaactctcgcctccgctccgtaattcgaaacccgacaacgacgcgaaaactaaaaactacgcgacgaaaactacgaacgactccgacatccgcgctaacgacaacgatcgccgcgccgtaaaaaactataaaaacgcgccctttctcgaaatacccattcaacgacgactcgaaactccctaccccgctactttaaaaaacgatcgtaaaacaaaatcactctctaaaaactcccgaaacccattcgactcgaaaccctcatcgccgaccctttcccgaactcccgaaacgtaaaaaaaaaccgcctccgaaacgcgacgaaaaacataaaaaaaacgacgcgcacgcaaacgacgacgaaaaaacgcgcgctaactcccgtaactaaaactatacttctaaacgacaaaaaccgcgactacccgaaataaacgctaaacgaaacgaacaactaaaaacgaaaaccaaaaacgccaacctaacgaaacgaaacctacaccgataacgttaacttcccaacttacgccctacacctcgacgctc

SEQ ID NO: 13819 - DNA, 929 bp, Artificial Sequence
  chemically treated genomic DNA (Homo sapiens) CpG-island No: 13819
ttttagaagggtttaaagtagatgaataaaacggaggttttttggaagtaggtgattgagttaggtaatcgagatgtttatatatttgtgcggcgttcgttttaagaggttagtcggtttcgtttagtttttcgcggcgtggtcgtattttcgtcgttcgatttttagttcgtttttttttttcgcgagcgggggggggagttgtaggcggggttcgaagcgtttcgggggtacgtggagcggtttttggtttatttgcgtttttcgggttttagtttagcgtcgtcgcgttatcgtttttttcgcggtttcgttttagttcggtttattggttgtcgttcggaggggaggggaaggggcggttgcgggggttttattagcgatgcggattttcgttttcgtttcgtagttcggggttcggtagcggcgcgagggttgggaattgcgcggcggggattgcgggcgatttcggtattcgcgttggcggtagcggtcgtcgcgtcgtgggaagttatggggacgcgttttttttcggggtgtttatttagcggcggttcggagttttttgtttcgttgttttaggaagcgatcgtggagtagagttattttttgaagattttcgagatttattcgattcgggatttttatcgtcgattttttttcgggttttcggagcgtgaagaagagtcgttttcggaacgcggcgaggagtatggggagagcggcgcgtacgtaggcggcggcggaggggcgcgcgttggttttcgtggttggggttgtgtttttgggcggtagggatcgcggttgttcgaggtaagcgttgggcggagcgggtagttgggggcgagggttaggggcgttagtttgacggagcgggatttgtatcgatggcgttggttttttaatttgcgttttgtatttcggcgttt

SEQ ID NO: 13820 - DNA, 929 bp, Artificial Sequence
  chemically treated genomic DNA (Homo sapiens) CpG-island No: 13820
aaacgccgaaatacaaaacgcaaattaaaaaaccaacgccatcgatacaaatcccgctccgtcaaactaacgcccctaaccctcgcccccaactacccgctccgcccaacgcttacctcgaacaaccgcgatccctaccgcccaaaaacacaaccccaaccacgaaaaccaacgcgcgcccctccgccgccgcctacgtacgcgccgctctccccatactcctcgccgcgttccgaaaacgactcttcttcacgctccgaaaacccgaaaaaaaatcgacgataaaaatcccgaatcgaataaatctcgaaaatcttcaaaaaataactctactccacgatcgcttcctaaaacaacgaaacaaaaaactccgaaccgccgctaaataaacaccccgaaaaaaaacgcgtccccataacttcccacgacgcgacgaccgctaccgccaacgcgaataccgaaatcgcccgcaatccccgccgcgcaattcccaaccctcgcgccgctaccgaaccccgaactacgaaacgaaaacgaaaatccgcatcgctaataaaacccccgcaaccgccccttcccctcccctccgaacgacaaccaataaaccgaactaaaacgaaaccgcgaaaaaaacgataacgcgacgacgctaaactaaaacccgaaaaacgcaaataaaccaaaaaccgctccacgtacccccgaaacgcttcgaaccccgcctacaactcccccccccgctcgcgaaaaaaaaaaacgaactaaaaatcgaacgacgaaaatacgaccacgccgcgaaaaactaaacgaaaccgactaacctcttaaaacgaacgccgcacaaatatataaacatctcgattacctaactcaatcacctacttccaaaaaacctccgttttattcatctactttaaacccttctaaaa

SEQ ID NO: 13821 - DNA, 715 bp, Artificial Sequence
  chemically treated genomic DNA (Homo sapiens) CpG-island No: 13821
tttttgttcgttgttttcgggttgttttagcgggggtcggatagggtagcggtcgtttttcgcgacgttttcgcgtttcgtatgtatattttcgcgggtttttatatttgcggcgtcgttataaagtttcggtgagcggcgtgcgttcggaattggggtgcgtttcggttagattcggagtagttttttagttcggtttcgttttacgtattttttcgtcgttcggggttcgcggagtcgagcggagggggcgaagggacgggggaggagtttttttggtcgtcgtattttcgcggtttcgttttttttttcggtcgcgtcgttttttcgttcgtcgcgcgtttttcggttcgttcgtttagttgttgtcgtacgttttattttcggaatttcgttttttttcgcgtttttaatcgttttttttcgaaatttttcgttaagatggcggttttcgagttggtttgtcgcgtttttacgtgatcgttttttcggcgtttttagttaatgggaagtgaggaggcggttcgcgtcgagtttcgggtttttcgcgttgttattttcgggttggaagggggaggcgggtcgggggagggtaggggaacggaaggggtattcggggagtattttaagggaattttttcgtttaaaagggcggtcgttgaagtggttttgagaataaaggagttaatattcggattttataggtggttcgggg

SEQ ID NO: 13822 - DNA, 715 bp, Artificial Sequence
  chemically treated genomic DNA (Homo sapiens) CpG-island No: 13822
ccccgaaccacctataaaatccgaatattaactcctttattctcaaaaccacttcaacgaccgcccttttaaacgaaaaaattcccttaaaatactccccgaataccccttccgttcccctaccctcccccgacccgcctcccccttccaacccgaaaataacaacgcgaaaaacccgaaactcgacgcgaaccgcctcctcacttcccattaactaaaaacgccgaaaaaacgatcacgtaaaaacgcgacaaaccaactcgaaaaccgccatcttaacgaaaaatttcgaaaaaaaacgattaaaaacgcgaaaaaaaacgaaattccgaaaataaaacgtacgacaacaactaaacgaacgaaccgaaaaacgcgcgacgaacgaaaaaacgacgcgaccgaaaaaaaaaacgaaaccgcgaaaatacgacgaccaaaaaaactcctcccccgtcccttcgccccctccgctcgactccgcgaaccccgaacgacgaaaaaatacgtaaaacgaaaccgaactaaaaaactactccgaatctaaccgaaacgcaccccaattccgaacgcacgccgctcaccgaaactttataacgacgccgcaaatataaaaacccgcgaaaatatacatacgaaacgcgaaaacgtcgcgaaaaacgaccgctaccctatccgacccccgctaaaacaacccgaaaacaacgaacaaaaa

SEQ ID NO: 13823 - DNA, 715 bp, Artificial Sequence
  chemically treated genomic DNA (Homo sapiens) CpG-island No: 13823
tttcgggttatttgtggagttcgagtgttaatttttttgtttttagagttattttagcggtcgtttttttaagcgaagaggtttttttaggatgtttttcgggtatttttttcgtttttttgttttttttcgattcgttttttttttttaattcgaaggtagtagcgcggggagttcggggttcggcgcgagtcgtttttttattttttattggttgagagcgtcgggaaagcggttacgtgggagcgcggtaggttagttcgggggtcgttattttggcggaaagtttcgggggagagcggttgggggcgcggaaggaggcgaggtttcgggggtggggcgtgcggtagtaattgggcgagcgggtcggggggcgcgcggcgagcgaggaggcggcgcggtcgagaaggaggacgaggtcgcgggggtgcggcggttaggggagtttttttttcgttttttcgtttttttcgttcggtttcgcgggtttcgggcggcgggggggtacgtggagcggggtcgggttggggagttgtttcgagtttggtcggggcgtattttagtttcgagcgtacgtcgtttatcggaattttgtggcggcgtcgtaggtgtgggggttcgcggaggtgtgtatgcggggcgcgagggcgtcgcggagagcggtcgttgttttgttcggttttcgttggagtagttcggaggtagcgagtaagga

SEQ ID NO: 13824 - DNA, 715 bp, Artificial Sequence
  chemically treated genomic DNA (Homo sapiens) CpG-island No: 13824
tccttactcgctacctccgaactactccaacgaaaaccgaacaaaacaacgaccgctctccgcgacgccctcgcgccccgcatacacacctccgcgaacccccacacctacgacgccgccacaaaattccgataaacgacgtacgctcgaaactaaaatacgccccgaccaaactcgaaacaactccccaacccgaccccgctccacgtacccccccgccgcccgaaacccgcgaaaccgaacgaaaaaaacgaaaaaacgaaaaaaaaactcccctaaccgccgcacccccgcgacctcgtcctccttctcgaccgcgccgcctcctcgctcgccgcgcgccccccgacccgctcgcccaattactaccgcacgccccacccccgaaacctcgcctccttccgcgcccccaaccgctctcccccgaaactttccgccaaaataacgacccccgaactaacctaccgcgctcccacgtaaccgctttcccgacgctctcaaccaataaaaaataaaaaaacgactcgcgccgaaccccgaactccccgcgctactaccttcgaattaaaaaaaaaaaacgaatcgaaaaaaaacaaaaaaacgaaaaaaatacccgaaaaacatcctaaaaaaacctcttcgcttaaaaaaacgaccgctaaaataactctaaaaacaaaaaaattaacactcgaactccacaaataacccgaaa

SEQ ID NO: 13825 - DNA, 1179 bp, Artificial Sequence
  chemically treated genomic DNA (Homo sapiens) CpG-island No: 13825
gttattttcgagtggatgttgtgtattggttagtgtgttatttatatgcgcgttatttttgagtggatgttgtgtattggtcggtgtgttatttattacgcgcgttagttttgagtggttgttgtgtattggttggtgtgttatttatatgcgcgttatttttgagtggatgttgtgtattggtcggtgtgttatttattacgcgcgttagttttgagtggatgttgtgtattggtcggtgtgttatttatatgcgcgttatttttgagtggatgttgtgtattggttcgtgtgttatttatatgtacgttatttttgagtggatgttgtgtattggtcggtgtgttatttattacgcgcgttagttttgagtggatgttgtgtattggtcggtgtgttatttatacgcgcgttattttcgagtggatgttgtgtattggttcgtgtgttatttattatgtacgttattttcgagtggatgttgtgtattggtcggtgtgttatttattatgcgcgttattttcgagtggatgttgtgtattggtcggtgtgttatttattatgcgttttattttcgagtggatgttgtgtattggtcggtgtgttatttattatgcgttttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttattatgcgcgttattttcgagtggatgttgtgtattggtcggtgtgttatttatatgcgcgttattttcgagtggaggttgtgtattggtcggtgtgttatttatatgttttttttttttttgatatggtgattagtaacgttttaggtatag

SEQ ID NO: 13826 - DNA, 1179 bp, Artificial Sequence
  chemically treated genomic DNA (Homo sapiens) CpG-island No: 13826
ctatacctaaaacgttactaatcaccatatcaaaaaaaaaaaaaacatataaataacacaccgaccaatacacaacctccactcgaaaataacgcgcatataaataacacaccgaccaatacacaacatccactcgaaaataacgcgcataataaataacacaccgaccaatacacaacatccactcgaaaataacgcgcataataaataacacaccgaccaatacacaacatccactcgaaaataacgcgcataataaataacacaccgaccaatacacaacatccactcgaaaataacgcgcataataaataacacaccgaccaatacacaacatccactcgaaaataacgcgcataataaataacacaccgaccaatacacaacatccactcgaaaataacgcgcataataaataacacaccgaccaatacacaacatccactcgaaaataacgcgcataataaataacacaccgaccaatacacaacatccactcgaaaataacgcgcataataaataacacaccgaccaatacacaacatccactcgaaaataaaacgcataataaataacacaccgaccaatacacaacatccactcgaaaataaaacgcataataaataacacaccgaccaatacacaacatccactcgaaaataacgcgcataataaataacacaccgaccaatacacaacatccactcgaaaataacgtacataataaataacacacgaaccaatacacaacatccactcgaaaataacgcgcgtataaataacacaccgaccaatacacaacatccactcaaaactaacgcgcgtaataaataacacaccgaccaatacacaacatccactcaaaaataacgtacatataaataacacacgaaccaatacacaacatccactcaaaaataacgcgcatataaataacacaccgaccaatacacaacatccactcaaaactaacgcgcgtaataaataacacaccgaccaatacacaacatccactcaaaaataacgcgcatataaataacacaccaaccaatacacaacaaccactcaaaactaacgcgcgtaataaataacacaccgaccaatacacaacatccactcaaaaataacgcgcatataaataacacactaaccaatacacaacatccactcgaaaataac

SEQ ID NO: 13827 - DNA, 1179 bp, Artificial Sequence
  chemically treated genomic DNA (Homo sapiens) CpG-island No: 13827
ttgtatttgaaacgttgttggttattatgttagaaggaaagagagtatgtgaataatatatcggttagtatatagtttttattcgggagtgacgcgtatgtgaataatatatcggttagtatatagtatttattcgggagtgacgcgtatggtgaataatatatcggttagtatatagtatttattcgggagtgacgcgtatggtgaataatatatcggttagtatatagtatttattcgggagtgacgcgtatggtgaataatatatcggttagtatatagtatttattcgggagtgacgcgtatggtgaataatatatcggttagtatatagtatttattcgggagtgacgcgtatggtgaataatatatcggttagtatatagtatttattcgggagtgacgcgtatggtgaataatatatcggttagtatatagtatttattcgggagtgacgcgtatggtgaataatatatcggttagtatatagtatttattcgggagtgacgcgtatggtgaataatatatcggttagtatatagtatttattcgggagtgaggcgtatggtgaataatatatcggttagtatatagtatttattcgggagtgaggcgtatggtgaataatatatcggttagtatatagtatttattcgggagtgacgcgtatggtgaataatatatcggttagtatatagtatttattcgggagtgacgtgtatggtgaataatatacgggttagtatatagtatttattcgggagtgacgcgcgtgtgaataatatatcggttagtatatagtatttatttaggattgacgcgcgtggtgaataatatatcggttagtatatagtatttatttaggagtgacgtgtatgtgaataatatacgggttagtatatagtatttatttaggagtgacgcgtatgtgaataatatatcggttagtatatagtatttatttaggattgacgcgcgtggtgaataatatatcggttagtatatagtatttatttaggagtgacgcgtatgtgaataatatattagttagtatatagtaattatttaggattgacgcgcgtggtgaataatatatcggttagtatatagtatttatttaggagtgacgcgtatgtgaataatatattggttagtatatagtatttattcgggagtgat

SEQ ID NO: 13828 - DNA, 1179 bp, Artificial Sequence
  chemically treated genomic DNA (Homo sapiens) CpG-island No: 13828
atcactcccgaataaatactatatactaaccaatatattattcacatacgcgtcactcctaaataaatactatatactaaccgatatattattcaccacgcgcgtcaatcctaaataattactatatactaactaatatattattcacatacgcgtcactcctaaataaatactatatactaaccgatatattattcaccacgcgcgtcaatcctaaataaatactatatactaaccgatatattattcacatacgcgtcactcctaaataaatactatatactaacccgtatattattcacatacacgtcactcctaaataaatactatatactaaccgatatattattcaccacgcgcgtcaatcctaaataaatactatatactaaccgatatattattcacacgcgcgtcactcccgaataaatactatatactaacccgtatattattcaccatacacgtcactcccgaataaatactatatactaaccgatatattattcaccatacgcgtcactcccgaataaatactatatactaaccgatatattattcaccatacgcctcactcccgaataaatactatatactaaccgatatattattcaccatacgcctcactcccgaataaatactatatactaaccgatatattattcaccatacgcgtcactcccgaataaatactatatactaaccgatatattattcaccatacgcgtcactcccgaataaatactatatactaaccgatatattattcaccatacgcgtcactcccgaataaatactatatactaaccgatatattattcaccatacgcgtcactcccgaataaatactatatactaaccgatatattattcaccatacgcgtcactcccgaataaatactatatactaaccgatatattattcaccatacgcgtcactcccgaataaatactatatactaaccgatatattattcaccatacgcgtcactcccgaataaatactatatactaaccgatatattattcaccatacgcgtcactcccgaataaatactatatactaaccgatatattattcacatacgcgtcactcccgaataaaaactatatactaaccgatatattattcacatactctctttccttctaacataataaccaacaacgtttcaaatacaa

SEQ ID NO: 13829 - DNA, 1111 bp, Artificial Sequence
  chemically treated genomic DNA (Homo sapiens) CpG-island No: 13829
tggcgaaaggtcggggtcgtttttaagcgttagtttcggggaggcgttcgcggtagaggttttcgcgtttcgtcgggtaggatttcgcgtttatttttttggtaaggatatcggggaggcgtcgagacgcggttagggaggaattcggttgcggttatttcgattcgggtcggggtagacgacgcgtttcgagaaatttcgagggcgtttagttttatagtggaaggtttttagggcggcgtttttggatttaagtgtttttaggatttttcgagggaaacgcggcgttacgagaggacggagggcgtttttagttttattcggattttatggagttcgaatttatggggacgacgcggaggaggaagcggcgattttagtttcgtattttcgttttaaatttggtttcgtagattcgtttagtttttggtgcgcgtttttcgtttcggtcggaggtttcgcgtttttgtgtttttttcgcgatttgtcggggtcggtagtgtttgtaaataaacggttacgtggttcggcggcgtttttcgttttcggcgtttacggggattttacgcggaatcgagggcgtcgtatttttaatttcgcgtaggttcggtcgggggagttcggaggtcggggtcggggatttagagttcgagttgatagcgcgttttacgtttacgcgcgttcggttcgcgtcgtatttcggtgtatttattcggcgataggcggttttgttcggttagcgtggggtttggtttcgttggggtgcgtaacggcgaagcgcggttcggttggggttcgggttttcggtacgtttttaaagttatagttttcgttatcgtcgcggtcgttatttcgtattttttcgggttcgggtcgggggttatttcgtgatggacgcgttttcgtatttattttttcggtttagtatatagtaatacgtcgcgggttggtcgggcgtagtcgtagtttattcgcgtagagttaattattagaggacggaatttcgtttttcgtttttttcgatcgtttatttttttatttttcggttcggtttagtatgggttaggggagagcggttggttagggtttcgttcgtttaggtaatttgtcg

SEQ ID NO: 13830 - DNA, 1111 bp, Artificial Sequence
  chemically treated genomic DNA (Homo sapiens) CpG-island No: 13830
cgacaaattacctaaacgaacgaaaccctaaccaaccgctctcccctaacccatactaaaccgaaccgaaaaataaaaaaataaacgatcgaaaaaaacgaaaaacgaaattccgtcctctaataattaactctacgcgaataaactacgactacgcccgaccaacccgcgacgtattactatatactaaaccgaaaaaataaatacgaaaacgcgtccatcacgaaataacccccgacccgaacccgaaaaaatacgaaataacgaccgcgacgataacgaaaactataactttaaaaacgtaccgaaaacccgaaccccaaccgaaccgcgcttcgccgttacgcaccccaacgaaaccaaaccccacgctaaccgaacaaaaccgcctatcgccgaataaatacaccgaaatacgacgcgaaccgaacgcgcgtaaacgtaaaacgcgctatcaactcgaactctaaatccccgaccccgacctccgaactcccccgaccgaacctacgcgaaattaaaaatacgacgccctcgattccgcgtaaaatccccgtaaacgccgaaaacgaaaaacgccgccgaaccacgtaaccgtttatttacaaacactaccgaccccgacaaatcgcgaaaaaaacacaaaaacgcgaaacctccgaccgaaacgaaaaacgcgcaccaaaaactaaacgaatctacgaaaccaaatttaaaacgaaaatacgaaactaaaatcgccgcttcctcctccgcgtcgtccccataaattcgaactccataaaatccgaataaaactaaaaacgccctccgtcctctcgtaacgccgcgtttccctcgaaaaatcctaaaaacacttaaatccaaaaacgccgccctaaaaaccttccactataaaactaaacgccctcgaaatttctcgaaacgcgtcgtctaccccgacccgaatcgaaataaccgcaaccgaattcctccctaaccgcgtctcgacgcctccccgatatccttaccaaaaaaataaacgcgaaatcctacccgacgaaacgcgaaaacctctaccgcgaacgcctccccgaaactaacgcttaaaaacgaccccgacctttcgcca

SEQ ID NO: 13831 - DNA, 1111 bp, Artificial Sequence
  chemically treated genomic DNA (Homo sapiens) CpG-island No: 13831
cggtaagttgtttggacgggcgggattttaattagtcgtttttttttagtttatgttgggtcgggtcgaggggtgggggagtgggcggtcggggaaagcggggggcggagtttcgttttttgatgattggttttgcgcggatgggttgcggttgcgttcggttaattcgcggcgtgttgttatgtgttgagtcgaggggataggtgcgggggcgcgtttattacggggtagttttcggttcggattcggagggatgcggagtggcggtcgcggcggtggcggagattgtggttttaagagcgtgtcgggagttcgagttttagtcgggtcgcgtttcgtcgttgcgtattttagcggagttaagttttacgttggtcggatagggtcgtttgtcgtcgggtaagtgtatcggagtgcggcgcgggtcgggcgcgcgtgggcgtggggcgcgttgttagttcgggttttgggttttcggtttcggttttcggattttttcggtcgggtttgcgcggggttgggggtgcggcgttttcggtttcgcgtggggttttcgtgggcgtcggggacggggagcgtcgtcgggttacgtgatcgtttgtttataaatattgtcggtttcgatagatcgcggagggagtataagggcgcgggattttcggtcggggcgggagacgcgtattaggggttgggcgagtttgcggggttaggtttggggcgggggtgcggagttggaatcgtcgttttttttttcgcgtcgtttttatgggttcggattttatggggttcgggtggggttggggacgtttttcgttttttcgtgacgtcgcgtttttttcggagagttttggggatatttaggtttaggggcgtcgttttgggggttttttattgtgggattgggcgttttcgaaatttttcggagcgcgtcgtttgtttcgattcgggtcgaggtaatcgtagtcgagtttttttttggtcgcgtttcggcgttttttcggtgtttttgttaagggggtgggcgcgaggttttgttcgacggaacgcgggagtttttgtcgcgagcgttttttcggagttggcgtttaggggcggtttcgatttttcgtta

SEQ ID NO: 13832 - DNA, 1111 bp, Artificial Sequence
  chemically treated genomic DNA (Homo sapiens) CpG-island No: 13832
taacgaaaaatcgaaaccgcccctaaacgccaactccgaaaaaacgctcgcgacaaaaactcccgcgttccgtcgaacaaaacctcgcgcccacccccttaacaaaaacaccgaaaaaacgccgaaacgcgaccaaaaaaaaactcgactacgattacctcgacccgaatcgaaacaaacgacgcgctccgaaaaatttcgaaaacgcccaatcccacaataaaaaacccccaaaacgacgcccctaaacctaaatatccccaaaactctccgaaaaaaacgcgacgtcacgaaaaaacgaaaaacgtccccaaccccacccgaaccccataaaatccgaacccataaaaacgacgcgaaaaaaaaaacgacgattccaactccgcacccccgccccaaacctaaccccgcaaactcgcccaacccctaatacgcgtctcccgccccgaccgaaaatcccgcgcccttatactccctccgcgatctatcgaaaccgacaatatttataaacaaacgatcacgtaacccgacgacgctccccgtccccgacgcccacgaaaaccccacgcgaaaccgaaaacgccgcacccccaaccccgcgcaaacccgaccgaaaaaatccgaaaaccgaaaccgaaaacccaaaacccgaactaacaacgcgccccacgcccacgcgcgcccgacccgcgccgcactccgatacacttacccgacgacaaacgaccctatccgaccaacgtaaaacttaactccgctaaaatacgcaacgacgaaacgcgacccgactaaaactcgaactcccgacacgctcttaaaaccacaatctccgccaccgccgcgaccgccactccgcatccctccgaatccgaaccgaaaactaccccgtaataaacgcgcccccgcacctatcccctcgactcaacacataacaacacgccgcgaattaaccgaacgcaaccgcaacccatccgcgcaaaaccaatcatcaaaaaacgaaactccgccccccgctttccccgaccgcccactcccccacccctcgacccgacccaacataaactaaaaaaaaacgactaattaaaatcccgcccgtccaaacaacttaccg

SEQ ID NO: 13833 - DNA, 1122 bp, Artificial Sequence
  chemically treated genomic DNA (Homo sapiens) CpG-island No: 13833
ggtttttgcgattcgcgttcgtttttttcggttgggaagtatttgttagcggtttttatttgggtcgttttcgtcgcggggtatttttttgaagtagtcgttgagcgataggttgtggcggatggagttttgttagtcggttttgttgcgttggtagaaggggaagttatcggcgacgaattggtagatgtggttgagagtgagtttgcgttcgggcgcgttttgaatggttatggcgatgagcgtcgaatacgagtagggcggtcgtattatttttattaggttttcgcggttggttatggatagtagtttagtttttcgggtttcgcggcgcggcgggcgaggcgggcgcggcggggcgggttgcgcgaagggtcgttgagagtagtcgaaggtgtcggcggtaggcggtggttgtagaaagggttcggtcgcggttcggggggcggcggtcgcgcggagcgtttaggtacgcggcggcggttgcggcggcggcggagggcgggttttttacgtcgggttcgttgagttataggtaggggttgcggcggcggcggcggcgcggcgtagtcgttaagttcgtaaggtttttggttgtcggggggagttcggggcggcggcggtggcggcgggcgggggtaggtcgggttgcgaatatatttcgaagttgtcgtcgtagtagagggttatgtcggcggtcgtgggcgagttggtcggtcgcggcgaggggcgagcggggttggtttcgtcgttcgggcgagagtatttttttgggggttaattatatggttcgtttttattttcgttgggatcggtgtttcgggtcggggtcgggcgggtgttagcggagcgtttgttagtcggttttttataatcgagttcggcgcggttttttttgggtcggttcggagcggggcggtgtcgcgggtttgggttttttacgttttcgttacgttttatttgttcgcgcgtttaaattcggagttcgttcgtttcgtttttatcgtttttttgtcgggttcgggagcgtttggaggtcggcgtttttaggtttcgggtaaaaagtagtattttatttttagtttacgttttttaatattataataagtaaagttacgaata

SEQ ID NO: 13834 - DNA, 1122 bp, Artificial Sequence
  chemically treated genomic DNA (Homo sapiens) CpG-island No: 13834
tattcgtaactttacttattataatattaaaaaacgtaaactaaaaataaaatactactttttacccgaaacctaaaaacgccgacctccaaacgctcccgaacccgacaaaaaaacgataaaaacgaaacgaacgaactccgaatttaaacgcgcgaacaaataaaacgtaacgaaaacgtaaaaaacccaaacccgcgacaccgccccgctccgaaccgacccaaaaaaaaccgcgccgaactcgattataaaaaaccgactaacaaacgctccgctaacacccgcccgaccccgacccgaaacaccgatcccaacgaaaataaaaacgaaccatataattaacccccaaaaaaatactctcgcccgaacgacgaaaccaaccccgctcgcccctcgccgcgaccgaccaactcgcccacgaccgccgacataaccctctactacgacgacaacttcgaaatatattcgcaacccgacctacccccgcccgccgccaccgccgccgccccgaactccccccgacaaccaaaaaccttacgaacttaacgactacgccgcgccgccgccgccgccgcaacccctacctataactcaacgaacccgacgtaaaaaacccgccctccgccgccgccgcaaccgccgccgcgtacctaaacgctccgcgcgaccgccgccccccgaaccgcgaccgaaccctttctacaaccaccgcctaccgccgacaccttcgactactctcaacgacccttcgcgcaacccgccccgccgcgcccgcctcgcccgccgcgccgcgaaacccgaaaaactaaactactatccataaccaaccgcgaaaacctaataaaaataatacgaccgccctactcgtattcgacgctcatcgccataaccattcaaaacgcgcccgaacgcaaactcactctcaaccacatctaccaattcgtcgccgataacttccccttctaccaacgcaacaaaaccgactaacaaaactccatccgccacaacctatcgctcaacgactacttcaaaaaaataccccgcgacgaaaacgacccaaataaaaaccgctaacaaatacttcccaaccgaaaaaaacgaacgcgaatcgcaaaaacc

SEQ ID NO: 13835 - DNA, 1122 bp, Artificial Sequence
  chemically treated genomic DNA (Homo sapiens) CpG-island No: 13835
tattcgtggttttatttattatgatgttaagaaacgtgggttaggaatggggtgttgttttttgttcgaaatttggaggcgtcggtttttagacgttttcgggttcggtagaggggcggtaggggcggggcgggcgggtttcgggtttgggcgcgcgggtaggtggggcgtggcgggggcgtggagagtttaggttcgcggtatcgtttcgtttcgggtcggtttaggaggagtcgcgtcgggttcggttataagaggtcggttagtaggcgtttcgttagtattcgttcgatttcggttcggagtatcggttttagcgggggtgaaggcggattatgtggttggtttttaaagggatgttttcgttcgagcggcgagattagtttcgttcgtttttcgtcgcggtcggttagttcgtttacggtcgtcgatatggttttttattgcggcgataatttcggagtgtattcgtagttcggtttgttttcgttcgtcgttatcgtcgtcgtttcgggtttttttcggtagttaggggttttacgggtttggcgattacgtcgcgtcgtcgtcgtcgtcgtaatttttatttgtggtttaacgggttcggcgtgggaggttcgtttttcgtcgtcgtcgtagtcgtcgtcgcgtatttgggcgtttcgcgcggtcgtcgtttttcgggtcgcggtcgggttttttttgtagttatcgtttgtcgtcggtattttcggttgtttttagcggtttttcgcgtagttcgtttcgtcgcgttcgtttcgttcgtcgcgtcgcggggttcggggagttgggttgttgtttatggttagtcgcgaggatttgatgaagatggtgcggtcgttttattcgtattcggcgtttatcgttatggttatttagagcgcgttcgagcgtaaatttatttttagttatatttattagttcgtcgtcgatagtttttttttttattagcgtagtaaggtcggttggtagaattttattcgttataatttgtcgtttaacgattgttttaagaaggtgtttcgcgacgaggacgatttaggtgagggtcgttggtaggtgttttttagtcggggagggcggacgcgggtcgtaagggtt

SEQ ID NO: 13836 - DNA, 1122 bp, Artificial Sequence
  chemically treated genomic DNA (Homo sapiens) CpG-island No: 13836
aacccttacgacccgcgtccgccctccccgactaaaaaacacctaccaacgaccctcacctaaatcgtcctcgtcgcgaaacaccttcttaaaacaatcgttaaacgacaaattataacgaataaaattctaccaaccgaccttactacgctaataaaaaaaaaaactatcgacgacgaactaataaatataactaaaaataaatttacgctcgaacgcgctctaaataaccataacgataaacgccgaatacgaataaaacgaccgcaccatcttcatcaaatcctcgcgactaaccataaacaacaacccaactccccgaaccccgcgacgcgacgaacgaaacgaacgcgacgaaacgaactacgcgaaaaaccgctaaaaacaaccgaaaataccgacgacaaacgataactacaaaaaaaacccgaccgcgacccgaaaaacgacgaccgcgcgaaacgcccaaatacgcgacgacgactacgacgacgacgaaaaacgaacctcccacgccgaacccgttaaaccacaaataaaaattacgacgacgacgacgacgcgacgtaatcgccaaacccgtaaaacccctaactaccgaaaaaaacccgaaacgacgacgataacgacgaacgaaaacaaaccgaactacgaatacactccgaaattatcgccgcaataaaaaaccatatcgacgaccgtaaacgaactaaccgaccgcgacgaaaaacgaacgaaactaatctcgccgctcgaacgaaaacatccctttaaaaaccaaccacataatccgccttcacccccgctaaaaccgatactccgaaccgaaatcgaacgaatactaacgaaacgcctactaaccgacctcttataaccgaacccgacgcgactcctcctaaaccgacccgaaacgaaacgataccgcgaacctaaactctccacgcccccgccacgccccacctacccgcgcgcccaaacccgaaacccgcccgccccgcccctaccgcccctctaccgaacccgaaaacgtctaaaaaccgacgcctccaaatttcgaacaaaaaacaacaccccattcctaacccacgtttcttaacatcataataaataaaaccacgaata

SEQ ID NO: 13837 - DNA, 926 bp, Artificial Sequence
  chemically treated genomic DNA (Homo sapiens) CpG-island No: 13837
  misc_feature (610)..(610): n is either a, c, g or t
  misc_feature (613)..(613): n is either a, c, g or t
gtttcgcgaagggttcgttgtttttttggagttattggagttatttgtttaaggtcgcgaaattatcggtgtcgtcggtaattagcgaggtttagcggggttgcgcggttttcggtttgtcggcgttcggcgtcgtttcggttttatttggtgtttcgtaatttgcgtaaaggttgggagatcgcgttttttttcgatttattattagtttaagttgggttcggaattaatattcgataagcgttggcggttagttgtagtcgggaaggagtatcggaaggaggcggtggcggggcggtcgagggcggagcgggtcggggcggggcgcggtttataaaagttacgcgcggcgcggtgggcgggtttgggcgcgagcggttgagtcggtaaaatttttggcgtcgtaaaggtcgcgggcgaggatcgggaggggagagggaggagataggaggaggagacgcgagtgcggggtggcgtcggtttattttcgtagcgtttttgttttttttaggttttggaaggcgggttcgggttgcggtagcggcggaatcggttgtatggagaggtgaagtcgggttgcggcggtttcggtcgggacggcggagggagncgnttgattcggcgagggtgggtaggtttgggcggtcggcgtcgttgcgaggtggaggggcggtttggtattttcggggcggggcggggttttcgagggtcgcggtcggtgcgtttttcgtaggttagtttttttcggggttttgtagaagcggtttttgcgtattcggggcggttgtgggaagggtgggggtcggtgtttgtagggtttttcgtggtcgttcgggagaggtgtttttcgtttaggttttttcggagatttgagggggtgcgcgttggcgtgtatggggtttgttttgtttttggtttggggatgt

SEQ ID NO: 13838 - DNA, 926 bp, Artificial Sequence
  chemically treated genomic DNA (Homo sapiens) CpG-island No: 13838
  misc_feature (314)..(314): n is either a, c, g or t
  misc_feature (317)..(317): n is either a, c, g or t
acatccccaaaccaaaaacaaaacaaaccccatacacgccaacgcgcaccccctcaaatctccgaaaaaacctaaacgaaaaacacctctcccgaacgaccacgaaaaaccctacaaacaccgacccccacccttcccacaaccgccccgaatacgcaaaaaccgcttctacaaaaccccgaaaaaaactaacctacgaaaaacgcaccgaccgcgaccctcgaaaaccccgccccgccccgaaaataccaaaccgcccctccacctcgcaacgacgccgaccgcccaaacctacccaccctcgccgaatcaancgnctccctccgccgtcccgaccgaaaccgccgcaacccgacttcacctctccatacaaccgattccgccgctaccgcaacccgaacccgccttccaaaacctaaaaaaaacaaaaacgctacgaaaataaaccgacgccaccccgcactcgcgtctcctcctcctatctcctccctctcccctcccgatcctcgcccgcgacctttacgacgccaaaaattttaccgactcaaccgctcgcgcccaaacccgcccaccgcgccgcgcgtaacttttataaaccgcgccccgccccgacccgctccgccctcgaccgccccgccaccgcctccttccgatactccttcccgactacaactaaccgccaacgcttatcgaatattaattccgaacccaacttaaactaataataaatcgaaaaaaaacgcgatctcccaacctttacgcaaattacgaaacaccaaataaaaccgaaacgacgccgaacgccgacaaaccgaaaaccgcgcaaccccgctaaacctcgctaattaccgacgacaccgataatttcgcgaccttaaacaaataactccaataactccaaaaaaacaacgaacccttcgcgaaac

SEQ ID NO: 13839 - DNA, 926 bp, Artificial Sequence
  chemically treated genomic DNA (Homo sapiens) CpG-island No: 13839
  misc_feature (314)..(314): n is either a, c, g or t
  misc_feature (317)..(317): n is either a, c, g or t
gtatttttaaattaaggatagaataggttttatgtacgttagcgcgtatttttttaagttttcgggggagtttgagcgaagagtatttttttcgagcggttacggagagttttgtaggtatcgatttttattttttttatagtcgtttcgggtacgtagaagtcgtttttgtaaggtttcgggggaggttgatttgcggaaaacgtatcgatcgcggttttcgggagtttcgtttcgtttcggggatgttaagtcgtttttttatttcgtagcggcgtcggtcgtttagatttgtttattttcgtcgggttagncgntttttttcgtcgtttcgatcgaggtcgtcgtagttcgattttatttttttatgtagtcgatttcgtcgttgtcgtagttcgggttcgttttttaaagtttgggggaggtaggagcgttgcggaggtggatcggcgttatttcgtattcgcgttttttttttttgtttttttttttttttttttcggttttcgttcgcggtttttgcggcgttagagattttgtcgatttagtcgttcgcgtttaggttcgtttatcgcgtcgcgcgtggtttttgtaggtcgcgtttcgtttcggttcgtttcgttttcggtcgtttcgttatcgttttttttcggtgttttttttcggttgtagttggtcgttagcgtttgtcgggtgttagtttcgggtttagtttgggttggtggtaggtcgggagagggcgcggttttttagtttttgcgtagattgcggggtattaggtggggtcgaggcgacgtcgaacgtcggtaggtcggaaatcgcgtagtttcgttggatttcgttgattgtcggcggtatcggtggtttcgcgattttgaataggtgattttaatagttttaggagggtagcgagtttttcgcggaat

SEQ ID NO: 13840 - DNA, 926 bp, Artificial Sequence
  chemically treated genomic DNA (Homo sapiens) CpG-island No: 13840
  misc_feature (610)..(610): n is either a, c, g or t
  misc_feature (613)..(613): n is either a, c, g or t
attccgcgaaaaactcgctaccctcctaaaactattaaaatcacctattcaaaatcgcgaaaccaccgataccgccgacaatcaacgaaatccaacgaaactacgcgatttccgacctaccgacgttcgacgtcgcctcgaccccacctaataccccgcaatctacgcaaaaactaaaaaaccgcgccctctcccgacctaccaccaacccaaactaaacccgaaactaacacccgacaaacgctaacgaccaactacaaccgaaaaaaaacaccgaaaaaaaacgataacgaaacgaccgaaaacgaaacgaaccgaaacgaaacgcgacctacaaaaaccacgcgcgacgcgataaacgaacctaaacgcgaacgactaaatcgacaaaatctctaacgccgcaaaaaccgcgaacgaaaaccgaaaaaaaaaaaaaaaaaaacaaaaaaaaaaaacgcgaatacgaaataacgccgatccacctccgcaacgctcctacctcccccaaactttaaaaaacgaacccgaactacgacaacgacgaaatcgactacataaaaaaataaaatcgaactacgacgacctcgatcgaaacgacgaaaaaaancgnctaacccgacgaaaataaacaaatctaaacgaccgacgccgctacgaaataaaaaaacgacttaacatccccgaaacgaaacgaaactcccgaaaaccgcgatcgatacgttttccgcaaatcaacctcccccgaaaccttacaaaaacgacttctacgtacccgaaacgactataaaaaaaataaaaatcgatacctacaaaactctccgtaaccgctcgaaaaaaatactcttcgctcaaactcccccgaaaacttaaaaaaatacgcgctaacgtacataaaacctattctatccttaatttaaaaatac

SEQ ID NO: 13841 - DNA, 672 bp, Artificial Sequence
  chemically treated genomic DNA (Homo sapiens) CpG-island No: 13841
acgaggggcgtcggggagagggagttcggttagtcggtaggggcgttttttcggcggaagagggtcgtcgaagattttttttttatttggttgagttcgttttcggttgtaattcgtaatttcgggtcgatggtgttttttagcgtttggatgattcggttgaggtttattttttcgggtgggggtttcgcggttttcggaatagtaggtcggattgtagttttagtttttttttgatttttttagttttttttttcgcgatttttggattattttatattttatttttcggtatcgtcgttatttgcggttatttgttgcgttattttgatttcgcgttttttgtttttttttttttttttttataattcgttttttatttatcgttttacgatagtcggtgggaggcgggagaaggaagaagaggaagtagagttttttttacggcggttttttttttcgggcgtgatgttatgatcgtttttcgtcggcggtcgttatgttgttgtacggaaaacggtttaggtttttttttcggaaaggaattcgcgttttcgaatttaggtaggcggtcgttatgttttcgtacggtaaatagtttttcgtttttttttaggtgaggaaatttgagttggtcgggagtttgtttatagttgtttttaaattaagtat

SEQ ID NO: 13842 - DNA, 672 bp, Artificial Sequence
  chemically treated genomic DNA (Homo sapiens) CpG-island No: 13842
atacttaatttaaaaacaactataaacaaactcccgaccaactcaaatttcctcacctaaaaaaaaacgaaaaactatttaccgtacgaaaacataacgaccgcctacctaaattcgaaaacgcgaattcctttccgaaaaaaaaacctaaaccgttttccgtacaacaacataacgaccgccgacgaaaaacgatcataacatcacgcccgaaaaaaaaaaccgccgtaaaaaaaactctacttcctcttcttccttctcccgcctcccaccgactatcgtaaaacgataaataaaaaacgaattataaaaaaaaaaaaaaaaaaacaaaaaacgcgaaatcaaaataacgcaacaaataaccgcaaataacgacgataccgaaaaataaaatataaaataatccaaaaatcgcgaaaaaaaaaactaaaaaaatcaaaaaaaaactaaaactacaatccgacctactattccgaaaaccgcgaaacccccacccgaaaaaataaacctcaaccgaatcatccaaacgctaaaaaacaccatcgacccgaaattacgaattacaaccgaaaacgaactcaaccaaataaaaaaaaaatcttcgacgaccctcttccgccgaaaaaacgcccctaccgactaaccgaactccctctccccgacgcccctcgt

SEQ ID NO: 13843 - DNA, 672 bp, Artificial Sequence
  chemically treated genomic DNA (Homo sapiens) CpG-island No: 13843
atgtttaatttggaagtagttgtaagtagattttcggttagtttaagtttttttatttgggaagaggcgggaggttgtttatcgtacggaagtatagcggtcgtttgtttgagttcgggagcgcgggttttttttcgggaaagaagtttaggtcgtttttcgtatagtagtatggcggtcgtcgacgggaggcggttatagtattacgttcgggggaagaggtcgtcgtaaaggaagttttgttttttttttttttttttttcgttttttatcggttgtcgtaaaacggtgaatggagagcgagttgtgggggggaaaaagggaggatagggggcgcggagttagagtggcgtagtaagtggtcgtaggtggcgacggtgtcggggggtggggtgtgaggtaatttaggggtcgcggaagaggaggttgagagggttaaaagaaaattaaagttgtagttcggtttattgtttcgggggtcgcggagtttttattcggggagatggattttaatcggattatttaggcgttgaagggtattatcgattcgaagttgcggattgtagtcgagaacgagtttaattaggtgaggagagggttttcggcgattttttttcgtcgaaggggcgtttttgtcggttggtcgggtttttttttttcggcgtttttcgt

SEQ ID NO: 13844 - DNA, 672 bp, Artificial Sequence
  chemically treated genomic DNA (Homo sapiens) CpG-island No: 13844
acgaaaaacgccgaaaaaaaaaaacccgaccaaccgacaaaaacgccccttcgacgaaaaaaaatcgccgaaaaccctctcctcacctaattaaactcgttctcgactacaatccgcaacttcgaatcgataatacccttcaacgcctaaataatccgattaaaatccatctccccgaataaaaactccgcgacccccgaaacaataaaccgaactacaactttaattttcttttaaccctctcaacctcctcttccgcgacccctaaattacctcacaccccaccccccgacaccgtcgccacctacgaccacttactacgccactctaactccgcgccccctatcctccctttttcccccccacaactcgctctccattcaccgttttacgacaaccgataaaaaacgaaaaaaaaaaaaaaaaaaaacaaaacttcctttacgacgacctcttcccccgaacgtaatactataaccgcctcccgtcgacgaccgccatactactatacgaaaaacgacctaaacttctttcccgaaaaaaaacccgcgctcccgaactcaaacaaacgaccgctatacttccgtacgataaacaacctcccgcctcttcccaaataaaaaaacttaaactaaccgaaaatctacttacaactacttccaaattaaacat

SEQ ID NO: 13845 - DNA, 619 bp, Artificial Sequence
  chemically treated genomic DNA (Homo sapiens) CpG-island No: 13845
  misc_feature (379)..(379): n is either a, c, g or t
  misc_feature (387)..(387): n is either a, c, g or t
  misc_feature (481)..(481): n is either a, c, g or t
  misc_feature (519)..(519): n is either a, c, g or t
  misc_feature (577)..(577): n is either a, c, g or t
  misc_feature (580)..(580): n is either a, c, g or t
tttcgttttttttttcgcgtcgcgtcggttttgtgcggcgtgttgtgtttcgttttttttcgttttcgttttcgtttttttttcgtcgtcgttttcgttcggtcgtcgtgttttttttcgtttttcggcgcgtcggcgttcgtcgggcgtttttcgtttggcgcgttttttcggcgtgttttggggcgttcgcgtcgtttcgtttcggttcgcgtttcgtcgtcgttttcgggtgtcgttgtttttcgttttcggcggttcgtttttgtttcgtttttttttttgcggcggttttttggcgtgtttttttcgtttgttttcggttcgtcgttgcggcggtttcgttttcgtgcgtcgtagcgcgcgcgcgtcgcgcggntgtgtttnttggtcgcgcgcgcggttttttttcgttgtttcgttcgcgcgtgttgtgttcgtcgcggttgtcgcgacgcggtcgtttgtttcgttcggtttncgcgcgcgttcgttcgcgtcgcgttcgtgttacgtttncgtagttcgtttgttttcgtacgtttcggcgtcgcgtatcgcgcgtcgcggttgcggnttncgcgttttaagtgagacgatcgaaataaatatatataag

SEQ ID NO: 13846 - DNA, 619 bp, Artificial Sequence
  chemically treated genomic DNA (Homo sapiens) CpG-island No: 13846
  misc_feature (40)..(40): n is either a, c, g or t
  misc_feature (43)..(43): n is either a, c, g or t
  misc_feature (101)..(101): n is either a, c, g or t
  misc_feature (139)..(139): n is either a, c, g or t
  misc_feature (233)..(233): n is either a, c, g or t
  misc_feature (241)..(241): n is either a, c, g or t
cttatatatatttatttcgatcgtctcacttaaaacgcgnaanccgcaaccgcgacgcgcgatacgcgacgccgaaacgtacgaaaacaaacgaactacgnaaacgtaacacgaacgcgacgcgaacgaacgcgcgcgnaaaccgaacgaaacaaacgaccgcgtcgcgacaaccgcgacgaacacaacacgcgcgaacgaaacaacgaaaaaaaaccgcgcgcgcgaccaanaaacacanccgcgcgacgcgcgcgcgctacgacgcacgaaaacgaaaccgccgcaacgacgaaccgaaaacaaacgaaaaaaacacgccaaaaaaccgccgcaaaaaaaaaaacgaaacaaaaacgaaccgccgaaaacgaaaaacaacgacacccgaaaacgacgacgaaacgcgaaccgaaacgaaacgacgcgaacgccccaaaacacgccgaaaaaacgcgccaaacgaaaaacgcccgacgaacgccgacgcgccgaaaaacgaaaaaaaacacgacgaccgaacgaaaacgacgacgaaaaaaaaacgaaaacgaaaacgaaaaaaaacgaaacacaacacgccgcacaaaaccgacgcgacgcgaaaaaaaaaacgaaa

SEQ ID NO: 13847 - DNA, 619 bp, Artificial Sequence
  chemically treated genomic DNA (Homo sapiens) CpG-island No: 13847
  misc_feature (40)..(40): n is either a, c, g or t
  misc_feature (43)..(43): n is either a, c, g or t
  misc_feature (101)..(101): n is either a, c, g or t
  misc_feature (139)..(139): n is either a, c, g or t
  misc_feature (233)..(233): n is either a, c, g or t
  misc_feature (241)..(241): n is either a, c, g or t
tttatgtgtgtttgtttcggtcgttttatttggagcgcgngantcgtagtcgcggcgcgcgatacgcggcgtcgggacgtgcgggagtaggcgagttgcgngagcgtagtacggacgcggcgcggacgggcgcgcgcgnaggtcggacggagtagacgatcgcgtcgcgatagtcgcggcgaatatagtacgcgcgaacgaggtagcgaggaagaatcgcgcgcgcggttaanagatatantcgcgcggcgcgcgcgcgttacggcgtacggggacgggatcgtcgtagcggcgagtcgaaggtaagcgaaaggaatacgttaagaggtcgtcgtagaggggagggcggggtagaggcgggtcgtcggggacgaggggtaacggtattcggaggcggcgacgggacgcgggtcgaggcgaggcggcgcgggcgttttaaagtacgtcgaaggagcgcgttaggcggaaaacgttcggcggacgtcggcgcgtcggggggcgggggggagtacggcggtcgggcgagggcggcgacgggggggaggcggaggcgggggcgaggggaggcggggtataatacgtcgtataggatcggcgcggcgcgggaaaaaggacgagg

SEQ ID NO: 13848 - DNA, 619 bp, Artificial Sequence
  chemically treated genomic DNA (Homo sapiens) CpG-island No: 13848
  misc_feature (379)..(379): n is either a, c, g or t
  misc_feature (387)..(387): n is either a, c, g or t
  misc_feature (481)..(481): n is either a, c, g or t
  misc_feature (519)..(519): n is either a, c, g or t
  misc_feature (577)..(577): n is either a, c, g or t
  misc_feature (580)..(580): n is either a, c, g or t
cctcgtcctttttcccgcgccgcgccgatcctatacgacgtattataccccgcctcccctcgcccccgcctccgcctcccccccgtcgccgccctcgcccgaccgccgtactcccccccgccccccgacgcgccgacgtccgccgaacgttttccgcctaacgcgctccttcgacgtactttaaaacgcccgcgccgcctcgcctcgacccgcgtcccgtcgccgcctccgaataccgttacccctcgtccccgacgacccgcctctaccccgccctcccctctacgacgacctcttaacgtattcctttcgcttaccttcgactcgccgctacgacgatcccgtccccgtacgccgtaacgcgcgcgcgccgcgcgantatatctnttaaccgcgcgcgcgattcttcctcgctacctcgttcgcgcgtactatattcgccgcgactatcgcgacgcgatcgtctactccgtccgacctncgcgcgcgcccgtccgcgccgcgtccgtactacgctcncgcaactcgcctactcccgcacgtcccgacgccgcgtatcgcgcgccgcgactacgantcncgcgctccaaataaaacgaccgaaacaaacacacataaa

SEQ ID NO: 13849 - DNA, 537 bp, Artificial Sequence
  chemically treated genomic DNA (Homo sapiens) CpG-island No: 13849
  misc_feature (160)..(160): n is either a, c, g or t
  misc_feature (440)..(440): n is either a, c, g or t
ttcggtttcgttttcggttttggggttttcggttgttttttggtcgttgtcgtcgcgcgggttttttttggcggggtcgttcgtacgtttgtttttgcgttttcgtttcgtttcgcgtttttcgcgtttttcgttgtttcgcgcgtcgtcgtcggtgttnttgtgcgtgggttgttttttcgtttttttttcgttttttttttcggttcgttttcgttgttgtttcgtttttttcgtttttgtttcgttgtttttttttttggtcgtcggtcgggttcgtgggttttcggttcgtcgttcgttttttcgttttcgcgtacgtcgtattttcgtgcgcgcgtcgttgttgtttcgcgtgttttttttcgttttgtcgtgttttgttttttgttttcgttcgttgcgttttcgttcgtttattttttttttggttattcgtnttcgttcgcgttcgttttggattatttcgtattcgcgtcgtgtcgcgtttttcgcgttcgttacgatcgacgttggcggataatcgtaaaaacgaaa

SEQ ID NO: 13850 - DNA, 537 bp, Artificial Sequence
  chemically treated genomic DNA (Homo sapiens) CpG-island No: 13850
  misc_feature (98)..(98): n is either a, c, g or t
  misc_feature (378)..(378): n is either a, c, g or t
tttcgtttttacgattatccgccaacgtcgatcgtaacgaacgcgaaaaacgcgacacgacgcgaatacgaaataatccaaaacgaacgcgaacgaanacgaataaccaaaaaaaaaataaacgaacgaaaacgcaacgaacgaaaacaaaaaacaaaacacgacaaaacgaaaaaaaacacgcgaaacaacaacgacgcgcgcacgaaaatacgacgtacgcgaaaacgaaaaaacgaacgacgaaccgaaaacccacgaacccgaccgacgaccaaaaaaaaaaacaacgaaacaaaaacgaaaaaaacgaaacaacaacgaaaacgaaccgaaaaaaaaaacgaaaaaaaaacgaaaaaacaacccacgcacaanaacaccgacgacgacgcgcgaaacaacgaaaaacgcgaaaaacgcgaaacgaaacgaaaacgcaaaaacaaacgtacgaacgaccccgccaaaaaaaacccgcgcgacgacaacgaccaaaaaacaaccgaaaaccccaaaaccgaaaacgaaaccgaa

SEQ ID NO: 13851 - DNA, 537 bp, Artificial Sequence
  chemically treated genomic DNA (Homo sapiens) CpG-island No: 13851
  misc_feature (98)..(98): n is either a, c, g or t
  misc_feature (378)..(378): n is either a, c, g or t
tttcgtttttacgattgttcgttagcgtcggtcgtggcgaacgcgggaggcgcgatacggcgcgggtacgggatgatttagagcgggcgcgggcgagnacgggtggttaggagagaggtgggcgagcggaaacgtaacggacgaagatagaggatagaatacggtagggcgggggggagtacgcggaatagtagcggcgcgcgtacgaggatgcgacgtgcgcgagggcgggggggcgggcgacgagtcgggagtttacggattcgatcggcggttaaggaggagggtagcggggtaggggcgggaaggacggagtagtaacgagagcgagtcgggagggggggcgaaggggaggcgagggggtagtttacgtatagngatatcgacggcgacgcgcggggtagcgggagacgcggagggcgcggggcggggcgagagcgtaggggtaaacgtgcggacggtttcgttagggagagttcgcgcgacgatagcgattaagagataatcggagattttagggtcggaggcgggatcgaa

SEQ ID NO: 13852 - DNA, 537 bp, Artificial Sequence
  chemically treated genomic DNA (Homo sapiens) CpG-island No: 13852
  misc_feature (160)..(160): n is either a, c, g or t
  misc_feature (440)..(440): n is either a, c, g or t
ttcgatcccgcctccgaccctaaaatctccgattatctcttaatcgctatcgtcgcgcgaactctccctaacgaaaccgtccgcacgtttacccctacgctctcgccccgccccgcgccctccgcgtctcccgctaccccgcgcgtcgccgtcgatatcnctatacgtaaactaccccctcgcctccccttcgccccccctcccgactcgctctcgttactactccgtccttcccgcccctaccccgctaccctcctccttaaccgccgatcgaatccgtaaactcccgactcgtcgcccgcccccccgccctcgcgcacgtcgcatcctcgtacgcgcgccgctactattccgcgtactcccccccgccctaccgtattctatcctctatcttcgtccgttacgtttccgctcgcccacctctctcctaaccacccgtnctcgcccgcgcccgctctaaatcatcccgtacccgcgccgtatcgcgcctcccgcgttcgccacgaccgacgctaacgaacaatcgtaaaaacgaaa

SEQ ID NO: 13853 - DNA, 1291 bp, Artificial Sequence
  chemically treated genomic DNA (Homo sapiens) CpG-island No: 13853
  misc_feature (685)..(685): n is either a, c, g or t
  misc_feature (688)..(688): n is either a, c, g or t
  misc_feature (1146)..(1146): n is either a, c, g or t
ggagtcggggaatttggatttttatatgttcgtcgagaattttttagttttcgtttataaagttttttcgtatggtacgtttattttttcgatttttagttgcgaggtcgagacgtttgttgttgtggttttcgacgaagttcggagatgttttttttttgcgaaagttgggttcggtagcgtcggtcgcggggtcgggcgttttcgggtttggcggtcggcgagggagcgtcgggcgcggggcggggcggtttttaggcgcgcgttgtttattcgggttgtaagagtcgcgggttcgcgagtttcggtttggagtaagaggcgcgcgcgggtcgtgggggttgggtcgaggcggagcgcgaggcggcggcggtggcgggaggcgtcgcgggacgaggtagcggttttcgtttttcgaagttcgttttcgcgcggggttggggagtttagggcggggaagtcgcggggtcgcgttacgtttttcgttcgttttagagcgggttttataggcggttttagtttgggggtttttgtgtttgcgattcgggagcggcgagagagtagattttttttttagagggcgttgtgagtgtgtcgttagggtcgggtcgcgagttttttgttttttttgttagcggtttttgaggcggcggcgaagaagaaggagtgggaggaggcggcggtngtngcggcgtattcgtttttagtatatgtcggtttcgggtggggggtcgtttttaggtcgcgttttcggttatcgtcgttgagtttcgtcggtgttcgtacgtcgtttcgtcgtttcgtcgtttcgaggtttcgttttttttttaaattttgtaaagtcggttcgcgtttttatcgttttcggtcgtgtttcggtttcgaggtttgtttcgtagtcgtagcggtttcgcgaggaggaggagtcgtcgtcgtagtattaaagagatcgaattttcgcggtttgggggggagttatgttttgcggtttgtattgtttttagaatacgagaaggattttatttttttgaagagagttttaggttatcgataacggtgtcgtattggcgtaatttgggtgagttacgttcgtcgtgtttcgtttttcgttttcgggaggttatcggtttttgttcggtttttagnttcgcgtcgtttcgtttttcgtttgtattttttcgtttcgtgtttgttattttcgtttttcgttttcgttttttcgttgttttttttatatttttttttttgatttttcgttttttcgatttttgcgtttcgttgtttttttttt

SEQ ID NO: 13854 - DNA, 1291 bp, Artificial Sequence
  chemically treated genomic DNA (Homo sapiens) CpG-island No: 13854
  misc_feature (146)..(146): n is either a, c, g or t
  misc_feature (604)..(604): n is either a, c, g or t
  misc_feature (607)..(607): n is either a, c, g or t
aaaaaaaaaacaacgaaacgcaaaaatcgaaaaaacgaaaaatcaaaaaaaaaaatataaaaaaaacaacgaaaaaacgaaaacgaaaaacgaaaataacaaacacgaaacgaaaaaatacaaacgaaaaacgaaacgacgcgaanctaaaaaccgaacaaaaaccgataacctcccgaaaacgaaaaacgaaacacgacgaacgtaactcacccaaattacgccaatacgacaccgttatcgataacctaaaactctcttcaaaaaaataaaatccttctcgtattctaaaaacaatacaaaccgcaaaacataactcccccccaaaccgcgaaaattcgatctctttaatactacgacgacgactcctcctcctcgcgaaaccgctacgactacgaaacaaacctcgaaaccgaaacacgaccgaaaacgataaaaacgcgaaccgactttacaaaatttaaaaaaaaaacgaaacctcgaaacgacgaaacgacgaaacgacgtacgaacaccgacgaaactcaacgacgataaccgaaaacgcgacctaaaaacgaccccccacccgaaaccgacatatactaaaaacgaatacgccgcnacnaccgccgcctcctcccactccttcttcttcgccgccgcctcaaaaaccgctaacaaaaaaaacaaaaaactcgcgacccgaccctaacgacacactcacaacgccctctaaaaaaaaaatctactctctcgccgctcccgaatcgcaaacacaaaaacccccaaactaaaaccgcctataaaacccgctctaaaacgaacgaaaaacgtaacgcgaccccgcgacttccccgccctaaactccccaaccccgcgcgaaaacgaacttcgaaaaacgaaaaccgctacctcgtcccgcgacgcctcccgccaccgccgccgcctcgcgctccgcctcgacccaacccccacgacccgcgcgcgcctcttactccaaaccgaaactcgcgaacccgcgactcttacaacccgaataaacaacgcgcgcctaaaaaccgccccgccccgcgcccgacgctccctcgccgaccgccaaacccgaaaacgcccgaccccgcgaccgacgctaccgaacccaactttcgcaaaaaaaaaacatctccgaacttcgtcgaaaaccacaacaacaaacgtctcgacctcgcaactaaaaatcgaaaaaataaacgtaccatacgaaaaaactttataaacgaaaactaaaaaattctcgacgaacatataaaaatccaaattccccgactcc

SEQ ID NO: 13855 - DNA, 1291 bp, Artificial Sequence
  chemically treated genomic DNA (Homo sapiens) CpG-island No: 13855
  misc_feature (146)..(146): n is either a, c, g or t
  misc_feature (604)..(604): n is either a, c, g or t
  misc_feature (607)..(607): n is either a, c, g or t
gggaaagagataacgggacgtaaaagtcgggggggcgagggattagggggggaggtgtagggggggtaacggggggacgggggcggggggcggggatagtaggtacggggcgggggggtgtagacgggaagcggggcggcgcgganttagggatcggatagaggtcgatggtttttcgggggcggggaacggggtacggcgaacgtggtttatttaggttgcgttaatgcggtatcgttatcggtgatttagaattttttttagggaaatgggatttttttcgtgttttggggatagtatagatcgtaaagtatgatttttttttaggtcgcgggaattcggtttttttgatgttgcggcggcggtttttttttttcgcggggtcgttgcggttgcgaggtaagtttcggagtcgaggtacggtcgagggcggtggggacgcgggtcgattttgtaaagtttgggaggaggacgaggtttcggggcggcggggcggcggggcggcgtgcgggtatcggcggggtttagcggcggtggtcgggagcgcggtttgggggcggttttttattcggggtcggtatgtgttgagggcgagtgcgtcgtngtngtcgtcgtttttttttattttttttttttcgtcgtcgttttaggagtcgttgataggggaagtaggaggttcgcggttcggttttggcggtatatttatagcgttttttgaggaggaggtttgttttttcgtcgttttcgagtcgtagatataaaagtttttagattggagtcgtttgtaaaattcgttttggggcgggcgagggacgtggcgcggtttcgcggttttttcgttttgagttttttagtttcgcgcggggacgggtttcggggggcgggggtcgttgtttcgtttcgcggcgtttttcgttatcgtcgtcgtttcgcgtttcgtttcggtttagtttttacggttcgcgcgcgttttttgttttaagtcggggttcgcgggttcgcggtttttgtagttcgggtgggtagcgcgcgtttaggggtcgtttcgtttcgcgttcggcgttttttcgtcgatcgttaggttcgagaacgttcgatttcgcggtcgacgttatcgggtttagttttcgtaaggaaagggtattttcgaatttcgtcggaggttatagtagtaggcgtttcggtttcgtagttagggatcggaaagatgaacgtattatgcgaggaaattttgtaagcgggagttggagagttttcggcgggtatgtggggatttagatttttcgatttt

SEQ ID NO: 13856 - DNA, 1291 bp, Artificial Sequence
  chemically treated genomic DNA (Homo sapiens) CpG-island No: 13856
  misc_feature (685)..(685): n is either a, c, g or t
  misc_feature (688)..(688): n is either a, c, g or t
  misc_feature (1146)..(1146): n is either a, c, g or t
aaaatcgaaaaatctaaatccccacatacccgccgaaaactctccaactcccgcttacaaaatttcctcgcataatacgttcatctttccgatccctaactacgaaaccgaaacgcctactactataacctccgacgaaattcgaaaataccctttccttacgaaaactaaacccgataacgtcgaccgcgaaatcgaacgttctcgaacctaacgatcgacgaaaaaacgccgaacgcgaaacgaaacgacccctaaacgcgcgctacccacccgaactacaaaaaccgcgaacccgcgaaccccgacttaaaacaaaaaacgcgcgcgaaccgtaaaaactaaaccgaaacgaaacgcgaaacgacgacgataacgaaaaacgccgcgaaacgaaacaacgacccccgccccccgaaacccgtccccgcgcgaaactaaaaaactcaaaacgaaaaaaccgcgaaaccgcgccacgtccctcgcccgccccaaaacgaattttacaaacgactccaatctaaaaacttttatatctacgactcgaaaacgacgaaaaaacaaacctcctcctcaaaaaacgctataaatataccgccaaaaccgaaccgcgaacctcctacttcccctatcaacgactcctaaaacgacgacgaaaaaaaaaaaataaaaaaaaacgacgacnacnacgacgcactcgccctcaacacataccgaccccgaataaaaaaccgcccccaaaccgcgctcccgaccaccgccgctaaaccccgccgatacccgcacgccgccccgccgccccgccgccccgaaacctcgtcctcctcccaaactttacaaaatcgacccgcgtccccaccgccctcgaccgtacctcgactccgaaacttacctcgcaaccgcaacgaccccgcgaaaaaaaaaaaccgccgccgcaacatcaaaaaaaccgaattcccgcgacctaaaaaaaaatcatactttacgatctatactatccccaaaacacgaaaaaaatcccatttccctaaaaaaaattctaaatcaccgataacgataccgcattaacgcaacctaaataaaccacgttcgccgtaccccgttccccgcccccgaaaaaccatcgacctctatccgatccctaantccgcgccgccccgcttcccgtctacacccccccgccccgtacctactatccccgccccccgcccccgtccccccgttaccccccctacacctccccccctaatccctcgcccccccgacttttacgtcccgttatctctttccc

SEQ ID NO: 13857 - DNA, 641 bp, Artificial Sequence
  chemically treated genomic DNA (Homo sapiens) CpG-island No: 13857
tttatacgcgggttaggtatagcgcgattacgtttgttcggttttttttaggtagacggttttttttggttttgaggtcgtcggtgtcgtcgttgtcggtttcgattttttcgggtgtaacgtttttagattatgtttttcgtcgggtacgtagggggcgtacggcgttcgtcgtttagttcggagttcgtcgttcggttttcggttttcggttcgattcggtttttttttttcggtagcgttcgattcggggtttattatggtagtcgttttgttttcggggtttaaatttcgattttttggtttcgcggtcggggattaagcgtggtcggcgggttagaggttaaggaaagtcgtagagagcgcgtgcgcgatacggcgttgggtatgcgtattgttttagtttaagggcgggttatcgggagcgttttagcggttcggggcggggtcggaggcggggtttgattgagtttgcgtcgggttttggataattgggggcgggtttgggagggtaaggggcgttatcgggagttttaattgttcgcgtgtttattttagtgcgttggagtagttaagtatatcggttagacgtggggcgatttttgtttttgattttgttaaaatatttgggaatgtaatat

SEQ ID NO: 13858 - DNA, 641 bp, Artificial Sequence
  chemically treated genomic DNA (Homo sapiens) CpG-island No: 13858
atattacattcccaaatattttaacaaaatcaaaaacaaaaatcgccccacgtctaaccgatatacttaactactccaacgcactaaaataaacacgcgaacaattaaaactcccgataacgccccttaccctcccaaacccgcccccaattatccaaaacccgacgcaaactcaatcaaaccccgcctccgaccccgccccgaaccgctaaaacgctcccgataacccgcccttaaactaaaacaatacgcatacccaacgccgtatcgcgcacgcgctctctacgactttccttaacctctaacccgccgaccacgcttaatccccgaccgcgaaaccaaaaaatcgaaatttaaaccccgaaaacaaaacgactaccataataaaccccgaatcgaacgctaccgaaaaaaaaaaaccgaatcgaaccgaaaaccgaaaaccgaacgacgaactccgaactaaacgacgaacgccgtacgccccctacgtacccgacgaaaaacataatctaaaaacgttacacccgaaaaaatcgaaaccgacaacgacgacaccgacgacctcaaaaccaaaaaaaaccgtctacctaaaaaaaaccgaacaaacgtaatcgcgctatacctaacccgcgtataaa

SEQ ID NO: 13859 - DNA, 641 bp, Artificial Sequence
  chemically treated genomic DNA (Homo sapiens) CpG-island No: 13859
atgttgtatttttaaatattttggtaaaattaagggtagaaatcgttttacgtttgatcgatgtgtttagttgttttagcgtattggggtaagtacgcgggtaattgagattttcggtaacgttttttgtttttttaagttcgtttttagttatttagagttcgacgtaggtttagttaaatttcgttttcgatttcgtttcgagtcgttaagacgttttcggtggttcgtttttagattgaggtaatgcgtatgtttagcgtcgtatcgcgtacgcgttttttgcggttttttttgatttttgattcgtcgattacgtttgattttcggtcgcggggttaggaagtcggagtttgagtttcggaggtagagcggttgttatggtgagtttcgagtcgggcgttatcggggaggggaagtcgagtcgggtcgggggtcgggggtcgggcggcgagtttcgggttgggcggcgggcgtcgtgcgttttttgcgtgttcggcgggaagtatggtttgggggcgttgtattcgggggaatcgaggtcggtagcggcggtatcggcggttttagggttagggaaaatcgtttgtttggaagaggtcgggtaaacgtggtcgcgttgtgtttagttcgcgtgtgag

SEQ ID NO: 13860 - DNA, 641 bp, Artificial Sequence
  chemically treated genomic DNA (Homo sapiens) CpG-island No: 13860
ctcacacgcgaactaaacacaacgcgaccacgtttacccgacctcttccaaacaaacgattttccctaaccctaaaaccgccgataccgccgctaccgacctcgattcccccgaatacaacgcccccaaaccatacttcccgccgaacacgcaaaaaacgcacgacgcccgccgcccaacccgaaactcgccgcccgacccccgacccccgacccgactcgacttcccctccccgataacgcccgactcgaaactcaccataacaaccgctctacctccgaaactcaaactccgacttcctaaccccgcgaccgaaaatcaaacgtaatcgacgaatcaaaaatcaaaaaaaaccgcaaaaaacgcgtacgcgatacgacgctaaacatacgcattacctcaatctaaaaacgaaccaccgaaaacgtcttaacgactcgaaacgaaatcgaaaacgaaatttaactaaacctacgtcgaactctaaataactaaaaacgaacttaaaaaaacaaaaaacgttaccgaaaatctcaattacccgcgtacttaccccaatacgctaaaacaactaaacacatcgatcaaacgtaaaacgatttctacccttaattttaccaaaatatttaaaaatacaacat

SEQ ID NO: 13861 - DNA, 621 bp, Artificial Sequence
  chemically treated genomic DNA (Homo sapiens) CpG-island No: 13861
tcggtttacgagtttttcggtggggaaggggcgtgtttttacgcggtttcgtttcggttaatggggagaggtttcgtttttgtcgcggcgggttcgtttttcgggatttttaaggcgcgatttgtttttagcgagtcgatttcggagttcgagttcggggcgggtggacgcggattcgaacgtagttgtttcgggatttaggattttttcgggttcgattcgttaggaaagattgaggtcgcggtttgtttcgttcggttttttgcgtcgtcgtcgtttttcggtgagtttttgtggggttggggggttgcgggcggggaagggggcgttacggttaggttgtgtatacgcgcggggatcgtcgtcgcgcgtatatacgtattttcgggcgggatcgcggttttagttttatacggttatttgggtcgttcggcgggtaggttttgtacgttttttttttcgtcgttttggggcgtcgatagtttcgcggtcggttagggtgcgcgtttgagtgtgcggtgagttcgcgaggttgtaagtagataaaataaatatttcgttttatgttttttttttttacggttgggttttcggtatgattagttttatgaattaaatttt

SEQ ID NO: 13862 - DNA, 621 bp, Artificial Sequence
  chemically treated genomic DNA (Homo sapiens) CpG-island No: 13862
aaaatttaattcataaaactaatcataccgaaaacccaaccgtaaaaaaaaaaaacataaaacgaaatatttattttatctacttacaacctcgcgaactcaccgcacactcaaacgcgcaccctaaccgaccgcgaaactatcgacgccccaaaacgacgaaaaaaaaaacgtacaaaacctacccgccgaacgacccaaataaccgtataaaactaaaaccgcgatcccgcccgaaaatacgtatatacgcgcgacgacgatccccgcgcgtatacacaacctaaccgtaacgcccccttccccgcccgcaaccccccaaccccacaaaaactcaccgaaaaacgacgacgacgcaaaaaaccgaacgaaacaaaccgcgacctcaatctttcctaacgaatcgaacccgaaaaaatcctaaatcccgaaacaactacgttcgaatccgcgtccacccgccccgaactcgaactccgaaatcgactcgctaaaaacaaatcgcgccttaaaaatcccgaaaaacgaacccgccgcgacaaaaacgaaacctctccccattaaccgaaacgaaaccgcgtaaaaacacgccccttccccaccgaaaaactcgtaaaccga

SEQ ID NO: 13863 - DNA, 621 bp, Artificial Sequence
  chemically treated genomic DNA (Homo sapiens) CpG-island No: 13863
ggggtttgatttataaaattggttatgtcggaggtttagtcgtgggaggaggaagtatgggacggggtgtttattttgtttgtttgtagtttcgcgggtttatcgtatatttaggcgcgtattttggtcggtcgcggggttgtcggcgttttaggacggcgggggagggagcgtatagggtttgttcgtcgggcggtttaggtgatcgtgtggggttggggtcgcggtttcgttcgaaagtgcgtgtgtgcgcgcggcggcggttttcgcgcgtgtgtatagtttggtcgtggcgttttttttttcgttcgtagttttttagttttatagaaatttatcgggaggcggcggcggcgtagggagtcgggcggggtaggtcgcggttttagttttttttggcgggtcgggttcgagggggttttgggtttcgaagtaattgcgttcgagttcgcgtttattcgtttcgggttcgggtttcggagtcggttcgttggaggtaggtcgcgttttaagagtttcggggggcgggttcgtcgcggtaggggcggggtttttttttattggtcggggcggagtcgcgtggagatacgttttttttttatcgaggggttcgtgggtcgg

SEQ ID NO: 13864 - DNA, 621 bp, Artificial Sequence
  chemically treated genomic DNA (Homo sapiens) CpG-island No: 13864
ccgacccacgaacccctcgataaaaaaaaaacgtatctccacgcgactccgccccgaccaataaaaaaaaaccccgcccctaccgcgacgaacccgccccccgaaactcttaaaacgcgacctacctccaacgaaccgactccgaaacccgaacccgaaacgaataaacgcgaactcgaacgcaattacttcgaaacccaaaaccccctcgaacccgacccgccaaaaaaaactaaaaccgcgacctaccccgcccgactccctacgccgccgccgcctcccgataaatttctataaaactaaaaaactacgaacgaaaaaaaaaacgccacgaccaaactatacacacgcgcgaaaaccgccgccgcgcgcacacacgcactttcgaacgaaaccgcgaccccaaccccacacgatcacctaaaccgcccgacgaacaaaccctatacgctccctcccccgccgtcctaaaacgccgacaaccccgcgaccgaccaaaatacgcgcctaaatatacgataaacccgcgaaactacaaacaaacaaaataaacaccccgtcccatacttcctcctcccacgactaaacctccgacataaccaattttataaatcaaacccc

SEQ ID NO: 13865 - DNA, 547 bp, Artificial Sequence
  chemically treated genomic DNA (Homo sapiens) CpG-island No: 13865
tagcgttcggttttcgggtcggatttatttcgcggcggggcggtcgagtttcggtgtgtcggaatttggatattttgaagcggtttatggcgacgggtacggcggcggacgcgttttcgaggatttcgggcgtcgggttttaggtgtacgttgagtaatcgcgattttcgttgtttcggttttattcgggatttaatgtcgcggttacgttttcggcgcgttttattgttaatcgtagtcgttttcggttttttgggttacgtttttaagttttttttttttcgcgcgcgtattatcggtttcgtttttcggttaatttaggtacggtcgtttcgcgaggttacgttttgatatcgaggggacggattggcgcgggtgggaggttacgtggggcgtagttgttagtttacgttttttgcggtgtttgtttgcgtggggtttcggttgtagtattcgcgattttgtgtgtaggatttgttgtggagtttttgcggtgtatttagtacgttttttagtattatttatttttttttgtagagaggggaga

SEQ ID NO: 13866 - DNA, 547 bp, Artificial Sequence
  chemically treated genomic DNA (Homo sapiens) CpG-island No: 13866
tctcccctctctacaaaaaaaaataaataatactaaaaaacgtactaaatacaccgcaaaaactccacaacaaatcctacacacaaaatcgcgaatactacaaccgaaaccccacgcaaacaaacaccgcaaaaaacgtaaactaacaactacgccccacgtaacctcccacccgcgccaatccgtcccctcgatatcaaaacgtaacctcgcgaaacgaccgtacctaaattaaccgaaaaacgaaaccgataatacgcgcgcgaaaaaaaaaaaacttaaaaacgtaacccaaaaaaccgaaaacgactacgattaacaataaaacgcgccgaaaacgtaaccgcgacattaaatcccgaataaaaccgaaacaacgaaaatcgcgattactcaacgtacacctaaaacccgacgcccgaaatcctcgaaaacgcgtccgccgccgtacccgtcgccataaaccgcttcaaaatatccaaattccgacacaccgaaactcgaccgccccgccgcgaaataaatccgacccgaaaaccgaacgcta

SEQ ID NO: 13867 - DNA, 547 bp, Artificial Sequence
  chemically treated genomic DNA (Homo sapiens) CpG-island No: 13867
ttttttttttttataggaagaggtagatagtgttggaaggcgtgttaggtatatcgtaaagattttatagtaaattttgtatataaaatcgcgaatgttgtagtcgagattttacgtaagtaagtatcgtaggagacgtgggttgatagttgcgttttacgtgattttttattcgcgttagttcgttttttcggtattagggcgtggtttcgcggggcggtcgtatttggattggtcgggaggcgggatcggtggtgcgcgcgcgaaaggagaggggtttgggggcgtggtttagggggtcggagacggttgcgattggtagtggggcgcgtcgggggcgtgatcgcggtattgggtttcgggtggggtcgaggtagcgggagtcgcggttgtttagcgtgtatttgagattcgacgttcggggttttcgaagacgcgttcgtcgtcgtgttcgtcgttatgaatcgttttagggtgtttaagtttcggtatatcgaggttcggtcgtttcgtcgcgaggtgagttcggttcgaggatcgggcgttg

SEQ ID NO: 13868 - DNA, 547 bp, Artificial Sequence
  chemically treated genomic DNA (Homo sapiens) CpG-island No: 13868
caacgcccgatcctcgaaccgaactcacctcgcgacgaaacgaccgaacctcgatataccgaaacttaaacaccctaaaacgattcataacgacgaacacgacgacgaacgcgtcttcgaaaaccccgaacgtcgaatctcaaatacacgctaaacaaccgcgactcccgctacctcgaccccacccgaaacccaataccgcgatcacgcccccgacgcgccccactaccaatcgcaaccgtctccgaccccctaaaccacgcccccaaacccctctcctttcgcgcgcgcaccaccgatcccgcctcccgaccaatccaaatacgaccgccccgcgaaaccacgccctaataccgaaaaaacgaactaacgcgaataaaaaatcacgtaaaacgcaactatcaacccacgtctcctacgatacttacttacgtaaaatctcgactacaacattcgcgattttatatacaaaatttactataaaatctttacgatatacctaacacgccttccaacactatctacctcttcctataaaaaaaaaaaa

SEQ ID NO: 13869 - DNA, 722 bp, Artificial Sequence
  chemically treated genomic DNA (Homo sapiens) CpG-island No: 13869
ttttttataaatcggtaggggacgagaaaacgttttgtcgggtttaatttagttgtagaagttacgtttttttttttatcggggtcggttgttgttggagagaagttttcgagttttgcgcgtcgaaaaggtcgagggttcgagaagcgaagaggtttagggaaggcgaggcgaggatcgtagtttttttttttttcgcggggtcggcgcgttggttcgatttttcgttcgtagttgtcggcgggcgcggagtcgaagtttacgaggtggagttcggttagttattttttttggttttttcggtcgcgtcgggtttttgtagcggagcgttttgtatttatcgttggagttttatttttttttaagttttttgatttgttttaggtttagtttcgtattttcgttgacgtcgaagtggtttagtattttttttatcgttttggtgtgcgcgttttttatggtttcgggggttcggtcggtttcgtttttcgttttcgcggttttttcgttttcgtttcgtatttcggtcgcgggttcgtgttatttcgggagtttaggcgcggacgggttttttttttttttttttgcggtcgttttcgtttcgtcgggcgttgaattatttcgcgtttttttttttagataatcgtttttcgcgcggtttcgagtttcgtagggcgggttgggggtttttgatttatttttttttttttcgttagaaggga

SEQ ID NO: 13870 - DNA, 722 bp, Artificial Sequence
  chemically treated genomic DNA (Homo sapiens) CpG-island No: 13870
tcccttctaacgaaaaaaaaaaaaataaatcaaaaacccccaacccgccctacgaaactcgaaaccgcgcgaaaaacgattatctaaaaaaaaaaacgcgaaataattcaacgcccgacgaaacgaaaacgaccgcaaaaaaaaaaaaaaaaaacccgtccgcgcctaaactcccgaaataacacgaacccgcgaccgaaatacgaaacgaaaacgaaaaaaccgcgaaaacgaaaaacgaaaccgaccgaacccccgaaaccataaaaaacgcgcacaccaaaacgataaaaaaaatactaaaccacttcgacgtcaacgaaaatacgaaactaaacctaaaacaaatcaaaaaacttaaaaaaaaataaaactccaacgataaatacaaaacgctccgctacaaaaacccgacgcgaccgaaaaaaccaaaaaaaataactaaccgaactccacctcgtaaacttcgactccgcgcccgccgacaactacgaacgaaaaatcgaaccaacgcgccgaccccgcgaaaaaaaaaaaaactacgatcctcgcctcgccttccctaaacctcttcgcttctcgaaccctcgaccttttcgacgcgcaaaactcgaaaacttctctccaacaacaaccgaccccgataaaaaaaaaaacgtaacttctacaactaaattaaacccgacaaaacgttttctcgtcccctaccgatttataaaaaa

SEQ ID NO: 13871 - DNA, 722 bp, Artificial Sequence
  chemically treated genomic DNA (Homo sapiens) CpG-island No: 13871
ttttttttggcgaggggagggagggtgggttaggagtttttaattcgttttgcggagttcggggtcgcgcgaggggcggttgtttgggggagggggcgcggggtgatttagcgttcggcgaggcggaagcggtcgtaagaggaggaggggagagttcgttcgcgtttgggttttcggggtggtacgagttcgcggtcggagtgcgaggcggaggcgaggaggtcgcggggacgggaggcgaggtcggtcgggttttcgaagttatggagaacgcgtatattaagacggtggaggaggtgttgggttatttcggcgttaacgagagtacggggttgagtttggaataggttaagaagtttaaggagagatggggttttaacggtaggtgtagggcgtttcgttgtaggggttcggcgcggtcgggagagttagggaagatggttgatcgggttttatttcgtgggtttcggtttcgcgttcgtcgatagttgcgggcggagggtcgggttagcgcgtcggtttcgcgggagagaaaggggttgcggttttcgtttcgttttttttggattttttcgtttttcgggttttcgattttttcggcgcgtaaggttcggaggtttttttttagtagtagtcggtttcggtggagggagggacgtggtttttgtagttaggttgagttcggtaagacgttttttcgttttttgtcgatttatgaggag

SEQ ID NO: 13872 - DNA, 722 bp, Artificial Sequence
  chemically treated genomic DNA (Homo sapiens) CpG-island No: 13872
ctcctcataaatcgacaaaaaacgaaaaaacgtcttaccgaactcaacctaactacaaaaaccacgtccctccctccaccgaaaccgactactactaaaaaaaaacctccgaaccttacgcgccgaaaaaatcgaaaacccgaaaaacgaaaaaatccaaaaaaaacgaaacgaaaaccgcaacccctttctctcccgcgaaaccgacgcgctaacccgaccctccgcccgcaactatcgacgaacgcgaaaccgaaacccacgaaataaaacccgatcaaccatcttccctaactctcccgaccgcgccgaacccctacaacgaaacgccctacacctaccgttaaaaccccatctctccttaaacttcttaacctattccaaactcaaccccgtactctcgttaacgccgaaataacccaacacctcctccaccgtcttaatatacgcgttctccataacttcgaaaacccgaccgacctcgcctcccgtccccgcgacctcctcgcctccgcctcgcactccgaccgcgaactcgtaccaccccgaaaacccaaacgcgaacgaactctcccctcctcctcttacgaccgcttccgcctcgccgaacgctaaatcaccccgcgccccctcccccaaacaaccgcccctcgcgcgaccccgaactccgcaaaacgaattaaaaactcctaacccaccctccctcccctcgccaaaaaaaa

SEQ ID NO: 13873 - DNA, 545 bp, Artificial Sequence
  chemically treated genomic DNA (Homo sapiens) CpG-island No: 13873
tgtttcgttgtttaaggagtagttatgatttggtttcgtcgttagttttttatcggcgtcggcgtgttggtagtcgttagcggtatcgtagggcgcgtggtggcgaaaacgttgaatattaatggggtgcgttacggtatggtgtatgacgagtcgttatgtatcggttgtatcgtttgtatggatgtttgtcgggaagtgaataaggtgtcggaaggcgtttcgcgtttgacgattattcgtagcgagtcgtaggcgaattttttgatgtgaatatcgtttttttcgtaagttttgttagtattgcgattatgcgtcgtgcgttgacgtttgttcgatcggtgcgttttttcgcgatgttgttagtgggattgtcgatgttaatcggatttttgcgtcggttgttagtaatgtattcgcgtttgtcggtacgcggtcggtttatttattcggtacgaaaacgcggataaattcgattttgtcgtaaattaattttaagcggtaaatttcgcgtgcgttgaattggcggattaagggtatatttg

SEQ ID NO: 13874 - DNA, 545 bp, Artificial Sequence
  chemically treated genomic DNA (Homo sapiens) CpG-island No: 13874
caaatatacccttaatccgccaattcaacgcacgcgaaatttaccgcttaaaattaatttacgacaaaatcgaatttatccgcgttttcgtaccgaataaataaaccgaccgcgtaccgacaaacgcgaatacattactaacaaccgacgcaaaaatccgattaacatcgacaatcccactaacaacatcgcgaaaaaacgcaccgatcgaacaaacgtcaacgcacgacgcataatcgcaatactaacaaaacttacgaaaaaaacgatattcacatcaaaaaattcgcctacgactcgctacgaataatcgtcaaacgcgaaacgccttccgacaccttattcacttcccgacaaacatccatacaaacgatacaaccgatacataacgactcgtcatacaccataccgtaacgcaccccattaatattcaacgttttcgccaccacgcgccctacgataccgctaacgactaccaacacgccgacgccgataaaaaactaacgacgaaaccaaatcataactactccttaaacaacgaaaca

SEQ ID NO: 13875 - DNA, 545 bp, Artificial Sequence
  chemically treated genomic DNA (Homo sapiens) CpG-island No: 13875
taaatgtatttttggttcgttagtttaacgtacgcggaatttatcgtttgaaattggtttacggtagaatcggatttgttcgcgttttcgtatcggatggataagtcgatcgcgtatcgataggcgcgaatgtattattgataatcgacgtagagattcgattaatatcgataattttattggtagtatcgcgaaaagacgtatcggtcgggtagacgttaacgtacggcgtatgatcgtagtgttggtaagatttacggaagaagcgatatttatattaggaaattcgtttgcggttcgttacgaataatcgttaggcgcgagacgtttttcggtattttgtttatttttcgataagtatttatataggcggtatagtcgatgtataacgattcgttatgtattatgtcgtaacgtattttattgatatttaacgttttcgttattacgcgttttgcggtgtcgttgacggttgttagtacgtcgacgtcggtgagaaattggcgacgagattaggttatggttgttttttaagtaacggaata

SEQ ID NO: 13876 - DNA, 545 bp, Artificial Sequence
  chemically treated genomic DNA (Homo sapiens) CpG-island No: 13876
tattccgttacttaaaaaacaaccataacctaatctcgtcgccaatttctcaccgacgtcgacgtactaacaaccgtcaacgacaccgcaaaacgcgtaataacgaaaacgttaaatatcaataaaatacgttacgacataatacataacgaatcgttatacatcgactataccgcctatataaatacttatcgaaaaataaacaaaataccgaaaaacgtctcgcgcctaacgattattcgtaacgaaccgcaaacgaatttcctaatataaatatcgcttcttccgtaaatcttaccaacactacgatcatacgccgtacgttaacgtctacccgaccgatacgtcttttcgcgatactaccaataaaattatcgatattaatcgaatctctacgtcgattatcaataatacattcgcgcctatcgatacgcgatcgacttatccatccgatacgaaaacgcgaacaaatccgattctaccgtaaaccaatttcaaacgataaattccgcgtacgttaaactaacgaaccaaaaatacattta

SEQ ID NO: 13877 - DNA, 984 bp, Artificial Sequence
  chemically treated genomic DNA (Homo sapiens) CpG-island No: 13877
ggttagcggtaggcgcgatggtcgtagtggtataggtgaatttttcgcgtcggcgtgtatatcgggtttatttggttttgtatttgcgttatcgttaggtcgtacgatgttagttagcggcggttttttttatttattcggttagttaggattttattttttagtcggtcgagtatttgtattagtatcggcgggaatattatattgttatcgttttcgttatcggattgttgaagggtattcgttaggttgcggcgttgcgttttcgttagtttatcggtggcggttttaattttgatgagtggcgtgaagtttttcggttgataaatcgtttggatgcgggttttgtcgttttgtatcgtggttaggcggtcgtcgttttagtcgtattaggttatttgcggttttcgtgatagcgatatttagttcgttaggtttcgtttacgtcgttatattcgtttggttattttgcggtttagcgggtcgtaaagatagcgattttcgattagcggttttgtatattgtgttcgcgtgtagtgtattagtcggtgttgattgtcgtaatggtatcggtgggtgcgtttattattcgtgcggataatttttttcgggatgaggtcggttttttttgttagtttgtcgtgacggttatatcggtaaagatagtgcgcgttacgggcgatacggttattcggttatatgttgagggcgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggtggtgtttttattcgttttt

SEQ ID NO: 13878 - DNA, 984 bp, Artificial Sequence
  chemically treated genomic DNA (Homo sapiens) CpG-island No: 13878
aaaaacgaataaaaacaccaccgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacgccctcaacatataaccgaataaccgtatcgcccgtaacgcgcactatctttaccgatataaccgtcacgacaaactaacaaaaaaaaccgacctcatcccgaaaaaaattatccgcacgaataataaacgcacccaccgataccattacgacaatcaacaccgactaatacactacacgcgaacacaatatacaaaaccgctaatcgaaaatcgctatctttacgacccgctaaaccgcaaaataaccaaacgaatataacgacgtaaacgaaacctaacgaactaaatatcgctatcacgaaaaccgcaaataacctaatacgactaaaacgacgaccgcctaaccacgatacaaaacgacaaaacccgcatccaaacgatttatcaaccgaaaaacttcacgccactcatcaaaattaaaaccgccaccgataaactaacgaaaacgcaacgccgcaacctaacgaatacccttcaacaatccgataacgaaaacgataacaatataatattcccgccgatactaatacaaatactcgaccgactaaaaaataaaatcctaactaaccgaataaataaaaaaaaccgccgctaactaacatcgtacgacctaacgataacgcaaatacaaaaccaaataaacccgatatacacgccgacgcgaaaaattcacctataccactacgaccatcgcgcctaccgctaacc

SEQ ID NO: 13879 - DNA, 984 bp, Artificial Sequence
  chemically treated genomic DNA (Homo sapiens) CpG-island No: 13879
ggaaacgggtgagggtattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatattatagattcggtaggtaatcgtttgttcgattcggagttgtattcggatagcgtttttagtatgtggtcggataatcgtatcgttcgtgacgcgtattatttttatcggtatgatcgttacggtaggttgatagagaaaatcgattttatttcggaaggggttattcgtacggatgatgagcgtatttatcggtattattacgatagttagtatcggttggtgtattatacgcggatataatatgtagagtcgttggtcgaaagtcgttatttttacgattcgttgggtcgtagggtggttaaacgggtatggcggcgtgaacgggatttgacgggttggatgtcgttgttacggaaatcgtaagtgatttggtacggttgggacggcgatcgtttgattacgatatagaacgatagaattcgtatttagacgatttattagtcggggagttttacgttatttattagggttgaaatcgttatcggtgagttggcgaaaacgtagcgtcgtagtttggcggatattttttagtagttcggtggcgaagacggtggtagtgtggtgttttcgtcggtgttggtgtagatgttcgatcggttggaaagtgaaattttggttgatcgggtgagtgaggaaagtcgtcgttggttggtatcgtgcggtttgacggtggcgtagatgtaaagttagatggattcggtatatacgtcggcgcgaaaaatttatttgtattattgcgattatcgcgtttgtcgttggtt

SEQ ID NO: 13880 - DNA, 984 bp, Artificial Sequence
  chemically treated genomic DNA (Homo sapiens) CpG-island No: 13880
aaccaacgacaaacgcgataatcgcaataatacaaataaatttttcgcgccgacgtatataccgaatccatctaactttacatctacgccaccgtcaaaccgcacgataccaaccaacgacgactttcctcactcacccgatcaaccaaaatttcactttccaaccgatcgaacatctacaccaacaccgacgaaaacaccacactaccaccgtcttcgccaccgaactactaaaaaatatccgccaaactacgacgctacgttttcgccaactcaccgataacgatttcaaccctaataaataacgtaaaactccccgactaataaatcgtctaaatacgaattctatcgttctatatcgtaatcaaacgatcgccgtcccaaccgtaccaaatcacttacgatttccgtaacaacgacatccaacccgtcaaatcccgttcacgccgccatacccgtttaaccaccctacgacccaacgaatcgtaaaaataacgactttcgaccaacgactctacatattatatccgcgtataatacaccaaccgatactaactatcgtaataataccgataaatacgctcatcatccgtacgaataaccccttccgaaataaaatcgattttctctatcaacctaccgtaacgatcataccgataaaaataatacgcgtcacgaacgatacgattatccgaccacatactaaaaacgctatccgaatacaactccgaatcgaacaaacgattacctaccgaatctataatatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataccctcacccgtttcc

SEQ ID NO: 13881 - DNA, 903 bp, Artificial Sequence
  chemically treated genomic DNA (Homo sapiens) CpG-island No: 13881
ttggcgtatggtttgtcggacgttttaataaacgtttttttacgttaatgtggtagtcggttatttgttgtttgttggttggtttgttgatgtggattttcgattggttggcgtgatgaatgtttggacgttgttcgttttcgtcgcgttgttttttttcggtgtcgggatgttgttttcgttggcgattagcggcgcgatggagtcgtttttttttttggcgggtacggttggcgcgttggtcggcggtttgtaaaatattggtttcggcgtgttggcgtcgttttttgcgatgttgtcgtaaatcggttagggtagtttggggttgttgatgattttaatgggattgttgatcgtgttgtgttggttgtcgttggcgacgcggatgtcgtattaggggtagttcgtttaagcgtacgttatcgtagtatcgttattagttttatgggagaacgatgttgttttattagattacgtattattcgtatatgcggtgcggagtaagaataaaacgtttgatagttcgtataaagtacgttgtttggcgttttttggtcgagcgtgcgggtatcgggcgatgttagtcgtacgtttggagtatcgcgtcggtggcgggttttcgttttttttttgtagggggttaaaattatcgaaaaggtttcgttttcgttggttaatgagcgtatttttttggcgtggattcgtattgtattaggatttttggcggcgggggttgggtttgattaatttgcgttagatttcgttacgttcgttattcgcgaattgttggcgttgttgttgtgtttgtttttcggcgggttagcgatgtatggttatttgcgttggttacgtaatgaaaaagcgatgcgtttgaaagaggatttgttttatattaatagttta

SEQ ID NO: 13882 - DNA, 903 bp, Artificial Sequence
  chemically treated genomic DNA (Homo sapiens) CpG-island No: 13882
taaactattaatataaaacaaatcctctttcaaacgcatcgctttttcattacgtaaccaacgcaaataaccatacatcgctaacccgccgaaaaacaaacacaacaacaacgccaacaattcgcgaataacgaacgtaacgaaatctaacgcaaattaatcaaacccaacccccgccgccaaaaatcctaatacaatacgaatccacgccaaaaaaatacgctcattaaccaacgaaaacgaaaccttttcgataattttaaccccctacaaaaaaaaaacgaaaacccgccaccgacgcgatactccaaacgtacgactaacatcgcccgatacccgcacgctcgaccaaaaaacgccaaacaacgtactttatacgaactatcaaacgttttattcttactccgcaccgcatatacgaataatacgtaatctaataaaacaacatcgttctcccataaaactaataacgatactacgataacgtacgcttaaacgaactacccctaatacgacatccgcgtcgccaacgacaaccaacacaacacgatcaacaatcccattaaaatcatcaacaaccccaaactaccctaaccgatttacgacaacatcgcaaaaaacgacgccaacacgccgaaaccaatattttacaaaccgccgaccaacgcgccaaccgtacccgccaaaaaaaaaaacgactccatcgcgccgctaatcgccaacgaaaacaacatcccgacaccgaaaaaaaacaacgcgacgaaaacgaacaacgtccaaacattcatcacgccaaccaatcgaaaatccacatcaacaaaccaaccaacaaacaacaaataaccgactaccacattaacgtaaaaaaacgtttattaaaacgtccgacaaaccatacgccaa

SEQ ID NO: 13883 - DNA, 903 bp, Artificial Sequence
  chemically treated genomic DNA (Homo sapiens) CpG-island No: 13883
taagttgttggtgtagggtaggtttttttttagacgtatcgtttttttattgcgtaattagcgtaagtagttatatatcgttaattcgtcggaaaatagatataataataacgttagtagttcgcgaatgacgggcgtggcgaaatttggcgtaagttgattaagtttaattttcgtcgttagaaattttagtgtagtacggatttacgttagaaaagtacgtttattagttagcgagaacgaaattttttcggtgattttgattttttataaaggggggacgaaaattcgttatcggcgcggtgttttaggcgtgcgattggtatcgttcggtgttcgtacgttcggttaggagacgttagatagcgtgttttgtgcgggttattaggcgttttatttttatttcgtatcgtatatgcgggtgatgcgtgatttgataaagtagtatcgtttttttatggagttgatgacgatgttgcggtgacgtgcgtttaaacgggttgtttttgatgcgatattcgcgtcgttagcggtagttagtatagtacgattaataattttattaaggttattaataattttaggttgttttgatcggtttgcggtaatatcgtagagagcgacgttagtacgtcggaattaatgttttgtagatcgtcgattagcgcgttagtcgtgttcgttaggaaggggaacggttttatcgcgtcgttggtcgttagcggaaatagtatttcggtatcgaaaaagaatagcgcggcgggaacgagtagcgtttagatatttattacgttaattagtcggggatttatattagtaagttagttagtaggtagtagataatcgattgttatattaacgtggagaagcgtttattgggacgttcggtaaattatgcgttag

SEQ ID NO: 13884 - DNA, 903 bp, Artificial Sequence
  chemically treated genomic DNA (Homo sapiens) CpG-island No: 13884
ctaacgcataatttaccgaacgtcccaataaacgcttctccacgttaatataacaatcgattatctactacctactaactaacttactaatataaatccccgactaattaacgtaataaatatctaaacgctactcgttcccgccgcgctattctttttcgataccgaaatactatttccgctaacgaccaacgacgcgataaaaccgttccccttcctaacgaacacgactaacgcgctaatcgacgatctacaaaacattaattccgacgtactaacgtcgctctctacgatattaccgcaaaccgatcaaaacaacctaaaattattaataaccttaataaaattattaatcgtactatactaactaccgctaacgacgcgaatatcgcatcaaaaacaacccgtttaaacgcacgtcaccgcaacatcgtcatcaactccataaaaaaacgatactactttatcaaatcacgcatcacccgcatatacgatacgaaataaaaataaaacgcctaataacccgcacaaaacacgctatctaacgtctcctaaccgaacgtacgaacaccgaacgataccaatcgcacgcctaaaacaccgcgccgataacgaattttcgtcccccctttataaaaaatcaaaatcaccgaaaaaatttcgttctcgctaactaataaacgtacttttctaacgtaaatccgtactacactaaaatttctaacgacgaaaattaaacttaatcaacttacgccaaatttcgccacgcccgtcattcgcgaactactaacgttattattatatctattttccgacgaattaacgatatataactacttacgctaattacgcaataaaaaaacgatacgtctaaaaaaaaacctaccctacaccaacaactta

SEQ ID NO: 13885 - DNA, 1078 bp, Artificial Sequence
  chemically treated genomic DNA (Homo sapiens) CpG-island No: 13885
gatggtcgtattaatcggaacgattttcggttgaattagcggtagttggtttagtacggtaacgttacgcgtaatattaatgatgtttaagtagtcggtacggtttggcgttacgttgatttcgatggtgttgttattaagttttaggtatttacggatatcggtgttaatcggcgtattcgtaggtagttcgataatgtcgttgtgatcgttagaaatgtttagtttagagaaggttacgggtgttgcgcgttaaaattagtggattttttcgtagtgggtttacgacgtatagttggacgatttgttgagtgattacgatgtcgtgttttttggcgtcgggatttattagttaatgcgcggcgggttggaaaacgaagacgtcgatggcgtgtacgtagcgttgtcgttttttatcgttaatattaaatagttaatgggttttggtgaaattcgcgacgaatcgttcgttagtatggaaggtaaacgcgtggtggtttttggcggtggcgatattgcgatggattgcgtgcgtacgttcgtgcgttaggagcgaagtacgttatttgtgtttatcgtcgtgatgaagagaatatgtcgggttttcgtcgcgaagtgaaaaacgcgcgggaagaaggcgtagagtttaaatttaacgtttagtcgttgggtattgaagtgaacggtaacggtaaagttagcggcgtaaaaatggtgcgtatcgaaatgggcgaatcggacgttaaaggtcgtcgtcgcgcggagtatcgttgtaggtttcgaatatatcgtttcggtagatgcggtgattatggcgttggttttcgtttataaaatattggaatgggttggtaaaatatagcgtcgagttggatttataagtcgtattatcgtttcggaagtagcgataacgttttttagattagtaattcgaaaatttttgttggcggcgatatcgttcgtggtttcgatttggtggtgatcgttattgtcgaaggtcgtaaggcggtagacggtattatgaattggttggaagtttaagcgaggtaataatgaattcgttagattgtgtttggcg

SEQ ID NO: 13886 - DNA, 1078 bp, Artificial Sequence
  chemically treated genomic DNA (Homo sapiens) CpG-island No: 13886
cgccaaacacaatctaacgaattcattattacctcgcttaaacttccaaccaattcataataccgtctaccgccttacgaccttcgacaataacgatcaccaccaaatcgaaaccacgaacgatatcgccgccaacaaaaattttcgaattactaatctaaaaaacgttatcgctacttccgaaacgataatacgacttataaatccaactcgacgctatattttaccaacccattccaatattttataaacgaaaaccaacgccataatcaccgcatctaccgaaacgatatattcgaaacctacaacgatactccgcgcgacgacgacctttaacgtccgattcgcccatttcgatacgcaccatttttacgccgctaactttaccgttaccgttcacttcaatacccaacgactaaacgttaaatttaaactctacgccttcttcccgcgcgtttttcacttcgcgacgaaaacccgacatattctcttcatcacgacgataaacacaaataacgtacttcgctcctaacgcacgaacgtacgcacgcaatccatcgcaatatcgccaccgccaaaaaccaccacgcgtttaccttccatactaacgaacgattcgtcgcgaatttcaccaaaacccattaactatttaatattaacgataaaaaacgacaacgctacgtacacgccatcgacgtcttcgttttccaacccgccgcgcattaactaataaatcccgacgccaaaaaacacgacatcgtaatcactcaacaaatcgtccaactatacgtcgtaaacccactacgaaaaaatccactaattttaacgcgcaacacccgtaaccttctctaaactaaacatttctaacgatcacaacgacattatcgaactacctacgaatacgccgattaacaccgatatccgtaaatacctaaaacttaataacaacaccatcgaaatcaacgtaacgccaaaccgtaccgactacttaaacatcattaatattacgcgtaacgttaccgtactaaaccaactaccgctaattcaaccgaaaatcgttccgattaatacgaccatc

SEQ ID NO: 13887 - DNA, 1078 bp, Artificial Sequence
  chemically treated genomic DNA (Homo sapiens) CpG-island No: 13887
cgttagatatagtttggcgaatttattgttatttcgtttaaatttttagttagtttataatatcgtttgtcgttttacgattttcggtaatagcggttattattagatcggaattacggacgatatcgtcgttagtaaagattttcgggttgttggtttggaaggcgttgtcgttgttttcggggcgatgatgcggtttgtgaatttagttcgacgttgtgttttgttagtttattttaatgttttgtggacggaaattaacgttatgattatcgtatttgtcggaacgatatgttcggaatttgtaacgatgtttcgcgcggcgacggtttttggcgttcggttcgtttatttcggtacgtattatttttacgtcgttgattttgtcgttatcgtttattttaatatttagcggttggacgttgaatttgaattttacgtttttttttcgcgcgttttttatttcgcggcgggaattcggtatgttttttttattacgacgataggtataggtaacgtgtttcgtttttggcgtacggacgtacgtacgtagtttatcgtagtgtcgttatcgttaaggattattacgcgtttgttttttatgttgacgaacggttcgtcgcgggttttattaaagtttattaattgtttggtgttggcgatgaggaacggtagcgttgcgtatacgttatcggcgttttcgttttttagttcgtcgcgtattgattgataagtttcgacgttaaggaatacggtatcgtaattatttagtagatcgtttagttgtacgtcgtaggtttattgcggggggatttattagttttaacgcgtagtattcgtggttttttttgaattgggtatttttgacgattatagcggtattatcgaattgtttgcggatgcgtcgattggtatcgatattcgtgaatatttgaaatttgatgataatattatcgaaattagcgtgacgttaaatcgtgtcgattgtttaggtattattggtgttgcgcgtgacgttgtcgtgttgaattagttgtcgttggtttaatcggaaatcgtttcggttggtgcgattatt

SEQ ID NO: 13888 - DNA, 1078 bp, Artificial Sequence
  chemically treated genomic DNA (Homo sapiens) CpG-island No: 13888
aataatcgcaccaaccgaaacgatttccgattaaaccaacgacaactaattcaacacgacaacgtcacgcgcaacaccaataatacctaaacaatcgacacgatttaacgtcacgctaatttcgataatattatcatcaaatttcaaatattcacgaatatcgataccaatcgacgcatccgcaaacaattcgataataccgctataatcgtcaaaaatacccaattcaaaaaaaaccacgaatactacgcgttaaaactaataaatccccccgcaataaacctacgacgtacaactaaacgatctactaaataattacgataccgtattccttaacgtcgaaacttatcaatcaatacgcgacgaactaaaaaacgaaaacgccgataacgtatacgcaacgctaccgttcctcatcgccaacaccaaacaattaataaactttaataaaacccgcgacgaaccgttcgtcaacataaaaaacaaacgcgtaataatccttaacgataacgacactacgataaactacgtacgtacgtccgtacgccaaaaacgaaacacgttacctatacctatcgtcgtaataaaaaaaacataccgaattcccgccgcgaaataaaaaacgcgcgaaaaaaaaacgtaaaattcaaattcaacgtccaaccgctaaatattaaaataaacgataacgacaaaatcaacgacgtaaaaataatacgtaccgaaataaacgaaccgaacgccaaaaaccgtcgccgcgcgaaacatcgttacaaattccgaacatatcgttccgacaaatacgataatcataacgttaatttccgtccacaaaacattaaaataaactaacaaaacacaacgtcgaactaaattcacaaaccgcatcatcgccccgaaaacaacgacaacgccttccaaaccaacaacccgaaaatctttactaacgacgatatcgtccgtaattccgatctaataataaccgctattaccgaaaatcgtaaaacgacaaacgatattataaactaactaaaaatttaaacgaaataacaataaattcgccaaactatatctaacg

SEQ ID NO: 13889 - DNA, 707 bp, Artificial Sequence
  chemically treated genomic DNA (Homo sapiens) CpG-island No: 13889
tacgcgttggtttagttcgcgcgtaatggtaaatgttagcgtttcggtaatcgtgtcgcgtcgtttatgttcgattttatcgagtttataaacgtagtcggtatgatgttgtagtcgtcggagttaaaagtgatatttttatttattaggtacgcgtatattggcgtttttttatcgttagtggggttgtaatttagcgttagtaatatcggagaacgttttgaatcgcgttcgattgtgtgtagttttatataattttgtttacgtagattttcgtttttggtgattcgataagttatacgatcgttcgcgacgttgttgattagattaatagtacgttgtgttagttgcgatggttttaatttttttgtcggtgcgttgatggtgttacgtatttagtcgatgattattaggcggttatttagtttttggcgttgggtatcgtttagattcggttatattattttacgcgtgtttttcggggttttgtaattttgttagaatgtttagtagcgattcgtattttagtttttatcgtttaattgaatatgtttgatgtttagatcgttaattttgcgcgtcgtacgttggattagttttagatcgtttgtttcgtttaaatgtagggtaatgtcgttattattaatgttgtaagttgttttttttttttagcgcgcgtcggtaggttgggtagagagggtaatttt

SEQ ID NO: 13890 - DNA, 707 bp, Artificial Sequence
  chemically treated genomic DNA (Homo sapiens) CpG-island No: 13890
aaaattaccctctctacccaacctaccgacgcgcgctaaaaaaaaaaaacaacttacaacattaataataacgacattaccctacatttaaacgaaacaaacgatctaaaactaatccaacgtacgacgcgcaaaattaacgatctaaacatcaaacatattcaattaaacgataaaaactaaaatacgaatcgctactaaacattctaacaaaattacaaaaccccgaaaaacacgcgtaaaataatataaccgaatctaaacgatacccaacgccaaaaactaaataaccgcctaataatcatcgactaaatacgtaacaccatcaacgcaccgacaaaaaaattaaaaccatcgcaactaacacaacgtactattaatctaatcaacaacgtcgcgaacgatcgtataacttatcgaatcaccaaaaacgaaaatctacgtaaacaaaattatataaaactacacacaatcgaacgcgattcaaaacgttctccgatattactaacgctaaattacaaccccactaacgataaaaaaacgccaatatacgcgtacctaataaataaaaatatcacttttaactccgacgactacaacatcataccgactacgtttataaactcgataaaatcgaacataaacgacgcgacacgattaccgaaacgctaacatttaccattacgcgcgaactaaaccaacgcgta

SEQ ID NO: 13891 - DNA, 707 bp, Artificial Sequence
  chemically treated genomic DNA (Homo sapiens) CpG-island No: 13891
aagattattttttttatttaatttgtcgacgcgcgttggggagaaaaagtaatttatagtattaataatgacggtattattttgtatttgaacggggtagacgatttggggttgatttagcgtgcggcgcgtaagattgacggtttgggtattaagtatgtttagttaagcggtgaaggttgggatgcggatcgttgttgggtattttggtaaggttataaagtttcgaaaggtacgcgtaaagtggtgtggtcggatttggacgatgtttagcgttaggaattggataatcgtttgatgattatcgattgggtgcgtgatattattaacgtatcggtagaagaattgggattatcgtaattggtatagcgtgttgttgatttgattagtaacgtcgcgggcgatcgtgtgatttatcggattattaaaggcgaagatttgcgtgagtaaggttatatggggttgtatatagtcggacgcggtttagaacgtttttcggtattgttggcgttggattataattttattggcgataaagaagcgttagtgtacgcgtgtttggtaggtaaaggtattatttttgatttcggcggttatagtattatatcgattgcgtttatggattcgatgaagtcggatatgggcggcgcggtacggttatcggggcgttggtatttgttattacgcgcggattgaattagcgcgtg

SEQ ID NO: 13892 - DNA, 707 bp, Artificial Sequence
  chemically treated genomic DNA (Homo sapiens) CpG-island No: 13892
cacgcgctaattcaatccgcgcgtaataacaaataccaacgccccgataaccgtaccgcgccgcccatatccgacttcatcgaatccataaacgcaatcgatataatactataaccgccgaaatcaaaaataatacctttacctaccaaacacgcgtacactaacgcttctttatcgccaataaaattataatccaacgccaacaataccgaaaaacgttctaaaccgcgtccgactatatacaaccccatataaccttactcacgcaaatcttcgcctttaataatccgataaatcacacgatcgcccgcgacgttactaatcaaatcaacaacacgctataccaattacgataatcccaattcttctaccgatacgttaataatatcacgcacccaatcgataatcatcaaacgattatccaattcctaacgctaaacatcgtccaaatccgaccacaccactttacgcgtacctttcgaaactttataaccttaccaaaatacccaacaacgatccgcatcccaaccttcaccgcttaactaaacatacttaatacccaaaccgtcaatcttacgcgccgcacgctaaatcaaccccaaatcgtctaccccgttcaaatacaaaataataccgtcattattaatactataaattactttttctccccaacgcgcgtcgacaaattaaataaaaaaaataatctt

SEQ ID NO: 13893 - DNA, 656 bp, Artificial Sequence
  chemically treated genomic DNA (Homo sapiens) CpG-island No: 13893
ttagtagaataatttgtataatacgtatttagtcgcgtttagtttgtaggttggtgataaaggtttagttaaagaatgcgatatttagcgtcgattataagcgtaatttttatatattattaattattcgttttagtaggaagatcggtagtgcgaggattataaaattaaacgcggttttgatttgttttatttacgggtcgtttttcggtagtaagcggttattaaagacggtaattagtattagcggtaggtttatgtttaacgtatagagataaagcgtgtcgtcgtttagttatatgttttcgttttgggcgatatatagtagaatcgcgttaagcggtgcggtggtgtatggtgaatagattagttcggtaatcgtttttataataaatatatcgttaggtgagtcgttttgttggcgattgtttattaacgtgagacgtgtttgtagcgaagaggggagttgtagggtaaataagttaaatattgatatcgttagtaaggtaaagacgatggcgaggttaatgagtacgtatgggtgttgtagcgtcgtttggaattgtaattttgcggcggtaattattagatttagcgtcgtgtaggttagcgttattttttgtatataaataaaggttagtaataatgttttggta

SEQ ID NO: 13894 - DNA, 656 bp, Artificial Sequence
  chemically treated genomic DNA (Homo sapiens) CpG-island No: 13894
taccaaaacattattactaacctttatttatatacaaaaaataacgctaacctacacgacgctaaatctaataattaccgccgcaaaattacaattccaaacgacgctacaacacccatacgtactcattaacctcgccatcgtctttaccttactaacgatatcaatatttaacttatttaccctacaactcccctcttcgctacaaacacgtctcacgttaataaacaatcgccaacaaaacgactcacctaacgatatatttattataaaaacgattaccgaactaatctattcaccatacaccaccgcaccgcttaacgcgattctactatatatcgcccaaaacgaaaacatataactaaacgacgacacgctttatctctatacgttaaacataaacctaccgctaatactaattaccgtctttaataaccgcttactaccgaaaaacgacccgtaaataaaacaaatcaaaaccgcgtttaattttataatcctcgcactaccgatcttcctactaaaacgaataattaataatatataaaaattacgcttataatcgacgctaaatatcgcattctttaactaaacctttatcaccaacctacaaactaaacgcgactaaatacgtattatacaaattattctactaa

SEQ ID NO: 13895 - DNA, 656 bp, Artificial Sequence
  chemically treated genomic DNA (Homo sapiens) CpG-island No: 13895
tgttagagtattgttgttgatttttatttatgtgtaggggatggcgttgatttatacggcgttgggtttggtggttgtcgtcgtagggttatagttttaggcggcgttatagtatttatacgtgtttattggtttcgttatcgtttttattttgttggcgatgttaatgtttggtttgtttattttgtaattttttttttcgttgtaaatacgttttacgttgatgagtaatcgttaatagggcggtttatttggcggtgtgtttgttatgggggcgattgtcggattgatttgtttattatgtattatcgtatcgtttagcgcgattttgttgtatatcgtttaaagcgggaatatgtggttgggcggcggtacgttttatttttatgcgttgggtatgggtttgtcgttgatgttaattatcgtttttggtaatcgtttgttgtcgaaaagcggttcgtggatggaataagttaaaatcgcgtttggttttgtgattttcgtattgtcggtttttttgttggagcgagtgattggtgatgtatggggattacgtttgtggtcggcgttgggtgtcgtattttttggttgggtttttattattagtttataggttaaacgcggttggatgcgtattgtgtaaattattttgttgg

SEQ ID NO: 13896 - DNA, 656 bp, Artificial Sequence
  chemically treated genomic DNA (Homo sapiens) CpG-island No: 13896
ccaacaaaataatttacacaatacgcatccaaccgcgtttaacctataaactaataataaaaacccaaccaaaaaatacgacacccaacgccgaccacaaacgtaatccccatacatcaccaatcactcgctccaacaaaaaaaccgacaatacgaaaatcacaaaaccaaacgcgattttaacttattccatccacgaaccgcttttcgacaacaaacgattaccaaaaacgataattaacatcaacgacaaacccatacccaacgcataaaaataaaacgtaccgccgcccaaccacatattcccgctttaaacgatatacaacaaaatcgcgctaaacgatacgataatacataataaacaaatcaatccgacaatcgcccccataacaaacacaccgccaaataaaccgccctattaacgattactcatcaacgtaaaacgtatttacaacgaaaaaaaaaattacaaaataaacaaaccaaacattaacatcgccaacaaaataaaaacgataacgaaaccaataaacacgtataaatactataacgccgcctaaaactataaccctacgacgacaaccaccaaacccaacgccgtataaatcaacgccatcccctacacataaataaaaatcaacaacaatactctaaca

SEQ ID NO: 13897 - DNA, 715 bp, Artificial Sequence
  chemically treated genomic DNA (Homo sapiens) CpG-island No: 13897
gacgcgagattcgcgttcgtcgtcgttcgtttaggcggcgatgatacggcgttcgcggcggttcggaggcgtcgggtgggtcgtttgttgatcggatcgcggttattcgttagcgtgttcgcggcgtcgtcgttagtatgggttgtgtttcgagtatttatattttcgagcgtttggtggtcgaggacgcgtttagtttcgcggtatcgtcgttgtcgttcggcggtcgcgtttttcgtagggttagaagacggtcgttttgtttcggattcgcggcgtcggttttttggagtcggagtttcgcgacggtagcggtaagaaggtaaggggcgtcgggtattttggggtcgtcgcgaaattcgggttcggttagtaagtaattttttcgcgagtcgggcggggttttttttattcggttcggtgtttttttgtttcgttttggatggttttgattgacgttagtttttcgttttgtcggggtagcgtttagagaaggatcgatttagtttcgcgattttgattttttagggttgcgattaggacgtcgtttgtgtcgcggcgtcggttttttggatatattcgattttcggagcggcggggttcgatgtgaagttgattgaggcgtttgtattaattttttttttaagagcgggtgtttgagggaaattttaggatattttggcgcgtttttgtaatgttaaattagtgtgaattt

SEQ ID NO: 13898 - DNA, 715 bp, Artificial Sequence
  chemically treated genomic DNA (Homo sapiens) CpG-island No: 13898
aaattcacactaatttaacattacaaaaacgcgccaaaatatcctaaaatttccctcaaacacccgctcttaaaaaaaaaattaatacaaacgcctcaatcaacttcacatcgaaccccgccgctccgaaaatcgaatatatccaaaaaaccgacgccgcgacacaaacgacgtcctaatcgcaaccctaaaaaatcaaaatcgcgaaactaaatcgatccttctctaaacgctaccccgacaaaacgaaaaactaacgtcaatcaaaaccatccaaaacgaaacaaaaaaacaccgaaccgaataaaaaaaaccccgcccgactcgcgaaaaaattacttactaaccgaacccgaatttcgcgacgaccccaaaatacccgacgccccttaccttcttaccgctaccgtcgcgaaactccgactccaaaaaaccgacgccgcgaatccgaaacaaaacgaccgtcttctaaccctacgaaaaacgcgaccgccgaacgacaacgacgataccgcgaaactaaacgcgtcctcgaccaccaaacgctcgaaaatataaatactcgaaacacaacccatactaacgacgacgccgcgaacacgctaacgaataaccgcgatccgatcaacaaacgacccacccgacgcctccgaaccgccgcgaacgccgtatcatcgccgcctaaacgaacgacgacgaacgcgaatctcgcgtc

SEQ ID NO: 13899 - DNA, 715 bp, Artificial Sequence
  chemically treated genomic DNA (Homo sapiens) CpG-island No: 13899
aagtttatattgatttaatattgtaggggcgcgttagaatattttggggttttttttaaatattcgtttttggagaggaaattgatgtaagcgttttagttaattttatatcgggtttcgtcgtttcgggagtcggatgtgtttaaaaaatcgacgtcgcgatataggcggcgttttaatcgtaattttaggaaattagggtcgcgggattgggtcggtttttttttgaacgttgtttcggtaaggcgggagattggcgttaattagaattatttaaagcgggataagagggtatcgagtcgggtgggggggatttcgttcggttcgcgggaaagttgtttattggtcgggttcgagtttcgcggcggttttagagtgttcggcgttttttatttttttgtcgttgtcgtcgcgaagtttcgattttaagaggtcggcgtcgcgggttcggggtaaggcggtcgttttttggttttgcgggaggcgcggtcgtcggacgatagcggcggtgtcgcggggttaggcgcgttttcggttattaggcgttcggaaatgtggatgttcggggtatagtttatgttggcggcggcgtcgcggatacgttggcgggtagtcgcgattcggttagtaaacggtttattcggcgttttcgggtcgtcgcgggcgtcgtgttatcgtcgtttgggcgggcggcggcgagcgcggatttcgcgtt

SEQ ID NO: 13900 - DNA, 715 bp, Artificial Sequence
  chemically treated genomic DNA (Homo sapiens) CpG-island No: 13900
aacgcgaaatccgcgctcgccgccgcccgcccaaacgacgataacacgacgcccgcgacgacccgaaaacgccgaataaaccgtttactaaccgaatcgcgactacccgccaacgtatccgcgacgccgccgccaacataaactataccccgaacatccacatttccgaacgcctaataaccgaaaacgcgcctaaccccgcgacaccgccgctatcgtccgacgaccgcgcctcccgcaaaaccaaaaaacgaccgccttaccccgaacccgcgacgccgacctcttaaaatcgaaacttcgcgacgacaacgacaaaaaaataaaaaacgccgaacactctaaaaccgccgcgaaactcgaacccgaccaataaacaactttcccgcgaaccgaacgaaatcccccccacccgactcgataccctcttatcccgctttaaataattctaattaacgccaatctcccgccttaccgaaacaacgttcaaaaaaaaaccgacccaatcccgcgaccctaatttcctaaaattacgattaaaacgccgcctatatcgcgacgtcgattttttaaacacatccgactcccgaaacgacgaaacccgatataaaattaactaaaacgcttacatcaatttcctctccaaaaacgaatatttaaaaaaaaccccaaaatattctaacgcgcccctacaatattaaatcaatataaactt

SEQ ID NO: 13901 - DNA, 1025 bp, Artificial Sequence
  chemically treated genomic DNA (Homo sapiens) CpG-island No: 13901
aggatttaacgatattatcggattttttgggaaaagaggggagacgtcgtgatttaggtttcgttttattttgtcgtttcgtgttcggcgttaagatttagcgggcgcgtcgttcgttcggggttcggttttgttttttttcgttcgcggggtagttagtttagtttcggagagtcggcggcgcggcgggtatggttcgggtggcgtgggggttgttgtggttgttgttgggtagcgtcggggcgtagtacgagaagtatagttttcggggtttttcgttcgaggatttgatgtcgttggtcgcggcgtacgggtacgttttggagtagtacgagggagagagttggcgcgagagcgcgcgttatttggaggcggcgttgcggttgtatcggtttttgcgcgatagcgaggttttttgttacgttaattgtagcggtttcgcgttcgcggttaagttcgatttcgacggcggtcgcgtagacgagtgggtttgcgagttgcggtttttcggtcgcgttttggagcgagtcgtttgtttgcggcgttgtaagcggacgttgttcgttttttaggtgttttattcgtcgcggtagttgttgcgtgatttttagagtcgtttgttttattagtatttgtattacgcgttgtttaaggtgggagttcgtttttattcggggatttgtttcgggttgggcgtcgtggttttttatagatcggtcgaaggagcgttatttttatttaaggtacgaagttcgtcgtgcgttcggggtcgtttagtttcggttttgttgattcgtttttttattttttatttttcgattaggttaatcggttggagaaggcggtggcggcggttttatatttttttttagaggaattcgaagtacgagttgatcgttaagtattttaattattattaggggatgttggacgtcgtcgacgagttttttacggatttagaggtttagttttacgaggtggggtggagggttaggaggaggtttgtagaggagggttagtagagg

SEQ ID NO: 13902 - DNA, 1025 bp, Artificial Sequence
  chemically treated genomic DNA (Homo sapiens) CpG-island No: 13902
cctctactaaccctcctctacaaacctcctcctaaccctccaccccacctcgtaaaactaaacctctaaatccgtaaaaaactcgtcgacgacgtccaacatcccctaataataattaaaatacttaacgatcaactcgtacttcgaattcctctaaaaaaaaatataaaaccgccgccaccgccttctccaaccgattaacctaatcgaaaaataaaaaataaaaaaacgaatcaacaaaaccgaaactaaacgaccccgaacgcacgacgaacttcgtaccttaaataaaaataacgctccttcgaccgatctataaaaaaccacgacgcccaacccgaaacaaatccccgaataaaaacgaactcccaccttaaacaacgcgtaatacaaatactaataaaacaaacgactctaaaaatcacgcaacaactaccgcgacgaataaaacacctaaaaaacgaacaacgtccgcttacaacgccgcaaacaaacgactcgctccaaaacgcgaccgaaaaaccgcaactcgcaaacccactcgtctacgcgaccgccgtcgaaatcgaacttaaccgcgaacgcgaaaccgctacaattaacgtaacaaaaaacctcgctatcgcgcaaaaaccgatacaaccgcaacgccgcctccaaataacgcgcgctctcgcgccaactctctccctcgtactactccaaaacgtacccgtacgccgcgaccaacgacatcaaatcctcgaacgaaaaaccccgaaaactatacttctcgtactacgccccgacgctacccaacaacaaccacaacaacccccacgccacccgaaccatacccgccgcgccgccgactctccgaaactaaactaactaccccgcgaacgaaaaaaaacaaaaccgaaccccgaacgaacgacgcgcccgctaaatcttaacgccgaacacgaaacgacaaaataaaacgaaacctaaatcacgacgtctcccctcttttcccaaaaaatccgataatatcgttaaatcct

SEQ ID NO: 13903 - DNA, 1025 bp, Artificial Sequence
  chemically treated genomic DNA (Homo sapiens) CpG-island No: 13903
tttttattagtttttttttataagtttttttttgattttttattttatttcgtagggttgggtttttaggttcgtgagggattcgtcggcgacgtttagtattttttgatagtagttgagatatttggcggttagttcgtgtttcgggtttttttggaggaaggtgtgaggtcgtcgttatcgttttttttagtcggttagtttggtcggggggtagggggtgggggagcgggttagtaagatcggagttgggcggtttcgagcgtacggcgggtttcgtgttttgggtgaagataacgttttttcgatcgatttgtggggagttacgacgtttagttcgagataggttttcgggtgggggcgggtttttattttgagtagcgcgtagtgtaggtattggtagggtaggcggttttggaagttacgtagtagttgtcgcggcgggtagggtatttggaaggcgggtagcgttcgtttgtagcgtcgtaggtaggcggttcgttttaggacgcggtcgaagagtcgtagttcgtaggtttattcgtttgcgcggtcgtcgtcgggatcgggtttggtcgcgggcgcggggtcgttgtagttggcgtggtagaaggtttcgttgtcgcgtaggagtcggtgtagtcgtagcgtcgtttttaggtagcgcgcgttttcgcgttagttttttttttcgtattgttttagagcgtgttcgtacgtcgcggttagcggtattaggttttcgggcgggaagtttcggaagttgtatttttcgtattgcgtttcggcgttgtttagtagtaattatagtagtttttacgttattcgagttatgttcgtcgcgtcgtcggtttttcggagttgagttggttgtttcgcggacggaaggggatagggtcgggtttcgggcgggcggcgcgttcgttgggttttagcgtcgggtacgaggcggtaaggtggggcggggtttgggttacgacgttttttttttttttttagagggttcgatagtgtcgttaagtttt

SEQ ID NO: 13904 - DNA, 1025 bp, Artificial Sequence
  chemically treated genomic DNA (Homo sapiens) CpG-island No: 13904
aaaacttaacgacactatcgaaccctctaaaaaaaaaaaaaaaacgtcgtaacccaaaccccgccccaccttaccgcctcgtacccgacgctaaaacccaacgaacgcgccgcccgcccgaaacccgaccctatccccttccgtccgcgaaacaaccaactcaactccgaaaaaccgacgacgcgacgaacataactcgaataacgtaaaaactactataattactactaaacaacgccgaaacgcaatacgaaaaatacaacttccgaaacttcccgcccgaaaacctaataccgctaaccgcgacgtacgaacacgctctaaaacaatacgaaaaaaaaaactaacgcgaaaacgcgcgctacctaaaaacgacgctacgactacaccgactcctacgcgacaacgaaaccttctaccacgccaactacaacgaccccgcgcccgcgaccaaacccgatcccgacgacgaccgcgcaaacgaataaacctacgaactacgactcttcgaccgcgtcctaaaacgaaccgcctacctacgacgctacaaacgaacgctacccgccttccaaataccctacccgccgcgacaactactacgtaacttccaaaaccgcctaccctaccaatacctacactacgcgctactcaaaataaaaacccgcccccacccgaaaacctatctcgaactaaacgtcgtaactccccacaaatcgatcgaaaaaacgttatcttcacccaaaacacgaaacccgccgtacgctcgaaaccgcccaactccgatcttactaacccgctcccccaccccctaccccccgaccaaactaaccgactaaaaaaaacgataacgacgacctcacaccttcctccaaaaaaacccgaaacacgaactaaccgccaaatatctcaactactatcaaaaaatactaaacgtcgccgacgaatccctcacgaacctaaaaacccaaccctacgaaataaaataaaaaatcaaaaaaaaacttataaaaaaaaactaataaaaa

SEQ ID NO: 13905 - DNA, 868 bp, Artificial Sequence
  chemically treated genomic DNA (Homo sapiens) CpG-island No: 13905
  misc_feature (73)..(73): n is either a, c, g or t
tggaggcgaggcggcgttgttggaggcgaggcggcgttgttggaggcgaggcggcgtatgtgcggtcggcggncgatttggtttcgtttcgcgcgtattatttaattttagaatttttttgtgtcgtattaatagtcgtatcgtttcgaggttgtggaggtcgggcgtagcggcgttaagatggcggttgcggtagtggcggcggcggcggcggcggtcgcggttgtatttttttaggtattggaaatggagagtatggagacgggtcgtcgtcggttcggtaggattggtcgtcgaggttcgaggtagcggtacggtggatttcgggtttgggtcggggatttttgtaatggaggcgagcgggggcgattcgggtttagaagtcgaggatttcgagtgtagtttttattgtttagagttgttttggcggtagaacgagtagcggcgttagggttttttttgcgatattattttgtgtttcggcggggttggaggtcgcgagtttcgggtttatcgttcggtattggttgtcgttatcgagtattttacgtttttgttttcgggttagtttttcgagtttcgttcgggacgggtggagatgcgtaagtggagtttcgagtcggggttcgaattcgatatagtggaagtcgtaatcgagtatatgtatatcgggcgtattcgcgttagtacgggtagcgtgtacgaggtgttggagttggtcgataggtaggcgagggaggcgggagcgcggagggcggcgggcgcggagagggggagatgttcgttggcggaggggagggtagtgtttgttacggtagttcgcgagttttgagtgaatgtattggttttatattcgttgagcgtttgt

SEQ ID NO: 13906 - DNA, 868 bp, Artificial Sequence
  chemically treated genomic DNA (Homo sapiens) CpG-island No: 13906
  misc_feature (796)..(796): n is either a, c, g or t
acaaacgctcaacgaatataaaaccaatacattcactcaaaactcgcgaactaccgtaacaaacactaccctcccctccgccaacgaacatctccccctctccgcgcccgccgccctccgcgctcccgcctccctcgcctacctatcgaccaactccaacacctcgtacacgctacccgtactaacgcgaatacgcccgatatacatatactcgattacgacttccactatatcgaattcgaaccccgactcgaaactccacttacgcatctccacccgtcccgaacgaaactcgaaaaactaacccgaaaacaaaaacgtaaaatactcgataacgacaaccaataccgaacgataaacccgaaactcgcgacctccaaccccgccgaaacacaaaataatatcgcaaaaaaaaccctaacgccgctactcgttctaccgccaaaacaactctaaacaataaaaactacactcgaaatcctcgacttctaaacccgaatcgcccccgctcgcctccattacaaaaatccccgacccaaacccgaaatccaccgtaccgctacctcgaacctcgacgaccaatcctaccgaaccgacgacgacccgtctccatactctccatttccaatacctaaaaaaatacaaccgcgaccgccgccgccgccgccgccactaccgcaaccgccatcttaacgccgctacgcccgacctccacaacctcgaaacgatacgactattaatacgacacaaaaaaattctaaaattaaataatacgcgcgaaacgaaaccaaatcgnccgccgaccgcacatacgccgcctcgcctccaacaacgccgcctcgcctccaacaacgccgcctcgcctcca

SEQ ID NO: 13907 - DNA, 868 bp, Artificial Sequence
  chemically treated genomic DNA (Homo sapiens) CpG-island No: 13907
  misc_feature (796)..(796): n is either a, c, g or t
gtaggcgtttagcgagtgtgaaattaatgtatttatttaggattcgcgagttgtcgtggtaggtattgttttttttttcgttagcgagtattttttttttttcgcgttcgtcgtttttcgcgttttcgtttttttcgtttatttgtcggttaattttagtatttcgtgtacgttgttcgtgttgacgcggatgcgttcggtgtatatgtattcgattacggtttttattgtgtcgggttcgggtttcggttcggagttttatttgcgtatttttattcgtttcgagcgggattcggaaaattggttcgagagtaggggcgtgaagtattcggtggcggtagttagtatcgagcggtgggttcggaattcgcggtttttagtttcgtcgaagtatagggtaatgtcgtagaagaggttttggcgtcgttgttcgttttgtcgttaggatagttttgagtagtgagagttgtattcgaaattttcggtttttgggttcggatcgttttcgttcgtttttattgtagagattttcggtttaggttcgaagtttatcgtgtcgttgtttcggatttcggcggttagttttgtcgagtcggcggcggttcgtttttatgttttttatttttagtatttgaagagatgtagtcgcggtcgtcgtcgtcgtcgtcgttattgtcgtagtcgttattttgacgtcgttgcgttcggtttttatagtttcggaacgatgcggttgttggtacgatatagagggattttgggattaaatagtgcgcgcggggcggggttaggtcgntcgtcggtcgtatatgcgtcgtttcgtttttagtagcgtcgtttcgtttttagtagcgtcgtttcgttttta

SEQ ID NO: 13908 - DNA, 868 bp, Artificial Sequence
  chemically treated genomic DNA (Homo sapiens) CpG-island No: 13908
  misc_feature (73)..(73): n is either a, c, g or t
taaaaacgaaacgacgctactaaaaacgaaacgacgctactaaaaacgaaacgacgcatatacgaccgacgancgacctaaccccgccccgcgcgcactatttaatcccaaaatccctctatatcgtaccaacaaccgcatcgttccgaaactataaaaaccgaacgcaacgacgtcaaaataacgactacgacaataacgacgacgacgacgacgaccgcgactacatctcttcaaatactaaaaataaaaaacataaaaacgaaccgccgccgactcgacaaaactaaccgccgaaatccgaaacaacgacacgataaacttcgaacctaaaccgaaaatctctacaataaaaacgaacgaaaacgatccgaacccaaaaaccgaaaatttcgaatacaactctcactactcaaaactatcctaacgacaaaacgaacaacgacgccaaaacctcttctacgacattaccctatacttcgacgaaactaaaaaccgcgaattccgaacccaccgctcgatactaactaccgccaccgaatacttcacgcccctactctcgaaccaattttccgaatcccgctcgaaacgaataaaaatacgcaaataaaactccgaaccgaaacccgaacccgacacaataaaaaccgtaatcgaatacatatacaccgaacgcatccgcgtcaacacgaacaacgtacacgaaatactaaaattaaccgacaaataaacgaaaaaaacgaaaacgcgaaaaacgacgaacgcgaaaaaaaaaaaatactcgctaacgaaaaaaaaaacaatacctaccacgacaactcgcgaatcctaaataaatacattaatttcacactcgctaaacgcctac

SEQ ID NO: 13909 - DNA, 611 bp, Artificial Sequence
  chemically treated genomic DNA (Homo sapiens) CpG-island No: 13909
ttattcggatcgcggttattttcgggatcgttcgattttcggttttattttcgtttcgttttcggttttattaattttcgttcgggttttaggcgggaggcgacgtttgcgtagtgcggtcgcggggttgtcgttgtttcgcgagtcgtcgattaggtttcgaacgggatggtagaggaggtgaggagggaggaagcgttcggagtggggcgggttcggatttcgattttcggggcgtttcgagttttttagttggttatcgaggtatcgtcgttttatttaggttagtagtcgttttttcgcgtatttcggtttcgttttatacgcgcgttcgagcgagtttcgggtttttttcgggtttagcgtggcgtaggggttagtggttttttcgggtttcgggataggtgagtattttgatgaaggttacggttttgatgcggtagtttgggcgggtgtaggagatcgtgggcgtttttcgtaagggcggcggagatcgattataggtatttttcgggcgtacggtgttcggtcgggttgggggcggttggagaggttttttgtttattgggttttttcgttttgttttgtcgcggattttttttagttttttg

SEQ ID NO: 13910 - DNA, 611 bp, Artificial Sequence
  chemically treated genomic DNA (Homo sapiens) CpG-island No: 13910
caaaaaactaaaaaaaatccgcgacaaaacaaaacgaaaaaacccaataaacaaaaaacctctccaaccgcccccaacccgaccgaacaccgtacgcccgaaaaatacctataatcgatctccgccgcccttacgaaaaacgcccacgatctcctacacccgcccaaactaccgcatcaaaaccgtaaccttcatcaaaatactcacctatcccgaaacccgaaaaaaccactaacccctacgccacgctaaacccgaaaaaaacccgaaactcgctcgaacgcgcgtataaaacgaaaccgaaatacgcgaaaaaacgactactaacctaaataaaacgacgatacctcgataaccaactaaaaaactcgaaacgccccgaaaatcgaaatccgaacccgccccactccgaacgcttcctccctcctcacctcctctaccatcccgttcgaaacctaatcgacgactcgcgaaacaacgacaaccccgcgaccgcactacgcaaacgtcgcctcccgcctaaaacccgaacgaaaattaataaaaccgaaaacgaaacgaaaataaaaccgaaaatcgaacgatcccgaaaataaccgcgatccgaataa

SEQ ID NO: 13911 - DNA, 611 bp, Artificial Sequence
  chemically treated genomic DNA (Homo sapiens) CpG-island No: 13911
tagagagttaggaggggttcgcggtagagtaaagcgggaaggtttaatgggtaggaagtttttttagtcgtttttagttcggtcggatatcgtacgttcgagaggtatttgtaatcggttttcgtcgtttttgcggagggcgtttacgattttttgtattcgtttaggttgtcgtattaggatcgtggtttttattagggtgtttatttgtttcgagattcgagagaattattgatttttgcgttacgttgggttcgaggggagttcggggttcgttcgggcgcgcgtgtgaggcggggtcggggtgcgcgagggggcggttattggtttgggtgaagcggcggtgtttcggtgattagttggggggttcgaagcgtttcgggggtcggagttcgggttcgttttatttcggacgttttttttttttttattttttttgttatttcgttcgaggtttggtcggcggttcgcgggataacgatagtttcgcgatcgtattgcgtaggcgtcgtttttcgtttggagttcgggcgggggttggtggggtcgggggcggggcgggggtggggtcgagaatcgagcggtttcggagatggtcgcgattcgggtgg

SEQ ID NO: 13912 - DNA, 611 bp, Artificial Sequence
  chemically treated genomic DNA (Homo sapiens) CpG-island No: 13912
ccacccgaatcgcgaccatctccgaaaccgctcgattctcgaccccacccccgccccgcccccgaccccaccaacccccgcccgaactccaaacgaaaaacgacgcctacgcaatacgatcgcgaaactatcgttatcccgcgaaccgccgaccaaacctcgaacgaaataacaaaaaaaataaaaaaaaaaaaaacgtccgaaataaaacgaacccgaactccgacccccgaaacgcttcgaaccccccaactaatcaccgaaacaccgccgcttcacccaaaccaataaccgccccctcgcgcaccccgaccccgcctcacacgcgcgcccgaacgaaccccgaactcccctcgaacccaacgtaacgcaaaaatcaataattctctcgaatctcgaaacaaataaacaccctaataaaaaccacgatcctaatacgacaacctaaacgaatacaaaaaatcgtaaacgccctccgcaaaaacgacgaaaaccgattacaaatacctctcgaacgtacgatatccgaccgaactaaaaacgactaaaaaaacttcctacccattaaaccttcccgctttactctaccgcgaacccctcctaactctcta

SEQ ID NO: 13913 - DNA, 614 bp, Artificial Sequence
  chemically treated genomic DNA (Homo sapiens) CpG-island No: 13913
  misc_feature (590)..(590): n is either a, c, g or t
tttttcgttagtttagggcgagagttagggacgcggcgtcgggcgagttgcgcgggtttcgggggaggcgcgatttcggaggtatttgttcggattttttttcgttttgtttagatttttggttcgcggagtttcgaggcgcgttcggttcgaatcgcgcgatttttaagtcgtcgcgtttaggattttagcgcgttttttgtcgtcggtgtagggtggcgttcgatggtatcggtttttatttgtttagggacggttgggatcggtttcgcggtcgttcgttatttttttgtttttaacgatatttgcgttttcgatagttcgtatttgagtatggggtttgatcgggtcgggtcggggtcgggtcggggtgggagtcggcgcggatagcgaattgagttcggcgtggtcgggcggcggttgtttcggattttggttaaggtagtaatttagtaatcgaataaaaggcgaagagatttgatagttaagttacgtttttcgttatttcgaagtttcgttttgggggagacgtttatttttggtgcgagtttattggttatttcgtttgatttttcgtggagggggatttnttagagtcgaatcgtaggttgagt

SEQ ID NO: 13914 - DNA, 614 bp, Artificial Sequence
  chemically treated genomic DNA (Homo sapiens) CpG-island No: 13914
  misc_feature (25)..(25): n is either a, c, g or t
actcaacctacgattcgactctaanaaatccccctccacgaaaaatcaaacgaaataaccaataaactcgcaccaaaaataaacgtctcccccaaaacgaaacttcgaaataacgaaaaacgtaacttaactatcaaatctcttcgccttttattcgattactaaattactaccttaaccaaaatccgaaacaaccgccgcccgaccacgccgaactcaattcgctatccgcgccgactcccaccccgacccgaccccgacccgacccgatcaaaccccatactcaaatacgaactatcgaaaacgcaaatatcgttaaaaacaaaaaaataacgaacgaccgcgaaaccgatcccaaccgtccctaaacaaataaaaaccgataccatcgaacgccaccctacaccgacgacaaaaaacgcgctaaaatcctaaacgcgacgacttaaaaatcgcgcgattcgaaccgaacgcgcctcgaaactccgcgaaccaaaaatctaaacaaaacgaaaaaaaatccgaacaaatacctccgaaatcgcgcctcccccgaaacccgcgcaactcgcccgacgccgcgtccctaactctcgccctaaactaacgaaaaa

SEQ ID NO: 13915 - DNA, 614 bp, Artificial Sequence
  chemically treated genomic DNA (Homo sapiens) CpG-island No: 13915
  misc_feature (25)..(25): n is either a, c, g or t
gtttagtttgcggttcgattttagnggatttttttttacgggaagttaggcgagatagttagtgagttcgtattagaggtgggcgttttttttagggcggagtttcgaggtggcgaggggcgtggtttggttgttaggttttttcgttttttgttcggttattgagttgttgttttggttagagttcggagtagtcgtcgttcgattacgtcgagtttagttcgttgttcgcgtcggtttttatttcggttcgatttcgattcggttcggttaggttttatatttaggtgcgggttatcgggggcgtaggtatcgttggggatagaggggtggcgagcggtcgcggggtcggttttagtcgtttttgggtaggtgagggtcggtgttatcgagcgttattttgtatcggcggtagggggcgcgttggggttttgggcgcggcgatttgggggtcgcgcggttcggatcgagcgcgtttcggagtttcgcgaattagagatttgagtaaggcggggagggattcggataggtgttttcggggtcgcgtttttttcggggttcgcgtagttcgttcgacgtcgcgtttttgattttcgttttgggttggcggggga

SEQ ID NO: 13916 - DNA, 614 bp, Artificial Sequence
  chemically treated genomic DNA (Homo sapiens) CpG-island No: 13916
  misc_feature (590)..(590): n is either a, c, g or t
tcccccgccaacccaaaacgaaaatcaaaaacgcgacgtcgaacgaactacgcgaaccccgaaaaaaacgcgaccccgaaaacacctatccgaatccctccccgccttactcaaatctctaattcgcgaaactccgaaacgcgctcgatccgaaccgcgcgacccccaaatcgccgcgcccaaaaccccaacgcgccccctaccgccgatacaaaataacgctcgataacaccgaccctcacctacccaaaaacgactaaaaccgaccccgcgaccgctcgccacccctctatccccaacgatacctacgcccccgataacccgcacctaaatataaaacctaaccgaaccgaatcgaaatcgaaccgaaataaaaaccgacgcgaacaacgaactaaactcgacgtaatcgaacgacgactactccgaactctaaccaaaacaacaactcaataaccgaacaaaaaacgaaaaaacctaacaaccaaaccacgcccctcgccacctcgaaactccgccctaaaaaaaacgcccacctctaatacgaactcactaactatctcgcctaacttcccgtaaaaaaaaatccnctaaaatcgaaccgcaaactaaac

SEQ ID NO: 13917 - DNA, 583 bp, Artificial Sequence
  chemically treated genomic DNA (Homo sapiens) CpG-island No: 13917
  misc_feature (553)..(553): n is either a, c, g or t
gggcgattttttgttttcgaattatcgttcggcgcgatcgcgtttcgttcgtcgtatcgttaagttattacgttttttttttttcggtcgcgaagataaaggtatgaggtcgcggttcgtacgcggtatatttatttttttttttttgtattcgtttattttcgttaatatttattcgttttcgtttttttttttttgattattattttttttttttttattatttgagtttttttttatattatttttttacgtttttttttttaagcgtcgtttatcgtattttttttatttagttattcggcgtcgttttatataagacgtttttttttttcgacgttacgttattttttgtcgtatttttttttattatttcgtacgagtattaattttttatatacgtatttcgtacgtcgttttttattacgcgtttttatcgattcgaatttattttaaatttttatttataatttttttttatatacgtattgggtttttaattattgatttcgataattttcgtttattttattcgaacgcgcggtttattttngttttattcgattcgttttttcgtgtttta

SEQ ID NO: 13918 - DNA, 583 bp, Artificial Sequence
  chemically treated genomic DNA (Homo sapiens) CpG-island No: 13918
  misc_feature (31)..(31): n is either a, c, g or t
taaaacacgaaaaaacgaatcgaataaaacnaaaataaaccgcgcgttcgaataaaataaacgaaaattatcgaaatcaataattaaaaacccaatacgtatataaaaaaaaattataaataaaaatttaaaataaattcgaatcgataaaaacgcgtaataaaaaacgacgtacgaaatacgtatataaaaaattaatactcgtacgaaataataaaaaaaaatacgacaaaaaataacgtaacgtcgaaaaaaaaaaacgtcttatataaaacgacgccgaataactaaataaaaaaaatacgataaacgacgcttaaaaaaaaaaacgtaaaaaaataatataaaaaaaaactcaaataataaaaaaaaaaaaaataataatcaaaaaaaaaaaaacgaaaacgaataaatattaacgaaaataaacgaatacaaaaaaaaaaaaataaatataccgcgtacgaaccgcgacctcatacctttatcttcgcgaccgaaaaaaaaaaaacgtaataacttaacgatacgacgaacgaaacgcgatcgcgccgaacgataattcgaaaacaaaaaatcgccc

SEQ ID NO: 13919 - DNA, 583 bp, Artificial Sequence
  chemically treated genomic DNA (Homo sapiens) CpG-island No: 13919
  misc_feature (31)..(31): n is either a, c, g or t
taaggtacggaggagcggatcgggtggggtnaaggtaggtcgcgcgttcgaatagaatgggcgggggttatcggagttagtagttggagatttagtacgtgtgtgggaaggagttatagatggagatttggaatgggttcggatcggtggaggcgcgtgatggggagcggcgtgcggggtgcgtatgtggaaggttggtattcgtgcggagtagtgaaaaagagtgcggtagggggtgacgtgacgtcggaggggggagacgttttgtgtggggcgacgtcggataattaggtggggagggtgcggtgggcggcgtttgagagggaaaacgtgaaaagatagtgtgggggggggtttaggtaatgggggggaggggagtgatagttaggggaggggaggcgggggcgaataaatgttagcgagagtaggcgggtataggggggaagaggtagatgtgtcgcgtacgagtcgcgattttatgtttttgttttcgcggtcggggggggggaagcgtgatgatttggcgatgcggcggacggggcgcggtcgcgtcgggcggtagttcgggggtagggggtcgttt

SEQ ID NO: 13920 - DNA, 583 bp, Artificial Sequence
  chemically treated genomic DNA (Homo sapiens) CpG-island No: 13920
  misc_feature (553)..(553): n is either a, c, g or t
aaacgaccccctacccccgaactaccgcccgacgcgaccgcgccccgtccgccgcatcgccaaatcatcacgcttccccccccccgaccgcgaaaacaaaaacataaaatcgcgactcgtacgcgacacatctacctcttcccccctatacccgcctactctcgctaacatttattcgcccccgcctcccctcccctaactatcactcccctcccccccattacctaaacccccccccacactatcttttcacgttttccctctcaaacgccgcccaccgcaccctccccacctaattatccgacgtcgccccacacaaaacgtctcccccctccgacgtcacgtcaccccctaccgcactctttttcactactccgcacgaataccaaccttccacatacgcaccccgcacgccgctccccatcacgcgcctccaccgatccgaacccattccaaatctccatctataactccttcccacacacgtactaaatctccaactactaactccgataacccccgcccattctattcgaacgcgcgacctaccttnaccccacccgatccgctcctccgtacctta

SEQ ID NO: 13921 - DNA, 617 bp, Artificial Sequence
  chemically treated genomic DNA (Homo sapiens) CpG-island No: 13921
ggggttacgcgtcgtattgtatcgagcggcggtagcggtaagtttgggtgtgagttcgggagtcgttttgtttatcgttttgtcggttttagtcgtcgttaggaggttcgcgggttttgcggtaattttcgttatagacgttgggcggtcggcgatatttggtttatggttttcgcggcggttttgttttttttggtcgttagagttttaagtttcgtcgcgatatttatttcgtacggcgttttttgtaaggggttttttcgtattttgttcgtttttttcgagttggtttggtagttgcgtatgaatttttcgtatttttacgtcgcgggttcggtgatttttaatattcgattgtaggtatatatttagagttatgattaagataacggttttcggggttagtatgatggtcgatttttagggttcgttgcggcgcggcggagtagttaatggcgagttttatagtttcgcgagagtgtttaggcgtttttcgtggttgtttttttagttgttagcggagttttttagggggcggtcgggagtttataatttttagaaagaaaatacgttatttcggaaatagaattgtagttaagattttcgaaaagatttaa

SEQ ID NO: 13922 - DNA, 617 bp, Artificial Sequence
  chemically treated genomic DNA (Homo sapiens) CpG-island No: 13922
ttaaatcttttcgaaaatcttaactacaattctatttccgaaataacgtattttctttctaaaaattataaactcccgaccgccccctaaaaaactccgctaacaactaaaaaaacaaccacgaaaaacgcctaaacactctcgcgaaactataaaactcgccattaactactccgccgcgccgcaacgaaccctaaaaatcgaccatcatactaaccccgaaaaccgttatcttaatcataactctaaatatatacctacaatcgaatattaaaaatcaccgaacccgcgacgtaaaaatacgaaaaattcatacgcaactaccaaaccaactcgaaaaaaacgaacaaaatacgaaaaaaccccttacaaaaaacgccgtacgaaataaatatcgcgacgaaacttaaaactctaacgaccaaaaaaaacaaaaccgccgcgaaaaccataaaccaaatatcgccgaccgcccaacgtctataacgaaaattaccgcaaaacccgcgaacctcctaacgacgactaaaaccgacaaaacgataaacaaaacgactcccgaactcacacccaaacttaccgctaccgccgctcgatacaatacgacgcgtaacccc

SEQ ID NO: 13923 - DNA, 617 bp, Artificial Sequence
  chemically treated genomic DNA (Homo sapiens) CpG-island No: 13923
ttagattttttcgagggttttaattgtagttttgttttcggaatggcgtattttttttttaggaattgtaggttttcggtcgttttttgaggagtttcgttagtagttaagagggtagttacgaagagcgtttgagtattttcgcgagattgtggggttcgttattggttgtttcgtcgcgtcgtaacggattttgggagtcggttattatgttggtttcggaggtcgttattttagttatggttttaaatatgtatttgtaatcggatgttgaggattatcgagttcgcgacgtagaagtacgggaagtttatgcgtagttgttaggttagttcgaagaaggcgagtagggtgcgggagagttttttgtagaagacgtcgtacgaggtgggtgtcgcggcggggtttgaggttttgacggttaaggaggatagagtcgtcgcgggggttatgagttaggtgtcgtcggtcgtttagcgtttgtagcgagggttgtcgtagggttcgcggattttttagcgacggttgggatcggtaggacggtaagtaaagcggttttcgggtttatatttaagtttgtcgttgtcgtcgttcggtgtagtgcggcgcgtagtttt

SEQ ID NO: 13924 - DNA, 617 bp, Artificial Sequence
  chemically treated genomic DNA (Homo sapiens) CpG-island No: 13924
aaaactacgcgccgcactacaccgaacgacgacaacgacaaacttaaatataaacccgaaaaccgctttacttaccgtcctaccgatcccaaccgtcgctaaaaaatccgcgaaccctacgacaaccctcgctacaaacgctaaacgaccgacgacacctaactcataacccccgcgacgactctatcctccttaaccgtcaaaacctcaaaccccgccgcgacacccacctcgtacgacgtcttctacaaaaaactctcccgcaccctactcgccttcttcgaactaacctaacaactacgcataaacttcccgtacttctacgtcgcgaactcgataatcctcaacatccgattacaaatacatatttaaaaccataactaaaataacgacctccgaaaccaacataataaccgactcccaaaatccgttacgacgcgacgaaacaaccaataacgaaccccacaatctcgcgaaaatactcaaacgctcttcgtaactaccctcttaactactaacgaaactcctcaaaaaacgaccgaaaacctacaattcctaaaaaaaaaatacgccattccgaaaacaaaactacaattaaaaccctcgaaaaaatctaa

SEQ ID NO: 13925 - DNA, 625 bp, Artificial Sequence
  chemically treated genomic DNA (Homo sapiens) CpG-island No: 13925
ttcgtacgtcgcgtttcgatttggcgttcgggtaattgggcgcgcgttttgtttttcgttttcggtcgggtgcggtttgtttaggtcggggttttaggcggttgtcgcgcgttttatgttcggcgggttaggcgcggggttgcggggcgcgcgttttttgggcgtcgtcgggcggttgtgggcgtttcggttcggttcgcgtttcggtttttttgtcgtttgttttttgattttttcgcgttcggtttcgcgtttcgtttcggtcgtcgcgtgcgtcgttttgagttgtagtggtcgttatcgttatcgtagttgtagcgtttttttatatttttagcgcgtcgtcggtcgggtagtttggtcgcggtacggaggaggggttttggagggggcggtcgggggaggcgacgtcgaattatcgttttcgggtagtcgtcgtcgggggggagcgcggagatttggaaagggcgcgtcgggtaacgttttttttttttttatttcggtcgtttttttttattttcgttttttttttaattatttttttaatattatattcgtttatttttttttttttaattttttatttattttattttgttaatatataatattttttataagtttt

SEQ ID NO: 13926 - DNA, 625 bp, Artificial Sequence
  chemically treated genomic DNA (Homo sapiens) CpG-island No: 13926
aaaacttataaaaaatattatatattaacaaaataaaataaataaaaaattaaaaaaaaaaaaataaacgaatataatattaaaaaaataattaaaaaaaaaacgaaaataaaaaaaaacgaccgaaataaaaaaaaaaaaaacgttacccgacgcgccctttccaaatctccgcgctcccccccgacgacgactacccgaaaacgataattcgacgtcgcctcccccgaccgccccctccaaaacccctcctccgtaccgcgaccaaactacccgaccgacgacgcgctaaaaatataaaaaaacgctacaactacgataacgataacgaccactacaactcaaaacgacgcacgcgacgaccgaaacgaaacgcgaaaccgaacgcgaaaaaatcaaaaaacaaacgacaaaaaaaccgaaacgcgaaccgaaccgaaacgcccacaaccgcccgacgacgcccaaaaaacgcgcgccccgcaaccccgcgcctaacccgccgaacataaaacgcgcgacaaccgcctaaaaccccgacctaaacaaaccgcacccgaccgaaaacgaaaaacaaaacgcgcgcccaattacccgaacgccaaatcgaaacgcgacgtacgaa

SEQ ID NO: 13927 - DNA, 625 bp, Artificial Sequence
  chemically treated genomic DNA (Homo sapiens) CpG-island No: 13927
ggggtttgtaggaagtattgtatattggtaggatggaatgggtaggaagttggaagaggaggggtaggcgagtgtagtgttaggagggtagttgggaggggagcgggggtgaggaggggcggtcggagtgggaggaggggaggcgttgttcgacgcgttttttttaagttttcgcgttttttttcggcggcggttgttcgggggcggtggttcggcgtcgtttttttcgatcgttttttttagggtttttttttcgtgtcgcggttaggttgttcggtcggcggcgcgttggaaatatgaagagacgttgtagttgcggtggcggtggcggttattgtagtttagagcggcgtacgcggcggtcggggcgggacgcggggtcgggcgcggagaagttaaaaaatagacggtagagaggtcgggacgcggatcgggtcggggcgtttatagtcgttcgacggcgtttagagagcgcgcgtttcgtagtttcgcgtttagttcgtcgggtatggggcgcgcggtagtcgtttgaagtttcggtttggatagatcgtattcggtcggaggcggagggtagggcgcgcgtttagttgttcgggcgttaaatcggagcgcggcgtgcggg

SEQ ID NO: 13928 - DNA, 625 bp, Artificial Sequence
  chemically treated genomic DNA (Homo sapiens) CpG-island No: 13928
cccgcacgccgcgctccgatttaacgcccgaacaactaaacgcgcgccctaccctccgcctccgaccgaatacgatctatccaaaccgaaacttcaaacgactaccgcgcgccccatacccgacgaactaaacgcgaaactacgaaacgcgcgctctctaaacgccgtcgaacgactataaacgccccgacccgatccgcgtcccgacctctctaccgtctattttttaacttctccgcgcccgaccccgcgtcccgccccgaccgccgcgtacgccgctctaaactacaataaccgccaccgccaccgcaactacaacgtctcttcatatttccaacgcgccgccgaccgaacaacctaaccgcgacacgaaaaaaaaaccctaaaaaaaacgatcgaaaaaaacgacgccgaaccaccgcccccgaacaaccgccgccgaaaaaaaacgcgaaaacttaaaaaaaacgcgtcgaacaacgcctcccctcctcccactccgaccgcccctcctcacccccgctcccctcccaactaccctcctaacactacactcgcctacccctcctcttccaacttcctacccattccatcctaccaatatacaatacttcctacaaacccc

SEQ ID NO: 13929 - DNA, 598 bp, Artificial Sequence
  chemically treated genomic DNA (Homo sapiens) CpG-island No: 13929
gcgttcgtcgcgtaggttttcgatgagttgatgttttgggtcgaggattgtttcgaagttcggtatttcgtgtacgcggatttcggttttaataatgttttgacggataatggtcgtataatagcggttattgattggagcgaggcgatgttcggggatttttaatacgaggtcgttaatatttttttttggaggtcgtggttggtttgtatggagtagtagacgcgttatttcgagcggaggtattcggagtttgtaggatcgtcgcggtttcgggcgtatatgtttcgtattggttttgattaattttattagagtttggttgacggtaatttcgatgatgtagtttgggcgtagggtcgatgcgacgtaatcgttcgattcggagtcgggattgtcgggcgtatataaatcgttcgtagaagcgcggtcgtttggatcgatggttgtgtagaagtattcgtcgatagtggaaatcgacgttttagtattcgttcgagggtaaaggaatagagtagatgtcgatcgggatttatcgtcgataggtttcggatttgtagtacgtgttgataattaattatcggtatagtatatcggt

SEQ ID NO: 13930 - DNA, 598 bp, Artificial Sequence
  chemically treated genomic DNA (Homo sapiens) CpG-island No: 13930
accgatatactataccgataattaattatcaacacgtactacaaatccgaaacctatcgacgataaatcccgatcgacatctactctattcctttaccctcgaacgaatactaaaacgtcgatttccactatcgacgaatacttctacacaaccatcgatccaaacgaccgcgcttctacgaacgatttatatacgcccgacaatcccgactccgaatcgaacgattacgtcgcatcgaccctacgcccaaactacatcatcgaaattaccgtcaaccaaactctaataaaattaatcaaaaccaatacgaaacatatacgcccgaaaccgcgacgatcctacaaactccgaatacctccgctcgaaataacgcgtctactactccatacaaaccaaccacgacctccaaaaaaaaatattaacgacctcgtattaaaaatccccgaacatcgcctcgctccaatcaataaccgctattatacgaccattatccgtcaaaacattattaaaaccgaaatccgcgtacacgaaataccgaacttcgaaacaatcctcgacccaaaacatcaactcatcgaaaacctacgcgacgaacgc

SEQ ID NO: 13931 - DNA, 598 bp, Artificial Sequence
  chemically treated genomic DNA (Homo sapiens) CpG-island No: 13931
gtcgatatattatgtcgatgattaattgttaatacgtgttgtaggttcgaggtttgtcgacgatagatttcggtcggtatttattttatttttttgttttcggacgagtgttggggcgtcggtttttattatcggcgagtatttttatatagttatcggtttagacggtcgcgtttttgcgggcgatttgtgtacgttcgatagtttcggtttcggatcggacgattgcgtcgtatcgattttgcgtttaagttgtattatcgaaattgtcgttaattaagttttgatagagttggttaagattaatgcggagtatatacgttcggagtcgcggcgattttgtaagtttcggatgttttcgttcgaagtagcgcgtttgttgttttatataagttaattacggtttttagaagaagatgttggcgatttcgtattgggaattttcgaatatcgtttcgttttagttaatgatcgttgttatgcggttattgttcgttaggatattgttggagtcgaaattcgcgtgtacgaggtgtcggatttcggggtagttttcggtttaaagtattagtttatcgagagtttgcgcgacggacgt

SEQ ID NO: 13932 - DNA, 598 bp, Artificial Sequence
  chemically treated genomic DNA (Homo sapiens) CpG-island No: 13932
acgtccgtcgcgcaaactctcgataaactaatactttaaaccgaaaactaccccgaaatccgacacctcgtacacgcgaatttcgactccaacaatatcctaacgaacaataaccgcataacaacgatcattaactaaaacgaaacgatattcgaaaattcccaatacgaaatcgccaacatcttcttctaaaaaccgtaattaacttatataaaacaacaaacgcgctacttcgaacgaaaacatccgaaacttacaaaatcgccgcgactccgaacgtatatactccgcattaatcttaaccaactctatcaaaacttaattaacgacaatttcgataatacaacttaaacgcaaaatcgatacgacgcaatcgtccgatccgaaaccgaaactatcgaacgtacacaaatcgcccgcaaaaacgcgaccgtctaaaccgataactatataaaaatactcgccgataataaaaaccgacgccccaacactcgtccgaaaacaaaaaaataaaataaataccgaccgaaatctatcgtcgacaaacctcgaacctacaacacgtattaacaattaatcatcgacataatatatcgac

SEQ ID NO: 13933 - DNA, 572 bp, Artificial Sequence
  chemically treated genomic DNA (Homo sapiens) CpG-island No: 13933
ttcgtcgcgcgaggtaagtttaagggtttcgacgtagggcgcgggtagggaggcgcgtcgtcgttttcgggatatttaattttagtttggagttcgtcgggcgtcggacgttcgggtttttcggcgttcgcgtttttttttttttttttcggttgtttttcggagcgttttatttttcgttttgcgttcgtttcgcgcgtaggtatcggtcggcgggcgcggggagcggggcgcggcggtcgttcgtttttgcggagtcgttttttggtcgttgtcgtcgcgtatcgtttagttcgcgtcgttcgcgtcgttcgggttttagtcgtttcgttgttcgttttgagtgcgtcgcggttgttcgagcgtttcgtagacgggcgggtggtcgtggacgtttagttagtagttcgtagtatggattcggatttcggggagtagagcgagggcgagttcgtgatcgtcgtaggtatttaggggtcgcgacggtttaggcgggtgggttggggttggggaggacgggaggttggggtatgaaatcgggaagtcgatttttagtagttcgatttttttta

SEQ ID NO: 13934 - DNA, 572 bp, Artificial Sequence
  chemically treated genomic DNA (Homo sapiens) CpG-island No: 13934
taaaaaaaatcgaactactaaaaatcgacttcccgatttcataccccaacctcccgtcctccccaaccccaacccacccgcctaaaccgtcgcgacccctaaatacctacgacgatcacgaactcgccctcgctctactccccgaaatccgaatccatactacgaactactaactaaacgtccacgaccacccgcccgtctacgaaacgctcgaacaaccgcgacgcactcaaaacgaacaacgaaacgactaaaacccgaacgacgcgaacgacgcgaactaaacgatacgcgacgacaacgaccaaaaaacgactccgcaaaaacgaacgaccgccgcgccccgctccccgcgcccgccgaccgatacctacgcgcgaaacgaacgcaaaacgaaaaataaaacgctccgaaaaacaaccgaaaaaaaaaaaaaaaaacgcgaacgccgaaaaacccgaacgtccgacgcccgacgaactccaaactaaaattaaatatcccgaaaacgacgacgcgcctccctacccgcgccctacgtcgaaacccttaaacttacctcgcgcgacgaa

SEQ ID NO: 13935 - DNA, 572 bp, Artificial Sequence
  chemically treated genomic DNA (Homo sapiens) CpG-island No: 13935
tggaaggggtcgggttgttgaggatcggtttttcgattttatgttttagtttttcgttttttttagttttagtttattcgtttgggtcgtcgcggtttttaggtatttgcggcggttacgggttcgttttcgttttgtttttcggaattcgaatttatgttgcgggttgttggttgggcgtttacggttattcgttcgtttgcggggcgttcgggtagtcgcggcgtatttagggcggatagcggggcggttggagttcgggcggcgcgggcggcgcgggttgggcggtgcgcggcggtagcggttagggggcggtttcgtagaggcgagcggtcgtcgcgtttcgtttttcgcgttcgtcggtcggtgtttgcgcgcgaggcgagcgtagggcggagggtggggcgtttcgggagatagtcgggaggagggaggggaggcgcgagcgtcgaggagttcgagcgttcggcgttcggcgggttttaggttggggttaaatatttcgggggcggcggcgcgtttttttattcgcgttttgcgtcggagtttttggatttgtttcgcgcggcgag

SEQ ID NO: 13936 - DNA, 572 bp, Artificial Sequence
  chemically treated genomic DNA (Homo sapiens) CpG-island No: 13936
ctcgccgcgcgaaacaaatccaaaaactccgacgcaaaacgcgaataaaaaaacgcgccgccgcccccgaaatatttaaccccaacctaaaacccgccgaacgccgaacgctcgaactcctcgacgctcgcgcctcccctccctcctcccgactatctcccgaaacgccccaccctccgccctacgctcgcctcgcgcgcaaacaccgaccgacgaacgcgaaaaacgaaacgcgacgaccgctcgcctctacgaaaccgccccctaaccgctaccgccgcgcaccgcccaacccgcgccgcccgcgccgcccgaactccaaccgccccgctatccgccctaaatacgccgcgactacccgaacgccccgcaaacgaacgaataaccgtaaacgcccaaccaacaacccgcaacataaattcgaattccgaaaaacaaaacgaaaacgaacccgtaaccgccgcaaatacctaaaaaccgcgacgacccaaacgaataaactaaaactaaaaaaaacgaaaaactaaaacataaaatcgaaaaaccgatcctcaacaacccgaccccttcca

SEQ ID NO: 13937 - DNA, 817 bp, Artificial Sequence
  chemically treated genomic DNA (Homo sapiens) CpG-island No: 13937
cgcggatgagcggatatcgtaattcggggatatcgttttttagggaatatcgcgtttagggatatcgttttcgtcgtattatttggttttcgaggtaaattttttgagttagtttttgtaggagatagtagagtagtgaagttttcgttcgtagtttggaaatagcgtagtatcgcggttacggaatagggttcggagattcgcgcgggagcgttatagttcgttcgtcgtagtttatatggcgcggcgtcgggattcggagcgagtagggagataacgggcgtaggcgcggagcgataattgacgcgagggtggcggcgtgtggacggggcgacggcgtagagcgggaggaagatttacgtttggtaggcggcgtgtgggcggggcgatgatgtagggcggggcgatgatgtagggcggggcgaggatagacgcgaaattgacggcgtgtgggcggggttacggcgcggggcgggacgaagacggggtgtaaggcgggcggggtaacgacggcggaggggcgaaggttcgaggggggcggtaggtgggcggggcgaggatagacgcgaagttgacggcgtgtggacggggcgacggcgagggacggggtaaagattggacgtaagaaggggcggggcgataacggcggagggggcgaaggcgcgaggcgaacggcgagtgggcggggtgaagatcgacgcgaagcgggcggtggttgggcggggcgaagattgacgcgaggcgggcggtgaatgggcggggcgaagattggcgcgaggtgggcggtgggtgggtagggaaaagattgagcgagaag

SEQ ID NO: 13938 - DNA, 817 bp, Artificial Sequence
  chemically treated genomic DNA (Homo sapiens) CpG-island No: 13938
cttctcgctcaatcttttccctacccacccaccgcccacctcgcgccaatcttcgccccgcccattcaccgcccgcctcgcgtcaatcttcgccccgcccaaccaccgcccgcttcgcgtcgatcttcaccccgcccactcgccgttcgcctcgcgccttcgccccctccgccgttatcgccccgccccttcttacgtccaatctttaccccgtccctcgccgtcgccccgtccacacgccgtcaacttcgcgtctatcctcgccccgcccacctaccgcccccctcgaaccttcgcccctccgccgtcgttaccccgcccgccttacaccccgtcttcgtcccgccccgcgccgtaaccccgcccacacgccgtcaatttcgcgtctatcctcgccccgccctacatcatcgccccgccctacatcatcgccccgcccacacgccgcctaccaaacgtaaatcttcctcccgctctacgccgtcgccccgtccacacgccgccaccctcgcgtcaattatcgctccgcgcctacgcccgttatctccctactcgctccgaatcccgacgccgcgccatataaactacgacgaacgaactataacgctcccgcgcgaatctccgaaccctattccgtaaccgcgatactacgctatttccaaactacgaacgaaaacttcactactctactatctcctacaaaaactaactcaaaaaatttacctcgaaaaccaaataatacgacgaaaacgatatccctaaacgcgatattccctaaaaaacgatatccccgaattacgatatccgctcatccgcg

SEQ ID NO: 13939 - DNA, 817 bp, Artificial Sequence
  chemically treated genomic DNA (Homo sapiens) CpG-island No: 13939
tttttcgtttagttttttttttgtttatttatcgtttatttcgcgttagttttcgtttcgtttatttatcgttcgtttcgcgttagttttcgtttcgtttaattatcgttcgtttcgcgtcggtttttatttcgtttattcgtcgttcgtttcgcgttttcgtttttttcgtcgttgtcgtttcgtttttttttgcgtttagtttttgtttcgtttttcgtcgtcgtttcgtttatacgtcgttagtttcgcgtttgttttcgtttcgtttatttatcgtttttttcgggttttcgttttttcgtcgtcgttgtttcgttcgttttgtatttcgttttcgtttcgtttcgcgtcgtggtttcgtttatacgtcgttagtttcgcgtttgttttcgtttcgttttgtattatcgtttcgttttgtattatcgtttcgtttatacgtcgtttgttaggcgtgagtttttttttcgttttgcgtcgtcgtttcgtttatacgtcgttattttcgcgttagttgtcgtttcgcgtttgcgttcgttgtttttttgttcgtttcgggtttcggcgtcgcgttatgtgggttgcggcgggcgggttgtggcgttttcgcgcgggttttcgggttttgtttcgtagtcgcgatgttgcgttatttttaggttgcgagcggggattttattgttttgttgttttttgtaagaattggtttaagaaatttgtttcgaaaattaagtaatgcggcgggggcggtgtttttgggcgcggtattttttagggggcggtgttttcgggttgcggtgttcgtttattcgcg

SEQ ID NO: 13940 - DNA, 817 bp, Artificial Sequence
  chemically treated genomic DNA (Homo sapiens) CpG-island No: 13940
cgcgaataaacgaacaccgcaacccgaaaacaccgccccctaaaaaataccgcgcccaaaaacaccgcccccgccgcattacttaattttcgaaacaaatttcttaaaccaattcttacaaaaaacaacaaaacaataaaatccccgctcgcaacctaaaaataacgcaacatcgcgactacgaaacaaaacccgaaaacccgcgcgaaaacgccacaacccgcccgccgcaacccacataacgcgacgccgaaacccgaaacgaacaaaaaaacaacgaacgcaaacgcgaaacgacaactaacgcgaaaataacgacgtataaacgaaacgacgacgcaaaacgaaaaaaaaactcacgcctaacaaacgacgtataaacgaaacgataatacaaaacgaaacgataatacaaaacgaaacgaaaacaaacgcgaaactaacgacgtataaacgaaaccacgacgcgaaacgaaacgaaaacgaaatacaaaacgaacgaaacaacgacgacgaaaaaacgaaaacccgaaaaaaacgataaataaacgaaacgaaaacaaacgcgaaactaacgacgtataaacgaaacgacgacgaaaaacgaaacaaaaactaaacgcaaaaaaaaacgaaacgacaacgacgaaaaaaacgaaaacgcgaaacgaacgacgaataaacgaaataaaaaccgacgcgaaacgaacgataattaaacgaaacgaaaactaacgcgaaacgaacgataaataaacgaaacgaaaactaacgcgaaataaacgataaataaacaaaaaaaaaactaaacgaaaaa

SEQ ID NO: 13941 - DNA, 984 bp, Artificial Sequence
  chemically treated genomic DNA (Homo sapiens) CpG-island No: 13941
  misc_feature (117)..(117): n is either a, c, g or t
  misc_feature (284)..(284): n is either a, c, g or t
tcgtttgtaagttattcgtggatttttatatttgagatattttcgagttttgtaaatgcggttcgatttgtgagcgttgagggagcggtttgtgtttttacgaatagttttattatngcgtgtttagattataatgagcgcgtagcgtttttgaaattattttatttgtgttgtattttcgatgtttgataagttattagtagcgttcgaattattacgttttttagttatatttgggattcgtagattaacgatcgatagacgttaatagcgtttatcgtatnggttagtataggtacgttttttgcgttacggtcgtaaaaggttcgtcgttttttacgaataggatcgtagcggtttatttcgagatttgttacgaagattaacggcgattcgcgaatataagaattcgcgtttggcgtttttgcgttattagtcgttttggcgatttttttcgcgggtataatatttttcggggttcgagtaagaaagtatcgtcgttttataaatttagaatattttttattattgataagcgaaaattgaagttacgttttgtaagcgtaattacggagaggttttagtaacgtatggtcgtagggagtatatcgatggttatttaggtcggagaattattaggcgagtttcgcgttattttttattttagatatacgataaattcggttggtagcgatcgtgcggtattaatagttttttataaaagggcgttttggaagagaatagattttcggttttttttatttcgaagcgtgtttcgttaatcgacgttattttatagcgttatgcggttggttaatatcgaatgacgattttcgttaatttagcgttagacgttatttcgtaagacgcggcgcgttttcgaaagcgatcggattttgatgattagaggtttacgtcgtataattttggttatatttagttttagagtacgggttaatatttttttttttttattattgtaga

SEQ ID NO: 13942 - DNA, 984 bp, Artificial Sequence
  chemically treated genomic DNA (Homo sapiens) CpG-island No: 13942
  misc_feature (701)..(701): n is either a, c, g or t
  misc_feature (868)..(868): n is either a, c, g or t
tctacaataataaaaaaaaaaaaatattaacccgtactctaaaactaaatataaccaaaattatacgacgtaaacctctaatcatcaaaatccgatcgctttcgaaaacgcgccgcgtcttacgaaataacgtctaacgctaaattaacgaaaatcgtcattcgatattaaccaaccgcataacgctataaaataacgtcgattaacgaaacacgcttcgaaataaaaaaaaccgaaaatctattctcttccaaaacgcccttttataaaaaactattaataccgcacgatcgctaccaaccgaatttatcgtatatctaaaataaaaaataacgcgaaactcgcctaataattctccgacctaaataaccatcgatatactccctacgaccatacgttactaaaacctctccgtaattacgcttacaaaacgtaacttcaattttcgcttatcaataataaaaaatattctaaatttataaaacgacgatactttcttactcgaaccccgaaaaatattatacccgcgaaaaaaatcgccaaaacgactaataacgcaaaaacgccaaacgcgaattcttatattcgcgaatcgccgttaatcttcgtaacaaatctcgaaataaaccgctacgatcctattcgtaaaaaacgacgaaccttttacgaccgtaacgcaaaaaacgtacctatactaaccnatacgataaacgctattaacgtctatcgatcgttaatctacgaatcccaaatataactaaaaaacgtaataattcgaacgctactaataacttatcaaacatcgaaaatacaacacaaataaaataatttcaaaaacgctacgcgctcattataatctaaacacgcnataataaaactattcgtaaaaacacaaaccgctccctcaacgctcacaaatcgaaccgcatttacaaaactcgaaaatatctcaaatataaaaatccacgaataacttacaaacga

SEQ ID NO: 13943 - DNA, 984 bp, Artificial Sequence
  chemically treated genomic DNA (Homo sapiens) CpG-island No: 13943
  misc_feature (701)..(701): n is either a, c, g or t
  misc_feature (868)..(868): n is either a, c, g or t
tttataatagtaggagagagagagtattagttcgtgttttgaagttggatgtggttaggattgtgcgacgtgagtttttgattattagggttcgatcgttttcggagacgcgtcgcgttttgcgggatgacgtttggcgttgagttggcgaggatcgttattcggtattagttagtcgtatagcgttgtgaggtggcgtcgattagcgggatacgtttcggagtagaggaggtcgggagtttgtttttttttagggcgtttttttgtgggaagttgttgatgtcgtacggtcgttgttagtcgggtttgtcgtgtgtttagggtgaagggtggcgcgaggttcgtttggtggtttttcggtttagatggttatcggtgtattttttgcggttatgcgttgttagagttttttcgtgattgcgtttgtagggcgtggttttagttttcgtttgttagtgatgggaggtgttttgagtttatgaggcggcggtatttttttgttcgggtttcggagagtgttgtgttcgcgggagaagtcgttagggcggttggtgacgtagggacgttaggcgcgagtttttgtgttcgcgggtcgtcgttggttttcgtggtaggtttcgagatgagtcgttacggttttgttcgtgggaggcgacgggttttttgcggtcgtggcgtaggaggcgtgtttgtgttgattnatgcggtgggcgttattggcgtttgtcgatcgttagtttgcgggttttagatatggttagggagcgtagtggttcggacgttgttgatgatttgttaggtatcggagatgtagtatagatgggatgattttaggagcgttacgcgtttattgtggtttggatacgtnatagtgaggttgttcgtagagatataggtcgtttttttagcgtttatagatcgggtcgtatttgtaggattcgggagtattttagatgtgagaatttacgagtgatttgtagacga

SEQ ID NO: 13944 - DNA, 984 bp, Artificial Sequence
  chemically treated genomic DNA (Homo sapiens) CpG-island No: 13944
  misc_feature (117)..(117): n is either a, c, g or t
  misc_feature (284)..(284): n is either a, c, g or t
tcgtctacaaatcactcgtaaattctcacatctaaaatactcccgaatcctacaaatacgacccgatctataaacgctaaaaaaacgacctatatctctacgaacaacctcactatnacgtatccaaaccacaataaacgcgtaacgctcctaaaatcatcccatctatactacatctccgatacctaacaaatcatcaacaacgtccgaaccactacgctccctaaccatatctaaaacccgcaaactaacgatcgacaaacgccaataacgcccaccgcatnaatcaacacaaacacgcctcctacgccacgaccgcaaaaaacccgtcgcctcccacgaacaaaaccgtaacgactcatctcgaaacctaccacgaaaaccaacgacgacccgcgaacacaaaaactcgcgcctaacgtccctacgtcaccaaccgccctaacgacttctcccgcgaacacaacactctccgaaacccgaacaaaaaaataccgccgcctcataaactcaaaacacctcccatcactaacaaacgaaaactaaaaccacgccctacaaacgcaatcacgaaaaaactctaacaacgcataaccgcaaaaaatacaccgataaccatctaaaccgaaaaaccaccaaacgaacctcgcgccacccttcaccctaaacacacgacaaacccgactaacaacgaccgtacgacatcaacaacttcccacaaaaaaacgccctaaaaaaaaacaaactcccgacctcctctactccgaaacgtatcccgctaatcgacgccacctcacaacgctatacgactaactaataccgaataacgatcctcgccaactcaacgccaaacgtcatcccgcaaaacgcgacgcgtctccgaaaacgatcgaaccctaataatcaaaaactcacgtcgcacaatcctaaccacatccaacttcaaaacacgaactaatactctctctctcctactattataaa

SEQ ID NO: 13945 - DNA, 599 bp, Artificial Sequence
  chemically treated genomic DNA (Homo sapiens) CpG-island No: 13945
gttggcgatttcgtgggcggcgttttcgttggcgatgtcgtgggcggtattttcgttggcgatgtttttgtcggcggtttcgttagcgatgttttgggcggcgttttttttggcgatgttttgggcggcgttttttttggcgatgttttgggcggcgttttcgttggcgatgttttgggcggcgttttttttggcgatgttttgggcggcgttttcgttggcgatgttttgggcggcgttttcgttggcgatgtcgtggacggcgttttttatggcgatgttttggacggcgttttcgttggcgatgttttgggcggcgttttcgttggcgatgtcgtgggcggcgttttcgttggcgatgtcgtgggcggcgttttcgttggcgatgtcgtgggcggcgttttcgttggcgatgttgtgggcggtattttcgttggcgatgtttttgtcggcggtttcgttagcgatgtcgtgtatagtattttcgttagcgatgtcgtgtgtggcgttttcgttagtgatgtcgtgtacggtgtttttatggggagttagaaaaatatagagttaaggttagtgttttggtggtggagattgtgaat

SEQ ID NO: 13946 - DNA, 599 bp, Artificial Sequence
  chemically treated genomic DNA (Homo sapiens) CpG-island No: 13946
attcacaatctccaccaccaaaacactaaccttaactctatatttttctaactccccataaaaacaccgtacacgacatcactaacgaaaacgccacacacgacatcgctaacgaaaatactatacacgacatcgctaacgaaaccgccgacaaaaacatcgccaacgaaaataccgcccacaacatcgccaacgaaaacgccgcccacgacatcgccaacgaaaacgccgcccacgacatcgccaacgaaaacgccgcccacgacatcgccaacgaaaacgccgcccaaaacatcgccaacgaaaacgccgtccaaaacatcgccataaaaaacgccgtccacgacatcgccaacgaaaacgccgcccaaaacatcgccaacgaaaacgccgcccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgctaacgaaaccgccgacaaaaacatcgccaacgaaaataccgcccacgacatcgccaacgaaaacgccgcccacgaaatcgccaac

SEQ ID NO: 13947 - DNA, 599 bp, Artificial Sequence
  chemically treated genomic DNA (Homo sapiens) CpG-island No: 13947
atttatagtttttattattagggtattgattttaattttgtgtttttttagttttttatgaggatatcgtatacgatattattaacgaggacgttatatacgatatcgttaacgaggatattgtatacgatatcgttaacgaggtcgtcgataagggtatcgttaacgaggatgtcgtttatagtatcgttaacgaggacgtcgtttacggtatcgttagcgaggacgtcgtttacggtatcgttagcgaggacgtcgtttacggtatcgttagcgaggacgtcgtttagggtatcgttaacgaggacgtcgtttagggtatcgttatggaggacgtcgtttacggtatcgttaacgaggacgtcgtttagggtatcgttaacgaggacgtcgtttagggtatcgttaaggaggacgtcgtttagggtatcgttaacgaggacgtcgtttagggtatcgttaaagaggacgtcgtttagggtatcgttaaggaggacgtcgtttagggtatcgttaacgaggtcgtcgataagggtatcgttaacgaggatgtcgtttacggtatcgttagcgaggacgtcgtttacggaatcgttagt

SEQ ID NO: 13948 - DNA, 599 bp, Artificial Sequence
  chemically treated genomic DNA (Homo sapiens) CpG-island No: 13948
actaacgattccgtaaacgacgtcctcgctaacgataccgtaaacgacatcctcgttaacgatacccttatcgacgacctcgttaacgataccctaaacgacgtcctccttaacgataccctaaacgacgtcctctttaacgataccctaaacgacgtcctcgttaacgataccctaaacgacgtcctccttaacgataccctaaacgacgtcctcgttaacgataccctaaacgacgtcctcgttaacgataccgtaaacgacgtcctccataacgataccctaaacgacgtcctcgttaacgataccctaaacgacgtcctcgctaacgataccgtaaacgacgtcctcgctaacgataccgtaaacgacgtcctcgctaacgataccgtaaacgacgtcctcgttaacgatactataaacgacatcctcgttaacgatacccttatcgacgacctcgttaacgatatcgtatacaatatcctcgttaacgatatcgtatataacgtcctcgttaataatatcgtatacgatatcctcataaaaaactaaaaaaacacaaaattaaaatcaataccctaataataaaaactataaat

SEQ ID NO: 13949 - DNA, 503 bp, Artificial Sequence
  chemically treated genomic DNA (Homo sapiens) CpG-island No: 13949
ggcgatgtcgtgggcggcgttttttttggcgatgttttgggcggcgttttcgttggcgatgttttgggcggcgttttcgttggcgatgttttgggcggtattttttttgtcgatgttttggacggcgttttcgttggcgatttcgtgggcgtcgttttcgttggcgatgttttgggcggcgttttcgttggcgatgtcgtgggcggcgttttttttggcgatgttttgggcggcgttttcgttggcgatgttttgggcggcgttttttttggcgatgttttgggcggcgttttttttggcgatgttttgggcggcgttttttttggcgatgttttgggcggcgttttcgttggcgatgtcgtggacggcgtattttttggcgatgttttggatggcgttttcgttggcgatgttttgggtcggcgttttcgttggcgatgttttgggcggcgttttcgttggcgatgttttggacggcgttttttttgtcgatgttttggtcg

SEQ ID NO: 13950 - DNA, 503 bp, Artificial Sequence
  chemically treated genomic DNA (Homo sapiens) CpG-island No: 13950
cgaccaaaacatcgacaaaaaaaacgccgtccaaaacatcgccaacgaaaacgccgcccaaaacatcgccaacgaaaacgccgacccaaaacatcgccaacgaaaacgccatccaaaacatcgccaaaaaatacgccgtccacgacatcgccaacgaaaacgccgcccaaaacatcgccaaaaaaaacgccgcccaaaacatcgccaaaaaaaacgccgcccaaaacatcgccaaaaaaaacgccgcccaaaacatcgccaacgaaaacgccgcccaaaacatcgccaaaaaaaacgccgcccacgacatcgccaacgaaaacgccgcccaaaacatcgccaacgaaaacgacgcccacgaaatcgccaacgaaaacgccgtccaaaacatcgacaaaaaaaataccgcccaaaacatcgccaacgaaaacgccgcccaaaacatcgccaacgaaaacgccgcccaaaacatcgccaaaaaaaacgccgcccacgacatcgcc

SEQ ID NO: 13951 - DNA, 503 bp, Artificial Sequence
  chemically treated genomic DNA (Homo sapiens) CpG-island No: 13951
cgattagggtatcgataaggaggacgtcgtttagggtatcgttaacgaggacgtcgtttagggtatcgttaacgaggacgtcggtttagggtatcgttaacgaggacgttatttagggtatcgttaaggagtacgtcgtttacggtatcgttaacgaggacgtcgtttagggtatcgttaaggaggacgtcgtttagggtatcgttaaggaggacgtcgtttagggtatcgttaaggaggacgtcgtttagggtatcgttaacgaggacgtcgtttagggtatcgttaaagaggacgtcgtttacggtatcgttaacgaggacgtcgtttagggtatcgttaacgaggacggcgtttacggaatcgttagcgaggacgtcgtttagggtatcgataaggaggatgtcgtttagggtatcgttaacgaggacgtcgtttagggtatcgttaacgaggacgtcgtttagggtatcgttaaagaggacgtcgtttacggtatcgtt

SEQ ID NO: 13952 - DNA, 503 bp, Artificial Sequence
  chemically treated genomic DNA (Homo sapiens) CpG-island No: 13952
aacgataccgtaaacgacgtcctctttaacgataccctaaacgacgtcctcgttaacgataccctaaacgacgtcctcgttaacgataccctaaacgacatcctccttatcgataccctaaacgacgtcctcgctaacgattccgtaaacgccgtcctcgttaacgataccctaaacgacgtcctcgttaacgataccgtaaacgacgtcctctttaacgataccctaaacgacgtcctcgttaacgataccctaaacgacgtcctccttaacgataccctaaacgacgtcctccttaacgataccctaaacgacgtcctccttaacgataccctaaacgacgtcctcgttaacgataccgtaaacgacgtactccttaacgataccctaaataacgtcctcgttaacgataccctaaaccgacgtcctcgttaacgataccctaaacgacgtcctcgttaacgataccctaaacgacgtcctccttatcgataccctaatcg

SEQ ID NO: 13953 - DNA, 811 bp, Artificial Sequence
  chemically treated genomic DNA (Homo sapiens) CpG-island No: 13953
  misc_feature (596)..(596): n is either a, c, g or t
  misc_feature (637)..(637): n is either a, c, g or t
  misc_feature (653)..(653): n is either a, c, g or t
  misc_feature (736)..(736): n is either a, c, g or t
gtcgtgggagagcgaacggggacggtgggatcgcggacgagatttattgggatcgggttggggttggttgtcgtaatttgagtaagtgatgcgaggaatcgtaaaggtatgggggaataagggggggagggggggcgtgggcgttacgaagagaggacgagggatggaatggtggcgtcgagaggtggaataggggagagagtgtatggcgttgcgtagtgtgggtgagagggttgagagagaagcgataggggtcgcgcgtgattattggagaggagtcgtagcggtataaggtgttttgtaaatggtggacggtgcgatggtagcgagcggggttggtggcgggtgattcgtaagtggacgtgagtgtttggacggttagttgcgggagtgcggcgaatattttggtgtaagttcgagtgtgattataatggatttgcgggtgaatatgtcgacgatagaatgttttgtggagtaaagttgtacgcgcgacgcgggatgcgaaaaacgttttcgttaacgtacggaaataggcgaacggtaatgagttcggagcgtaattttatgttcggggagtcgggtacgtaatcgagagnaggcgtcgcgtcgtatcgggaattattggtagaaggggagnaaataaatacgacgtncgcgcgttggcgggcgcgcgggggggggcgggcgggggggcggcggcgtgaggcgtggcgcggggcggttgggggggtcgcgnattatttagtcggttttttttattattacgaatgatagtgataagaaaatttaatattataaatatttggataag

SEQ ID NO: 13954 - DNA, 811 bp, Artificial Sequence
  chemically treated genomic DNA (Homo sapiens) CpG-island No: 13954
  misc_feature (76)..(76): n is either a, c, g or t
  misc_feature (159)..(159): n is either a, c, g or t
  misc_feature (175)..(175): n is either a, c, g or t
  misc_feature (216)..(216): n is either a, c, g or t
cttatccaaatatttataatattaaattttcttatcactatcattcgtaataataaaaaaaaccgactaaataatncgcgacccccccaaccgccccgcgccacgcctcacgccgccgcccccccgcccgcccccccccgcgcgcccgccaacgcgcgnacgtcgtatttatttnctccccttctaccaataattcccgatacgacgcgacgcctnctctcgattacgtacccgactccccgaacataaaattacgctccgaactcattaccgttcgcctatttccgtacgttaacgaaaacgtttttcgcatcccgcgtcgcgcgtacaactttactccacaaaacattctatcgtcgacatattcacccgcaaatccattataatcacactcgaacttacaccaaaatattcgccgcactcccgcaactaaccgtccaaacactcacgtccacttacgaatcacccgccaccaaccccgctcgctaccatcgcaccgtccaccatttacaaaacaccttataccgctacgactcctctccaataatcacgcgcgacccctatcgcttctctctcaaccctctcacccacactacgcaacgccatacactctctcccctattccacctctcgacgccaccattccatccctcgtcctctcttcgtaacgcccacgccccccctcccccccttattcccccatacctttacgattcctcgcatcacttactcaaattacgacaaccaaccccaacccgatcccaataaatctcgtccgcgatcccaccgtccccgttcgctctcccacgac

SEQ ID NO: 13955 - DNA, 811 bp, Artificial Sequence
  chemically treated genomic DNA (Homo sapiens) CpG-island No: 13955
  misc_feature (76)..(76): n is either a, c, g or t
  misc_feature (159)..(159): n is either a, c, g or t
  misc_feature (175)..(175): n is either a, c, g or t
  misc_feature (216)..(216): n is either a, c, g or t
tttgtttaagtgtttatagtgttagatttttttgttattattattcgtaatagtaggaaggatcggttgagtggtncgcggtttttttagtcgtttcgcgttacgttttacgtcgtcgttttttcgttcgttttttttcgcgcgttcgttaacgcgcgngcgtcgtgtttgtttnttttttttttgttaatgattttcggtgcggcgcggcgtttnttttcggttgcgtattcggtttttcgggtatggaattgcgtttcgggtttattatcgttcgtttattttcgtgcgttggcgaaggcgtttttcgtatttcgcgtcgcgcgtgtaattttgttttatagagtattttgtcgtcggtatgtttattcgtaggtttattatagttatattcgggtttgtattaaggtattcgtcgtattttcgtagttaatcgtttaaatatttacgtttatttacgggttattcgttattaatttcgttcgttattatcgtatcgtttattatttataaaatattttatgtcgttgcgatttttttttagtaattacgcgcggtttttatcgttttttttttagtttttttatttatattgcgtaacgttatatatttttttttttattttatttttcggcgttattattttatttttcgtttttttttcgtggcgtttacgtttttttttttttttttgtttttttatgtttttacggtttttcgtattatttatttaagttgcggtagttagttttagttcggttttagtagatttcgttcgcggttttatcgttttcgttcgtttttttacgat

SEQ ID NO: 13956 - DNA, 811 bp, Artificial Sequence
  chemically treated genomic DNA (Homo sapiens) CpG-island No: 13956
  misc_feature (596)..(596): n is either a, c, g or t
  misc_feature (637)..(637): n is either a, c, g or t
  misc_feature (653)..(653): n is either a, c, g or t
  misc_feature (736)..(736): n is either a, c, g or t
atcgtaaaaaaacgaacgaaaacgataaaaccgcgaacgaaatctactaaaaccgaactaaaactaactaccgcaacttaaataaataatacgaaaaaccgtaaaaacataaaaaaacaaaaaaaaaaaaaaaaacgtaaacgccacgaaaaaaaaacgaaaaataaaataataacgccgaaaaataaaataaaaaaaaaaatatataacgttacgcaatataaataaaaaaactaaaaaaaaaacgataaaaaccgcgcgtaattactaaaaaaaaatcgcaacgacataaaatattttataaataataaacgatacgataataacgaacgaaattaataacgaataacccgtaaataaacgtaaatatttaaacgattaactacgaaaatacgacgaataccttaatacaaacccgaatataactataataaacctacgaataaacataccgacgacaaaatactctataaaacaaaattacacgcgcgacgcgaaatacgaaaaacgccttcgccaacgcacgaaaataaacgaacgataataaacccgaaacgcaattccatacccgaaaaaccgaatacgcaaccgaaaanaaacgccgcgccgcaccgaaaatcattaacaaaaaaaaaanaaacaaacacgacgcncgcgcgttaacgaacgcgcgaaaaaaaacgaacgaaaaaacgacgacgtaaaacgtaacgcgaaacgactaaaaaaaccgcgnaccactcaaccgatccttcctactattacgaataataataacaaaaaaatctaacactataaacacttaaacaaa

SEQ ID NO: 13957 - DNA, 752 bp, Artificial Sequence
  chemically treated genomic DNA (Homo sapiens) CpG-island No: 13957
ttgtcgtatttatttttttagattcgttacgtacgtatatggttcgtatttttgtacgttagttacgtttgtttaggttcgttacgttagggtttggtcgttttcggtttggattcggtttagattcgggtttgggttcgttatgttcgttcggttagttcgttagttcgatcgtagatagatagtcgtagatagtgttattattagtcgttatttttttatatatattttttatttaatttattttttttatacgcgttaattttatttttaatatttcgattttttatattaatatatttttataataattttattttattttttattttattatatattcgttttaacgattttcggttttattttattttatttacgtatttttatataatttacgttttaatttatttcgagtatttatgtatttattattattttttatatttaattatcgttaattttacgtatattttttatgatttattacggggatttagtattcgtatttacgttaattaaatgggttattaatatttttagagaaataaatatttttagtatacgtatttatcgttaattcgttttacgtttatttatttggggaattttcgattcggtatttcgatttatatttcggtattaagtaaaaatatttggtttcgtaattttttttaattttattttaatacgattttatatacggtatattacgataagaatgtagtcgtatataatttatattatatttt

SEQ ID NO: 13958 - DNA, 752 bp, Artificial Sequence
  chemically treated genomic DNA (Homo sapiens) CpG-island No: 13958
aaaatataatataaattatatacgactacattcttatcgtaatataccgtatataaaatcgtattaaaataaaattaaaaaaaattacgaaaccaaatatttttacttaataccgaaatataaatcgaaataccgaatcgaaaattccccaaataaataaacgtaaaacgaattaacgataaatacgtatactaaaaatatttatttctctaaaaatattaataacccatttaattaacgtaaatacgaatactaaatccccgtaataaatcataaaaaatatacgtaaaattaacgataattaaatataaaaaataataataaatacataaatactcgaaataaattaaaacgtaaattatataaaaatacgtaaataaaataaaataaaaccgaaaatcgttaaaacgaatatataataaaataaaaaataaaataaaattattataaaaatatattaatataaaaaatcgaaatattaaaaataaaattaacgcgtataaaaaaaataaattaaataaaaaatatatataaaaaaataacgactaataataacactatctacgactatctatctacgatcgaactaacgaactaaccgaacgaacataacgaacccaaacccgaatctaaaccgaatccaaaccgaaaacgaccaaaccctaacgtaacgaacctaaacaaacgtaactaacgtacaaaaatacgaaccatatacgtacgtaacgaatctaaaaaaataaatacgacaa

SEQ ID NO: 13959 - DNA, 752 bp, Artificial Sequence
  chemically treated genomic DNA (Homo sapiens) CpG-island No: 13959
aaaatgtgatgtgaattgtgtgcgattatatttttgtcgtggtgtatcgtatatggagtcgtgttggggtggagttaggggaggttgcggggttaggtgtttttatttggtgtcggggtgtgaatcgggatgtcgggtcgggggttttttaggtgggtgggcgtggggcgggttggcggtgagtgcgtgtgttaaaggtgtttgtttttttgggggtgttggtggtttatttggttggcgtgggtgcgggtattgggttttcgtggtgggttatggaaggtatgcgtggggttggcggtagttgggtgtggggggtggtggtggatgtatgagtgttcggagtggattggagcgtggattgtgtgggggtgcgtgggtggagtggggtggagtcggaggtcgttggagcgggtgtgtagtggaatgggaagtggaatggaattgttgtggaagtgtattggtgtggagggtcggggtgttgggggtgaggttggcgcgtgtggggagggtgagttgagtgaggagtgtgtgtggaggggtgacgattgatgatgatattatttacgattatttatttacgatcgagttagcgaattagtcgagcgagtatagcgaatttaagttcgagtttgagtcggatttaaatcggaagcggttaaattttagcgtaacgaatttgagtaaacgtagttgacgtatagaggtgcgagttatgtgcgtgcgtgacgggtttggggggataggtgcggtag

SEQ ID NO: 13960 - DNA, 752 bp, Artificial Sequence
  chemically treated genomic DNA (Homo sapiens) CpG-island No: 13960
ctaccgcacctatccccccaaacccgtcacgcacgcacataactcgcacctctatacgtcaactacgtttactcaaattcgttacgctaaaatttaaccgcttccgatttaaatccgactcaaactcgaacttaaattcgctatactcgctcgactaattcgctaactcgatcgtaaataaataatcgtaaataatatcatcatcaatcgtcacccctccacacacactcctcactcaactcaccctccccacacgcgccaacctcacccccaacaccccgaccctccacaccaatacacttccacaacaattccattccacttcccattccactacacacccgctccaacgacctccgactccaccccactccacccacgcacccccacacaatccacgctccaatccactccgaacactcatacatccaccaccaccccccacacccaactaccgccaaccccacgcataccttccataacccaccacgaaaacccaatacccgcacccacgccaaccaaataaaccaccaacacccccaaaaaaacaaacacctttaacacacgcactcaccgccaacccgccccacgcccacccacctaaaaaacccccgacccgacatcccgattcacaccccgacaccaaataaaaacacctaaccccgcaacctcccctaactccaccccaacacgactccatatacgatacaccacgacaaaaatataatcgcacacaattcacatcacatttt

SEQ ID NO: 13961 - DNA, 539 bp, Artificial Sequence
  chemically treated genomic DNA (Homo sapiens) CpG-island No: 13961
  misc_feature (346)..(346): n is either a, c, g or t
gacgttttgttatttaaatattttttgttattaatatcgtttgtcgtaattttatcgtattatcgttttcgttttatagtcgtggtacgtcgtcgttatatttaacggagcggatcgcgggttcgtatcgacgtttcggacgatattagtcgcgggtcgttttcgttcgcgtcgattcgcgtatcgcgtagtttgattttagcgtttcgtattacgcgatcgcggatatatatattatttattattcgatcgtcgacgttacggcgcggtcgtatcgcgttcgcgttttcgtattcgcgtttcgttcgttcgtttcgcgattttttttcgtcgttatcgcgcgttngcggcgacgacgttcgcgtagtacggtttattcgtcgcgcgacgcggttgttacggcgcgggcgtcgtcgtttcgcgtcgcgttcgacggcgttacgttcgcgtacgcgcgttcggttcgtatattcgtagttcgatatagcgtcgcgtcgcgcgagtatgacgtcgcgtcgtagttagcgttgtcgcgtttt

SEQ ID NO: 13962 - DNA, 539 bp, Artificial Sequence
  chemically treated genomic DNA (Homo sapiens) CpG-island No: 13962
  misc_feature (194)..(194): n is either a, c, g or t
aaaacgcgacaacgctaactacgacgcgacgtcatactcgcgcgacgcgacgctatatcgaactacgaatatacgaaccgaacgcgcgtacgcgaacgtaacgccgtcgaacgcgacgcgaaacgacgacgcccgcgccgtaacaaccgcgtcgcgcgacgaataaaccgtactacgcgaacgtcgtcgccgcnaacgcgcgataacgacgaaaaaaaatcgcgaaacgaacgaacgaaacgcgaatacgaaaacgcgaacgcgatacgaccgcgccgtaacgtcgacgatcgaataataaataatatatatatccgcgatcgcgtaatacgaaacgctaaaatcaaactacgcgatacgcgaatcgacgcgaacgaaaacgacccgcgactaatatcgtccgaaacgtcgatacgaacccgcgatccgctccgttaaatataacgacgacgtaccacgactataaaacgaaaacgataatacgataaaattacgacaaacgatattaataacaaaaaatatttaaataacaaaacgtc

SEQ ID NO: 13963 - DNA, 539 bp, Artificial Sequence
  chemically treated genomic DNA (Homo sapiens) CpG-island No: 13963
  misc_feature (194)..(194): n is either a, c, g or t
gaggcgcggtagcgttggttgcggcgcggcgttatgttcgcgcggcgcgacgttgtgtcggattgcgagtgtgcggatcgagcgcgcgtgcgcgagcgtggcgtcgtcgggcgcggcgcgaggcgacgacgttcgcgtcgtggtagtcgcgtcgcgcggcgagtaggtcgtgttgcgcgggcgtcgtcgtcgtnagcgcgcgatggcggcgggggagggtcgcggggcgggcgggcggggcgcgagtgcggaggcgcggacgcggtgcggtcgcgtcgtgacgtcggcggtcgggtggtgggtgatgtgtgtgttcgcggtcgcgtggtgcggggcgttgggattaggttgcgcggtgcgcgagtcggcgcgggcgggagcggttcgcggttggtgtcgttcggggcgtcggtgcgggttcgcggttcgtttcgttgggtgtggcggcggcgtgttacggttgtggggcgggggcggtgatgcggtagggttgcggtaggcggtgttagtagtaaggggtgtttaggtggtagggcgtt

SEQ ID NO: 13964 - DNA, 539 bp, Artificial Sequence
  chemically treated genomic DNA (Homo sapiens) CpG-island No: 13964
  misc_feature (346)..(346): n is either a, c, g or t
aacgccctaccacctaaacaccccttactactaacaccgcctaccgcaaccctaccgcatcaccgcccccgccccacaaccgtaacacgccgccgccacacccaacgaaacgaaccgcgaacccgcaccgacgccccgaacgacaccaaccgcgaaccgctcccgcccgcgccgactcgcgcaccgcgcaacctaatcccaacgccccgcaccacgcgaccgcgaacacacacatcacccaccacccgaccgccgacgtcacgacgcgaccgcaccgcgtccgcgcctccgcactcgcgccccgcccgcccgccccgcgaccctcccccgccgccatcgcgcgctnacgacgacgacgcccgcgcaacacgacctactcgccgcgcgacgcgactaccacgacgcgaacgtcgtcgcctcgcgccgcgcccgacgacgccacgctcgcgcacgcgcgctcgatccgcacactcgcaatccgacacaacgtcgcgccgcgcgaacataacgccgcgccgcaaccaacgctaccgcgcctc

SEQ ID NO: 13965 - DNA, 887 bp, Artificial Sequence
  chemically treated genomic DNA (Homo sapiens) CpG-island No: 13965
ttggacgtcgggtatttttattcgattgaagtgattttcgataagattttcgtcgttatgttgtatgtgtcgtagttgttgttgtacgttagtcgttcggttcgttgggatagcgattacgtagtgttgttggatgatgaaatttaggtaattgttagtgagattgtgcgttacgatttgtttgatcgggtgtatatcggttttgattttttcgatgtttttattaatcgtattgtcgcgtgggttattggtatacgtaatatgaaaaaagttttgttgcgtgcgttgttggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggattataggttggttatcgttgtaggtttgataagacgcggtagcgtcgtattaggtattgtgtacgattgtcggatgcggcgtaaacgttttattcggtatatattagttcggttgtagatttgataggcgaagcgtattagataacggttttagagtttaattgtttattcggtatgaa

SEQ ID NO: 13966 - DNA, 887 bp, Artificial Sequence
  chemically treated genomic DNA (Homo sapiens) CpG-island No: 13966
ttcataccgaataaacaattaaactctaaaaccgttatctaatacgcttcgcctatcaaatctacaaccgaactaatatataccgaataaaacgtttacgccgcatccgacaatcgtacacaatacctaatacgacgctaccgcgtcttatcaaacctacaacgataaccaacctataatccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattccaacaacgcacgcaacaaaacttttttcatattacgtataccaataacccacgcgacaatacgattaataaaaacatcgaaaaaatcaaaaccgatatacacccgatcaaacaaatcgtaacgcacaatctcactaacaattacctaaatttcatcatccaacaacactacgtaatcgctatcccaacgaaccgaacgactaacgtacaacaacaactacgacacatacaacataacgacgaaaatcttatcgaaaatcacttcaatcgaataaaaatacccgacgtccaa

SEQ ID NO: 13967 - DNA, 887 bp, Artificial Sequence
  chemically treated genomic DNA (Homo sapiens) CpG-island No: 13967
tttatgtcgaatgggtaattgaattttgaaatcgttgtttgatgcgtttcgtttgttaggtttataatcgggttaatgtatgtcggataaggcgtttacgtcgtattcggtaatcgtgtataatgtttgatgcgacgttgtcgcgttttattaggtttataacggtggttagtttgtagttcggataaggtatttgtgtcgtattcggtaattaatgtttgatgcgacgttgtcgcgttttattaggtttataattattgtcgatttgtaggtcggataaggtatttgtgtcgtattcggtaattaatgtttgatgcgacgttgtcgcgttttattaggtttataattgttgtcgattcgtaggtcggataaggcgttcgcgtcgtattcggtagtgtttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggttttagtaacgtacgtagtagggttttttttatattgcgtgtattaatgatttacgcggtaatgcggttgatagaggtatcgaagaagttaaggtcgatatgtattcggttaaatagatcgtgacgtataattttattggtaattgtttgggttttattatttagtagtattacgtgatcgttgttttagcgaatcggacggttgacgtgtagtagtaattgcggtatatatagtatggcggcggaaattttgtcggaaattattttagtcgggtggaagtgttcggcgtttag

SEQ ID NO: 13968 - DNA, 887 bp, Artificial Sequence
  chemically treated genomic DNA (Homo sapiens) CpG-island No: 13968
ctaaacgccgaacacttccacccgactaaaataatttccgacaaaatttccgccgccatactatatataccgcaattactactacacgtcaaccgtccgattcgctaaaacaacgatcacgtaatactactaaataataaaacccaaacaattaccaataaaattatacgtcacgatctatttaaccgaatacatatcgaccttaacttcttcgatacctctatcaaccgcattaccgcgtaaatcattaatacacgcaatataaaaaaaaccctactacgtacgttactaaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataaacactaccgaatacgacgcgaacgccttatccgacctacgaatcgacaacaattataaacctaataaaacgcgacaacgtcgcatcaaacattaattaccgaatacgacacaaataccttatccgacctacaaatcgacaataattataaacctaataaaacgcgacaacgtcgcatcaaacattaattaccgaatacgacacaaataccttatccgaactacaaactaaccaccgttataaacctaataaaacgcgacaacgtcgcatcaaacattatacacgattaccgaatacgacgtaaacgccttatccgacatacattaacccgattataaacctaacaaacgaaacgcatcaaacaacgatttcaaaattcaattacccattcgacataaa

SEQ ID NO: 13969 - DNA, 612 bp, Artificial Sequence
  chemically treated genomic DNA (Homo sapiens) CpG-island No: 13969
taacgtcgacgatatggtggatatcgtgtttatgaattttttgcggggcggttggttcggggcgggggtttgggtttttcgggttaggggggtgttttttcgcgttgtcgttcgttgtagttcgtttcgtaggaggtggtgtcgtacgggtattttcgtcgtttcgattattttttagaagagaggagcgttcgggatttgtttaagcgtttggaggcgtcgcggtcgtcggcggtgttggatttggtgtattcggtcgaacgtttggcgttggtttcggtcgcgcggttttcgcgtttcggcgtttgttttcgttgtggggcgttggttagtcgcgcgttttgttaggtttgtttttttttggacggtttgaatcgcggtcggtttcgtttggttatcggtaagggtcgtcgggggttggacgaggaggcgacgtcggggacgttcggggattcggttcgggtttttattttcgagatcgtttttattttttagcgatttcgggtttttcgtcgggattcgacgcgttcgggtgaggtttgtttgtaaatgatattgtgaataaattcgttattttatttggttttttatgtgaggtgggagggggatggg

SEQ ID NO: 13970 - DNA, 612 bp, Artificial Sequence
  chemically treated genomic DNA (Homo sapiens) CpG-island No: 13970
cccatccccctcccacctcacataaaaaaccaaataaaataacgaatttattcacaatatcatttacaaacaaacctcacccgaacgcgtcgaatcccgacgaaaaacccgaaatcgctaaaaaataaaaacgatctcgaaaataaaaacccgaaccgaatccccgaacgtccccgacgtcgcctcctcgtccaacccccgacgacccttaccgataaccaaacgaaaccgaccgcgattcaaaccgtccaaaaaaaaacaaacctaacaaaacgcgcgactaaccaacgccccacaacgaaaacaaacgccgaaacgcgaaaaccgcgcgaccgaaaccaacgccaaacgttcgaccgaatacaccaaatccaacaccgccgacgaccgcgacgcctccaaacgcttaaacaaatcccgaacgctcctctcttctaaaaaataatcgaaacgacgaaaatacccgtacgacaccacctcctacgaaacgaactacaacgaacgacaacgcgaaaaaacacccccctaacccgaaaaacccaaacccccgccccgaaccaaccgccccgcaaaaaattcataaacacgatatccaccatatcgtcgacgtta

SEQ ID NO: 13971 - DNA, 612 bp, Artificial Sequence
  chemically treated genomic DNA (Homo sapiens) CpG-island No: 13971
tttattttttttttattttatatggaaggttaggtaaggtaacgggtttatttatagtgttatttataggtagattttattcgggcgcgtcggatttcggcgggaggttcggagtcgttagaaggtggggacggtttcggaagtgggggttcgggtcggattttcgggcgttttcggcgtcgttttttcgtttagttttcggcggtttttgtcgatggttaggcggggtcgatcgcggtttaggtcgtttaggagggagtaggtttggtagagcgcgcggttggttagcgttttatagcgggggtaggcgtcggggcgcgggggtcgcgcggtcgaggttagcgttaggcgttcggtcgagtgtattaggtttagtatcgtcgacggtcgcggcgtttttaggcgtttgagtaggtttcgggcgttttttttttttgagaagtagtcgaggcggcggaagtgttcgtacggtattattttttgcgaggcgaattgtagcgggcggtagcgcggaagggtatttttttagttcggagagtttaggttttcgtttcgggttagtcgtttcgtaggaagtttatgagtacggtgtttattatgtcgtcggcgttg

SEQ ID NO: 13972 - DNA, 612 bp, Artificial Sequence
  chemically treated genomic DNA (Homo sapiens) CpG-island No: 13972
caacgccgacgacataataaacaccgtactcataaacttcctacgaaacgactaacccgaaacgaaaacctaaactctccgaactaaaaaaatacccttccgcgctaccgcccgctacaattcgcctcgcaaaaaataataccgtacgaacacttccgccgcctcgactacttctcaaaaaaaaaaaacgcccgaaacctactcaaacgcctaaaaacgccgcgaccgtcgacgatactaaacctaatacactcgaccgaacgcctaacgctaacctcgaccgcgcgacccccgcgccccgacgcctacccccgctataaaacgctaaccaaccgcgcgctctaccaaacctactccctcctaaacgacctaaaccgcgatcgaccccgcctaaccatcgacaaaaaccgccgaaaactaaacgaaaaaacgacgccgaaaacgcccgaaaatccgacccgaacccccacttccgaaaccgtccccaccttctaacgactccgaacctcccgccgaaatccgacgcgcccgaataaaatctacctataaataacactataaataaacccgttaccttacctaaccttccatataaaataaaaaaaaaataaa

SEQ ID NO: 13973 - DNA, 662 bp, Artificial Sequence
  chemically treated genomic DNA (Homo sapiens) CpG-island No: 13973
tagtttatcgaattttcgagcgttttgaaggttgtgtatatgatttcgcgtttgtcgttttagcgttgcgttacgtatacgtatttgcgagtttttattagcgtttttattgttagtcgtttaggatttttcgtttttatttttcgataggtttcggcgtttatcgcgttcgtcgtcgcgggtttttagggttggtggtagttgtcgttttatacgtacgtggcggggttttcgttagcgaagatttcgcggaatatgtcgattatgtagaggttttcggcgcggttgttatttattattatgaggacgcgtagtcgcgcgcgcgggtatagtagggcgcgggcggacgttaggtattggcgtaggtacgcggggtttttttggtaggcggagatggttagcgttatattgcgcgcggtggttgtatttagcggttttcgcgtcgtcgtcgttattcgtcggtgttttaggtacgcgaagaggttttgcgttattaggtgcgttgaaaggaaggtttcgtagaggtcgaaggttaggaggtcgtagcgatcggaggttagcggtatttcggcggcgtaggtttaggttatgaggtttaggatgagtagggcgaaggcgatggttagtatttttcgggttaggtcggagtagcggtaggttgt

SEQ ID NO: 13974 - DNA, 662 bp, Artificial Sequence
  chemically treated genomic DNA (Homo sapiens) CpG-island No: 13974
acaacctaccgctactccgacctaacccgaaaaatactaaccatcgccttcgccctactcatcctaaacctcataacctaaacctacgccgccgaaataccgctaacctccgatcgctacgacctcctaaccttcgacctctacgaaaccttcctttcaacgcacctaataacgcaaaacctcttcgcgtacctaaaacaccgacgaataacgacgacgacgcgaaaaccgctaaatacaaccaccgcgcgcaatataacgctaaccatctccgcctaccaaaaaaaccccgcgtacctacgccaatacctaacgtccgcccgcgccctactatacccgcgcgcgcgactacgcgtcctcataataataaataacaaccgcgccgaaaacctctacataatcgacatattccgcgaaatcttcgctaacgaaaaccccgccacgtacgtataaaacgacaactaccaccaaccctaaaaacccgcgacgacgaacgcgataaacgccgaaacctatcgaaaaataaaaacgaaaaatcctaaacgactaacaataaaaacgctaataaaaactcgcaaatacgtatacgtaacgcaacgctaaaacgacaaacgcgaaatcatatacacaaccttcaaaacgctcgaaaattcgataaacta

SEQ ID NO: 13975 - DNA, 662 bp, Artificial Sequence
  chemically treated genomic DNA (Homo sapiens) CpG-island No: 13975
gtagtttgtcgttgtttcggtttggttcggagggtgttgattatcgttttcgttttgtttattttgggttttatgatttgggtttacgtcgtcggggtgtcgttggttttcgatcgttacggttttttggttttcggtttttacggggttttttttttagcgtatttggtggcgtagagttttttcgcgtatttggagtatcggcgggtggcggcggcggcgcgggggtcgttggatgtagttatcgcgcgtagtgtggcgttgattattttcgtttattaggaggatttcgcgtatttgcgttagtgtttggcgttcgttcgcgttttgttgtattcgcgcgcgcggttgcgcgtttttatggtggtggatggtaatcgcgtcgaggatttttatatggtcgatatgtttcgcgaggttttcgttgacgaggatttcgttacgtacgtgtgggacggtaattattattagttttgggaattcgcggcggcgggcgcggtgggcgtcggagtttatcgggaggtggaggcggaggattttgggcggttggtagtggaggcgttggtgaggattcgtaggtgcgtgtgcgtggcgtagcgttggggcggtaagcgcgaggttatgtatatagtttttaaggcgttcggagattcggtggatta

SEQ ID NO: 13976 - DNA, 662 bp, Artificial Sequence
  chemically treated genomic DNA (Homo sapiens) CpG-island No: 13976
taatccaccgaatctccgaacgccttaaaaactatatacataacctcgcgcttaccgccccaacgctacgccacgcacacgcacctacgaatcctcaccaacgcctccactaccaaccgcccaaaatcctccgcctccacctcccgataaactccgacgcccaccgcgcccgccgccgcgaattcccaaaactaataataattaccgtcccacacgtacgtaacgaaatcctcgtcaacgaaaacctcgcgaaacatatcgaccatataaaaatcctcgacgcgattaccatccaccaccataaaaacgcgcaaccgcgcgcgcgaatacaacaaaacgcgaacgaacgccaaacactaacgcaaatacgcgaaatcctcctaataaacgaaaataatcaacgccacactacgcgcgataactacatccaacgacccccgcgccgccgccgccacccgccgatactccaaatacgcgaaaaaactctacgccaccaaatacgctaaaaaaaaaaccccgtaaaaaccgaaaaccaaaaaaccgtaacgatcgaaaaccaacgacaccccgacgacgtaaacccaaatcataaaacccaaaataaacaaaacgaaaacgataatcaacaccctccgaaccaaaccgaaacaacgacaaactac

SEQ ID NO: 13977 - DNA, 637 bp, Artificial Sequence
  chemically treated genomic DNA (Homo sapiens) CpG-island No: 13977
  misc_feature (9)..(9): n is either a, c, g or t
tgttgtttncgggggggggggagggcgacgaagggttttttgtgggttggcggtgtacgatgggggcgttttcggtttggggtggtcgtgtggtgatagtggcgttttcgtttttaggcggtgcgggggttgtttgtttggtttttttttggtcgtatacgtttgtttttttcggggttcgcgtggggcggtttttcgcggtgtcggggtgttttcgcggggtcgtcgcggtggttcgcgttttcgcggggcgcgtcgtttttttttattggcggtcgtcggcgcgcggcgcgtcgttcgaaggcgggggcgcggttcgggggggggggcgtggttttgcgggcgttatcggggatgcgtgcgttttttttttcggcgtcgcgtcgaatatagaggggcgtgtgcggcggtggggcgtttttcgttttcgtcggtgcggatgggcggggggtggcggggggcggggtcggtttttcgcgcgggcggggttttcgggcgggttacgcgcggcgggcgtgtgagttcgggttcgcgtttcgtgcggtgggcgtggggcgcggggtgtcgattgtcgtcggtatatttcgcgggtgcggtcggtacgggagtatcgagagggacgttcgcgttagttcgt

SEQ ID NO: 13978 - DNA, 637 bp, Artificial Sequence
  chemically treated genomic DNA (Homo sapiens) CpG-island No: 13978
  misc_feature (629)..(629): n is either a, c, g or t
acgaactaacgcgaacgtccctctcgatactcccgtaccgaccgcacccgcgaaatataccgacgacaatcgacaccccgcgccccacgcccaccgcacgaaacgcgaacccgaactcacacgcccgccgcgcgtaacccgcccgaaaaccccgcccgcgcgaaaaaccgaccccgccccccgccaccccccgcccatccgcaccgacgaaaacgaaaaacgccccaccgccgcacacgcccctctatattcgacgcgacgccgaaaaaaaaaacgcacgcatccccgataacgcccgcaaaaccacgcccccccccccgaaccgcgcccccgccttcgaacgacgcgccgcgcgccgacgaccgccaataaaaaaaaacgacgcgccccgcgaaaacgcgaaccaccgcgacgaccccgcgaaaacaccccgacaccgcgaaaaaccgccccacgcgaaccccgaaaaaaacaaacgtatacgaccaaaaaaaaaccaaacaaacaacccccgcaccgcctaaaaacgaaaacgccactatcaccacacgaccaccccaaaccgaaaacgcccccatcgtacaccgccaacccacaaaaaacccttcgtcgccctcccccccccccgnaaacaaca

SEQ ID NO: 13979 - DNA, 637 bp, Artificial Sequence
  chemically treated genomic DNA (Homo sapiens) CpG-island No: 13979
  misc_feature (629)..(629): n is either a, c, g or t
gcgggttggcgcgggcgtttttttcggtgttttcgtgtcgatcgtattcgcggggtatgtcgacggtaatcggtatttcgcgttttacgtttatcgtacggggcgcgaattcgggtttatacgttcgtcgcgcgtaattcgttcggggatttcgttcgcgcggggaatcggtttcgtttttcgttatttttcgtttattcgtatcggcggaagcggggggcgttttatcgtcgtatacgtttttttatattcggcgcggcgtcgggggggggggcgtacgtattttcggtggcgttcgtagggttacgttttttttttcgggtcgcgttttcgttttcgaacggcgcgtcgcgcgtcgacggtcgttaatgagggagggcggcgcgtttcgcgggggcgcggattatcgcggcggtttcgcgggggtatttcgatatcgcgaagggtcgttttacgcggatttcgaagaaggtagacgtgtgcggttaaaagggggttaagtagatagttttcgtatcgtttggggacgggggcgttattgttattatacgattattttaggtcggaggcgtttttatcgtatatcgttagtttataaggaatttttcgtcgttttttttttttttcgnaaataata

SEQ ID NO: 13980 - DNA, 637 bp, Artificial Sequence
  chemically treated genomic DNA (Homo sapiens) CpG-island No: 13980
  misc_feature (9)..(9): n is either a, c, g or t
tattatttncgaaaaaaaaaaaaaacgacgaaaaattccttataaactaacgatatacgataaaaacgcctccgacctaaaataatcgtataataacaataacgcccccgtccccaaacgatacgaaaactatctacttaacccccttttaaccgcacacgtctaccttcttcgaaatccgcgtaaaacgacccttcgcgatatcgaaatacccccgcgaaaccgccgcgataatccgcgcccccgcgaaacgcgccgccctccctcattaacgaccgtcgacgcgcgacgcgccgttcgaaaacgaaaacgcgacccgaaaaaaaaaacgtaaccctacgaacgccaccgaaaatacgtacgcccccccccccgacgccgcgccgaatataaaaaaacgtatacgacgataaaacgccccccgcttccgccgatacgaataaacgaaaaataacgaaaaacgaaaccgattccccgcgcgaacgaaatccccgaacgaattacgcgcgacgaacgtataaacccgaattcgcgccccgtacgataaacgtaaaacgcgaaataccgattaccgtcgacataccccgcgaatacgatcgacacgaaaacaccgaaaaaaacgcccgcgccaacccgc

SEQ ID NO: 13981 - DNA, 637 bp, Artificial Sequence
  chemically treated genomic DNA (Homo sapiens) CpG-island No: 13981
  misc_feature (315)..(315): n is either a, c, g or t
gtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtttcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggngtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacgggtcggcgttggatgatcgagcggtggtgttggggtcggatcgtgaaacgttgttgtgcgggggaaagcgttgtttgtcggtttgaggtttttgggttggtgatcggattgtgggggtttggggtcgaatgggtttgtgttttcggttagggtggtaatg

SEQ ID NO: 13982 - DNA, 637 bp, Artificial Sequence
  chemically treated genomic DNA (Homo sapiens) CpG-island No: 13982
  misc_feature (323)..(323): n is either a, c, g or t
cattaccaccctaaccgaaaacacaaacccattcgaccccaaacccccacaatccgatcaccaacccaaaaacctcaaaccgacaaacaacgctttcccccgcacaacaacgtttcacgatccgaccccaacaccaccgctcgatcatccaacgccgacccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgacnccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgaaacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcac

SEQ ID NO: 13983 - DNA, 637 bp, Artificial Sequence
  chemically treated genomic DNA (Homo sapiens) CpG-island No: 13983
  misc_feature (323)..(323): n is either a, c, g or t
tattgttattttgatcgaaaatataaatttattcggttttaggtttttataattcggttattaatttagaagttttaggtcggtagatagcgttttttttcgtataataacgttttacggttcgattttagtattatcgttcggttatttagcgtcgattcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtntcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgaagcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattat

SEQ ID NO: 13984 - DNA, 637 bp, Artificial Sequence
  chemically treated genomic DNA (Homo sapiens) CpG-island No: 13984
  misc_feature (315)..(315): n is either a, c, g or t
ataatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgcttcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacganaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgaatcgacgctaaataaccgaacgataatactaaaatcgaaccgtaaaacgttattatacgaaaaaaaacgctatctaccgacctaaaacttctaaattaataaccgaattataaaaacctaaaaccgaataaatttatattttcgatcaaaataacaata

SEQ ID NO: 13985 - DNA, 744 bp, Artificial Sequence
  chemically treated genomic DNA (Homo sapiens) CpG-island No: 13985
  misc_feature (595)..(595): n is either a, c, g or t
gacgtgtatgttattttcggtgatatcgattatgcgttgtttgataaaggcgtatatgtttcgttcggtatttgtttttcgggtaacgcggcgcgtttggtagcggtaaatttacgggagaaaattttgttttacggcgcgtaaatgttgggtgagttagtggtagatgtttaattggtaacgtcgggcgtcgtgcgcggtaagaaaggcgaagttagtttcggggatattgtttataaaggcgaaatcggtatcggttttggtttattggtgggaattggtagttatattacgtttgatttcgttttttcgtatggcgtaaatttcgttgaagttgtcgttaatacgcgtacgggtgaaattcgtttggataaattttacgttttgttggattgcggtatatcggttaatttagagttagcgttgggataaatttacggtgttattttgcgtgttatcggttatagtatgagcgaagagattatttatgacgtcgaaggttattcgttaacgcgtgatttacgtagttacggcgtatcgaaaattggtgatatttcgcgtgattttcgcgttgtgttggtgtcgagcgacgatnaagtcggttcgttcggggcgaaatcgatttcggaaatcggtgtaaatggcgtagtttcggcgattgttatcgtaatttacgatgtatgcggtatttggttacgcgaatggtattttatatcggagaaaatatttattgcgttggaaaaa

SEQ ID NO: 13986 - DNA, 744 bp, Artificial Sequence
  chemically treated genomic DNA (Homo sapiens) CpG-island No: 13986
  misc_feature (150)..(150): n is either a, c, g or t
tttttccaacgcaataaatattttctccgatataaaataccattcgcgtaaccaaataccgcatacatcgtaaattacgataacaatcgccgaaactacgccatttacaccgatttccgaaatcgatttcgccccgaacgaaccgacttnatcgtcgctcgacaccaacacaacgcgaaaatcacgcgaaatatcaccaattttcgatacgccgtaactacgtaaatcacgcgttaacgaataaccttcgacgtcataaataatctcttcgctcatactataaccgataacacgcaaaataacaccgtaaatttatcccaacgctaactctaaattaaccgatataccgcaatccaacaaaacgtaaaatttatccaaacgaatttcacccgtacgcgtattaacgacaacttcaacgaaatttacgccatacgaaaaaacgaaatcaaacgtaatataactaccaattcccaccaataaaccaaaaccgataccgatttcgcctttataaacaatatccccgaaactaacttcgcctttcttaccgcgcacgacgcccgacgttaccaattaaacatctaccactaactcacccaacatttacgcgccgtaaaacaaaattttctcccgtaaatttaccgctaccaaacgcgccgcgttacccgaaaaacaaataccgaacgaaacatatacgcctttatcaaacaacgcataatcgatatcaccgaaaataacatacacgtc

SEQ ID NO: 13987 - DNA, 744 bp, Artificial Sequence
  chemically treated genomic DNA (Homo sapiens) CpG-island No: 13987
  misc_feature (150)..(150): n is either a, c, g or t
tttttttagcgtagtgagtatttttttcggtgtgaaatgttattcgcgtaattagatgtcgtatgtatcgtgaattgcggtagtaatcgtcggagttgcgttatttatatcgattttcgagatcgatttcgtttcgaacgggtcgatttnatcgtcgttcggtattagtatagcgcggaaattacgcggaatgttattaattttcggtgcgtcgtaattgcgtaaattacgcgttaacgggtgattttcggcgttataaatgattttttcgtttatattgtggtcgatagtacgtagggtggtatcgtagatttgttttaacgttaattttggattgatcggtgtatcgtagtttagtaaggcgtagaatttatttaggcggattttattcgtacgcgtgttgacggtaattttagcgaagtttgcgttatacgggaaggcgaaattaggcgtgatataattgttagtttttattagtgaattaaagtcggtgtcggtttcgtttttatgggtaatattttcgaaattaatttcgttttttttgtcgcgtacgacgttcggcgttgttagttgaatatttgttattggtttatttaatatttgcgcgtcgtggaatagaattttttttcgtagatttatcgttgttaaacgcgtcgcgttattcgagaagtaagtatcggacgaggtatatgcgtttttattaaataacgtatgatcggtattatcggagataatatgtacgtt

SEQ ID NO: 13988 - DNA, 744 bp, Artificial Sequence
  chemically treated genomic DNA (Homo sapiens) CpG-island No: 13988
  misc_feature (595)..(595): n is either a, c, g or t
aacgtacatattatctccgataataccgatcatacgttatttaataaaaacgcatatacctcgtccgatacttacttctcgaataacgcgacgcgtttaacaacgataaatctacgaaaaaaaattctattccacgacgcgcaaatattaaataaaccaataacaaatattcaactaacaacgccgaacgtcgtacgcgacaaaaaaaacgaaattaatttcgaaaatattacccataaaaacgaaaccgacaccgactttaattcactaataaaaactaacaattatatcacgcctaatttcgccttcccgtataacgcaaacttcgctaaaattaccgtcaacacgcgtacgaataaaatccgcctaaataaattctacgccttactaaactacgatacaccgatcaatccaaaattaacgttaaaacaaatctacgataccaccctacgtactatcgaccacaatataaacgaaaaaatcatttataacgccgaaaatcacccgttaacgcgtaatttacgcaattacgacgcaccgaaaattaataacattccgcgtaatttccgcgctatactaataccgaacgacgatnaaatcgacccgttcgaaacgaaatcgatctcgaaaatcgatataaataacgcaactccgacgattactaccgcaattcacgatacatacgacatctaattacgcgaataacatttcacaccgaaaaaaatactcactacgctaaaaaaa

SEQ ID NO: 13989 - DNA, 602 bp, Artificial Sequence
  chemically treated genomic DNA (Homo sapiens) CpG-island No: 13989
ggcgattatttgacgttttggttttgtcgtttgcgtatttagcgtttgcggttatggcgttagttatcgaatcgtggttaaacgaatttaataggcgtacgtttgtcgtttattttttagtataacgtgtcgtttatatcgttggcgtattaacgttataggtgtaataattagcgttatcggcggttaaatatgtattaatttgttgcgttagtattattgcgggtgtaataggttttttcgttcggttttagttaaatcgtttagttttttgcgggcgtcgcggttatttttttagcgtttttattttagaaatttgcgtatcggtttttttttttattaatggaagtaatgtacgtagagtcgtatttgtatatcgtcgattagtgttatattttatttatgttgtgtagcgtcgtatgttggttgggttgtatattaatttgtatatgtattttggtatcggtcgggtcgataggcgcggttagggtaaattagcgtgtcgtagtagtaattaacgtgttacgggcgtatattatggtttggatatttgacgagaagtcgattaattcgggttatttaataattatacggattatcgt

SEQ ID NO: 13990 - DNA, 602 bp, Artificial Sequence
  chemically treated genomic DNA (Homo sapiens) CpG-island No: 13990
acgataatccgtataattattaaataacccgaattaatcgacttctcgtcaaatatccaaaccataatatacgcccgtaacacgttaattactactacgacacgctaatttaccctaaccgcgcctatcgacccgaccgataccaaaatacatatacaaattaatatacaacccaaccaacatacgacgctacacaacataaataaaatataacactaatcgacgatatacaaatacgactctacgtacattacttccattaataaaaaaaaaaaccgatacgcaaatttctaaaataaaaacgctaaaaaaataaccgcgacgcccgcaaaaaactaaacgatttaactaaaaccgaacgaaaaaacctattacacccgcaataatactaacgcaacaaattaatacatatttaaccgccgataacgctaattattacacctataacgttaatacgccaacgatataaacgacacgttatactaaaaaataaacgacaaacgtacgcctattaaattcgtttaaccacgattcgataactaacgccataaccgcaaacgctaaatacgcaaacgacaaaaccaaaacgtcaaataatcgcc

SEQ ID NO: 13991 - DNA, 602 bp, Artificial Sequence
  chemically treated genomic DNA (Homo sapiens) CpG-island No: 13991
acgataattcgtatgattgttggatgattcgggttaatcggtttttcgttaggtgtttagattatgatgtacgttcgtgatacgttgattgttattgcggtacgttaatttgttttgatcgcgtttgtcgattcgatcgatgttaaaatgtatgtgtagattgatatgtaatttagttagtatgcggcgttgtatagtataggtgggatatggtattggtcggcgatatgtaagtgcgattttgcgtgtattgtttttattggtggaagaaaaagtcgatgcgtaagtttttgggataaaggcgttgggaagatgatcgcgacgttcgtaaagggttggacgatttagttgaaatcgagcgagaaagtttattgtattcgtaatgatgttggcgtagtaaattagtgtatgtttggtcgtcgatgacgttgattgttgtatttgtgacgttggtacgttaacggtgtgggcggtacgttatgttgaaaaatgaacggtaagcgtgcgtttgttaggttcgtttaattacggttcgatggttaacgttatggtcgtaggcgttgggtgcgtaggcgatagagttagaacgttaggtggtcgtt

SEQ ID NO: 13992 - DNA, 602 bp, Artificial Sequence
  chemically treated genomic DNA (Homo sapiens) CpG-island No: 13992
aacgaccacctaacgttctaactctatcgcctacgcacccaacgcctacgaccataacgttaaccatcgaaccgtaattaaacgaacctaacaaacgcacgcttaccgttcatttttcaacataacgtaccgcccacaccgttaacgtaccaacgtcacaaatacaacaatcaacgtcatcgacgaccaaacatacactaatttactacgccaacatcattacgaatacaataaactttctcgctcgatttcaactaaatcgtccaaccctttacgaacgtcgcgatcatcttcccaacgcctttatcccaaaaacttacgcatcgactttttcttccaccaataaaaacaatacacgcaaaatcgcacttacatatcgccgaccaataccatatcccacctatactatacaacgccgcatactaactaaattacatatcaatctacacatacattttaacatcgatcgaatcgacaaacgcgatcaaaacaaattaacgtaccgcaataacaatcaacgtatcacgaacgtacatcataatctaaacacctaacgaaaaaccgattaacccgaatcatccaacaatcatacgaattatcgt

SEQ ID NO: 13993 - DNA, 1812 bp, Artificial Sequence
  chemically treated genomic DNA (Homo sapiens) CpG-island No: 13993
  misc_feature (679)..(679): n is either a, c, g or t
  misc_feature (1173)..(1173): n is either a, c, g or t
  misc_feature (1216)..(1216): n is either a, c, g or t
  misc_feature (1468)..(1468): n is either a, c, g or t
tatgtaaggttatacgcgttttaaggttagtattttttttattcgaatttaggtcgtaagtttcgatttttaacgtttttttattttttttcgtgttttcgcgtcgttcgtttttttttattacgtttattcggtttcgatttttttatcgtattttttcgttcgtcgacgacgtttgcgtttacgttttattttttatcgacggtataattttataaattattttagttattagtttcgcgcgttatagttatttttattattttcgttaattttttagttattttttcgcggtaagtttgcgcgttcgtcgaagtatttatttttgtcgcgtttatacgagttttcgattatttagtttttgcgttttatatatttaattcgagcgatttttttagtacgtatttcgtcgcggtttattcgtagtttttcgtaatttttcgttatatttattgcgttttattacgtttcggtttttttttgttttttgtaatatttgttttattttcgttttttattatattttcgtatttattatattatttatttacgtttcgcgtatacgttatttatatacgttcgtttaatacgttttttcgcgcgttcgttttttatattcgtacgttcgtacgttttatatttttttttatttttatattttcgttcgttttcgtcgttnttttattattgtatttcgtcgtcgtttgtttacgttttcgcgcgtatatatttttcgtttttcgtcgttttacgttttcgtttatttgtattattggtatattttcgtcgatatatattcggttagtttcgcgtgtcgtacgtacgcgtacgtcgttttttcgtcgtttaatttgcgcgtttcgtttaagcgcgttcgggatttttttttttttttttttattttacgttcgttcgtatcgggcgtcgatattacgttttgtattttcgttttttttttttatttcgttttttcgggtttttttgttagtacgacgttttttttacgtttatacgtagtcgttcgtttatcgtttcgcgttttttcgttttttacgttacggcgtcgtatataatttttttcggtttttcgtattttttttgcgtttttttcgtaatattttcggttataatatttttttttttattattattttataatacgatattacgttnttcgacgtattagcgcgtttcgacgttgttttgtttttttatntttttcggatattatacgacgtttttattttattttaatatagtaatcgttcgcgtattttttatacgttttaatacgcgcgtcgatttaatatattcgtttttattttagcgcgcgttatgtcgtttatttttatcgtttcgatatttattttattttatatattatacgttttttttgcgcgcgttcgtaggttcgttcgttattcgtttattataattcgcgtatatttcgtatatacgcgtacgtttntttcgtatttttacgtcgtttttgtttcgcggcgataacgttcgtcgcgatttcgttgcgcgacgattaaggtatagttttatttatcgtcgtatcggtattcgcggcgttatcgtttttcgttattttttttattcggtttacgtgttcgttatttttattttatatttcgttcgtcgttttaattcgtttcgttttattatttttttttttttattcgtttcgttttttatcgtttttatttttatatttcgtttttttcgttattattttttttcgtttttatatttttttatttttttttttcgttttttttaggtaaatgtattaaatgaggttaggta

SEQ ID NO: 13994 - DNA, 1812 bp, Artificial Sequence
  chemically treated genomic DNA (Homo sapiens) CpG-island No: 13994
  misc_feature (345)..(345): n is either a, c, g or t
  misc_feature (597)..(597): n is either a, c, g or t
  misc_feature (640)..(640): n is either a, c, g or t
  misc_feature (1134)..(1134): n is either a, c, g or t
tacctaacctcatttaatacatttacctaaaaaaaacgaaaaaaaaaaataaaaaaatataaaaacgaaaaaaaataataacgaaaaaaacgaaatataaaaataaaaacgataaaaaacgaaacgaataaaaaaaaaaaaataataaaacgaaacgaattaaaacgacgaacgaaatataaaataaaaataacgaacacgtaaaccgaataaaaaaaataacgaaaaacgataacgccgcgaataccgatacgacgataaataaaactataccttaatcgtcgcgcaacgaaatcgcgacgaacgttatcgccgcgaaacaaaaacgacgtaaaaatacgaaanaaacgtacgcgtatatacgaaatatacgcgaattataataaacgaataacgaacgaacctacgaacgcgcgcaaaaaaaacgtataatatataaaataaaataaatatcgaaacgataaaaataaacgacataacgcgcgctaaaataaaaacgaatatattaaatcgacgcgcgtattaaaacgtataaaaaatacgcgaacgattactatattaaaataaaataaaaacgtcgtataatatccgaaaaanataaaaaaacaaaacaacgtcgaaacgcgctaatacgtcgaanaacgtaatatcgtattataaaataataataaaaaaaaaaatattataaccgaaaatattacgaaaaaaacgcaaaaaaaatacgaaaaaccgaaaaaaattatatacgacgccgtaacgtaaaaaacgaaaaaacgcgaaacgataaacgaacgactacgtataaacgtaaaaaaaacgtcgtactaacaaaaaaacccgaaaaaacgaaataaaaaaaaaaaacgaaaatacaaaacgtaatatcgacgcccgatacgaacgaacgtaaaataaaaaaaaaaaaaaaaaaatcccgaacgcgcttaaacgaaacgcgcaaattaaacgacgaaaaaacgacgtacgcgtacgtacgacacgcgaaactaaccgaatatatatcgacgaaaatataccaataatacaaataaacgaaaacgtaaaacgacgaaaaacgaaaaatatatacgcgcgaaaacgtaaacaaacgacgacgaaatacaataataaaanaacgacgaaaacgaacgaaaatataaaaataaaaaaaaatataaaacgtacgaacgtacgaatataaaaaacgaacgcgcgaaaaaacgtattaaacgaacgtatataaataacgtatacgcgaaacgtaaataaataatataataaatacgaaaatataataaaaaacgaaaataaaacaaatattacaaaaaacaaaaaaaaaccgaaacgtaataaaacgcaataaatataacgaaaaattacgaaaaactacgaataaaccgcgacgaaatacgtactaaaaaaatcgctcgaattaaatatataaaacgcaaaaactaaataatcgaaaactcgtataaacgcgacaaaaataaatacttcgacgaacgcgcaaacttaccgcgaaaaaataactaaaaaattaacgaaaataataaaaataactataacgcgcgaaactaataactaaaataatttataaaattataccgtcgataaaaaataaaacgtaaacgcaaacgtcgtcgacgaacgaaaaaatacgataaaaaaatcgaaaccgaataaacgtaataaaaaaaaacgaacgacgcgaaaacacgaaaaaaaataaaaaaacgttaaaaatcgaaacttacgacctaaattcgaataaaaaaaatactaaccttaaaacgcgtataaccttacata

SEQ ID NO: 13995 - DNA, 1812 bp, Artificial Sequence
  chemically treated genomic DNA (Homo sapiens) CpG-island No: 13995
  misc_feature (345)..(345): n is either a, c, g or t
  misc_feature (597)..(597): n is either a, c, g or t
  misc_feature (640)..(640): n is either a, c, g or t
  misc_feature (1134)..(1134): n is either a, c, g or t
tatttaattttatttaatatatttatttagagagggcggggagggggggtgggggggtgtaagggcgggggggagtggtgacgggggaagcggggtgtggaggtgggggcggtggggagcgaggcgagtgggggaggaggggtggtgaggcggggcgagttggagcggcgggcggggtgtggggtgggggtagcgagtacgtgagtcgggtgaggggggtggcgggaggcggtgacgtcgcgggtgtcggtgcggcggtgggtggggttgtgttttggtcgtcgcgtagcggggtcgcggcgggcgttgtcgtcgcggggtagaggcggcgtaagagtgcggagngggcgtgcgcgtgtgtacgaggtgtgcgcgagttgtggtgggcgggtgacgggcgagtttgcggacgcgcgtagaaggaacgtgtgatgtgtggggtggagtgggtgtcgaggcggtgagggtgggcggtatggcgcgcgttggagtaggagcgggtgtgttgggtcggcgcgcgtgttggagcgtgtgggaggtgcgcgagcggttgttgtgttagagtagggtgggagcgtcgtgtggtgttcgaaggangtgagagagtagagtagcgtcgagacgcgttagtgcgtcgggnggcgtagtgtcgtgttgtggagtggtagtgagagggggagtgttgtggtcgggagtgttgcgggagaagcgtagggggagtgcgaagagtcgaggggagttgtgtgcggcgtcgtggcgtggggggcgaggagacgcgaggcggtgggcgagcggttgcgtgtgggcgtagggagagcgtcgtgttgataggggggttcgaaggggcggggtgagagagggaggcgagaatgtagggcgtggtgtcggcgttcggtgcggacgagcgtggggtggagagagggagagagaggtttcgagcgcgtttgggcggggcgcgtagattgagcggcgagagagcgacgtgcgcgtgcgtgcgatacgcggagttggtcgagtgtgtgtcgacgggagtgtgttaatggtataggtgggcgagggcgtggggcggcgggaggcgaggggtgtgtgcgcgcgggagcgtaggtagacgacggcggggtgtagtggtggganggcggcgagagcgggcgagagtgtgagagtgggagagggtgtgaggcgtgcgagcgtgcgagtgtgaggggcgagcgcgcggaggggcgtgttgagcgagcgtgtgtgagtggcgtgtgcgcggggcgtgggtgagtggtgtggtgggtgcgagagtgtggtgggaggcgggagtgagataagtgttgtagggagtaggggaagatcgaggcgtagtggagcgtagtgagtgtagcggagagttgcggagggttgcgggtgagtcgcggcgggatgcgtgttgaggaggtcgttcgagttgagtgtgtggggcgtaggggttgggtggtcgagagttcgtgtgggcgcggtagaggtggatgtttcgacgagcgcgtaggtttgtcgcgaagaggtggttgggagattgacgagggtggtggaggtggttgtggcgcgcgggattgatggttgggatagtttgtggggttgtatcgtcggtggagggtgggacgtgggcgtaggcgtcgtcggcgggcgggggggtgcggtggggaggtcggggtcgagtgggcgtggtgggggggggcgggcggcgcgggggtacgggggggggtgggggggcgttaggggtcggaatttacgatttgagttcgggtaagggaagtgttggttttaagacgcgtgtggttttgtatg

SEQ ID NO: 13996 - DNA, 1812 bp, Artificial Sequence
  chemically treated genomic DNA (Homo sapiens) CpG-island No: 13996
  misc_feature (679)..(679): n is either a, c, g or t
  misc_feature (1173)..(1173): n is either a, c, g or t
  misc_feature (1216)..(1216): n is either a, c, g or t
  misc_feature (1468)..(1468): n is either a, c, g or t
catacaaaaccacacgcgtcttaaaaccaacacttcccttacccgaactcaaatcgtaaattccgacccctaacgcccccccacccccccccgtacccccgcgccgcccgcccccccccaccacgcccactcgaccccgacctccccaccgcacccccccgcccgccgacgacgcctacgcccacgtcccaccctccaccgacgatacaaccccacaaactatcccaaccatcaatcccgcgcgccacaaccacctccaccaccctcgtcaatctcccaaccacctcttcgcgacaaacctacgcgctcgtcgaaacatccacctctaccgcgcccacacgaactctcgaccacccaacccctacgccccacacactcaactcgaacgacctcctcaacacgcatcccgccgcgactcacccgcaaccctccgcaactctccgctacactcactacgctccactacgcctcgatcttcccctactccctacaacacttatctcactcccgcctcccaccacactctcgcacccaccacaccactcacccacgccccgcgcacacgccactcacacacgctcgctcaacacgcccctccgcgcgctcgcccctcacactcgcacgctcgcacgcctcacaccctctcccactctcacactctcgcccgctctcgccgccntcccaccactacaccccgccgtcgtctacctacgctcccgcgcgcacacacccctcgcctcccgccgccccacgccctcgcccacctataccattaacacactcccgtcgacacacactcgaccaactccgcgtatcgcacgcacgcgcacgtcgctctctcgccgctcaatctacgcgccccgcccaaacgcgctcgaaacctctctctccctctctccaccccacgctcgtccgcaccgaacgccgacaccacgccctacattctcgcctccctctctcaccccgccccttcgaacccccctatcaacacgacgctctccctacgcccacacgcaaccgctcgcccaccgcctcgcgtctcctcgccccccacgccacgacgccgcacacaactcccctcgactcttcgcactccccctacgcttctcccgcaacactcccgaccacaacactccccctctcactaccactccacaacacgacactacgccncccgacgcactaacgcgtctcgacgctactctactctctcacntccttcgaacaccacacgacgctcccaccctactctaacacaacaaccgctcgcgcacctcccacacgctccaacacgcgcgccgacccaacacacccgctcctactccaacgcgcgccataccgcccaccctcaccgcctcgacacccactccaccccacacatcacacgttccttctacgcgcgtccgcaaactcgcccgtcacccgcccaccacaactcgcgcacacctcgtacacacgcgcacgcccnctccgcactcttacgccgcctctaccccgcgacgacaacgcccgccgcgaccccgctacgcgacgaccaaaacacaaccccacccaccgccgcaccgacacccgcgacgtcaccgcctcccgccacccccctcacccgactcacgtactcgctacccccaccccacaccccgcccgccgctccaactcgccccgcctcaccacccctcctcccccactcgcctcgctccccaccgcccccacctccacaccccgcttcccccgtcaccactcccccccgcccttacacccccccaccccccctccccgccctctctaaataaatatattaaataaaattaaata

SEQ ID NO: 13997 - DNA, 604 bp, Artificial Sequence
  chemically treated genomic DNA (Homo sapiens) CpG-island No: 13997
tcgtttatttttgcgttcgaggatgcgttcgtggtgtcgtattcgattattatttgcgaggaggatgcgttcgtcgagtcgtattcgtttattatttgcgtaggaggtgcgttcgtcgagtcgtattcgtttattaattgcgtaggaggatgcgttgtcgagtcgtattcgtttattatttgcgtaggaggatgcgttcgtcgagcgtattcgttgattatttgcgtaggaggatgcgttcgtcgagtcgtatcgtttattatttgtatacgaagatgcgttcgtcgagtcgtattcgtttatatttgcgtaggaggatgcgttcgtcgagtcgtattcgtttattatttgttaggaggatgcgttcggcgagtcgtatacggttattattttatacgagacgttcgcgagtgtacggtgattttttcggcgagatgttttaggtttatatttagtggcgtaagtagttggaggtacgaggtttttttagtttttcgagtatagcgtttttatatggttttacgtcgttttttgagttagtattaaggttatttttcgtattagggaatcggattttcgcgtttattggtgaacgtttaagata

SEQ ID NO: 13998 - DNA, 604 bp, Artificial Sequence
  chemically treated genomic DNA (Homo sapiens) CpG-island No: 13998
tatcttaaacgttcaccaataaacgcgaaaatccgattccctaatacgaaaaataaccttaatactaactcaaaaaacgacgtaaaaccatataaaaacgctatactcgaaaaactaaaaaaacctcgtacctccaactacttacgccactaaatataaacctaaaacatctcgccgaaaaaatcaccgtacactcgcgaacgtctcgtataaaataataaccgtatacgactcgccgaacgcatcctcctaacaaataataaacgaatacgactcgacgaacgcatcctcctacgcaaatataaacgaatacgactcgacgaacgcatcttcgtatacaaataataaacgatacgactcgacgaacgcatcctcctacgcaaataatcaacgaatacgctcgacgaacgcatcctcctacgcaaataataaacgaatacgactcgacaacgcatcctcctacgcaattaataaacgaatacgactcgacgaacgcacctcctacgcaaataataaacgaatacgactcgacgaacgcatcctcctcgcaaataataatcgaatacgacaccacgaacgcatcctcgaacgcaaaaataaacga

SEQ ID NO: 13999 - DNA, 604 bp, Artificial Sequence
  chemically treated genomic DNA (Homo sapiens) CpG-island No: 13999
tattttaggcgtttattagtaggcgcgaaggttcggttttttagtgcgaagaatggttttaatgttaatttaggaaacgacgtgaaattatgtaaaggcgttatgttcggagggttagaggggtttcgtgtttttagttgtttacgttattgaatataggtttgaggtatttcgtcgaaagggttatcgtgtattcgcgaacgtttcgtatgaaatggtaatcgtgtgcgattcgtcgaacgtatttttttagtaaatggtgaacgggtgcgattcgacgaacgtatttttttacgtaaatgtgaacgggtgcgattcgacgaacgtattttcgtatgtaaatggtgaacggtgcgattcgacgaacgtatttttttacgtaaatggttaacgggtgcgttcgacgaacgtatttttttacgtaaatggtgaacgggtgcgattcgataacgtatttttttacgtaattggtgaacgggtgcgattcgacgaacgtattttttacgtaaatggtgaacgggtgcgattcgacgaacgtatttttttcgtaaatggtgatcgggtgcgatattacgaacgtattttcgaacgtaaaggtgaacgg

SEQ ID NO: 14000 - DNA, 604 bp, Artificial Sequence
  chemically treated genomic DNA (Homo sapiens) CpG-island No: 14000
ccgttcacctttacgttcgaaaatacgttcgtaatatcgcacccgatcaccatttacgaaaaaaatacgttcgtcgaatcgcacccgttcaccatttacgtaaaaaatacgttcgtcgaatcgcacccgttcaccaattacgtaaaaaaatacgttatcgaatcgcacccgttcaccatttacgtaaaaaaatacgttcgtcgaacgcacccgttaaccatttacgtaaaaaaatacgttcgtcgaatcgcaccgttcaccatttacatacgaaaatacgttcgtcgaatcgcacccgttcacatttacgtaaaaaaatacgttcgtcgaatcgcacccgttcaccatttactaaaaaaatacgttcgacgaatcgcacacgattaccatttcatacgaaacgttcgcgaatacacgataaccctttcgacgaaatacctcaaacctatattcaataacgtaaacaactaaaaacacgaaacccctctaaccctccgaacataacgcctttacataatttcacgtcgtttcctaaattaacattaaaaccattcttcgcactaaaaaaccgaaccttcgcgcctactaataaacgcctaaaata

SEQ ID NO: 14001 - DNA, 787 bp, Artificial Sequence
  chemically treated genomic DNA (Homo sapiens) CpG-island No: 14001
  misc_feature (141)..(141): n is either a, c, g or t
  misc_feature (189)..(189): n is either a, c, g or t
  misc_feature (276)..(276): n is either a, c, g or t
  misc_feature (398)..(398): n is either a, c, g or t
  misc_feature (418)..(418): n is either a, c, g or t
  misc_feature (431)..(431): n is either a, c, g or t
cggtggtcggcgtaacggtatttaagagggttatttatcgcgatttttttaagattagcggagttaattcgagcgacgaatcgaatatgttcgcgtttaattggtgatcggtatcgatttttgcgttcgtaattggtttgntagggcgtaatattattggaagtttcgtaatgttacgtgtttgtattntcgggggattcggttatgtcgtattagcgggttgtcgtataaaaattagagtagacgttagatttagtagagtttatgcgcgttgtntagggtatttagcggatcggaaaatcggcgttttatttttttgtgggtttgtatacggtgtgatggtagaatagtttggcgtattgggtttgttcgcgttttgaaattggagcgtgttgagngtaaagaggagggagggtgnaaatagtcgtttnaatggatattgtagggcgattggcgtgggttcgacgattcgtgtgaggaattgacgattttaattaatttgtgaatcggttcgttatagttgcggtatgatttgaattatcgattataatagttagtaagatttcgggggtttagtatacgaatttacggattggtgagttataagggatattggggcggtgttaaacggatagtaggtgtggtggttttaggaaagattgcggaatttcggtatgttagggcgggttcgtgtagtacggtatgtatcgtcgtgggatgtttattttgttgtgtaattaagcggaatggtttatatcgttggtttggtaaatatatattaacggga

SEQ ID NO: 14002 - DNA, 787 bp, Artificial Sequence
  chemically treated genomic DNA (Homo sapiens) CpG-island No: 14002
  misc_feature (357)..(357): n is either a, c, g or t
  misc_feature (370)..(370): n is either a, c, g or t
  misc_feature (390)..(390): n is either a, c, g or t
  misc_feature (512)..(512): n is either a, c, g or t
  misc_feature (599)..(599): n is either a, c, g or t
  misc_feature (647)..(647): n is either a, c, g or t
tcccgttaatatatatttaccaaaccaacgatataaaccattccgcttaattacacaacaaaataaacatcccacgacgatacataccgtactacacgaacccgccctaacataccgaaattccgcaatctttcctaaaaccaccacacctactatccgtttaacaccgccccaatatcccttataactcaccaatccgtaaattcgtatactaaacccccgaaatcttactaactattataatcgataattcaaatcataccgcaactataacgaaccgattcacaaattaattaaaatcgtcaattcctcacacgaatcgtcgaacccacgccaatcgccctacaatatccattnaaacgactatttncaccctccctcctctttacnctcaacacgctccaatttcaaaacgcgaacaaacccaatacgccaaactattctaccatcacaccgtatacaaacccacaaaaaaataaaacgccgattttccgatccgctaaataccctanacaacgcgcataaactctactaaatctaacgtctactctaatttttatacgacaacccgctaatacgacataaccgaatcccccganaatacaaacacgtaacattacgaaacttccaataatattacgccctancaaaccaattacgaacgcaaaaatcgataccgatcaccaattaaacgcgaacatattcgattcgtcgctcgaattaactccgctaatcttaaaaaaatcgcgataaataaccctcttaaataccgttacgccgaccaccg

SEQ ID NO: 14003 - DNA, 787 bp, Artificial Sequence
  chemically treated genomic DNA (Homo sapiens) CpG-island No: 14003
  misc_feature (357)..(357): n is either a, c, g or t
  misc_feature (370)..(370): n is either a, c, g or t
  misc_feature (390)..(390): n is either a, c, g or t
  misc_feature (512)..(512): n is either a, c, g or t
  misc_feature (599)..(599): n is either a, c, g or t
  misc_feature (647)..(647): n is either a, c, g or t
tttcgttgatgtatatttgttaaattagcgatgtaagttatttcgtttaattgtatagtaaggtgaatattttacggcggtatatgtcgtgttgtacgggttcgttttgatatatcgaaatttcgtaattttttttaggattattatatttgttgttcgtttggtatcgttttaatattttttgtggtttattaattcgtgaattcgtgtattaggttttcggggttttattggttgttatgatcggtgatttaggttatgtcgtaattgtagcgggtcggtttatagattaattggagtcgttaattttttatacgggtcgtcggatttacgttaatcgttttgtaatgtttattngggcggttatttntatttttttttttttttgtntttagtacgttttagttttagggcgcgagtagatttagtgcgttaagttattttattattatatcgtatgtagatttatagagaggtgagacgtcggtttttcgattcgttaaatgttttangtaacgcgtataaattttgttggatttggcgtttattttggtttttatgcgatagttcgttaatacggtatggtcgggtttttcgangatgtaggtacgtagtattacgaggtttttaatgatattgcgttttgntaagttaattacgagcgtaaaggtcggtgtcggttattaattgaacgcggatatattcgattcgtcgttcgaattgatttcgttaattttggaaggatcgcgataagtggtttttttgaatatcgttacgtcgattatcg

SEQ ID NO: 14004 - DNA, 787 bp, Artificial Sequence
  chemically treated genomic DNA (Homo sapiens) CpG-island No: 14004
  misc_feature (141)..(141): n is either a, c, g or t
  misc_feature (189)..(189): n is either a, c, g or t
  misc_feature (276)..(276): n is either a, c, g or t
  misc_feature (398)..(398): n is either a, c, g or t
  misc_feature (418)..(418): n is either a, c, g or t
  misc_feature (431)..(431): n is either a, c, g or t
cgataatcgacgtaacgatattcaaaaaaaccacttatcgcgatccttccaaaattaacgaaatcaattcgaacgacgaatcgaatatatccgcgttcaattaataaccgacaccgacctttacgctcgtaattaacttancaaaacgcaatatcattaaaaacctcgtaatactacgtacctacatcntcgaaaaacccgaccataccgtattaacgaactatcgcataaaaaccaaaataaacgccaaatccaacaaaatttatacgcgttacntaaaacatttaacgaatcgaaaaaccgacgtctcacctctctataaatctacatacgatataataataaaataacttaacgcactaaatctactcgcgccctaaaactaaaacgtactaaanacaaaaaaaaaaaaaaatanaaataaccgcccnaataaacattacaaaacgattaacgtaaatccgacgacccgtataaaaaattaacgactccaattaatctataaaccgacccgctacaattacgacataacctaaatcaccgatcataacaaccaataaaaccccgaaaacctaatacacgaattcacgaattaataaaccacaaaaaatattaaaacgataccaaacgaacaacaaatataataatcctaaaaaaaattacgaaatttcgatatatcaaaacgaacccgtacaacacgacatataccgccgtaaaatattcaccttactatacaattaaacgaaataacttacatcgctaatttaacaaatatacatcaacgaaa

SEQ ID NO: 14005 - DNA, 568 bp, Artificial Sequence
  chemically treated genomic DNA (Homo sapiens) CpG-island No: 14005
aaggcgtagtagttattatcgttatcggtttttgtttgcgtggggcggtgttgtcgtagttggagttaatttaattggcgtagtagtttgtaagaagttttgttaggtaaaatcgttattaatatttcgggttttcgtcgaattcgtataattttttcgcgatcgttgcgtatattattattacggtaaatcgtcgaaattggatgataaaaatcgttcgattttcgtttaggtcgtttgatttacgaatattgcgaacgtcgttcgtatttcgatgttgtcgttttgttaaagagttcggtgatgaagggtatcgcgaaggttggtgttgtattattcgggtgtaagggtagaaattacggtattgattagttgaaacgcgatgtggcggggtggcgggggattggtatttgtatggtgacgaaagatcggttttaggtttttagtgtatcgcgaaaaggcgtttataacgggtagaaaggggagtttatttgtgtcgggatggtacgtttaaaggaggtataaaatcgaagaataattggtggcgtgtcgttttttttttataacg

SEQ ID NO: 14006 - DNA, 568 bp, Artificial Sequence
  chemically treated genomic DNA (Homo sapiens) CpG-island No: 14006
cgttataaaaaaaaaacgacacgccaccaattattcttcgattttatacctcctttaaacgtaccatcccgacacaaataaactcccctttctacccgttataaacgccttttcgcgatacactaaaaacctaaaaccgatctttcgtcaccatacaaataccaatcccccgccaccccgccacatcgcgtttcaactaatcaataccgtaatttctacccttacacccgaataatacaacaccaaccttcgcgatacccttcatcaccgaactctttaacaaaacgacaacatcgaaatacgaacgacgttcgcaatattcgtaaatcaaacgacctaaacgaaaatcgaacgatttttatcatccaatttcgacgatttaccgtaataataatatacgcaacgatcgcgaaaaaattatacgaattcgacgaaaacccgaaatattaataacgattttacctaacaaaacttcttacaaactactacgccaattaaattaactccaactacgacaacaccgccccacgcaaacaaaaaccgataacgataataactactacgcctt

SEQ ID NO: 14007 - DNA, 568 bp, Artificial Sequence
  chemically treated genomic DNA (Homo sapiens) CpG-island No: 14007
cgttatgaaaagagagcggtacgttattaattatttttcggttttgtgttttttttggacgtattatttcgatataggtaagtttttttttttattcgttgtaagcgttttttcgcggtgtattgagaatttaggatcgatttttcgttattatgtaggtattaatttttcgttatttcgttatatcgcgttttagttgattaatgtcgtagtttttgtttttatattcgagtggtatagtattagttttcgcggtgttttttattatcgaattttttggtaaaacgatagtatcgaagtgcgggcgacgttcgtagtgttcgtgaattagacggtttaggcgaaggtcggacggtttttgttatttagtttcggcggtttgtcgtagtgatgatgtgcgtaacggtcgcgaggaagttgtgcgggttcggcgggagttcggaatattgataacggttttgtttggtagaattttttgtaggttattgcgttagttgggttaattttagttgcggtaatatcgttttacgtaggtaggaatcgatagcgataatggttgttgcgtttt

SEQ ID NO: 14008 - DNA, 568 bp, Artificial Sequence
  chemically treated genomic DNA (Homo sapiens) CpG-island No: 14008
aaaacgcaacaaccattatcgctatcgattcctacctacgtaaaacgatattaccgcaactaaaattaacccaactaacgcaataacctacaaaaaattctaccaaacaaaaccgttatcaatattccgaactcccgccgaacccgcacaacttcctcgcgaccgttacgcacatcatcactacgacaaaccgccgaaactaaataacaaaaaccgtccgaccttcgcctaaaccgtctaattcacgaacactacgaacgtcgcccgcacttcgatactatcgttttaccaaaaaattcgataataaaaaacaccgcgaaaactaatactataccactcgaatataaaaacaaaaactacgacattaatcaactaaaacgcgatataacgaaataacgaaaaattaatacctacataataacgaaaaatcgatcctaaattctcaatacaccgcgaaaaaacgcttacaacgaataaaaaaaaaaacttacctatatcgaaataatacgtccaaaaaaaacacaaaaccgaaaaataattaataacgtaccgctctcttttcataacg

SEQ ID NO: 14009 - DNA, 1070 bp, Artificial Sequence
  chemically treated genomic DNA (Homo sapiens) CpG-island No: 14009
  misc_feature (905)..(905): n is either a, c, g or t
  misc_feature (907)..(908): n is either a, c, g or t
  misc_feature (916)..(917): n is either a, c, g or t
  misc_feature (921)..(921): n is either a, c, g or t
  misc_feature (1007)..(1007): n is either a, c, g or t
  misc_feature (1030)..(1030): n is either a, c, g or t
tagtagcggttttttttatttattcggttagttaggattttattttttagtcggcgagtatttgtattagtatcggcgggaatattatattgttatcgttttttcgtcggattgttgaagggtattcgttaggttgcggcgttgcgttttcgtagtttatcggtggtagtttcgattttgatgagtggcgtgaagtttttcgttgataaatcgtttggatgcggtttttgtcgttttgtatcgtggttagcggtcgtcgttttagtcgtattaggttatttgcggttttcgtgatagcgtatttagttcgttaggtttcgtttacgtcgttatattcgttttgttatttgcggtttagcgggtcgtaaagatagcgattttcgattagcggtttttttattgtgttcgcgtgtagtgtattagtcggtgttgattgtcgtaatggttcggtgagttcgtttattattcgtgcggataatttttttcgggatgaggcggttttttttgttagtttgtcgtgacggttatatcggtaaagatagtggcgttacgggcgatacggttattcggttatatgttgagggtgttgttcggtgtagtttcgggtcgggtaggcggttatttgtcgggtttgtggtatacggatgcggatatttagattcgttgcggtggtgtgaacgtcggttagttttcggtggtgttgtagttgtaatttcgggtttggcgcgggttgttgatgcgatgagttcgtcgttgtcgttttaggtgtaatcgcggttagatagtaggtgtttaggtgttggttttgtaattgttcggtaggggtataagcggtggtagtttataacggtcgaagttgcgtaagcgttttttcggtggttagggcgggtcggcggggtggtatntnnttattagnncggntgtgtcgtcgagtttatgtttgttaggtatcgttgtttagttagttattttacggcgggtaggcgttcggtatatagcggttcgtntagtttttggcgcggttggtatngttttggttttgggggttttttatattggtttggttttag

SEQ ID NO: 14010 - DNA, 1070 bp, Artificial Sequence
  chemically treated genomic DNA (Homo sapiens) CpG-island No: 14010
  misc_feature (41)..(41): n is either a, c, g or t
  misc_feature (64)..(64): n is either a, c, g or t
  misc_feature (150)..(150): n is either a, c, g or t
  misc_feature (154)..(155): n is either a, c, g or t
  misc_feature (163)..(164): n is either a, c, g or t
  misc_feature (166)..(166): n is either a, c, g or t
ctaaaaccaaaccaatataaaaaacccccaaaaccaaaacnataccaaccgcgccaaaaactanacgaaccgctatataccgaacgcctacccgccgtaaaataactaactaaacaacgatacctaacaaacataaactcgacgacacanccgnnctaataannanataccaccccgccgacccgccctaaccaccgaaaaaacgcttacgcaacttcgaccgttataaactaccaccgcttatacccctaccgaacaattacaaaaccaacacctaaacacctactatctaaccgcgattacacctaaaacgacaacgacgaactcatcgcatcaacaacccgcgccaaacccgaaattacaactacaacaccaccgaaaactaaccgacgttcacaccaccgcaacgaatctaaatatccgcatccgtataccacaaacccgacaaataaccgcctacccgacccgaaactacaccgaacaacaccctcaacatataaccgaataaccgtatcgcccgtaacgccactatctttaccgatataaccgtcacgacaaactaacaaaaaaaaccgcctcatcccgaaaaaaattatccgcacgaataataaacgaactcaccgaaccattacgacaatcaacaccgactaatacactacacgcgaacacaataaaaaaaccgctaatcgaaaatcgctatctttacgacccgctaaaccgcaaataacaaaacgaatataacgacgtaaacgaaacctaacgaactaaatacgctatcacgaaaaccgcaaataacctaatacgactaaaacgacgaccgctaaccacgatacaaaacgacaaaaaccgcatccaaacgatttatcaacgaaaaacttcacgccactcatcaaaatcgaaactaccaccgataaactacgaaaacgcaacgccgcaacctaacgaatacccttcaacaatccgacgaaaaaacgataacaatataatattcccgccgatactaatacaaatactcgccgactaaaaaataaaatcctaactaaccgaataaataaaaaaaaccgctacta

SEQ ID NO: 14011 - DNA, 1070 bp, Artificial Sequence
  chemically treated genomic DNA (Homo sapiens) CpG-island No: 14011
  misc_feature (41)..(41): n is either a, c, g or t
  misc_feature (64)..(64): n is either a, c, g or t
  misc_feature (150)..(150): n is either a, c, g or t
  misc_feature (154)..(155): n is either a, c, g or t
  misc_feature (163)..(164): n is either a, c, g or t
  misc_feature (166)..(166): n is either a, c, g or t
ttggggttaggttaatgtgagggatttttaggattagggtngtattaatcgcgttaggggttgngcgaatcgttgtatatcggacgtttgttcgtcgtggaatggttgattaggtagcggtatttggtaggtataaattcggcgatatantcgnnttggtggnnangtattatttcgtcgattcgttttggttatcggggaaacgtttgcgtagtttcggtcgttatgaattattatcgtttatatttttgtcgggtagttatagagttagtatttgaatatttgttgtttgatcgcgattatatttggaacgataacggcgaatttatcgtattagtagttcgcgttagattcggagttatagttatagtattatcggaggttgatcggcgtttatattatcgtagcgaatttggatattcgtattcgtatgttatagattcggtaggtaatcgtttgttcgattcggagttgtatcggatagtatttttagtatgtggtcggataatcgtatcgttcgtgacgttattatttttatcggtatgatcgttacggtaggttgatagagaaaatcgttttatttcggaaggggttattcgtacggatgatgagcggatttatcggattattacgatagttagtatcggttggtgtattatacgcggatataatagaagagtcgttggtcgaaagtcgttatttttacgattcgttgggtcgtaggtggtaaaacgggtgtggcggcgtgaacgggatttgacgggttggatgcgttgttacggaaatcgtaagtgatttggtacggttgggacggcgatcgttgattacgatatagaacgataggagtcgtatttagacgatttattagcggggagttttacgttatttattagggtcgaaattgttatcggtgagttgcgaaaacgtagcgtcgtagtttggcggatgttttttagtagttcggcgggaagacggtggtagtgtggtgttttcgtcggtgttggtgtagatgttcgtcggttggaaagtgaaattttggttgatcgggtgagtgaggaaagtcgttgttg

SEQ ID NO: 14012 - DNA, 1070 bp, Artificial Sequence
  chemically treated genomic DNA (Homo sapiens) CpG-island No: 14012
  misc_feature (905)..(905): n is either a, c, g or t
  misc_feature (907)..(908): n is either a, c, g or t
  misc_feature (916)..(917): n is either a, c, g or t
  misc_feature (921)..(921): n is either a, c, g or t
  misc_feature (1007)..(1007): n is either a, c, g or t
  misc_feature (1030)..(1030): n is either a, c, g or t
caacaacgactttcctcactcacccgatcaaccaaaatttcactttccaaccgacgaacatctacaccaacaccgacgaaaacaccacactaccaccgtcttcccgccgaactactaaaaaacatccgccaaactacgacgctacgttttcgcaactcaccgataacaatttcgaccctaataaataacgtaaaactccccgctaataaatcgtctaaatacgactcctatcgttctatatcgtaatcaacgatcgccgtcccaaccgtaccaaatcacttacgatttccgtaacaacgcatccaacccgtcaaatcccgttcacgccgccacacccgttttaccacctacgacccaacgaatcgtaaaaataacgactttcgaccaacgactcttctattatatccgcgtataatacaccaaccgatactaactatcgtaataatccgataaatccgctcatcatccgtacgaataaccccttccgaaataaaacgattttctctatcaacctaccgtaacgatcataccgataaaaataataacgtcacgaacgatacgattatccgaccacatactaaaaatactatccgatacaactccgaatcgaacaaacgattacctaccgaatctataacatacgaatacgaatatccaaattcgctacgataatataaacgccgatcaacctccgataatactataactataactccgaatctaacgcgaactactaatacgataaattcgccgttatcgttccaaatataatcgcgatcaaacaacaaatattcaaatactaactctataactacccgacaaaaatataaacgataataattcataacgaccgaaactacgcaaacgtttccccgataaccaaaacgaatcgacgaaataatacntnnccaccaanncgantatatcgccgaatttatacctaccaaataccgctacctaatcaaccattccacgacgaacaaacgtccgatatacaacgattcgcncaacccctaacgcgattaatacnaccctaatcctaaaaatccctcacattaacctaaccccaa

SEQ ID NO: 14013 - DNA, 947 bp, Artificial Sequence
  chemically treated genomic DNA (Homo sapiens) CpG-island No: 14013
gttcgtgtatttgttttatagtaaaattattatcgttttgtgataataagacgcggattattacgtcggattttacgagtagtaattgtgtcggatttagattgtcgtattgtttttttttattacgcgggcgtagttgtttagttagattgcgttttttttttatcgtttttttttatcgtaaatagtatttgtcgtttttagtgttgtgggttttgtcgcgggtcgcgttatatttcggtcgtcgttgtcgttgtgatcgcggttacgtaattattagtcgtgataggtattagtttcgggtatatttttgttatttaggttttattttgggtgacgtatatatttttattatcgattaggcggtaaggttgggtttggtattacgtcgttttagttgtcgttatcgttattacgttcggggttaaggttttacgtattaggtcggggataaagtttatattttgcggacgtacgttatcgttagttggatttgttaggagaagatcgcgcggatattttttttggcgatgttcgattgaaatgcgttatcgtaaacgtttgtttttaggtattttacggttagtttgattgtcggagaattagcgttcggttatcgacggtgtaacggtgtaaattttatcgtatcgttcggtgagcgttagttatcgttgagcgtttcgtcgtttttatcgcgacgcgcgtttgtttcggcgtcgtattcggattggtaattttttttttaggtattttttttagcgttgttgcgaggcggtgagataaacgtcggacgcgttagaatatcgcggatttgtatttgttttttgttattttttgagcggttagtagatgggaataggtggtgtagagcgtggtcgatcgttgatatgcgttttattggtaaagcgattatcgttgattttagttttatcggtagggatttatgt

SEQ ID NO: 14014 - DNA, 947 bp, Artificial Sequence
  chemically treated genomic DNA (Homo sapiens) CpG-island No: 14014
acataaatccctaccgataaaactaaaatcaacgataatcgctttaccaataaaacgcatatcaacgatcgaccacgctctacaccacctattcccatctactaaccgctcaaaaaataacaaaaaacaaatacaaatccgcgatattctaacgcgtccgacgtttatctcaccgcctcgcaacaacgctaaaaaaaatacctaaaaaaaaaattaccaatccgaatacgacgccgaaacaaacgcgcgtcgcgataaaaacgacgaaacgctcaacgataactaacgctcaccgaacgatacgataaaatttacaccgttacaccgtcgataaccgaacgctaattctccgacaatcaaactaaccgtaaaatacctaaaaacaaacgtttacgataacgcatttcaatcgaacatcgccaaaaaaaatatccgcgcgatcttctcctaacaaatccaactaacgataacgtacgtccgcaaaatataaactttatccccgacctaatacgtaaaaccttaaccccgaacgtaataacgataacgacaactaaaacgacgtaataccaaacccaaccttaccgcctaatcgataataaaaatatatacgtcacccaaaataaaacctaaataacaaaaatatacccgaaactaatacctatcacgactaataattacgtaaccgcgatcacaacgacaacgacgaccgaaatataacgcgacccgcgacaaaacccacaacactaaaaacgacaaatactatttacgataaaaaaaaacgataaaaaaaaaacgcaatctaactaaacaactacgcccgcgtaataaaaaaaaacaatacgacaatctaaatccgacacaattactactcgtaaaatccgacgtaataatccgcgtcttattatcacaaaacgataataattttactataaaacaaatacacgaac

SEQ ID NO: 14015 - DNA, 947 bp, Artificial Sequence
  chemically treated genomic DNA (Homo sapiens) CpG-island No: 14015
gtataaatttttgtcggtgagattgaaattaacggtaatcgttttattagtaaggcgtatattaacggtcgattacgttttatattatttatttttatttgttgatcgtttaggaagtagtaaagagtaaatgtagattcgcgatattttggcgcgttcggcgtttattttatcgtttcgtagtaacgttgggaagaatatttgaagaaagggttattaattcggatgcgacgtcggaatagacgcgcgtcgcggtgaaagcgacgaaacgtttaacggtaattggcgtttatcgggcggtgcggtgaaatttatatcgttatatcgtcggtgatcgggcgttggtttttcggtaattagattggtcgtgggatatttggaagtaggcgtttgcgatggcgtattttaatcggatatcgttaaagagaatattcgcgcggtttttttttggtagatttagttggcgatagcgtgcgttcgtaggatgtgggttttgttttcgatttgatgcgtggaattttagtttcgagcgtggtggcgatggcggtaattggaacgacgtaatattaaatttagttttgtcgtttggtcggtgatggaagtgtatacgttatttaagataaaatttgggtggtagagatgtattcgaaattggtgtttattacgattggtggttacgtaatcgcgattataacggtaacggcggtcggaatatggcgcgattcgcgataaagtttataatattgagagcggtagatgttgtttacggtgaaaaaaggcgataaagaagagacgtagtttggttgaataattacgttcgcgtggtggagaaaggtagtacgatagtttgaattcggtatagttgttgttcgtgggattcggcgtgatgattcgcgttttgttattataagacggtggtaattttgttatggggtaagtatacgggt

SEQ ID NO: 14016 - DNA, 947 bp, Artificial Sequence
  chemically treated genomic DNA (Homo sapiens) CpG-island No: 14016
acccgtatacttaccccataacaaaattaccaccgtcttataataacaaaacgcgaatcatcacgccgaatcccacgaacaacaactataccgaattcaaactatcgtactacctttctccaccacgcgaacgtaattattcaaccaaactacgtctcttctttatcgccttttttcaccgtaaacaacatctaccgctctcaatattataaactttatcgcgaatcgcgccatattccgaccgccgttaccgttataatcgcgattacgtaaccaccaatcgtaataaacaccaatttcgaatacatctctaccacccaaattttatcttaaataacgtatacacttccatcaccgaccaaacgacaaaactaaatttaatattacgtcgttccaattaccgccatcgccaccacgctcgaaactaaaattccacgcatcaaatcgaaaacaaaacccacatcctacgaacgcacgctatcgccaactaaatctaccaaaaaaaaaccgcgcgaatattctctttaacgatatccgattaaaatacgccatcgcaaacgcctacttccaaatatcccacgaccaatctaattaccgaaaaaccaacgcccgatcaccgacgatataacgatataaatttcaccgcaccgcccgataaacgccaattaccgttaaacgtttcgtcgctttcaccgcgacgcgcgtctattccgacgtcgcatccgaattaataaccctttcttcaaatattcttcccaacgttactacgaaacgataaaataaacgccgaacgcgccaaaatatcgcgaatctacatttactctttactacttcctaaacgatcaacaaataaaaataaataatataaaacgtaatcgaccgttaatatacgccttactaataaaacgattaccgttaatttcaatctcaccgacaaaaatttatac

SEQ ID NO: 14017 - DNA, 599 bp, Artificial Sequence
  chemically treated genomic DNA (Homo sapiens) CpG-island No: 14017
tattagcgtatcgggaatattgtatgttttcgcgtaaagtcgatttttttgtcgttttgttagacggttaggcggtcgaattgttgggtataaagttgatgattttttcgttaggagcgtaagttcggaggcgttatggtgtagggcgtttggaacgatatatgcgaggtttagatgaaaggataaacgcgggacgcgaacggaattaagagggggcgtaacgaaacgtaaaaggcggtcggcggggaattttcggcggtggggaaatatttaagatttataagtggaagggcggggtaacgaacgggcggtatagtttcgtgtaatttttttcgtttatttttcgtattgttggcgttgaatggcgtaatagtaggaagcggattattggatttaggttgatttgtatcgatgtcgtggtggtagttttcgttgttatcgggtattcgggatcgaaatattggtcggattcgttttttgttgaatagtggcggcgtatcggttgtcgggtaattcgttagttgtaaattttgtatattattaggttacggtttttatttagtttaaattgttcgttacggttgtagatatcgaatcgt

SEQ ID NO: 14018 - DNA, 599 bp, Artificial Sequence
  chemically treated genomic DNA (Homo sapiens) CpG-island No: 14018
acgattcgatatctacaaccgtaacgaacaatttaaactaaataaaaaccgtaacctaataatatacaaaatttacaactaacgaattacccgacaaccgatacgccgccactattcaacaaaaaacgaatccgaccaatatttcgatcccgaatacccgataacaacgaaaactaccaccacgacatcgatacaaatcaacctaaatccaataatccgcttcctactattacgccattcaacgccaacaatacgaaaaataaacgaaaaaaattacacgaaactataccgcccgttcgttaccccgcccttccacttataaatcttaaatatttccccaccgccgaaaattccccgccgaccgccttttacgtttcgttacgccccctcttaattccgttcgcgtcccgcgtttatcctttcatctaaacctcgcatatatcgttccaaacgccctacaccataacgcctccgaacttacgctcctaacgaaaaaatcatcaactttatacccaacaattcgaccgcctaaccgtctaacaaaacgacaaaaaaatcgactttacgcgaaaacatacaatattcccgatacgctaata

SEQ ID NO: 14019 - DNA, 599 bp, Artificial Sequence
  chemically treated genomic DNA (Homo sapiens) CpG-island No: 14019
acggttcggtgtttatagtcgtaacggataatttaagttggatgaaaatcgtaatttggtgatatgtaaggtttatagttgacgggttattcggtaatcggtacgtcgttattatttagtaaggggcgaattcgattaatatttcgatttcgaatattcgatggtagcgaaaattattattacggtatcgatgtagattaatttgaatttagtgattcgttttttattgttacgttatttagcgttagtaatgcggaaagtaagcggaggaggttatacggaattgtgtcgttcgttcgttatttcgtttttttatttgtaagttttaaatatttttttatcgtcggaaatttttcgtcgatcgttttttgcgtttcgttgcgtttttttttagtttcgttcgcgtttcgcgtttatttttttatttggatttcgtatgtatcgttttagacgttttatattatggcgttttcgggtttgcgtttttgacgaagaggttattaattttatgtttagtaattcgatcgtttgatcgtttggtaggacggtaagaaagtcgattttacgcggaggtatatagtattttcggtgcgttggtg

SEQ ID NO: 14020 - DNA, 599 bp, Artificial Sequence
  chemically treated genomic DNA (Homo sapiens) CpG-island No: 14020
caccaacgcaccgaaaatactatatacctccgcgtaaaatcgactttcttaccgtcctaccaaacgatcaaacgatcgaattactaaacataaaattaataacctcttcgtcaaaaacgcaaacccgaaaacgccataatataaaacgtctaaaacgatacatacgaaatccaaataaaaaaataaacgcgaaacgcgaacgaaactaaaaaaaaacgcaacgaaacgcaaaaaacgatcgacgaaaaatttccgacgataaaaaaatatttaaaacttacaaataaaaaaacgaaataacgaacgaacgacacaattccgtataacctcctccgcttactttccgcattactaacgctaaataacgtaacaataaaaaacgaatcactaaattcaaattaatctacatcgataccgtaataataattttcgctaccatcgaatattcgaaatcgaaatattaatcgaattcgccccttactaaataataacgacgtaccgattaccgaataacccgtcaactataaaccttacatatcaccaaattacgattttcatccaacttaaattatccgttacgactataaacaccgaaccgt

SEQ ID NO: 14021 - DNA, 644 bp, Artificial Sequence
  chemically treated genomic DNA (Homo sapiens) CpG-island No: 14021
atcgtcgcggtgaacggttcgtcgtaatatattgggcgatggtttacggattgatcggtattgcgtagttgtgaataagtaaaagtacgcgtcgtttttaattttttgaaataggcggttgtttgttgcgggtaaacgcggttttagtttatatgtggtagtggtagattaaagtggttattttcggtacgttttcgtcgatgatgtttagtaagtcgacgtcgtgtttttttcgttgcgtcgttttagtagttgtatttttaagtagatgttagtatcggttgggtataggttttgatgagattaaatagttcgcgtttattatttgatttatcgtcgtttgcgtagtgttaacgtcgggtaaaaatagttatcggttagtaatacgacgttcgggttacggttgattttgggtttatatcgtgacgcgtaatggtagattttatcgagtttaggttggcgtagtcggattaaggattattacgtttattatagtatttttttcgacgagggtagggatcgttttttacgcggattggttggcgtacgtgcgattaaaggttttgatagaatttttatacggtgatgatcgttttatttttggttttaggtgtaggttcgtttatggtgtatgaagcgatcgg

SEQ ID NO: 14022 - DNA, 644 bp, Artificial Sequence
  chemically treated genomic DNA (Homo sapiens) CpG-island No: 14022
ccgatcgcttcatacaccataaacgaacctacacctaaaaccaaaaataaaacgatcatcaccgtataaaaattctatcaaaacctttaatcgcacgtacgccaaccaatccgcgtaaaaaacgatccctaccctcgtcgaaaaaaatactataataaacgtaataatccttaatccgactacgccaacctaaactcgataaaatctaccattacgcgtcacgatataaacccaaaatcaaccgtaacccgaacgtcgtattactaaccgataactatttttacccgacgttaacactacgcaaacgacgataaatcaaataataaacgcgaactatttaatctcatcaaaacctatacccaaccgatactaacatctacttaaaaatacaactactaaaacgacgcaacgaaaaaaacacgacgtcgacttactaaacatcatcgacgaaaacgtaccgaaaataaccactttaatctaccactaccacatataaactaaaaccgcgtttacccgcaacaaacaaccgcctatttcaaaaaattaaaaacgacgcgtacttttacttattcacaactacgcaataccgatcaatccgtaaaccatcgcccaatatattacgacgaaccgttcaccgcgacgat

SEQ ID NO: 14023 - DNA, 644 bp, Artificial Sequence
  chemically treated genomic DNA (Homo sapiens) CpG-island No: 14023
tcggtcgttttatatattatgggcggatttatatttgaaattaaaggtaaaacgattattatcgtgtagagattttgttaaagtttttggtcgtacgtgcgttagttaattcgcgtggaaggcgatttttgttttcgtcgaaaggagtgttgtaatgaacgtggtgatttttgattcggttgcgttaatttgaattcggtgaagtttgttattgcgcgttacggtatgaatttaaagttagtcgtgattcggacgtcgtgttgttggtcgataattgtttttattcggcgttggtattgcgtaagcggcgatggattaggtagtgagcgcgagttgtttgattttattaaagtttgtatttaatcggtgttggtatttgtttagggatgtaattgttggggcggcgtagcgaagagagtacggcgtcgatttgttgggtattatcgacgaagacgtgtcgaaaatgattattttggtttgttattgttatatatgggttggaatcgcgtttattcgtagtaggtaatcgtttgttttaggggattgaagacggcgcgtatttttatttgtttatagttacgtaatgtcggttaattcgtggattatcgtttagtgtattacggcgaatcgtttatcgcggcggt

SEQ ID NO: 14024 - DNA, 644 bp, Artificial Sequence
  chemically treated genomic DNA (Homo sapiens) CpG-island No: 14024
accgccgcgataaacgattcgccgtaatacactaaacgataatccacgaattaaccgacattacgtaactataaacaaataaaaatacgcgccgtcttcaatcccctaaaacaaacgattacctactacgaataaacgcgattccaacccatatataacaataacaaaccaaaataatcattttcgacacgtcttcgtcgataatacccaacaaatcgacgccgtactctcttcgctacgccgccccaacaattacatccctaaacaaataccaacaccgattaaatacaaactttaataaaatcaaacaactcgcgctcactacctaatccatcgccgcttacgcaataccaacgccgaataaaaacaattatcgaccaacaacacgacgtccgaatcacgactaactttaaattcataccgtaacgcgcaataacaaacttcaccgaattcaaattaacgcaaccgaatcaaaaatcaccacgttcattacaacactcctttcgacgaaaacaaaaatcgccttccacgcgaattaactaacgcacgtacgaccaaaaactttaacaaaatctctacacgataataatcgttttacctttaatttcaaatataaatccgcccataatatataaaacgaccga

SEQ ID NO: 14025 - DNA, 855 bp, Artificial Sequence
  chemically treated genomic DNA (Homo sapiens) CpG-island No: 14025
  misc_feature (511)..(511): n is either a, c, g or t
  misc_feature (522)..(523): n is either a, c, g or t
  misc_feature (533)..(533): n is either a, c, g or t
ggacgtatatttcgcggtcgtgtgcgatttgtaattaatattttcggtttttagcgacggaaaaaattatattggtttgttttgtagcgggttggtaggcgttttttgcgtcgtattttcggtacgaaggcggcgttaaattgtaattcgttatttattattattttggtgcgcgtttacggacgatttttgtcgtttgttggacgttagtatataggggtgacgggcgttattattgttggaaaacgatagtatcgttatcgcggttttttttcggtgatggcgcgttaggtttcggtattggtaagcggatattcgttagttgcgtcgtcgtcggttgtggtattacgttgtaatcgtaaagtttaacgtcgggtcgttgtattgtggtaatattaggaaaatggagagagcgttttatagtttggttgtaagtcgataatgcgtaattcggtattagtatatttgtcgtggaagagaggttgttcgcgatatagatattcgtttacgncggcgttgatnntattgttgancggcgaatattagaagggtcggaagtttttttagcgtattcggcggcgttttttcgttcgcgcgggttagtagcgatgagtaaatttttttcgtattgcgaggttgtatgcggattaattttgtagtcgtttatcgtacgtcgtgattgagcgtaaatgacgaagtttaacgatgggaattaaatgggcgttgtaaagttttaaggtttttcgggtttaatcgttcggtatttttatgtttcgttatttgttagcgtaggtgaagggatggttatcgatattagattgacgattatattattaattcgagaatgtttgatcg

SEQ ID NO: 14026 - DNA, 855 bp, Artificial Sequence
  chemically treated genomic DNA (Homo sapiens) CpG-island No: 14026
  misc_feature (323)..(323): n is either a, c, g or t
  misc_feature (333)..(334): n is either a, c, g or t
  misc_feature (345)..(345): n is either a, c, g or t
cgatcaaacattctcgaattaataatataatcgtcaatctaatatcgataaccatcccttcacctacgctaacaaataacgaaacataaaaataccgaacgattaaacccgaaaaaccttaaaactttacaacgcccatttaattcccatcgttaaacttcgtcatttacgctcaatcacgacgtacgataaacgactacaaaattaatccgcatacaacctcgcaatacgaaaaaaatttactcatcgctactaacccgcgcgaacgaaaaaacgccgccgaatacgctaaaaaaacttccgacccttctaatattcgccgntcaacaatannatcaacgccgncgtaaacgaatatctatatcgcgaacaacctctcttccacgacaaatatactaataccgaattacgcattatcgacttacaaccaaactataaaacgctctctccattttcctaatattaccacaatacaacgacccgacgttaaactttacgattacaacgtaataccacaaccgacgacgacgcaactaacgaatatccgcttaccaataccgaaacctaacgcgccatcaccgaaaaaaaaccgcgataacgatactatcgttttccaacaataataacgcccgtcacccctatatactaacgtccaacaaacgacaaaaatcgtccgtaaacgcgcaccaaaataataataaataacgaattacaatttaacgccgccttcgtaccgaaaatacgacgcaaaaaacgcctaccaacccgctacaaaacaaaccaatataattttttccgtcgctaaaaaccgaaaatattaattacaaatcgcacacgaccgcgaaatatacgtcc

SEQ ID NO: 14027 - DNA, 855 bp, Artificial Sequence
  chemically treated genomic DNA (Homo sapiens) CpG-island No: 14027
  misc_feature (323)..(323): n is either a, c, g or t
  misc_feature (333)..(334): n is either a, c, g or t
  misc_feature (345)..(345): n is either a, c, g or t
cgattaggtattttcgaattaatggtgtggtcgttaatttggtgtcgataattatttttttatttacgttggtaagtggcgaaatataaggatgtcgggcggttaagttcgggaagttttggggttttgtaacgtttatttggtttttatcgttgaatttcgttatttgcgtttagttacggcgtgcgatggacggttataggattgattcgtatgtaatttcgtaatgcgggaagaatttgtttatcgttgttggttcgcgcgggcgaaaaaacgtcgtcggatgcgttggaaaaattttcgatttttttgatgttcgtcgnttagtaatgnngttagcgtcgncgtaagcggatgtttgtatcgcgggtaattttttttttacggtaaatgtgttggtgtcggattacgtattatcggtttgtagttaggttgtaaaacgttttttttatttttttgatgttgttatagtatagcggttcggcgttgggttttgcgattgtagcgtggtgttatagtcgacggcggcgtagttggcggatattcgtttgttagtgtcgaaatttggcgcgttattatcggagaagagtcgcggtggcgatgttgtcgttttttagtaatggtagcgttcgttatttttgtgtgttaacgtttagtaggcgatagaaatcgttcgtgagcgcgtattaaagtggtggtggatggcgagttatagtttgacgtcgttttcgtgtcggaagtgcggcgtaaaaagcgtttgttagttcgttatagggtaggttaatgtgatttttttcgtcgttggaagtcggaaatattggttataaatcgtatacgatcgcgggatatgcgttt

SEQ ID NO: 14028 - DNA, 855 bp, Artificial Sequence
  chemically treated genomic DNA (Homo sapiens) CpG-island No: 14028
  misc_feature (511)..(511): n is either a, c, g or t
  misc_feature (522)..(523): n is either a, c, g or t
  misc_feature (533)..(533): n is either a, c, g or t
aaacgcatatcccgcgatcgtatacgatttataaccaatatttccgacttccaacgacgaaaaaaatcacattaacctaccctataacgaactaacaaacgctttttacgccgcacttccgacacgaaaacgacgtcaaactataactcgccatccaccaccactttaatacgcgctcacgaacgatttctatcgcctactaaacgttaacacacaaaaataacgaacgctaccattactaaaaaacgacaacatcgccaccgcgactcttctccgataataacgcgccaaatttcgacactaacaaacgaatatccgccaactacgccgccgtcgactataacaccacgctacaatcgcaaaacccaacgccgaaccgctatactataacaacatcaaaaaaataaaaaaaacgttttacaacctaactacaaaccgataatacgtaatccgacaccaacacatttaccgtaaaaaaaaaattacccgcgatacaaacatccgcttacgncgacgctaacnncattactaancgacgaacatcaaaaaaatcgaaaatttttccaacgcatccgacgacgttttttcgcccgcgcgaaccaacaacgataaacaaattcttcccgcattacgaaattacatacgaatcaatcctataaccgtccatcgcacgccgtaactaaacgcaaataacgaaattcaacgataaaaaccaaataaacgttacaaaaccccaaaacttcccgaacttaaccgcccgacatccttatatttcgccacttaccaacgtaaataaaaaaataattatcgacaccaaattaacgaccacaccattaattcgaaaatacctaatcg

SEQ ID NO: 14029 - DNA, 916 bp, Artificial Sequence
  chemically treated genomic DNA (Homo sapiens) CpG-island No: 14029
  misc_feature (106)..(106): n is either a, c, g or t
ggttcggttttgatgcgtaggtgtttcgaaataatttgcggtttagaggtttgcggcgcgtatttttttggagaatggtgaataagggcgggcggaaaatggtttngcggaaatgagattgtttgggtaggttaatgagtacggtcgcgggaggggagtaaagtgcgtggttgggacgacgcgcgaaatatgttgttgttttattttaggggcgttattacggtcggttgtagggtatcgggtcggtggttgtagttgtttttattggggatgatttggggataggcgttgatcgcgtagtcggcgggtattgatggtaggtcgttggggatgtgttaggtgatgaggacgtgtcgatgggaatgtgtgaggtggagaaggtaagggatagggatcgtagggaatattggaaggggcgtgtgcgtatttgggatcgagggcgtatggcgtttgatgtatattatagaatgtcgggtttgattgttattgcgcgtgtgtgagtttatggggaggggtcgatcgtcggcgatgttggtttggatcggggtgggggggtttgttttaattggattagtatatcgaggggtgcgtaaagggttggtgggcgatggggcgcgtgggcggttttaagtgaggattagggttcgatggaatggtggcgtcgttaggtagattaggagagagattgtttggagtgtcgttgtttgcgaatgagggttggtattagtacgttagtgggcgcgtaagcgtatttgtgtgaaggaggattcgcgtaaggtgttttgtatatggtgaagcgtgcgatggtggcgtgcgggtatggtgtcgagtttgtcggaacggtatgttatattgttggttgcgttaggagcggatagtgcggtatattgttttgggatggtgcggagagtgaaaa

SEQ ID NO: 14030 - DNA, 916 bp, Artificial Sequence
  chemically treated genomic DNA (Homo sapiens) CpG-island No: 14030
  misc_feature (811)..(811): n is either a, c, g or t
ttttcactctccgcaccatcccaaaacaatataccgcactatccgctcctaacgcaaccaacaatataacataccgttccgacaaactcgacaccatacccgcacgccaccatcgcacgcttcaccatatacaaaacaccttacgcgaatcctccttcacacaaatacgcttacgcgcccactaacgtactaataccaaccctcattcgcaaacaacgacactccaaacaatctctctcctaatctacctaacgacgccaccattccatcgaaccctaatcctcacttaaaaccgcccacgcgccccatcgcccaccaaccctttacgcacccctcgatatactaatccaattaaaacaaacccccccaccccgatccaaaccaacatcgccgacgatcgacccctccccataaactcacacacgcgcaataacaatcaaacccgacattctataatatacatcaaacgccatacgccctcgatcccaaatacgcacacgccccttccaatattccctacgatccctatcccttaccttctccacctcacacattcccatcgacacgtcctcatcacctaacacatccccaacgacctaccatcaatacccgccgactacgcgatcaacgcctatccccaaatcatccccaataaaaacaactacaaccaccgacccgataccctacaaccgaccgtaataacgcccctaaaataaaacaacaacatatttcgcgcgtcgtcccaaccacgcactttactcccctcccgcgaccgtactcattaacctacccaaacaatctcatttccgcnaaaccattttccgcccgcccttattcaccattctccaaaaaaatacgcgccgcaaacctctaaaccgcaaattatttcgaaacacctacgcatcaaaaccgaacc

SEQ ID NO: 14031 - DNA, 916 bp, Artificial Sequence
  chemically treated genomic DNA (Homo sapiens) CpG-island No: 14031
  misc_feature (811)..(811): n is either a, c, g or t
tttttatttttcgtattattttaaaataatatatcgtattattcgtttttaacgtagttaatagtatagtatatcgtttcggtaaattcggtattatgttcgtacgttattatcgtacgttttattatgtataaaatattttacgcgggtttttttttatataaatacgtttacgcgtttattaacgtgttaatgttagtttttattcgtaaatagcggtattttaaatagttttttttttaatttatttagcggcgttattattttatcgggttttggtttttatttaaggtcgtttacgcgttttatcgtttattaattttttacgtatttttcgatatgttaatttagttggggtaggtttttttatttcggtttaagttaatatcgtcggcggtcggtttttttttataggtttatatacgcgtagtgataattaaattcggtattttgtagtgtgtattaaacgttatacgttttcggttttaggtacgtatacgttttttttaatattttttacggtttttgttttttattttttttattttatatatttttatcggtacgtttttattatttagtatatttttagcgatttattattagtattcgtcggttacgcgattaacgtttgtttttaagttatttttagtagaagtaattataattatcggttcggtattttatagtcggtcgtaatagcgtttttaaagtaaggtaataatatgtttcgcgcgtcgttttagttacgtattttatttttttttcgcggtcgtgtttattagtttatttaagtaattttattttcgtnaaattatttttcgttcgtttttatttattattttttaagggggtgcgcgtcgtaagtttttaaatcgtaggttatttcggagtatttacgtattaaagtcgggtt

SEQ ID NO: 14032 - DNA, 916 bp, Artificial Sequence
  chemically treated genomic DNA (Homo sapiens) CpG-island No: 14032
  misc_feature (106)..(106): n is either a, c, g or t
aacccgactttaatacgtaaatactccgaaataacctacgatttaaaaacttacgacgcgcacccccttaaaaaataataaataaaaacgaacgaaaaataatttnacgaaaataaaattacttaaataaactaataaacacgaccgcgaaaaaaaaataaaatacgtaactaaaacgacgcgcgaaacatattattaccttactttaaaaacgctattacgaccgactataaaataccgaaccgataattataattacttctactaaaaataacttaaaaacaaacgttaatcgcgtaaccgacgaatactaataataaatcgctaaaaatatactaaataataaaaacgtaccgataaaaatatataaaataaaaaaaataaaaaacaaaaaccgtaaaaaatattaaaaaaaacgtatacgtacctaaaaccgaaaacgtataacgtttaatacacactacaaaataccgaatttaattatcactacgcgtatataaacctataaaaaaaaaccgaccgccgacgatattaacttaaaccgaaataaaaaaacctaccccaactaaattaacatatcgaaaaatacgtaaaaaattaataaacgataaaacgcgtaaacgaccttaaataaaaaccaaaacccgataaaataataacgccgctaaataaattaaaaaaaaaactatttaaaataccgctatttacgaataaaaactaacattaacacgttaataaacgcgtaaacgtatttatataaaaaaaaacccgcgtaaaatattttatacataataaaacgtacgataataacgtacgaacataataccgaatttaccgaaacgatatactatactattaactacgttaaaaacgaataatacgatatattattttaaaataatacgaaaaataaaaa

SEQ ID NO: 14033 - DNA, 642 bp, Artificial Sequence
  chemically treated genomic DNA (Homo sapiens) CpG-island No: 14033
  misc_feature (329)..(329): n is either a, c, g or t
tgttcggcgaggttttagcgaacgcgttatttgtcggaattagttgtaattcgttagtttattattattattgagtacgttaggtaattggttgaggtataacggagtaaattggttagagattgcggtttcggtgatagcgtaaagtcgtgcgatatttttaagttcgttgcgatacgtaataaatttttttatcgtaacggatattcgcggcgcgtttcgcgttaattttcgttcgttaggggttttttagttgatttcgattgcgggcggtttttcgttagtcgttttatcgcggtatacgggtttcgtcgtttattgtttttttnttttttacgttttttttattttttttttttttttttcgttttttcgtttttttttttttttatagtcggatcggcgtacggttacgggtagtggttttatcgttttggggttgacgttttttgcggtgggttatttgtcggtagcgggtttggcgttattttcggtatcgattcgttttatgttagaagttcgtgcgttgattaattggtcggtaacggcgtagcgattattgtcgttgttaagtgggtgaaagattggattataaaaaattggacgatgtgttgaataatcgtgcgtcggatgtaaaacgta

SEQ ID NO: 14034 - DNA, 642 bp, Artificial Sequence
  chemically treated genomic DNA (Homo sapiens) CpG-island No: 14034
  misc_feature (314)..(314): n is either a, c, g or t
tacgttttacatccgacgcacgattattcaacacatcgtccaattttttataatccaatctttcacccacttaacaacgacaataatcgctacgccgttaccgaccaattaatcaacgcacgaacttctaacataaaacgaatcgataccgaaaataacgccaaacccgctaccgacaaataacccaccgcaaaaaacgtcaaccccaaaacgataaaaccactacccgtaaccgtacgccgatccgactataaaaaaaaaaaaaaacgaaaaaacgaaaaaaaaaaaaaaaaaataaaaaaaacgtaaaaaanaaaaaaacaataaacgacgaaacccgtataccgcgataaaacgactaacgaaaaaccgcccgcaatcgaaatcaactaaaaaacccctaacgaacgaaaattaacgcgaaacgcgccgcgaatatccgttacgataaaaaaatttattacgtatcgcaacgaacttaaaaatatcgcacgactttacgctatcaccgaaaccgcaatctctaaccaatttactccgttatacctcaaccaattacctaacgtactcaataataataataaactaacgaattacaactaattccgacaaataacgcgttcgctaaaacctcgccgaaca

SEQ ID NO: 14035 - DNA, 642 bp, Artificial Sequence
  chemically treated genomic DNA (Homo sapiens) CpG-island No: 14035
  misc_feature (314)..(314): n is either a, c, g or t
tgcgttttgtattcggcgtacgattatttagtatatcgtttagttttttgtggtttagttttttatttatttagtaacgataatggtcgttacgtcgttatcgattagttagttagcgtacgagtttttgatataaagcgggtcgatatcgaggatagcgttagattcgttatcggtaaatggtttatcgtagagagcgttaattttaggacgataaagttattattcgtaatcgtgcgtcggttcggttataggggggaggagaggcggggggacggagaggagagggaggaggtgagggggacgtgggggangaaaggataataagcgacggggttcgtgtatcgcggtgaggcgattggcggggagtcgttcgtagtcgaggttagttggaaggtttttggcgggcgggggttagcgcggaacgcgtcgcggatgttcgttacggtaggggggtttattacgtgtcgtagcggatttgaaggtatcgtacggttttgcgttgttatcgaggtcgtaatttttagttagtttatttcgttatattttagttagttgtttgacgtgtttaatgatagtgatgagttggcgagttatagttgatttcggtagatggcgcgttcgttgaggtttcgtcgggta

SEQ ID NO: 14036 - DNA, 642 bp, Artificial Sequence
  chemically treated genomic DNA (Homo sapiens) CpG-island No: 14036
  misc_feature (329)..(329): n is either a, c, g or t
tacccgacgaaacctcaacgaacgcgccatctaccgaaatcaactataactcgccaactcatcactatcattaaacacgtcaaacaactaactaaaatataacgaaataaactaactaaaaattacgacctcgataacaacgcaaaaccgtacgataccttcaaatccgctacgacacgtaataaacccccctaccgtaacgaacatccgcgacgcgttccgcgctaacccccgcccgccaaaaaccttccaactaacctcgactacgaacgactccccgccaatcgcctcaccgcgatacacgaaccccgtcgcttattatcctttcntcccccacgtccccctcacctcctccctctcctctccgtccccccgcctctcctcccccctataaccgaaccgacgcacgattacgaataataactttatcgtcctaaaattaacgctctctacgataaaccatttaccgataacgaatctaacgctatcctcgatatcgacccgctttatatcaaaaactcgtacgctaactaactaatcgataacgacgtaacgaccattatcgttactaaataaataaaaaactaaaccacaaaaaactaaacgatatactaaataatcgtacgccgaatacaaaacgca

SEQ ID NO: 14037 - DNA, 1124 bp, Artificial Sequence
  chemically treated genomic DNA (Homo sapiens) CpG-island No: 14037
  misc_feature (1082)..(1083): n is either a, c, g or t
  misc_feature (1085)..(1086): n is either a, c, g or t
tggcgaattgaaaggtaaacgtgaaacgttagtttcgggtcgacgtttttttcgttgtgtattcgttatgggtgtaaggacgttgaattagcgtagcgattcggtgggataatgttttgtgtcgggaagtcgaagcgttgtagatattttgtagttagtcgacgtttatcgttcgtattgcgcgtattattattacgtttttcgttgatttagtttttgacgtaagcgaattggattagtatattgcggtggtagtttttcggttgttagttagaatcggtatttgtattttagcgagaaatggtatatcgtttaatatatttgttagcgttagatttttatttatcgtcgggtgtagaggaacggtttgatgttggaatttatttgacgtagtgtttggtggcgcggttaaatttgttttgattgaaattaaagttatcgattagcgtataacggtatcgttttgcggattgatcgatattagcgtcgagtttatttcggtatttgtgttagttattatgtatcgttaatttgacgaatttagattgttgattcgtttgtagaatatcggttattttacgcggcgtcggtttttgtgagtattcgaacggtaaggacgcgtttagcgaacgttttttatatttatgcgacggtcgattcgttcgttagtatcgtcgtcgtttgttgaggattgcgttggtgattgcggtaggtagtagcggattataggttggtagcgttttagcgtatcggtaatttttgttgttattttacgtcgattcgtttatttttataagtatatttgttcgggcgggatagtcgtggcgtatgtcgtagtttatacgttattacgtatcggttgttgcgtcggttgttgattttgcggttgagggtgtaatgcgataacgcgttatagattttcgtttagcgggttatttcgcggtttattcgttagtatgggcgaaaaaatttcgggggaataaagaattagggttatacggggggaattttatacgaggaaaacgtcgttataagggagaggttatatatttttgttttttttagacgaggatataatttanntnnagcgagacgataggtaagaagaagtacgaaattacgat

SEQ ID NO: 14038 - DNA, 1124 bp, Artificial Sequence
  chemically treated genomic DNA (Homo sapiens) CpG-island No: 14038
  misc_feature (39)..(40): n is either a, c, g or t
  misc_feature (42)..(43): n is either a, c, g or t
atcgtaatttcgtacttcttcttacctatcgtctcgctnnanntaaattatatcctcgtctaaaaaaaacaaaaatatataacctctcccttataacgacgttttcctcgtataaaattccccccgtataaccctaattctttattcccccgaaattttttcgcccatactaacgaataaaccgcgaaataacccgctaaacgaaaatctataacgcgttatcgcattacaccctcaaccgcaaaatcaacaaccgacgcaacaaccgatacgtaataacgtataaactacgacatacgccacgactatcccgcccgaacaaatatacttataaaaataaacgaatcgacgtaaaataacaacaaaaattaccgatacgctaaaacgctaccaacctataatccgctactacctaccgcaatcaccaacgcaatcctcaacaaacgacgacgatactaacgaacgaatcgaccgtcgcataaatataaaaaacgttcgctaaacgcgtccttaccgttcgaatactcacaaaaaccgacgccgcgtaaaataaccgatattctacaaacgaatcaacaatctaaattcgtcaaattaacgatacataataactaacacaaataccgaaataaactcgacgctaatatcgatcaatccgcaaaacgataccgttatacgctaatcgataactttaatttcaatcaaaacaaatttaaccgcgccaccaaacactacgtcaaataaattccaacatcaaaccgttcctctacacccgacgataaataaaaatctaacgctaacaaatatattaaacgatataccatttctcgctaaaatacaaataccgattctaactaacaaccgaaaaactaccaccgcaatatactaatccaattcgcttacgtcaaaaactaaatcaacgaaaaacgtaataataatacgcgcaatacgaacgataaacgtcgactaactacaaaatatctacaacgcttcgacttcccgacacaaaacattatcccaccgaatcgctacgctaattcaacgtccttacacccataacgaatacacaacgaaaaaaacgtcgacccgaaactaacgtttcacgtttacctttcaattcgcca

SEQ ID NO: 14039 - DNA, 1124 bp, Artificial Sequence
  chemically treated genomic DNA (Homo sapiens) CpG-island No: 14039
  misc_feature (39)..(40): n is either a, c, g or t
  misc_feature (42)..(43): n is either a, c, g or t
gtcgtggtttcgtgtttttttttgtttgtcgtttcgttnnanntaagttgtgttttcgtttggagaagataaagatgtgtggttttttttttgtggcggcgtttttttcgtgtggggtttttttcgtgtaattttggttttttattttttcggagttttttcgtttatattggcgaatgggtcgcggaatgattcgttaggcgaaggtttatgacgcgttatcgtattatatttttaatcgtaaagttaatagtcggcgtaatagtcggtacgtaataacgtgtggattacgatatgcgttacggttatttcgttcgggtaaatgtgtttgtgaaagtgggcgagtcggcgtgggataataataaagattatcgatacgttaaggcgttgttaatttatggttcgttgttgtttgtcgtagttattagcgtaatttttagtaagcgacggcgatgttggcggacgggtcgatcgtcgtatgagtatggaaggcgttcgttgggcgcgtttttatcgttcggatatttataaggatcgacgtcgcgtaaagtgatcgatgttttgtaaacgggttagtaatttgggttcgttaggttggcgatgtatggtggttggtataagtgtcgaagtgaattcggcgttggtgtcgattaattcgtaaaacggtgtcgttatgcgttggtcggtggttttgattttaattagagtaagtttaatcgcgttattaggtattgcgttaggtgggttttaatattaaatcgtttttttatattcggcgatggataaaggtttgacgttggtaagtatgttgaacgatgtgttatttttcgttgggatgtaagtgtcggttttgattggtagtcgaagaattattatcgtagtatgttggtttaattcgtttacgttaggggttgggttagcgaaaaacgtggtgatggtacgcgtaatgcgggcgatgggcgtcgattagttgtagaatatttgtaacgtttcggtttttcggtataaaatattgttttatcgaatcgttgcgttggtttagcgtttttatatttatgacgggtatatagcggagaaagcgtcggttcggagttggcgttttacgtttgttttttagttcgtta

SEQ ID NO: 14040 - DNA, 1124 bp, Artificial Sequence
  chemically treated genomic DNA (Homo sapiens) CpG-island No: 14040
  misc_feature (1082)..(1083): n is either a, c, g or t
  misc_feature (1085)..(1086): n is either a, c, g or t
taacgaactaaaaaacaaacgtaaaacgccaactccgaaccgacgctttctccgctatatacccgtcataaatataaaaacgctaaaccaacgcaacgattcgataaaacaatattttataccgaaaaaccgaaacgttacaaatattctacaactaatcgacgcccatcgcccgcattacgcgtaccatcaccacgtttttcgctaacccaacccctaacgtaaacgaattaaaccaacatactacgataataattcttcgactaccaatcaaaaccgacacttacatcccaacgaaaaataacacatcgttcaacatacttaccaacgtcaaacctttatccatcgccgaatataaaaaaacgatttaatattaaaacccacctaacgcaatacctaataacgcgattaaacttactctaattaaaatcaaaaccaccgaccaacgcataacgacaccgttttacgaattaatcgacaccaacgccgaattcacttcgacacttataccaaccaccatacatcgccaacctaacgaacccaaattactaacccgtttacaaaacatcgatcactttacgcgacgtcgatccttataaatatccgaacgataaaaacgcgcccaacgaacgccttccatactcatacgacgatcgacccgtccgccaacatcgccgtcgcttactaaaaattacgctaataactacgacaaacaacaacgaaccataaattaacaacgccttaacgtatcgataatctttattattatcccacgccgactcgcccactttcacaaacacatttacccgaacgaaataaccgtaacgcatatcgtaatccacacgttattacgtaccgactattacgccgactattaactttacgattaaaaatataatacgataacgcgtcataaaccttcgcctaacgaatcattccgcgacccattcgccaatataaacgaaaaaactccgaaaaaataaaaaaccaaaattacacgaaaaaaaccccacacgaaaaaaacgccgccacaaaaaaaaaaccacacatctttatcttctccaaacgaaaacacaacttanntnnaacgaaacgacaaacaaaaaaaaacacgaaaccacgac

SEQ ID NO: 14041 - DNA, 565 bp, Artificial Sequence
  chemically treated genomic DNA (Homo sapiens) CpG-island No: 14041
cgcgatcgcgcgtttgtttggtagattcgtttgcgggttattttttataaggaatagttcggtacggttaaggttttgcgcggtaaattagttagtttgttaggtaacgtcgggtcgttggttagttttttacgattatttttttggtcgtacgtatacggcgttgggcgttggaaatcgttatttcgttagtagtttagtcgtttgaacgttttggtttagttataggataaggtattttttattacgttagaaacgaatgtcgcgtattgacgcgaagaagacgttttttcgtttgttcggtaaattgcggattttgtatttttattgtagtatataggcgtagcgattttagatatttttcgtcgatagttttatacgcgcggtagaatattgcggtatttatagaatttacgtatcgcgtttaaaggttattgacgtagattattaatatgggtatcgttttgtatcgttgggtaaggttgattaaatattcgtgatatttatttttttttaagcgtacgtgtatcggttgatgtttttattatataatcgagttcggttt

SEQ ID NO: 14042 - DNA, 565 bp, Artificial Sequence
  chemically treated genomic DNA (Homo sapiens) CpG-island No: 14042
aaaccgaactcgattatataataaaaacatcaaccgatacacgtacgcttaaaaaaaaataaatatcacgaatatttaatcaaccttacccaacgatacaaaacgatacccatattaataatctacgtcaataacctttaaacgcgatacgtaaattctataaataccgcaatattctaccgcgcgtataaaactatcgacgaaaaatatctaaaatcgctacgcctatatactacaataaaaatacaaaatccgcaatttaccgaacaaacgaaaaaacgtcttcttcgcgtcaatacgcgacattcgtttctaacgtaataaaaaataccttatcctataactaaaccaaaacgttcaaacgactaaactactaacgaaataacgatttccaacgcccaacgccgtatacgtacgaccaaaaaaataatcgtaaaaaactaaccaacgacccgacgttacctaacaaactaactaatttaccgcgcaaaaccttaaccgtaccgaactattccttataaaaaataacccgcaaacgaatctaccaaacaaacgcgcgatcgcg

SEQ ID NO: 14043 - DNA, 565 bp, Artificial Sequence
  chemically treated genomic DNA (Homo sapiens) CpG-island No: 14043
aggtcgagttcgattgtatagtaagagtattagtcggtatacgtgcgtttaggaaggggtgaatgttacgaatgtttagttaattttatttaacgatgtagggcggtatttatgttaatggtttgcgttagtgatttttggacgcgatgcgtgagttttgtgaatatcgtaatattttgtcgcgcgtgtaaagttgtcggcggaagatatttgggatcgttgcgtttatgtgttgtagtaaaaatgtaggattcgtagtttgtcgggtagacgaaagagcgtttttttcgcgttaatgcgcggtattcgtttttggcgtggtgaaagatgttttattttgtggttgaattagaacgtttaggcggttgaattgttggcggagtggcgatttttagcgtttagcgtcgtatgcgtgcggttaaaaaagtggtcgtaaaaagttgattagcggttcggcgttgtttggtaaattggttgatttatcgcgtaggattttaatcgtatcgagttgttttttgtggaaggtgattcgtaggcggatttgttaagtaggcgcgcgatcgcg

SEQ ID NO: 14044 - DNA, 565 bp, Artificial Sequence
  chemically treated genomic DNA (Homo sapiens) CpG-island No: 14044
cgcgatcgcgcgcctacttaacaaatccgcctacgaatcaccttccacaaaaaacaactcgatacgattaaaatcctacgcgataaatcaaccaatttaccaaacaacgccgaaccgctaatcaactttttacgaccacttttttaaccgcacgcatacgacgctaaacgctaaaaatcgccactccgccaacaattcaaccgcctaaacgttctaattcaaccacaaaataaaacatctttcaccacgccaaaaacgaataccgcgcattaacgcgaaaaaaacgctctttcgtctacccgacaaactacgaatcctacatttttactacaacacataaacgcaacgatcccaaatatcttccgccgacaactttacacgcgcgacaaaatattacgatattcacaaaactcacgcatcgcgtccaaaaatcactaacgcaaaccattaacataaataccgccctacatcgttaaataaaattaactaaacattcgtaacattcaccccttcctaaacgcacgtataccgactaatactcttactatacaatcgaactcgacct

SEQ ID NO: 14045 - DNA, 521 bp, Artificial Sequence
  chemically treated genomic DNA (Homo sapiens) CpG-island No: 14045
  misc_feature (41)..(41): n is either a, c, g or t
taaacgcgacgttcgttattcggttcggtttgttttggttntggataatcgggattattcggtttatcgggtaggcggtggtgtagacggtgtatttaatgtagtttcgaagttggtgttatttattgttggttttttgcgcgttgggtaatttttgagcggtatgtaaagtattgacggtataaatatcgtcgtcgtatttcgggcgatgggattaaattcgtttagtatcgaatcgatggtaaataggttttaatggtttgttttgtttgtgacgggcgtagcgttttattagtggttaatcgaattgttgttacggttgcggcgtaaaaaaattttttttatattattatttcgcgtggcggtttgtagtatattaaggtcgagaatcggttttcgatgtcgttacgtttcgttattagttcgttattaaagaaattgtcgttgggagaatcgcgaaacgtggacgtagcgggaatatcggtggattattttatttattttttattttttataaaaat

SEQ ID NO: 14046 - DNA, 521 bp, Artificial Sequence
  chemically treated genomic DNA (Homo sapiens) CpG-island No: 14046
  misc_feature (481)..(481): n is either a, c, g or t
atttttataaaaaataaaaaataaataaaataatccaccgatattcccgctacgtccacgtttcgcgattctcccaacgacaatttctttaataacgaactaataacgaaacgtaacgacatcgaaaaccgattctcgaccttaatatactacaaaccgccacgcgaaataataatataaaaaaaatttttttacgccgcaaccgtaacaacaattcgattaaccactaataaaacgctacgcccgtcacaaacaaaacaaaccattaaaacctatttaccatcgattcgatactaaacgaatttaatcccatcgcccgaaatacgacgacgatatttataccgtcaatactttacataccgctcaaaaattacccaacgcgcaaaaaaccaacaataaataacaccaacttcgaaactacattaaatacaccgtctacaccaccgcctacccgataaaccgaataatcccgattatccanaaccaaaacaaaccgaaccgaataacgaacgtcgcgttta

SEQ ID NO: 14047 - DNA, 521 bp, Artificial Sequence
  chemically treated genomic DNA (Homo sapiens) CpG-island No: 14047
  misc_feature (481)..(481): n is either a, c, g or t
atttttataggggatggaagatgagtgaggtggtttatcgatattttcgttacgtttacgtttcgcggtttttttagcggtagtttttttagtggcggattggtagcggaacgtaacggtatcgagagtcgattttcggttttgatgtgttataaatcgttacgcggggtgatggtataagggagatttttttgcgtcgtaatcgtggtagtagttcggttaattattgatgagacgttacgttcgttataggtagggtaaattattgaaatttgtttgttatcggttcggtgttgggcggatttgattttatcgttcgggatgcggcggcggtgtttgtgtcgttagtgttttatatgtcgtttaaagattgtttaacgcgtaggaggttaataatgaatgatattagtttcgaaattgtattaagtgtatcgtttgtattatcgtttgttcggtgagtcgggtaatttcggttatttanggttaaaataagtcgggtcggatggcgagcgtcgcgtttg

SEQ ID NO: 14048 - DNA, 521 bp, Artificial Sequence
  chemically treated genomic DNA (Homo sapiens) CpG-island No: 14048
  misc_feature (41)..(41): n is either a, c, g or t
caaacgcgacgctcgccatccgacccgacttattttaaccntaaataaccgaaattacccgactcaccgaacaaacgataatacaaacgatacacttaatacaatttcgaaactaatatcattcattattaacctcctacgcgttaaacaatctttaaacgacatataaaacactaacgacacaaacaccgccgccgcatcccgaacgataaaatcaaatccgcccaacaccgaaccgataacaaacaaatttcaataatttaccctacctataacgaacgtaacgtctcatcaataattaaccgaactactaccacgattacgacgcaaaaaaatctcccttataccatcaccccgcgtaacgatttataacacatcaaaaccgaaaatcgactctcgataccgttacgttccgctaccaatccgccactaaaaaaactaccgctaaaaaaaccgcgaaacgtaaacgtaacgaaaatatcgataaaccacctcactcatcttccatcccctataaaaat

SEQ ID NO: 14049 - DNA, 1259 bp, Artificial Sequence
  chemically treated genomic DNA (Homo sapiens) CpG-island No: 14049
gtacgcgtttacggattatcgaaaaacggcggcggttttaaataatttgcggtgtcggattaaagaaatattagattgtcgtattgatagcgtaataattattattatcggtataaatacggttgagattttattcgtagttgatcgatttttggtttgttgttttgggtttggcgtattatgcgaagattcgtgatagcgtagtatggttgttaatcgtattggtacgaaatagttattgtcgttttgtattattgtttcggtatggacgttatcgttttcgttttttgttgcgggattggttcgttcgttagtatcgttttatttagttatgttcgttttgggtaatttcgttatttatcggtacgcgatcgtcggtcgtcggcgtagtaatatatttggttgtatttttgttagaggtacgttttttttttttcgttagtaattaggcgtgtcgtcggcggggttaaatcgagtaattttttagcgttttagaagaacgttggcgtgcgcgcgtttttagtatatggcgagattgattagatcgataattatcgcgttggtttcgtaataaagatgcgcgtttttatcgggaattattgcggttataggttgacgtttatcgaatgagttacgttacgttagtatttagcgttattagcgtatttatcgtcgtttatcgtttagtaggtttttttatgtattgcggtaaaaatggtcgtcggtaaaattattattgttagggttattaggtcgataattaattataggttgcgttgttagcggtgattattatgttatcgtcgattattttttagattatttcgggatatttatcgttagtgcgataattgtttgttagcggaagcgtttatcgtagcgacggcggttttttgttggcgttcgcggcgtttagcgttattttaatcgttttcgcgtcgtagttcgttttttttatcgtttgtattaaatttgtggggaggtattgtttattattagcgtagtacgtttcgttaggttattcgtgtttgagtgacgttcggtacgttttgtagcgtattttgtacgcggtgatatagttggcgtagtttatgtcgtttagtagtaattgttggttgtatcgttatcggcggtcgttgtcggaagcgttttagaaatcgttgttaggttttcgacgggattgatgatttcgttagcggtttagtttttgggtggttatagatgcgttataattcgcgtcggattttcgtgttgttgat

SEQ ID NO: 14050 - DNA, 1259 bp, Artificial Sequence
  chemically treated genomic DNA (Homo sapiens) CpG-island No: 14050
atcaacaacacgaaaatccgacgcgaattataacgcatctataaccacccaaaaactaaaccgctaacgaaatcatcaatcccgtcgaaaacctaacaacgatttctaaaacgcttccgacaacgaccgccgataacgatacaaccaacaattactactaaacgacataaactacgccaactatatcaccgcgtacaaaatacgctacaaaacgtaccgaacgtcactcaaacacgaataacctaacgaaacgtactacgctaataataaacaatacctccccacaaatttaatacaaacgataaaaaaaacgaactacgacgcgaaaacgattaaaataacgctaaacgccgcgaacgccaacaaaaaaccgccgtcgctacgataaacgcttccgctaacaaacaattatcgcactaacgataaatatcccgaaataatctaaaaaataatcgacgataacataataatcaccgctaacaacgcaacctataattaattatcgacctaataaccctaacaataataattttaccgacgaccatttttaccgcaatacataaaaaaacctactaaacgataaacgacgataaatacgctaataacgctaaatactaacgtaacgtaactcattcgataaacgtcaacctataaccgcaataattcccgataaaaacgcgcatctttattacgaaaccaacgcgataattatcgatctaatcaatctcgccatatactaaaaacgcgcgcacgccaacgttcttctaaaacgctaaaaaattactcgatttaaccccgccgacgacacgcctaattactaacgaaaaaaaaaaaacgtacctctaacaaaaatacaaccaaatatattactacgccgacgaccgacgatcgcgtaccgataaataacgaaattacccaaaacgaacataactaaataaaacgatactaacgaacgaaccaatcccgcaacaaaaaacgaaaacgataacgtccataccgaaacaataatacaaaacgacaataactatttcgtaccaatacgattaacaaccatactacgctatcacgaatcttcgcataatacgccaaacccaaaacaacaaaccaaaaatcgatcaactacgaataaaatctcaaccgtatttataccgataataataattattacgctatcaatacgacaatctaatatttctttaatccgacaccgcaaattatttaaaaccgccgccgtttttcgataatccgtaaacgcgtac

SEQ ID NO: 14051 - DNA, 1259 bp, Artificial Sequence
  chemically treated genomic DNA (Homo sapiens) CpG-island No: 14051
attagtagtacgaaggttcggcgcgggttatgacgtatttgtagttatttaaaggttaaatcgttggcggagttattaatttcgtcggaagtttgatagcggtttttgaggcgttttcggtagcgatcgtcgatgacgatgtagttagtagttgttgttgagcggtatgagttgcgttagttgtgttatcgcgtataaaatgcgttgtaaagcgtatcgggcgttatttaggtacgggtaatttggcggagcgtattgcgttggtgatgggtagtgtttttttataagtttagtgtaggcggtggaaaaagcgggttacggcgcggaagcgattgaaatgacgttaaacgtcgcgagcgttagtaagaaatcgtcgtcgttacgataagcgttttcgttggtaggtaattgtcgtattggcggtgggtatttcgggatggtttgggggatgatcggcgataatatgatggttatcgttgataacgtagtttgtggttggttatcggtttgataattttggtagtgatggttttgtcggcggttatttttatcgtagtgtatggaaaagtttgttgaacggtgggcgacgatggatacgttggtggcgttgggtattggcgtggcgtggtttattcgatgagcgttaatttgtggtcgtagtggttttcgatggaagcgcgtatttttattacgaagttagcgcgatgattatcggtttgattaatttcgttatatgttggaagcgcgcgtacgttagcgtttttttaaggcgttggaaagttattcgatttaatttcgtcgacggtacgtttggttattgacgaagggaaaaaagcgtgtttttggtagaagtgtagttaggtatgttgttgcgtcgacgatcggcgatcgcgtgtcggtagatggcgagattatttagggcgaatatggttggatgaagcgatgttgacgggcgaattaatttcgtagtaaaaggcgaaggcgatagcgtttatgtcgggatagtggtataggacggtagtggttgtttcgtgttagtgcggttggtagttatattacgttgttacgaattttcgtatggtgcgttaggtttagagtagtaagttagaaatcggttagttgcggataaaattttagtcgtatttgtgtcggtagtggtggttattgcgttgttagtgcggtaatttggtatttttttggttcggtatcgtagattgtttggaatcgtcgtcgtttttcggtggttcgtggacgcgtat

SEQ ID NO: 14052 - DNA, 1259 bp, Artificial Sequence
  chemically treated genomic DNA (Homo sapiens) CpG-island No: 14052
atacgcgtccacgaaccaccgaaaaacgacgacgattccaaacaatctacgataccgaaccaaaaaaataccaaattaccgcactaacaacgcaataaccaccactaccgacacaaatacgactaaaattttatccgcaactaaccgatttctaacttactactctaaacctaacgcaccatacgaaaattcgtaacaacgtaatataactaccaaccgcactaacacgaaacaaccactaccgtcctataccactatcccgacataaacgctatcgccttcgccttttactacgaaattaattcgcccgtcaacatcgcttcatccaaccatattcgccctaaataatctcgccatctaccgacacgcgatcgccgatcgtcgacgcaacaacatacctaactacacttctaccaaaaacacgcttttttcccttcgtcaataaccaaacgtaccgtcgacgaaattaaatcgaataactttccaacgccttaaaaaaacgctaacgtacgcgcgcttccaacatataacgaaattaatcaaaccgataatcatcgcgctaacttcgtaataaaaatacgcgcttccatcgaaaaccactacgaccacaaattaacgctcatcgaataaaccacgccacgccaatacccaacgccaccaacgtatccatcgtcgcccaccgttcaacaaacttttccatacactacgataaaaataaccgccgacaaaaccatcactaccaaaattatcaaaccgataaccaaccacaaactacgttatcaacgataaccatcatattatcgccgatcatcccccaaaccatcccgaaatacccaccgccaatacgacaattacctaccaacgaaaacgcttatcgtaacgacgacgatttcttactaacgctcgcgacgtttaacgtcatttcaatcgcttccgcgccgtaacccgctttttccaccgcctacactaaacttataaaaaaacactacccatcaccaacgcaatacgctccgccaaattacccgtacctaaataacgcccgatacgctttacaacgcattttatacgcgataacacaactaacgcaactcataccgctcaacaacaactactaactacatcgtcatcgacgatcgctaccgaaaacgcctcaaaaaccgctatcaaacttccgacgaaattaataactccgccaacgatttaacctttaaataactacaaatacgtcataacccgcgccgaaccttcgtactactaat

SEQ ID NO: 14053 - DNA, 781 bp, Artificial Sequence
  chemically treated genomic DNA (Homo sapiens) CpG-island No: 14053
gcgtgtacgtgtgttagtttaggtagagggagcgtttcggcggaggagttaaggaagagggggagggagaaacggttagaatttcggttcgggcgttttcgtcggtcgcggaggagttgtagttttaataggttcgtagaacgcgcgttcgttttttgtggttgagtcgtttttttcgcgggagcggttggcggagagatttcggttataggtttcgcgttgagagttttttagaggcggtttttttcggtttttttttttttttggagttttagtcgtcggcggttttttcggggcgaggtagagggcgtttcgggttttcgttttagtattatttcggggatagttttcgcgtcgtatcgggttttatcgggttagtattgtagcggcggatagcggcggtcgggcgggtttttcgtatttttcgttttggtttcgcgcggttgttaaggatcgtttttcgtttcgcgggtcgtttttaacgttagtatcgcggcggcggatagtttttttcgcggtatcgcgaatcgcgaataaagtcgcgggtttggggtttttagcgcgttaggggtggcgtgaggtcgtatcgatcgggggattttagttttttttaagaggtgttatcggcgagttaggcgggggtttagtatagtcgcgcgtttcggtttgggttcgtcgttcgtcgaggtttggtcgtgtaatggcggggttagttaagagtgggtaagaggtagagggggaaataggtatagaacggttcggtttcgttaggcgggttggg

SEQ ID NO: 14054 - DNA, 781 bp, Artificial Sequence
  chemically treated genomic DNA (Homo sapiens) CpG-island No: 14054
cccaacccgcctaacgaaaccgaaccgttctatacctatttccccctctacctcttacccactcttaactaaccccgccattacacgaccaaacctcgacgaacgacgaacccaaaccgaaacgcgcgactatactaaacccccgcctaactcgccgataacacctcttaaaaaaaactaaaatcccccgatcgatacgacctcacgccacccctaacgcgctaaaaaccccaaacccgcgactttattcgcgattcgcgataccgcgaaaaaaactatccgccgccgcgatactaacgttaaaaacgacccgcgaaacgaaaaacgatccttaacaaccgcgcgaaaccaaaacgaaaaatacgaaaaacccgcccgaccgccgctatccgccgctacaatactaacccgataaaacccgatacgacgcgaaaactatccccgaaataatactaaaacgaaaacccgaaacgccctctacctcgccccgaaaaaaccgccgacgactaaaactccaaaaaaaaaaaaaaaccgaaaaaaaccgcctctaaaaaactctcaacgcgaaacctataaccgaaatctctccgccaaccgctcccgcgaaaaaaacgactcaaccacaaaaaacgaacgcgcgttctacgaacctattaaaactacaactcctccgcgaccgacgaaaacgcccgaaccgaaattctaaccgtttctccctccccctcttccttaactcctccgccgaaacgctccctctacctaaactaacacacgtacacgc

SEQ ID NO: 14055 - DNA, 781 bp, Artificial Sequence
  chemically treated genomic DNA (Homo sapiens) CpG-island No: 14055
tttagttcgtttagcggagtcggatcgttttgtgtttgtttttttttttattttttgtttatttttagttggtttcgttattgtacggttaggtttcggcgggcggcggatttaagtcgagacgcgcggttgtgttaggttttcgtttagttcgtcggtgatattttttgggagaagttgaaatttttcgatcgatgcggttttacgttatttttagcgcgttgggggttttagattcgcggttttgttcgcggttcgcggtgtcgcggagagagttgttcgtcgtcgcggtgttagcgttgggagcggttcgcggggcgagggacggtttttagtagtcgcgcggaattagggcggagggtgcgaggagttcgttcggtcgtcgttgttcgtcgttgtagtgttgattcgatgggattcggtgcggcgcgggagttgttttcgagatggtgttggagcgagagttcgaggcgttttttgtttcgtttcggaagagtcgtcggcggttgaggttttagggagggggagaggtcggaggaagtcgtttttaggaagtttttagcgcggggtttgtggtcggggttttttcgttaatcgttttcgcggagggggcggtttagttatagggagcgagcgcgcgttttacgaatttgttggagttgtagttttttcgcggtcgacgagggcgttcgggtcgaggttttggtcgttttttttttttttttttttttgattttttcgtcgaggcgttttttttgtttgggttagtatacgtgtacgt

SEQ ID NO: 14056 - DNA, 781 bp, Artificial Sequence
  chemically treated genomic DNA (Homo sapiens) CpG-island No: 14056
acgtacacgtatactaacccaaacaaaaaaaacgcctcgacgaaaaaatcaaaaaaaaaaaaaaaaaaaaaacgaccaaaacctcgacccgaacgccctcgtcgaccgcgaaaaaactacaactccaacaaattcgtaaaacgcgcgctcgctccctataactaaaccgccccctccgcgaaaacgattaacgaaaaaaccccgaccacaaaccccgcgctaaaaacttcctaaaaacgacttcctccgacctctccccctccctaaaacctcaaccgccgacgactcttccgaaacgaaacaaaaaacgcctcgaactctcgctccaacaccatctcgaaaacaactcccgcgccgcaccgaatcccatcgaatcaacactacaacgacgaacaacgacgaccgaacgaactcctcgcaccctccgccctaattccgcgcgactactaaaaaccgtccctcgccccgcgaaccgctcccaacgctaacaccgcgacgacgaacaactctctccgcgacaccgcgaaccgcgaacaaaaccgcgaatctaaaacccccaacgcgctaaaaataacgtaaaaccgcatcgatcgaaaaatttcaacttctcccaaaaaatatcaccgacgaactaaacgaaaacctaacacaaccgcgcgtctcgacttaaatccgccgcccgccgaaacctaaccgtacaataacgaaaccaactaaaaataaacaaaaaataaaaaaaaaaacaaacacaaaacgatccgactccgctaaacgaactaaa

SEQ ID NO: 14057 - DNA, 667 bp, Artificial Sequence
  chemically treated genomic DNA (Homo sapiens) CpG-island No: 14057
cggaaagtggatttcggtttcgatttttttttacgggtttcgattttcgttgttaagataggtcgtggcgttcgtttttatttttacggttttttacgaagttaagtgtggagttcggatcgtttttttttttcggattttcggggttagcggcggcggtcgattggtcgggtcgttgcggattcgggggcggttttttttgtcgttgtcgttgttttttttttatttttcgtttgaatagttttaggaagttgtcgtcgttggcgaataagtttacgtcgttcgatatcgggttcgaattcgcgttcgatattttttcgttttcgttttcgggcgacgttttcgatttcgatttagtttaacggttttcgttatcgttatcgttcgcggggttcggagtttttcggttttgaggtttcgttcgtttttttcgggtagttattttgtcgttaggtgtcgcgtaaaggatttcgggaaggtcgtttcggtttcgcgtttggcgttcgattcgtttcgtttcgaataatgtatgtcgggaagagcggttaggttttttagcgttcgtagcgggggcggggcgaatgagggaattaattcgaaggggcggggttagggggaggagttttcgtttcgcgggtttttttgtttcgttttttttttttttttt

SEQ ID NO: 14058 - DNA, 667 bp, Artificial Sequence
  chemically treated genomic DNA (Homo sapiens) CpG-island No: 14058
aaaaaaaaaaaaaaaaacgaaacaaaaaaacccgcgaaacgaaaactcctccccctaaccccgccccttcgaattaattccctcattcgccccgcccccgctacgaacgctaaaaaacctaaccgctcttcccgacatacattattcgaaacgaaacgaatcgaacgccaaacgcgaaaccgaaacgaccttcccgaaatcctttacgcgacacctaacgacaaaataactacccgaaaaaaacgaacgaaacctcaaaaccgaaaaactccgaaccccgcgaacgataacgataacgaaaaccgttaaactaaatcgaaatcgaaaacgtcgcccgaaaacgaaaacgaaaaaatatcgaacgcgaattcgaacccgatatcgaacgacgtaaacttattcgccaacgacgacaacttcctaaaactattcaaacgaaaaataaaaaaaaaacaacgacaacgacaaaaaaaaccgcccccgaatccgcaacgacccgaccaatcgaccgccgccgctaaccccgaaaatccgaaaaaaaaaaacgatccgaactccacacttaacttcgtaaaaaaccgtaaaaataaaaacgaacgccacgacctatcttaacaacgaaaatcgaaacccgtaaaaaaaaatcgaaaccgaaatccactttccg

SEQ ID NO: 14059 - DNA, 667 bp, Artificial Sequence
  chemically treated genomic DNA (Homo sapiens) CpG-island No: 14059
aaaagaaaaaaaaaaaacgaaataaaaaaattcgcgagacgggggtttttttttttagtttcgttttttcgggttggtttttttattcgtttcgttttcgttgcgggcgttggagggtttgatcgtttttttcggtatgtattgttcgggacgaggcgagtcgggcgttaagcgcggggtcggagcggttttttcggagttttttgcgcggtatttggcgataaaatggttgttcgagggagacgggcggagttttagggtcgggaggtttcgggtttcgcgggcggtggcggtggcgggagtcgttgggttgagtcgggatcggggacgtcgttcgagagcggggacgaggaggtgtcgggcgcgggttcgagttcggtgtcgggcggcgtgaatttgttcgttaacgacggtagttttttggagttgtttaagcggaagatggaggaggagtagcggtagcggtaggaggagtcgttttcgggttcgtagcgattcgattagtcggtcgtcgtcgttggtttcggggattcgaagaggaagggcggttcgggttttatatttagtttcgtaaggagtcgtgggggtgggggcgggcgttacggtttgttttggtagcgggagtcggggttcgtgaagggggatcgggatcgaagtttatttttcg

SEQ ID NO: 14060 - DNA, 667 bp, Artificial Sequence
  chemically treated genomic DNA (Homo sapiens) CpG-island No: 14060
cgaaaaataaacttcgatcccgatcccccttcacgaaccccgactcccgctaccaaaacaaaccgtaacgcccgcccccacccccacgactccttacgaaactaaatataaaacccgaaccgcccttcctcttcgaatccccgaaaccaacgacgacgaccgactaatcgaatcgctacgaacccgaaaacgactcctcctaccgctaccgctactcctcctccatcttccgcttaaacaactccaaaaaactaccgtcgttaacgaacaaattcacgccgcccgacaccgaactcgaacccgcgcccgacacctcctcgtccccgctctcgaacgacgtccccgatcccgactcaacccaacgactcccgccaccgccaccgcccgcgaaacccgaaacctcccgaccctaaaactccgcccgtctccctcgaacaaccattttatcgccaaataccgcgcaaaaaactccgaaaaaaccgctccgaccccgcgcttaacgcccgactcgcctcgtcccgaacaatacataccgaaaaaaacgatcaaaccctccaacgcccgcaacgaaaacgaaacgaataaaaaaaccaacccgaaaaaacgaaactaaaaaaaaaaacccccgtctcgcgaatttttttatttcgttttttttttttctttt

SEQ ID NO: 14061 - DNA, 645 bp, Artificial Sequence
  chemically treated genomic DNA (Homo sapiens) CpG-island No: 14061
ggttttcggttttcggtttcggcgtattttttattattgggtagggcgcgcgtacgcggcgtagcgcgcgtagtttttaggtgatatggttagatacgaggtcgcggagcgcgtggtatattcgcgataggacgtggagtacgaggcgggcgtttaggtaggagtagatttcgagtagtagtttcgggggaaggtttagaaggttcggtttatttacggtcgaaattttggacgcggttcgaggtttcgaagcgttcggggacgcggcgggtgtggatagttgcgaggggcgcgagaacgttagttcggattttggcggattgagaacgcgggttacgtaggttttggtttgcgcgtttgggtttgtttttgattttgggttcgagttatcgttttaggtgcgggaattatcgtatcgttttaggggaagttttattgcgatcgggtgggcgttgtcggtttcgcgttttgttttttaggtagtacgagggtattttcggcgttgtttgatgacgtttatgcgtttatcggaagcgacgaagttagatattggtttaatatagaatatcgtttcgtttatagggttttttgtaattgcgtcggttttaggttggaaaatgtaggtttttgtttttgcgtttttta

SEQ ID NO: 14062 - DNA, 645 bp, Artificial Sequence
  chemically treated genomic DNA (Homo sapiens) CpG-island No: 14062
taaaaaacgcaaaaacaaaaacctacattttccaacctaaaaccgacgcaattacaaaaaaccctataaacgaaacgatattctatattaaaccaatatctaacttcgtcgcttccgataaacgcataaacgtcatcaaacaacgccgaaaataccctcgtactacctaaaaaacaaaacgcgaaaccgacaacgcccacccgatcgcaataaaacttcccctaaaacgatacgataattcccgcacctaaaacgataactcgaacccaaaatcaaaaacaaacccaaacgcgcaaaccaaaacctacgtaacccgcgttctcaatccgccaaaatccgaactaacgttctcgcgcccctcgcaactatccacacccgccgcgtccccgaacgcttcgaaacctcgaaccgcgtccaaaatttcgaccgtaaataaaccgaaccttctaaaccttcccccgaaactactactcgaaatctactcctacctaaacgcccgcctcgtactccacgtcctatcgcgaatataccacgcgctccgcgacctcgtatctaaccatatcacctaaaaactacgcgcgctacgccgcgtacgcgcgccctacccaataataaaaaatacgccgaaaccgaaaaccgaaaacc

SEQ ID NO: 14063 - DNA, 645 bp, Artificial Sequence
  chemically treated genomic DNA (Homo sapiens) CpG-island No: 14063
taaaaagcgtagaaataggaatttgtattttttagtttaaggtcgacgtagttgtaagagattttgtaagcggggcgatgttttgtattaagttagtgtttgatttcgtcgttttcggtgggcgtataaacgttattagatagcgtcggaagtgttttcgtgttgtttaggagataagacgcgaggtcggtagcgtttattcggtcgtaatggagttttttttagggcggtgcgatgattttcgtatttgggacgatgattcggatttagagttagagatagatttagacgcgtaggttaaggtttacgtggttcgcgtttttagttcgttaaaattcgggttggcgttttcgcgtttttcgtagttatttatattcgtcgcgttttcgagcgtttcggagtttcgggtcgcgtttagggtttcggtcgtaagtgagtcgggttttttgagttttttttcggagttgttgttcgagatttgtttttatttggacgttcgtttcgtgttttacgttttgtcgcgggtgtgttacgcgtttcgcgatttcgtgtttgattatgttatttggaggttacgcgcgttacgtcgcgtacgcgcgttttatttagtggtggaaggtgcgtcggggtcgggggtcggggatt

SEQ ID NO: 14064 - DNA, 645 bp, Artificial Sequence
  chemically treated genomic DNA (Homo sapiens) CpG-island No: 14064
aatccccgacccccgaccccgacgcaccttccaccactaaataaaacgcgcgtacgcgacgtaacgcgcgtaacctccaaataacataatcaaacacgaaatcgcgaaacgcgtaacacacccgcgacaaaacgtaaaacacgaaacgaacgtccaaataaaaacaaatctcgaacaacaactccgaaaaaaaactcaaaaaacccgactcacttacgaccgaaaccctaaacgcgacccgaaactccgaaacgctcgaaaacgcgacgaatataaataactacgaaaaacgcgaaaacgccaacccgaattttaacgaactaaaaacgcgaaccacgtaaaccttaacctacgcgtctaaatctatctctaactctaaatccgaatcatcgtcccaaatacgaaaatcatcgcaccgccctaaaaaaaactccattacgaccgaataaacgctaccgacctcgcgtcttatctcctaaacaacacgaaaacacttccgacgctatctaataacgtttatacgcccaccgaaaacgacgaaatcaaacactaacttaatacaaaacatcgccccgcttacaaaatctcttacaactacgtcgaccttaaactaaaaaatacaaattcctatttctacgcttttta

SEQ ID NO: 14065 - DNA, 1227 bp, Artificial Sequence
  chemically treated genomic DNA (Homo sapiens) CpG-island No: 14065
gcgttagagagggcgacgggggttcgggaagtttgatagggtttttgcgtatagttgtcggttggttgttattcgttcgcgttagttttcgagaacgcgcgattaggtatttagttcggttatcgtagcggagagttcgtcgttcgttgtagcgaggttcggagcggtttcgtagggattttttttagatcgtttgggtcgttcggatgtgtattaaaatggaatagtttttttattacgacgatttatatatagttacgggatacggtcgggtttttggtggtttttttttatacgattataaatttttgaaatcgagtttggcggttaatttggtcgatttttatcggagttttaaagcgtttggggttcgcggattcggtttagagggcggcggtggcggtagttatttttttggttagggttcggatatcggcgcgttttttaagttcgttttttcggagttggaacgtttgattgtttttaatagtaacggcgtgattacgacgacgtttatattttcgggatagtatttttattttcgcgggggtggtagcggtggaggtgtagggggcgtagggggcggcgttatcgaggagtaggagggtttcgtcgacggttttgttaaagttttggacgatttgtataagatgaattacgtgatattttttaacgtgtttttgggcgttatcggggggttttcggttgggttcgggggcgtttacgtcggttcggagttatttttcgtttatattaattttagtagttattttttagtttttgcgttttcgggaggcgtcggggttgtcgtcgggatcgggagttcgtattcgacgattattattagttattttttatacgcgtcgtttttcgtcggtggttattcggcgtagttgggtttgggtcgcggcgtttttatttttaaggaggaatcgtagatcgtgtcggaggcgcgtagtcgggacgttacgtcgtcggtgttttttattaatatggaagattaagagcgtattaaagtggagcgtaagcggttgcggaatcggttggcggttattaagtgtcggaagcggaagttggagcgtatcgcgcgtttggaggataaggtgaagacgtttaaggtcgagaacgcggggttgtcgagtatcgtcggtttttttcgggagtaggtggtttagtttaaatagaaggttatgatttacgttagtaacggttgttagttgttgtttg

SEQ ID NO: 14066 - DNA, 1227 bp, Artificial Sequence
  chemically treated genomic DNA (Homo sapiens) CpG-island No: 14066
caaacaacaactaacaaccgttactaacgtaaatcataaccttctatttaaactaaaccacctactcccgaaaaaaaccgacgatactcgacaaccccgcgttctcgaccttaaacgtcttcaccttatcctccaaacgcgcgatacgctccaacttccgcttccgacacttaataaccgccaaccgattccgcaaccgcttacgctccactttaatacgctcttaatcttccatattaataaaaaacaccgacgacgtaacgtcccgactacgcgcctccgacacgatctacgattcctccttaaaaataaaaacgccgcgacccaaacccaactacgccgaataaccaccgacgaaaaacgacgcgtataaaaaataactaataataatcgtcgaatacgaactcccgatcccgacgacaaccccgacgcctcccgaaaacgcaaaaactaaaaaataactactaaaattaatataaacgaaaaataactccgaaccgacgtaaacgcccccgaacccaaccgaaaaccccccgataacgcccaaaaacacgttaaaaaatatcacgtaattcatcttatacaaatcgtccaaaactttaacaaaaccgtcgacgaaaccctcctactcctcgataacgccgccccctacgccccctacacctccaccgctaccacccccgcgaaaataaaaatactatcccgaaaatataaacgtcgtcgtaatcacgccgttactattaaaaacaatcaaacgttccaactccgaaaaaacgaacttaaaaaacgcgccgatatccgaaccctaaccaaaaaaataactaccgccaccgccgccctctaaaccgaatccgcgaaccccaaacgctttaaaactccgataaaaatcgaccaaattaaccgccaaactcgatttcaaaaatttataatcgtataaaaaaaaaccaccaaaaacccgaccgtatcccgtaactatatataaatcgtcgtaataaaaaaactattccattttaatacacatccgaacgacccaaacgatctaaaaaaaatccctacgaaaccgctccgaacctcgctacaacgaacgacgaactctccgctacgataaccgaactaaatacctaatcgcgcgttctcgaaaactaacgcgaacgaataacaaccaaccgacaactatacgcaaaaaccctatcaaacttcccgaacccccgtcgccctctctaacgc

SEQ ID NO: 14067 - DNA, 1227 bp, Artificial Sequence
  chemically treated genomic DNA (Homo sapiens) CpG-island No: 14067
taagtagtagttgatagtcgttgttgacgtgggttatgattttttgtttgagttgggttatttgttttcggaggaggtcggcggtattcgatagtttcgcgttttcggttttgagcgtttttattttgttttttaggcgcgcgatgcgttttagttttcgttttcggtatttggtggtcgttagtcggtttcgtagtcgtttgcgttttattttgatgcgtttttggttttttatgttgatgggggatatcggcggcgtggcgtttcggttgcgcgttttcggtacggtttgcggtttttttttgaaggtggaggcgtcgcggtttaagtttagttgcgtcgggtggttatcggcgaagggcggcgcgtgtgggaggtagttgatggtggtcgtcgggtacgagttttcggtttcgacggtagtttcggcgtttttcgaggacgtagaggttggggagtagttgttgaggttggtgtaaacgggaggtggtttcgggtcggcgtagacgttttcgggtttagtcgggggtttttcggtagcgtttagggatacgttggggggtgttacgtggtttattttgtgtagatcgtttagggttttgataaagtcgtcggcgaagtttttttgtttttcggtgacgtcgttttttgcgttttttgtatttttatcgttgttattttcgcgggggtaaaagtattgtttcgggggtgtaggcgtcgtcgtgattacgtcgttgttgttggggataattaggcgttttagtttcgaagaggcgagtttgagagacgcgtcggtgttcgagttttgattagaaaagtagttgtcgttatcgtcgttttttgggtcgggttcgcgagttttaggcgttttgagatttcggtaggggtcggttaggttgatcgttaggttcggttttaggagtttgtagtcgtgtagagagaggttattaggggttcggtcgtatttcgtagttgtgtatgagtcgtcgtggtagaagggttgttttattttagtgtatattcgggcggtttaggcggtttggggagggtttttgcggggtcgtttcgggtttcgttgtagcgagcggcgagtttttcgttgcggtgatcggattgggtgtttggtcgcgcgttttcgggggttggcgcgggcgggtagtagttagtcggtagttgtgcgtaaaagttttgttaggtttttcgagttttcgtcgttttttttggcgt

SEQ ID NO: 14068 - DNA, 1227 bp, Artificial Sequence
  chemically treated genomic DNA (Homo sapiens) CpG-island No: 14068
acgccaaaaaaaacgacgaaaactcgaaaaacctaacaaaacttttacgcacaactaccgactaactactacccgcccgcgccaacccccgaaaacgcgcgaccaaacacccaatccgatcaccgcaacgaaaaactcgccgctcgctacaacgaaacccgaaacgaccccgcaaaaaccctccccaaaccgcctaaaccgcccgaatatacactaaaataaaacaacccttctaccacgacgactcatacacaactacgaaatacgaccgaacccctaataacctctctctacacgactacaaactcctaaaaccgaacctaacgatcaacctaaccgacccctaccgaaatctcaaaacgcctaaaactcgcgaacccgacccaaaaaacgacgataacgacaactacttttctaatcaaaactcgaacaccgacgcgtctctcaaactcgcctcttcgaaactaaaacgcctaattatccccaacaacaacgacgtaatcacgacgacgcctacacccccgaaacaatacttttacccccgcgaaaataacaacgataaaaatacaaaaaacgcaaaaaacgacgtcaccgaaaaacaaaaaaacttcgccgacgactttatcaaaaccctaaacgatctacacaaaataaaccacgtaacaccccccaacgtatccctaaacgctaccgaaaaacccccgactaaacccgaaaacgtctacgccgacccgaaaccacctcccgtttacaccaacctcaacaactactccccaacctctacgtcctcgaaaaacgccgaaactaccgtcgaaaccgaaaactcgtacccgacgaccaccatcaactacctcccacacgcgccgcccttcgccgataaccacccgacgcaactaaacttaaaccgcgacgcctccaccttcaaaaaaaaaccgcaaaccgtaccgaaaacgcgcaaccgaaacgccacgccgccgatatcccccatcaacataaaaaaccaaaaacgcatcaaaataaaacgcaaacgactacgaaaccgactaacgaccaccaaataccgaaaacgaaaactaaaacgcatcgcgcgcctaaaaaacaaaataaaaacgctcaaaaccgaaaacgcgaaactatcgaataccgccgacctcctccgaaaacaaataacccaactcaaacaaaaaatcataacccacgtcaacaacgactatcaactactactta

SEQ ID NO: 14069 - DNA, 669 bp, Artificial Sequence
  chemically treated genomic DNA (Homo sapiens) CpG-island No: 14069
cgcggattcgcggtttttcgggaaagcgtagtcggaaagttattcgcggcggttttttgcgcgttttgttgtgtaagttcggcgttgttagcggacggagaagttgttggtttgttcgatagtttagttcggtggcggttcggggcggattttatggttcgcggcgaacgcggggttagagttggcgtgggcgagtttttgcgcgttttttttcgcggggatttagttcgtttgttttttttcgttcgttggttttttcgatgtttgttgcgtttttggtcgtcgttgttttttcgtcgttttttatttttcggagtcgtcgtttaagtcgaggaggagagaatgatcgaggtgttgtggtcggttgtttttaacgggacggacgttgtttttttggtcggttcgggttcgttttgggggaatagtacggtcgtttttattgtcgtcgttttttcgtcgtttaaatgcgttttgattaagacgggtttttagttttattatttgtcggttgtttatattttggtatttattatcggttttttgggtaatagcgtggttatttggatgttcgttttttatatgaagttttggagcggtattttcgtgtatatgtttaatttggttttggtcgattttttgtacgtgttgattttgttagttttgattttt

SEQ ID NO: 14070 - DNA, 669 bp, Artificial Sequence
  chemically treated genomic DNA (Homo sapiens) CpG-island No: 14070
aaaaatcaaaactaacaaaatcaacacgtacaaaaaatcgaccaaaaccaaattaaacatatacacgaaaataccgctccaaaacttcatataaaaaacgaacatccaaataaccacgctattacccaaaaaaccgataataaataccaaaatataaacaaccgacaaataataaaactaaaaacccgtcttaatcaaaacgcatttaaacgacgaaaaaacgacgacaataaaaacgaccgtactattcccccaaaacgaacccgaaccgaccaaaaaaacaacgtccgtcccgttaaaaacaaccgaccacaacacctcgatcattctctcctcctcgacttaaacgacgactccgaaaaataaaaaacgacgaaaaaacaacgacgaccaaaaacgcaacaaacatcgaaaaaaccaacgaacgaaaaaaaacaaacgaactaaatccccgcgaaaaaaaacgcgcaaaaactcgcccacgccaactctaaccccgcgttcgccgcgaaccataaaatccgccccgaaccgccaccgaactaaactatcgaacaaaccaacaacttctccgtccgctaacaacgccgaacttacacaacaaaacgcgcaaaaaaccgccgcgaataactttccgactacgctttcccgaaaaaccgcgaatccgcg

SEQ ID NO: 14071 - DNA, 669 bp, Artificial Sequence
  chemically treated genomic DNA (Homo sapiens) CpG-island No: 14071
gaagattagggttggtagagttagtacgtataagaagtcggttagagttaaattgaatatgtatacggagatgtcgttttagggttttatgtggaagacgaatatttagatggttacgttgttgtttaggaagtcgatgatgaatattaagatgtagatagtcggtaggtagtaaaattggaagttcgttttggttaaggcgtatttgaacgacgaggagacggcggtagtggaggcgatcgtgttgtttttttaggacgaattcggatcggttaggaaggtagcgttcgtttcgttggggatagtcggttatagtatttcggttattttttttttttcgatttaggcggcggtttcgaggggtaggaggcggcgagagggtagcggcggttaggggcgtagtaagtatcggaaaagttagcgagcggaagggagtaggcgaattggattttcgcgggagggggcgcgtaggggttcgtttacgttagttttggtttcgcgttcgtcgcgggttatgaaattcgtttcgggtcgttatcgaattgggttatcgggtaagttagtaattttttcgttcgttggtaacgtcgagtttatataatagggcgcgtagggaatcgtcgcggataatttttcgattgcgttttttcgaggggtcgcgggttcgcg

SEQ ID NO: 14072 - DNA, 669 bp, Artificial Sequence
  chemically treated genomic DNA (Homo sapiens) CpG-island No: 14072
cgcgaacccgcgacccctcgaaaaaacgcaatcgaaaaattatccgcgacgattccctacgcgccctattatataaactcgacgttaccaacgaacgaaaaaattactaacttacccgataacccaattcgataacgacccgaaacgaatttcataacccgcgacgaacgcgaaaccaaaactaacgtaaacgaacccctacgcgccccctcccgcgaaaatccaattcgcctactcccttccgctcgctaacttttccgatacttactacgcccctaaccgccgctaccctctcgccgcctcctacccctcgaaaccgccgcctaaatcgaaaaaaaaaaaataaccgaaatactataaccgactatccccaacgaaacgaacgctaccttcctaaccgatccgaattcgtcctaaaaaaacaacacgatcgcctccactaccgccgtctcctcgtcgttcaaatacgccttaaccaaaacgaacttccaattttactacctaccgactatctacatcttaatattcatcatcgacttcctaaacaacaacgtaaccatctaaatattcgtcttccacataaaaccctaaaacgacatctccgtatacatattcaatttaactctaaccgacttcttatacgtactaactctaccaaccctaatcttc

SEQ ID NO: 14073 - DNA, 1096 bp, Artificial Sequence
  chemically treated genomic DNA (Homo sapiens) CpG-island No: 14073
gtggcgggattattggcgaagcgacgttcgattttattttttagtttcgtttgatttcggtattttggggataagcggtatcgatagcgacggttcgttttggagttcgattattacgaagttcgtattaaacgcgttattattgagattcgcgttacgttatgttggttgtcgattattcgaaatttggtcgtaatcgatggttaatatgggtagtattagtatggtagatgtcgtttatatcgagtttcgtcgttagtaagcgtgatgtaggtgttgacggattattatatttattggagttgtgttgattttgtacggttttttacgttagattaaaacgtttaggtatttgcgtagtcgattcgcgttattgacgttggttttgttttgcgcgaaacgttaaaaagttggcgttcggttgcggaaagcgattttgtttgcggtagatagcgataacgtgttttagttgtatacggtcgaagagatcgtgttttttgtttttgcgtttagtaacgtcgtaagcgcggaggggcggttttttgttagttatagcgtagacggtttattttatttttaattacgtttaagtgatgcgttcgttagtggttaacgtgggtattcgggtgaagttggtaaaagtcgcgaagttacggcgttagtggttggggagaggtcgtaaagtatagacgtcggtatggtgtatattcgtgtgttatgatgagggtggtttattaatcggcggtaaatttcgcgtcggtatcgtcgtaggcgatgtcggtcgattaatgagattatatagtttatagtcggtattatttgcgtttacgtacgaatttgattgtttagaaatgcggatacgttagcgggatattaacggattgtaggggagcgtatggtttatttgtcgttagtcggtggcgattatattggttgtatcggtagatttgtcgcgcgacggaattttgttattattttacgttcggaaaattttgtttcgtattatacggattttttgtataagttagcgaatttttaggtatttatcgattttaatcgtttcgtttagcgattaggtatcgttagatcgagcgta

SEQ ID NO: 14074 - DNA, 1096 bp, Artificial Sequence
  chemically treated genomic DNA (Homo sapiens) CpG-island No: 14074
tacgctcgatctaacgatacctaatcgctaaacgaaacgattaaaatcgataaatacctaaaaattcgctaacttatacaaaaaatccgtataatacgaaacaaaattttccgaacgtaaaataataacaaaattccgtcgcgcgacaaatctaccgatacaaccaatataatcgccaccgactaacgacaaataaaccatacgctcccctacaatccgttaatatcccgctaacgtatccgcatttctaaacaatcaaattcgtacgtaaacgcaaataataccgactataaactatataatctcattaatcgaccgacatcgcctacgacgataccgacgcgaaatttaccgccgattaataaaccaccctcatcataacacacgaatatacaccataccgacgtctatactttacgacctctccccaaccactaacgccgtaacttcgcgacttttaccaacttcacccgaatacccacgttaaccactaacgaacgcatcacttaaacgtaattaaaaataaaataaaccgtctacgctataactaacaaaaaaccgcccctccgcgcttacgacgttactaaacgcaaaaacaaaaaacacgatctcttcgaccgtatacaactaaaacacgttatcgctatctaccgcaaacaaaatcgctttccgcaaccgaacgccaactttttaacgtttcgcgcaaaacaaaaccaacgtcaataacgcgaatcgactacgcaaatacctaaacgttttaatctaacgtaaaaaaccgtacaaaatcaacacaactccaataaatataataatccgtcaacacctacatcacgcttactaacgacgaaactcgatataaacgacatctaccatactaatactacccatattaaccatcgattacgaccaaatttcgaataatcgacaaccaacataacgtaacgcgaatctcaataataacgcgtttaatacgaacttcgtaataatcgaactccaaaacgaaccgtcgctatcgataccgcttatccccaaaataccgaaatcaaacgaaactaaaaaataaaatcgaacgtcgcttcgccaataatcccgccac

SEQ ID NO: 14075 - DNA, 1096 bp, Artificial Sequence
  chemically treated genomic DNA (Homo sapiens) CpG-island No: 14075
tacgttcgatttaacggtgtttggtcgttgaacgaagcgattaaaatcggtaaatatttgaaggttcgttggtttatgtagaagattcgtgtggtgcggagtaaggtttttcgggcgtgaagtgatggtagagtttcgtcgcgcgataggtttatcgatgtaattaatatgatcgttatcgattggcggtaaatgggttatacgtttttttgtaattcgttgatatttcgttggcgtattcgtatttttggataattaagttcgtacgtaggcgtagatggtatcgattataggttgtgtggttttattggtcgatcggtatcgtttacggcggtgtcggcgcggaatttgtcgtcggttgatgggttatttttattatggtatacgggtgtatattatgtcggcgtttgtgttttgcgatttttttttagttattggcgtcgtaatttcgcgatttttgttagttttattcggatgtttacgttggttattagcggacgtattatttggacgtggttgaagatgagataaatcgtttgcgttataattggtaggaagtcgttttttcgcgtttacggcgttgttgggcgtagaggtagaaaatacgattttttcgatcgtatgtaattggaatacgttatcgttatttgtcgtaggtaaagtcgtttttcgtagtcggacgttagttttttgacgtttcgcgtagggtaaagttagcgttaatgacgcggatcggttacgtaaatatttgggcgttttggtttgacgtgggaagtcgtgtaggattagtatagttttagtgaatatggtggttcgttagtatttgtattacgtttattggcggcggggttcggtgtagacggtatttattatgttgatgttgtttatattgattatcggttacggttaaatttcgagtgatcgataattagtataacgtggcgcgagttttaataatggcgcgtttggtgcgaatttcgtggtaatcgaattttagagcgagtcgtcgttatcgatgtcgtttatttttagaatgtcgaaattaagcggaattgggagataaaatcgagcgtcgtttcgttaatgatttcgttat

SEQ ID NO: 14076 - DNA, 1096 bp, Artificial Sequence
  chemically treated genomic DNA (Homo sapiens) CpG-island No: 14076
ataacgaaatcattaacgaaacgacgctcgattttatctcccaattccgcttaatttcgacattctaaaaataaacgacatcgataacgacgactcgctctaaaattcgattaccacgaaattcgcaccaaacgcgccattattaaaactcgcgccacgttatactaattatcgatcactcgaaatttaaccgtaaccgataatcaatataaacaacatcaacataataaataccgtctacaccgaaccccgccgccaataaacgtaatacaaatactaacgaaccaccatattcactaaaactatactaatcctacacgacttcccacgtcaaaccaaaacgcccaaatatttacgtaaccgatccgcgtcattaacgctaactttaccctacgcgaaacgtcaaaaaactaacgtccgactacgaaaaacgactttacctacgacaaataacgataacgtattccaattacatacgatcgaaaaaatcgtattttctacctctacgcccaacaacgccgtaaacgcgaaaaaacgacttcctaccaattataacgcaaacgatttatctcatcttcaaccacgtccaaataatacgtccgctaataaccaacgtaaacatccgaataaaactaacaaaaatcgcgaaattacgacgccaataactaaaaaaaaatcgcaaaacacaaacgccgacataatatacacccgtataccataataaaaataacccatcaaccgacgacaaattccgcgccgacaccgccgtaaacgataccgatcgaccaataaaaccacacaacctataatcgataccatctacgcctacgtacgaacttaattatccaaaaatacgaatacgccaacgaaatatcaacgaattacaaaaaaacgtataacccatttaccgccaatcgataacgatcatattaattacatcgataaacctatcgcgcgacgaaactctaccatcacttcacgcccgaaaaaccttactccgcaccacacgaatcttctacataaaccaacgaaccttcaaatatttaccgattttaatcgcttcgttcaacgaccaaacaccgttaaatcgaacgta

SEQ ID NO: 14077 - DNA, 554 bp, Artificial Sequence
  chemically treated genomic DNA (Homo sapiens) CpG-island No: 14077
ttagagttattattagttttcgaaatttttcggaggagcgtttcgttattatttgtacggcgaagcggcgcgtaaacgaatttcgaacgttagtttttgcgtttgcgtgtcgcggtttcgtttggtttcgtttcgttggcgttcgtcgggtttttttttcgtcgaggtttgtggtttgtggagtcgaatttttttgttattagtgttcggttagtaggggcgttagtttgggcgtttgcgcggacggcgggcgtcgttattatggtagtattcgttggaggtttaggtaagcgtcgagcgcgcggtttttgtttggaggtggggcgttttgagaggtttcgtcggtcgtattttttttttgcgggttttcgcggttttttttgttagggatttgggagcgcgtcgcgtagaatcgggcggttgggtttggagttcgttttgtattcggggcgcgttcgcgatcgtttggtaaggattttggtttgtcgggtgggttttaaggtataggcgttaggggaggtcgagaatggtagggttagtgttttttgaggttt

SEQ ID NO: 14078 - DNA, 554 bp, Artificial Sequence
  chemically treated genomic DNA (Homo sapiens) CpG-island No: 14078
aaacctcaaaaaacactaaccctaccattctcgacctcccctaacgcctataccttaaaacccacccgacaaaccaaaatccttaccaaacgatcgcgaacgcgccccgaatacaaaacgaactccaaacccaaccgcccgattctacgcgacgcgctcccaaatccctaacaaaaaaaaccgcgaaaacccgcaaaaaaaaaatacgaccgacgaaacctctcaaaacgccccacctccaaacaaaaaccgcgcgctcgacgcttacctaaacctccaacgaatactaccataataacgacgcccgccgtccgcgcaaacgcccaaactaacgcccctactaaccgaacactaataacaaaaaaattcgactccacaaaccacaaacctcgacgaaaaaaaaacccgacgaacgccaacgaaacgaaaccaaacgaaaccgcgacacgcaaacgcaaaaactaacgttcgaaattcgtttacgcgccgcttcgccgtacaaataataacgaaacgctcctccgaaaaatttcgaaaactaataataactctaa

SEQ ID NO: 14079 - DNA, 554 bp, Artificial Sequence
  chemically treated genomic DNA (Homo sapiens) CpG-island No: 14079
agattttaaaagatattgattttgttattttcgattttttttaacgtttgtgttttagagtttattcggtaaattaaggtttttgttaggcgatcgcgggcgcgtttcgagtgtagagcgggttttaagtttagtcgttcggttttgcgcggcgcgtttttaggtttttagtaaggaagatcgcgggagttcgtaaagggagggtacggtcggcggagttttttaaagcgttttatttttaggtagaggtcgcgcgttcggcgtttatttgggtttttagcggatgttgttatggtgacgacgttcgtcgttcgcgtaggcgtttaggttggcgtttttgttaatcgggtattggtggtagggaaattcgattttataaattataggtttcggcgggggaagagttcggcgggcgttagcgaagcggaattaaacggagtcgcggtacgtaggcgtaaaggttggcgttcgaggttcgtttacgcgtcgtttcgtcgtgtaggtggtggcgaagcgttttttcgaaaggtttcggaagttggtggtagttttga

SEQ ID NO: 14080 - DNA, 554 bp, Artificial Sequence
  chemically treated genomic DNA (Homo sapiens) CpG-island No: 14080
tcaaaactaccaccaacttccgaaacctttcgaaaaaacgcttcgccaccacctacacgacgaaacgacgcgtaaacgaacctcgaacgccaacctttacgcctacgtaccgcgactccgtttaattccgcttcgctaacgcccgccgaactcttcccccgccgaaacctataatttataaaatcgaatttccctaccaccaatacccgattaacaaaaacgccaacctaaacgcctacgcgaacgacgaacgtcgtcaccataacaacatccgctaaaaacccaaataaacgccgaacgcgcgacctctacctaaaaataaaacgctttaaaaaactccgccgaccgtaccctccctttacgaactcccgcgatcttccttactaaaaacctaaaaacgcgccgcgcaaaaccgaacgactaaacttaaaacccgctctacactcgaaacgcgcccgcgatcgcctaacaaaaaccttaatttaccgaataaactctaaaacacaaacgttaaaaaaaatcgaaaataacaaaatcaatatcttttaaaatct

SEQ ID NO: 14081 - DNA, 1236 bp, Artificial Sequence
  chemically treated genomic DNA (Homo sapiens) CpG-island No: 14081
tttcgtcgtttcgattttcgtaaggggttagtttggtgtcgttttcgtttttttgttattttattcggtaggggttttcgttttcgttacgttttttgaagttgtggttcgcgcgtttttttaggattttttcgcgtcggagaggttcgtaggatcgtcgagtttatatttcgttttcgttcgggtttcgttttttcgcgtcgttttggtacgtttcggttacgttttttcggacgcgtttggtacgcgtcgggttttttcgttcgttttagtggttcggtcgcggcgattttatttcggcggcgcgtttttcgagtttggtacggtttagttcgtttttttcgaagtcgcgcgttcgcgttcgcgttttttagtcggtggagttcgtagttttttttgtggttcgcggtagtttttcgttcgttcggttcgcgttcgttatggttcgttcgcgtcgtgtttcgtatcgtttcggcgtcgggggttttttcgggggtcgcggtcgtttttcgcggtttttcgtggtgcgcgtcgttcgttcgcgtttttggtttgttagttttcgaggttcgtagttttcgcggattcgggttcgttcggttttttttatggtgagtttttcgttttttttttagagttttttacggtttcgtttttttagtttttatttcgggtttacgtttttgttcgtagttttcgtcgtttcggggtgttttttgtggttcgaagggtggtttcgttcggggtcgggttttttcgtggagtattcggtggttcgcgtcgcgtttttttttttgttgcgcgttcgggtcggggtggggggttgggggacgggggcggggcgggtttatattattgttgatttcgcggttcgatttaaacgcgggttgggggcggtagataggtagtcggtacgttcgtttgttttttttattggagagttgttcgtttttcgggtaggaaatttggaaatgggggcggttttgggggatagcggcgagggaggggttcgcgttttgtattagcgtttttagatgtcgtattcgtgggcgtttttttttggcggtcgtttcgtgttcgtggagtgcgtatttagaatacgcgttcgcgtttatatgtgggatgttttgatggattgtcgtgagtttagattttaaacgtaaatatttagtttcgtaggtattttgggttgtatacgttttttcggatttaaaagatgtatatgttttttagaaa

SEQ ID NO: 14082 - DNA, 1236 bp, Artificial Sequence
  chemically treated genomic DNA (Homo sapiens) CpG-island No: 14082
tttctaaaaaacatatacatcttttaaatccgaaaaaacgtatacaacccaaaatacctacgaaactaaatatttacgtttaaaatctaaactcacgacaatccatcaaaacatcccacatataaacgcgaacgcgtattctaaatacgcactccacgaacacgaaacgaccgccaaaaaaaaacgcccacgaatacgacatctaaaaacgctaatacaaaacgcgaacccctccctcgccgctatcccccaaaaccgcccccatttccaaatttcctacccgaaaaacgaacaactctccaataaaaaaaacaaacgaacgtaccgactacctatctaccgcccccaacccgcgtttaaatcgaaccgcgaaatcaacaataatataaacccgccccgcccccgtcccccaaccccccaccccgacccgaacgcgcaacaaaaaaaaaaacgcgacgcgaaccaccgaatactccacgaaaaaacccgaccccgaacgaaaccacccttcgaaccacaaaaaacaccccgaaacgacgaaaactacgaacaaaaacgtaaacccgaaataaaaactaaaaaaacgaaaccgtaaaaaactctaaaaaaaaaacgaaaaactcaccataaaaaaaaccgaacgaacccgaatccgcgaaaactacgaacctcgaaaactaacaaaccaaaaacgcgaacgaacgacgcgcaccacgaaaaaccgcgaaaaacgaccgcgacccccgaaaaaacccccgacgccgaaacgatacgaaacacgacgcgaacgaaccataacgaacgcgaaccgaacgaacgaaaaactaccgcgaaccacaaaaaaaactacgaactccaccgactaaaaaacgcgaacgcgaacgcgcgacttcgaaaaaaacgaactaaaccgtaccaaactcgaaaaacgcgccgccgaaataaaatcgccgcgaccgaaccactaaaacgaacgaaaaaacccgacgcgtaccaaacgcgtccgaaaaaacgtaaccgaaacgtaccaaaacgacgcgaaaaaacgaaacccgaacgaaaacgaaatataaactcgacgatcctacgaacctctccgacgcgaaaaaatcctaaaaaaacgcgcgaaccacaacttcaaaaaacgtaacgaaaacgaaaacccctaccgaataaaataacaaaaaaacgaaaacgacaccaaactaaccccttacgaaaatcgaaacgacgaaa

SEQ ID NO: 14083 - DNA, 1236 bp, Artificial Sequence
  chemically treated genomic DNA (Homo sapiens) CpG-island No: 14083
tttttgaaaagtatgtgtattttttgggttcggagaagcgtgtgtagtttaaagtatttgcgaagttgaatgtttacgtttaaggtttgggtttacggtagtttattaaagtattttatatgtgggcgcgggcgcgtattttaggtgcgtattttacgggtacggagcggtcgttaggggagaacgtttacgggtgcgatatttgggggcgttggtataaagcgcgggtttttttttcgtcgttgttttttaaaatcgtttttatttttaggttttttgttcggagagcgagtaattttttaataggaaaaataagcgagcgtgtcggttgtttgtttgtcgtttttagttcgcgtttaaatcgggtcgcggagttagtagtaatatgagttcgtttcgttttcgttttttaattttttatttcggttcgaacgcgtaataaaggggagagcgcggcgcgaattatcgggtgttttacgggggaattcggtttcgggcgggattatttttcgggttataggggatatttcggagcggcgggggttgcggataaaggcgtgagttcgggataggggttgggggggcggggtcgtggaaggttttggaaaaagggcggggggtttattatgggaggggtcgagcgggttcggattcgcggaggttgcgggtttcgggggttggtaggttaggagcgcgagcggacggcgcgtattacgaggggtcgcggagggcggtcgcgattttcgagggggttttcggcgtcggagcggtacggggtacggcgcggacggattatggcgggcgcgggtcgagcgggcggggagttgtcgcgggttataaggggggttgcgggttttatcgattgaggggcgcgggcgcgggcgcgcggtttcgggggagacgggttgagtcgtattaagttcgggggacgcgtcgtcggagtggggtcgtcgcggtcgaattattgaggcgagcgggggagttcggcgcgtattaagcgcgttcgagggggcgtggtcggagcgtattaaggcggcgcgggggagcggggttcgggcgggagcggagtgtgggttcggcggttttgcgggttttttcggcgcgggggagttttgggaagacgcgcgagttataattttagggggcgtggcgggaacgggagtttttatcgaatggggtggtagaagaacgaaggcgatattaagttggttttttgcgggggtcgggacggcggga

SEQ ID NO: 14084 - DNA, 1236 bp, Artificial Sequence
  chemically treated genomic DNA (Homo sapiens) CpG-island No: 14084
tcccgccgtcccgacccccgcaaaaaaccaacttaatatcgccttcgttcttctaccaccccattcgataaaaactcccgttcccgccacgccccctaaaattataactcgcgcgtcttcccaaaactcccccgcgccgaaaaaacccgcaaaaccgccgaacccacactccgctcccgcccgaaccccgctcccccgcgccgccttaatacgctccgaccacgccccctcgaacgcgcttaatacgcgccgaactcccccgctcgcctcaataattcgaccgcgacgaccccactccgacgacgcgtcccccgaacttaatacgactcaacccgtctcccccgaaaccgcgcgcccgcgcccgcgcccctcaatcgataaaacccgcaaccccccttataacccgcgacaactccccgcccgctcgacccgcgcccgccataatccgtccgcgccgtaccccgtaccgctccgacgccgaaaaccccctcgaaaatcgcgaccgccctccgcgacccctcgtaatacgcgccgtccgctcgcgctcctaacctaccaacccccgaaacccgcaacctccgcgaatccgaacccgctcgacccctcccataataaaccccccgccctttttccaaaaccttccacgaccccgcccccccaacccctatcccgaactcacgcctttatccgcaacccccgccgctccgaaatatcccctataacccgaaaaataatcccgcccgaaaccgaattcccccgtaaaacacccgataattcgcgccgcgctctcccctttattacgcgttcgaaccgaaataaaaaattaaaaaacgaaaacgaaacgaactcatattactactaactccgcgacccgatttaaacgcgaactaaaaacgacaaacaaacaaccgacacgctcgcttatttttcctattaaaaaattactcgctctccgaacaaaaaacctaaaaataaaaacgattttaaaaaacaacgacgaaaaaaaaacccgcgctttataccaacgcccccaaatatcgcacccgtaaacgttctcccctaacgaccgctccgtacccgtaaaatacgcacctaaaatacgcgcccgcgcccacatataaaatactttaataaactaccgtaaacccaaaccttaaacgtaaacattcaacttcgcaaatactttaaactacacacgcttctccgaacccaaaaaatacacatacttttcaaaaa

SEQ ID NO: 14085 - DNA, 1035 bp, Artificial Sequence
  chemically treated genomic DNA (Homo sapiens) CpG-island No: 14085
atttttatatattattttttttttattcggacggtagtcgaatagggataaaatttatggcgtatagttagtttttttcgcggagtacgttttgtgttgttttagtcgttggggttttttatttcgggttatagttttttggcgtttttcgggtcgaggtagtcgggtcgaggagtgtcggtgtggttcggttacggggcggggtcggcgggagtttcggtcgtcgtcgtcgtcgttgttgttttcgtttgttttttgggtcgttcgttcgttcgtcgttgggtgcgttgtacgcggggggtagtcgtggtgtagaggtttatgtagcggcggcggcggcggcggttgttgttgttgtcgtcgcggaggtagatagatcgggcgttgttatcgtcgttttttttcggttttatgtcgtcgtcgttgtcgttttttttttttcggcgaggggcggggggtttcggttcggggtgggtattatttttcgtagcgtcgtttttttttttgtttttcgttcgggcgttggagtcggcgagggtattcgtcgttttttaggagtgtatttttcgcgcgttttgtcggagcgagggggcgggcgtgggcggacgtcggggtagcggggatttcgcgcggttgtaagaggagggggtttttttaaggatgttcggcggtttttcgtttttaggtgcgagttgagtttgatcgggagcgagcggcgcgtcgttatgtcggcgtgacgggcgttttcggttgttcgcgcgggttttcgcgttgttttacgtcgcgtcgtgtcggtatcgggttgtaggatgggttgtatttaaagtattatttgtaaggcgcggattcggcgcgagaatatcgtggtgtacgatgtgtgcgttattatcgattagtgttttacgcgtatcgaggagatttcgtttatcgttttgcgttataagattttttattttaaagttttcgttcgcgtggttatgttttttatttttcgttacgagatttgggtggtgggttggatttaggcgtgtaatt

SEQ ID NO: 14086 - DNA, 1035 bp, Artificial Sequence
  chemically treated genomic DNA (Homo sapiens) CpG-island No: 14086
aattacacgcctaaatccaacccaccacccaaatctcgtaacgaaaaataaaaaacataaccacgcgaacgaaaactttaaaataaaaaatcttataacgcaaaacgataaacgaaatctcctcgatacgcgtaaaacactaatcgataataacgcacacatcgtacaccacgatattctcgcgccgaatccgcgccttacaaataatactttaaatacaacccatcctacaacccgataccgacacgacgcgacgtaaaacaacgcgaaaacccgcgcgaacaaccgaaaacgcccgtcacgccgacataacgacgcgccgctcgctcccgatcaaactcaactcgcacctaaaaacgaaaaaccgccgaacatccttaaaaaaaccccctcctcttacaaccgcgcgaaatccccgctaccccgacgtccgcccacgcccgccccctcgctccgacaaaacgcgcgaaaaatacactcctaaaaaacgacgaataccctcgccgactccaacgcccgaacgaaaaacaaaaaaaaaaacgacgctacgaaaaataatacccaccccgaaccgaaaccccccgcccctcgccgaaaaaaaaaaaacgacaacgacgacgacataaaaccgaaaaaaaacgacgataacaacgcccgatctatctacctccgcgacgacaacaacaacaaccgccgccgccgccgccgctacataaacctctacaccacgactaccccccgcgtacaacgcacccaacgacgaacgaacgaacgacccaaaaaacaaacgaaaacaacaacgacgacgacgacgaccgaaactcccgccgaccccgccccgtaaccgaaccacaccgacactcctcgacccgactacctcgacccgaaaaacgccaaaaaactataacccgaaataaaaaaccccaacgactaaaacaacacaaaacgtactccgcgaaaaaaactaactatacgccataaattttatccctattcgactaccgtccgaataaaaaaaaaataatatataaaaat

SEQ ID NO: 14087 - DNA, 1035 bp, Artificial Sequence
  chemically treated genomic DNA (Homo sapiens) CpG-island No: 14087
gattgtacgtttgaatttagtttattatttaggtttcgtggcgggggatggggggtatgattacgcgggcggaggttttgaagtagggggttttgtagcgtaggacgatgggcgaggttttttcgatgcgcgtggggtattggtcgatggtggcgtatatatcgtatattacgatgttttcgcgtcggattcgcgttttgtaggtgatgttttggatatagtttattttgtagttcggtgtcggtacggcgcggcgtggggtagcgcgggggttcgcgcgggtagtcgggggcgttcgttacgtcggtatggcgacgcgtcgttcgttttcggttagatttagttcgtatttaggagcggggagtcgtcgggtatttttggggaagttttttttttttgtagtcgcgcggggttttcgttgtttcgacgttcgtttacgttcgttttttcgtttcggtagggcgcgcggagggtgtatttttaggaggcggcgggtgttttcgtcggttttagcgttcgggcggagggtagggaggggagcggcgttgcgaggaatggtgtttatttcgggtcggagtttttcgtttttcgtcggagaggaggaggcggtagcggcggcggtatggagtcgggggagggcggcggtggtagcgttcggtttgtttgttttcgcggcggtagtagtagtagtcgtcgtcgtcgtcgtcgttgtatgaatttttgtattacggttgtttttcgcgtgtagcgtatttagcggcgggcgagcgggcggtttaagaggtaggcggaggtagtagcggcggcggcggcgatcggagttttcgtcggtttcgtttcgtagtcggattatatcgatatttttcggttcggttgtttcggttcggggggcgttaggaggttgtggttcggggtggagagttttaacggttggagtagtataggacgtgtttcgcggaggaaattggttgtacgttatgagttttgtttttattcggttgtcgttcgggtggggggggggtaatgtgtaagggt

SEQ ID NO: 14088 - DNA, 1035 bp, Artificial Sequence
  chemically treated genomic DNA (Homo sapiens) CpG-island No: 14088
acccttacacattaccccccccccacccgaacgacaaccgaataaaaacaaaactcataacgtacaaccaatttcctccgcgaaacacgtcctatactactccaaccgttaaaactctccaccccgaaccacaacctcctaacgccccccgaaccgaaacaaccgaaccgaaaaatatcgatataatccgactacgaaacgaaaccgacgaaaactccgatcgccgccgccgccgctactacctccgcctacctcttaaaccgcccgctcgcccgccgctaaatacgctacacgcgaaaaacaaccgtaatacaaaaattcatacaacgacgacgacgacgacgactactactactaccgccgcgaaaacaaacaaaccgaacgctaccaccgccgccctcccccgactccataccgccgccgctaccgcctcctcctctccgacgaaaaacgaaaaactccgacccgaaataaacaccattcctcgcaacgccgctcccctccctaccctccgcccgaacgctaaaaccgacgaaaacacccgccgcctcctaaaaatacaccctccgcgcgccctaccgaaacgaaaaaacgaacgtaaacgaacgtcgaaacaacgaaaaccccgcgcgactacaaaaaaaaaaaacttccccaaaaatacccgacgactccccgctcctaaatacgaactaaatctaaccgaaaacgaacgacgcgtcgccataccgacgtaacgaacgcccccgactacccgcgcgaacccccgcgctaccccacgccgcgccgtaccgacaccgaactacaaaataaactatatccaaaacatcacctacaaaacgcgaatccgacgcgaaaacatcgtaatatacgatatatacgccaccatcgaccaataccccacgcgcatcgaaaaaacctcgcccatcgtcctacgctacaaaaccccctacttcaaaacctccgcccgcgtaatcataccccccatcccccgccacgaaacctaaataataaactaaattcaaacgtacaatc

SEQ ID NO: 14089 - DNA, 725 bp, Artificial Sequence
  chemically treated genomic DNA (Homo sapiens) CpG-island No: 14089
ttcgttcgtcgcgtattatataggttgtgtagatattttttcgcgttatttttttttttttttcgcgggtcgtttaggttgtagttttgtttgtttcgaagattttttcgttttagcgtttttgtttcgttttttcgcgttcgttttttttcggagcgcgtatttatttaggcggtaaagttgtgattatttgggcgcgggtgattggcgtttcgttcgtttcgcgttcggcgtagataatttttcgcggttcggtttcgtcgcgtttcgggttcgcgtttttagggatttcgcggttttttagtttttaatttcggcggcgcgtcgggtagcgtttcggtggcggcggcggtcgcggtggtagcgaaggcggcggcggcggcggtagtggtagtggtcgttgtagttttatatttcgtcgttaaattggaggagcgacggaagttagattttaggaggtgagcgttcggtttcggtagttgtcgggagggtcgatggggtttttcgttttaaggcggaggcgggcgcgggttcgggggtcgatttcgtagggcgcgtaggcggttttagcgcgtttttgggagggagagagaggttaattgcgggtcgggtattttttgagttgggcgcgggcggtgtgtggaggttgttttcgcggaaaagtatttttttttttttttagggtttagaggaagagtttgggtggtttgttttttttttattgt

SEQ ID NO: 14090 - DNA, 725 bp, Artificial Sequence
  chemically treated genomic DNA (Homo sapiens) CpG-island No: 14090
acaataaaaaaaaaacaaaccacccaaactcttcctctaaaccctaaaaaaaaaaaaaaatacttttccgcgaaaacaacctccacacaccgcccgcgcccaactcaaaaaatacccgacccgcaattaacctctctctccctcccaaaaacgcgctaaaaccgcctacgcgccctacgaaatcgacccccgaacccgcgcccgcctccgccttaaaacgaaaaaccccatcgaccctcccgacaactaccgaaaccgaacgctcacctcctaaaatctaacttccgtcgctcctccaatttaacgacgaaatataaaactacaacgaccactaccactaccgccgccgccgccgccttcgctaccaccgcgaccgccgccgccaccgaaacgctacccgacgcgccgccgaaattaaaaactaaaaaaccgcgaaatccctaaaaacgcgaacccgaaacgcgacgaaaccgaaccgcgaaaaattatctacgccgaacgcgaaacgaacgaaacgccaatcacccgcgcccaaataatcacaactttaccgcctaaataaatacgcgctccgaaaaaaaacgaacgcgaaaaaacgaaacaaaaacgctaaaacgaaaaaatcttcgaaacaaacaaaactacaacctaaacgacccgcgaaaaaaaaaaaaaaataacgcgaaaaaatatctacacaacctatataatacgcgacgaacgaa

SEQ ID NO: 14091 - DNA, 725 bp, Artificial Sequence
  chemically treated genomic DNA (Homo sapiens) CpG-island No: 14091
gtagtgagggagaagtagattatttaaattttttttttaaattttaagaaggaaaaaaaatattttttcgcggaagtagtttttatatatcgttcgcgtttagtttaggggatgttcggttcgtaattgattttttttttttttttaggagcgcgttgaggtcgtttgcgcgttttacggaatcggttttcgggttcgcgttcgttttcgttttggagcgagggattttatcgattttttcggtagttgtcggggtcgggcgtttattttttggggtttggttttcgtcgtttttttagtttggcggcggagtgtggggttgtagcggttattgttattgtcgtcgtcgtcgtcgttttcgttgttatcgcggtcgtcgtcgttatcgaagcgttgttcggcgcgtcgtcggggttggaggttggggggtcgcggaatttttggaggcgcgagttcgggacgcggcggggtcgagtcgcgggaagttgtttgcgtcgggcgcggagcgagcggggcgttagttattcgcgtttaagtagttataattttgtcgtttgggtgggtgcgcgtttcggagagaggcgagcgcgggagagcggggtaaaggcgttggggcgggagggttttcggagtaggtaggattgtaatttgaacggttcgcgaggaaaggggaaaggtggcgcggggggatgtttatatagtttgtgtggtgcgcggcgagcgag

SEQ ID NO: 14092 - DNA, 725 bp, Artificial Sequence
  chemically treated genomic DNA (Homo sapiens) CpG-island No: 14092
ctcgctcgccgcgcaccacacaaactatataaacatccccccgcgccacctttcccctttcctcgcgaaccgttcaaattacaatcctacctactccgaaaaccctcccgccccaacgcctttaccccgctctcccgcgctcgcctctctccgaaacgcgcacccacccaaacgacaaaattataactacttaaacgcgaataactaacgccccgctcgctccgcgcccgacgcaaacaacttcccgcgactcgaccccgccgcgtcccgaactcgcgcctccaaaaattccgcgaccccccaacctccaaccccgacgacgcgccgaacaacgcttcgataacgacgacgaccgcgataacaacgaaaacgacgacgacgacgacaataacaataaccgctacaaccccacactccgccgccaaactaaaaaaacgacgaaaaccaaaccccaaaaaataaacgcccgaccccgacaactaccgaaaaaatcgataaaatccctcgctccaaaacgaaaacgaacgcgaacccgaaaaccgattccgtaaaacgcgcaaacgacctcaacgcgctcctaaaaaaaaaaaaaaaatcaattacgaaccgaacatcccctaaactaaacgcgaacgatatataaaaactacttccgcgaaaaaatattttttttccttcttaaaatttaaaaaaaaaatttaaataatctacttctccctcactac

SEQ ID NO: 14093 - DNA, 547 bp, Artificial Sequence
  chemically treated genomic DNA (Homo sapiens) CpG-island No: 14093
tatcgtattaaaacgtttagagattgagttatagagaggggtgtggtcggtattttagtttcgtttttgtcggagtagtcgaaggttttattggcgtttttacgttttagttgcgtttagtagtcgcggcgtaattggataaaagttcgtggagggggcgggattttaggggggtttttacgattagttaatatttaggagggcgggatagaaaggtgtagatttacgattcgattggtttcgggtttagttgggaggcgggacgaattattggttgggggaaatttacgaggggacgcggtcgaggagggtcgttgtttattcgggggcgtgggagtgaggtattagatttagtttatttggtttcgacgtttttgttttcggaattcgggtgttgcggattgaggtttcggtttttaacggtgggatcggtgttttcgggatgagatttggcgttttttcggggttttggtgggatcggtgtttttaggatgagatttagggttttttcggggttttcgggatttttatttaatattcggtatta

SEQ ID NO: 14094 - DNA, 547 bp, Artificial Sequence
  chemically treated genomic DNA (Homo sapiens) CpG-island No: 14094
taataccgaatattaaataaaaatcccgaaaaccccgaaaaaaccctaaatctcatcctaaaaacaccgatcccaccaaaaccccgaaaaaacgccaaatctcatcccgaaaacaccgatcccaccgttaaaaaccgaaacctcaatccgcaacacccgaattccgaaaacaaaaacgtcgaaaccaaataaactaaatctaatacctcactcccacgcccccgaataaacaacgaccctcctcgaccgcgtcccctcgtaaatttcccccaaccaataattcgtcccgcctcccaactaaacccgaaaccaatcgaatcgtaaatctacacctttctatcccgccctcctaaatattaactaatcgtaaaaacccccctaaaatcccgccccctccacgaacttttatccaattacgccgcgactactaaacgcaactaaaacgtaaaaacgccaataaaaccttcgactactccgacaaaaacgaaactaaaataccgaccacacccctctctataactcaatctctaaacgttttaatacgata

SEQ ID NO: 14095 - DNA, 547 bp, Artificial Sequence
  chemically treated genomic DNA (Homo sapiens) CpG-island No: 14095
taatatcggatattaggtgaagatttcgaaagtttcgaggaaattttaaattttattttgaggatatcgattttattaaagtttcgaggaaacgttaaattttatttcgaggatatcgattttatcgttaggaatcgggattttaattcgtagtattcggatttcgagaatagaggcgtcggggttaaatgggttgaatttggtattttatttttacgttttcgggtggatagcgatttttttcggtcgcgttttttcgtgggttttttttaattaataattcgtttcgttttttagttgagttcgaagttaatcgggtcgtagatttgtatttttttatttcgtttttttgggtattgattaatcgtagaaatttttttgggatttcgttttttttacgggtttttatttaattacgtcgcggttattaagcgtagttgaagcgtgaaggcgttaatgaggttttcggttatttcggtaggggcggaattaaaatgtcggttatatttttttttgtgatttagtttttgagcgttttaatacgatg

SEQ ID NO: 14096 - DNA, 547 bp, Artificial Sequence
  chemically treated genomic DNA (Homo sapiens) CpG-island No: 14096
catcgtattaaaacgctcaaaaactaaatcacaaaaaaaaatataaccgacattttaattccgcccctaccgaaataaccgaaaacctcattaacgccttcacgcttcaactacgcttaataaccgcgacgtaattaaataaaaacccgtaaaaaaaacgaaatcccaaaaaaatttctacgattaatcaatacccaaaaaaacgaaataaaaaaatacaaatctacgacccgattaacttcgaactcaactaaaaaacgaaacgaattattaattaaaaaaaacccacgaaaaaacgcgaccgaaaaaaatcgctatccacccgaaaacgtaaaaataaaataccaaattcaacccatttaaccccgacgcctctattctcgaaatccgaatactacgaattaaaatcccgattcctaacgataaaatcgatatcctcgaaataaaatttaacgtttcctcgaaactttaataaaatcgatatcctcaaaataaaatttaaaatttcctcgaaactttcgaaatcttcacctaatatccgatatta

SEQ ID NO: 14097 - DNA, 706 bp, Artificial Sequence
  chemically treated genomic DNA (Homo sapiens) CpG-island No: 14097
gcgtttatttttatttgtcgcgtcgtcgggagtcgcgaggaggcggagttcggtcgtcgtagttaatgagcgacgtcggcgttggtagttgttgttataaagggttgggggcggcggcggcgcggtttagagcgcggagcgcgtagcgcgggtcggagggagggagggagggtgggcgaggggagaggatttgaatatacgggatcggataggatcgatcgaggggcggcggcgaaaggtagagcgtcgcgatttttgtcgggaagcgtaattttttcgggtttcgcggggtcgcgtagggggcgtttttaatttcgcgttcgttttttttttttattttttgtcgttcgtaggttatttcggggttcggttattcgcgcgcgtattttcgggttcgggttcgtttttggttttcgagggagtcgtcgtttttatcgttatatttgtagcggtcgtattagaggtcgttcgggcgggattttagcgtgagtatcgggcgtttttttaggagtgtattattttcggagttttttttaatacggatcgcgttcgtcgggtatataagaatggttattgtaggtatttttttgtcgtcgaaagggaatcgggacggggaggagttgggtttaggtttcgcggagattgggcgggtgcggcgggggggggtaggattaggtttagttaggttcgggttgggggggtagga

SEQ ID NO: 14098 - DNA, 706 bp, Artificial Sequence
  chemically treated genomic DNA (Homo sapiens) CpG-island No: 14098
tcctacccccccaacccgaacctaactaaacctaatcctacccccccccgccgcacccgcccaatctccgcgaaacctaaacccaactcctccccgtcccgattccctttcgacgacaaaaaaatacctacaataaccattcttatatacccgacgaacgcgatccgtattaaaaaaaactccgaaaataatacactcctaaaaaaacgcccgatactcacgctaaaatcccgcccgaacgacctctaatacgaccgctacaaatataacgataaaaacgacgactccctcgaaaaccaaaaacgaacccgaacccgaaaatacgcgcgcgaataaccgaaccccgaaataacctacgaacgacaaaaaataaaaaaaaaaaacgaacgcgaaattaaaaacgccccctacgcgaccccgcgaaacccgaaaaaattacgcttcccgacaaaaatcgcgacgctctacctttcgccgccgcccctcgatcgatcctatccgatcccgtatattcaaatcctctcccctcgcccaccctccctccctccctccgacccgcgctacgcgctccgcgctctaaaccgcgccgccgccgcccccaaccctttataacaacaactaccaacgccgacgtcgctcattaactacgacgaccgaactccgcctcctcgcgactcccgacgacgcgacaaataaaaataaacgc

SEQ ID NO: 14099 - DNA, 706 bp, Artificial Sequence
  chemically treated genomic DNA (Homo sapiens) CpG-island No: 14099
ttttatttttttaattcgggtttagttaggtttggttttattttttttcgtcgtattcgtttaattttcgcggagtttgggtttaattttttttcgtttcgattttttttcggcgataggggaatatttatagtgattatttttgtgtgttcggcgggcgcggttcgtgttgaggggggtttcgggggtggtgtatttttaggggggcgttcgatgtttacgttggggtttcgttcgggcggtttttggtgcggtcgttgtagatgtggcgatgaaggcggcggttttttcgagggttagggacgggttcgaattcggggatgcgcgcgcggatggtcgggtttcggggtggtttgcgggcggtaggggatggaaagagggagcgggcgcggggttgaggacgttttttgcgcggtttcgcggggttcggggaggttgcgtttttcgatagagatcgcggcgttttgtttttcgtcgtcgtttttcggtcggttttgttcggtttcgtgtgtttaagtttttttttttcgtttatttttttttttttttttcggttcgcgttgcgcgtttcgcgttttggatcgcgtcgtcgtcgtttttagttttttatagtagtagttgttagcgtcggcgtcgtttattggttgcggcgatcgagtttcgttttttcgcggttttcgacggcgcggtaggtggaagtgagcgt

SEQ ID NO: 14100 - DNA, 706 bp, Artificial Sequence
  chemically treated genomic DNA (Homo sapiens) CpG-island No: 14100
acgctcacttccacctaccgcgccgtcgaaaaccgcgaaaaaacgaaactcgatcgccgcaaccaataaacgacgccgacgctaacaactactactataaaaaactaaaaacgacgacgacgcgatccaaaacgcgaaacgcgcaacgcgaaccgaaaaaaaaaaaaaaaaataaacgaaaaaaaaaaacttaaacacacgaaaccgaacaaaaccgaccgaaaaacgacgacgaaaaacaaaacgccgcgatctctatcgaaaaacgcaacctccccgaaccccgcgaaaccgcgcaaaaaacgtcctcaaccccgcgcccgctccctctttccatcccctaccgcccgcaaaccaccccgaaacccgaccatccgcgcgcgcatccccgaattcgaacccgtccctaaccctcgaaaaaaccgccgccttcatcgccacatctacaacgaccgcaccaaaaaccgcccgaacgaaaccccaacgtaaacatcgaacgcccccctaaaaatacaccacccccgaaacccccctcaacacgaaccgcgcccgccgaacacacaaaaataatcactataaatattcccctatcgccgaaaaaaaatcgaaacgaaaaaaaattaaacccaaactccgcgaaaattaaacgaatacgacgaaaaaaaataaaaccaaacctaactaaacccgaattaaaaaaataaaa

SEQ ID NO: 14101 - DNA, 818 bp, Artificial Sequence
  chemically treated genomic DNA (Homo sapiens) CpG-island No: 14101
  misc_feature (412)..(412): n is either a, c, g or t
gggagattgcgagtttcgagcgaaacgttggttttacgttcgttcggggagtcgtcgcgattcgttttttttaggtttgggtatcgtcgtggtgcgtgtcggttatgatcgtttcgggatttgcgcgacggcggttcgaggaggtttggcgggcggcggcgagaggttgtgtttagtttgtgtttaattagggagtgcgggttgtgttcgagtttggtagtaatgcgtaaataaatttacggtaattttttcgttttttcggcgttgtttcggttcgcgtcgttagcgcgcgtcgagcgcgggtttgtttttttcgcgttcgtcgtcggtcgtttagttttcgtttcggtcgttcgtattttcgttgtttcgttcgtttcgtcggcgcgggtttttttatttatcgtttttnacgcgggcggtcggttattacgtttcgcgcggttcgttcggatcgtggtttttcgagagtaaggtaagggcgatgcgcggggatattagcggttttttcgttcgacgcggtttagggaagtttttggcgtggttgtttttcgcggggtcgggggggaggtttcgggagttaggcgagtcggcgggcgggaggggtcgtttggcgtttcggggttataagttgtttaatttgatttcggtgcgggtcggtgggggcgcggtcgggttggcggcgcggaaaggggttggaggtacggcggggtcgggcgatcgggcgggtaaggggagggtttcgaggaatttttttttttttagaggcgttttttagttttggtcgcggtttcgcggagtagcggttttttggttgg

SEQ ID NO: 14102 - DNA, 818 bp, Artificial Sequence
  chemically treated genomic DNA (Homo sapiens) CpG-island No: 14102
  misc_feature (407)..(407): n is either a, c, g or t
ccaaccaaaaaaccgctactccgcgaaaccgcgaccaaaactaaaaaacgcctctaaaaaaaaaaaaattcctcgaaaccctccccttacccgcccgatcgcccgaccccgccgtacctccaacccctttccgcgccgccaacccgaccgcgcccccaccgacccgcaccgaaatcaaattaaacaacttataaccccgaaacgccaaacgacccctcccgcccgccgactcgcctaactcccgaaacctcccccccgaccccgcgaaaaacaaccacgccaaaaacttccctaaaccgcgtcgaacgaaaaaaccgctaatatccccgcgcatcgcccttaccttactctcgaaaaaccacgatccgaacgaaccgcgcgaaacgtaataaccgaccgcccgcgtnaaaaacgataaataaaaaaacccgcgccgacgaaacgaacgaaacaacgaaaatacgaacgaccgaaacgaaaactaaacgaccgacgacgaacgcgaaaaaaacaaacccgcgctcgacgcgcgctaacgacgcgaaccgaaacaacgccgaaaaaacgaaaaaattaccgtaaatttatttacgcattactaccaaactcgaacacaacccgcactccctaattaaacacaaactaaacacaacctctcgccgccgcccgccaaacctcctcgaaccgccgtcgcgcaaatcccgaaacgatcataaccgacacgcaccacgacgatacccaaacctaaaaaaaacgaatcgcgacgactccccgaacgaacgtaaaaccaacgtttcgctcgaaactcgcaatctccc

SEQ ID NO: 14103 - DNA, 818 bp, Artificial Sequence
  chemically treated genomic DNA (Homo sapiens) CpG-island No: 14103
  misc_feature (407)..(407): n is either a, c, g or t
ttagttagggagtcgttgtttcgcggggtcgcggttaggattggaaggcgtttttggggaagagaaagtttttcggggttttttttttgttcgttcggtcgttcggtttcgtcgtgtttttagttttttttcgcgtcgttagttcggtcgcgtttttatcggttcgtatcgaggttaggttaggtaatttgtgatttcggggcgttaggcggtttttttcgttcgtcggttcgtttggttttcggggtttttttttcggtttcgcggaaaatagttacgttagaaatttttttgggtcgcgtcgggcggggaagtcgttggtgttttcgcgtatcgtttttattttgttttcgagaggttacgattcgggcgggtcgcgcggggcgtggtagtcgatcgttcgcgtnaggggcggtaggtgagggagttcgcgtcggcggggcgggcggggtagcgggggtgcgagcggtcggggcgggggttgggcggtcggcggcgggcgcgaggagagtagattcgcgttcggcgcgcgttggcggcgcgggtcggggtagcgtcgagggggcggaggagttatcgtgggtttgtttacgtattgttgttaggttcgagtatagttcgtattttttgattggatataaattgggtatagtttttcgtcgtcgttcgttaggttttttcgagtcgtcgtcgcgtagatttcggagcgattatagtcgatacgtattacggcggtgtttaggtttggaggggacgagtcgcggcggtttttcgggcgggcgtgaagttaacgtttcgttcggggttcgtagtttttt

SEQ ID NO: 14104 - DNA, 818 bp, Artificial Sequence
  chemically treated genomic DNA (Homo sapiens) CpG-island No: 14104
  misc_feature (412)..(412): n is either a, c, g or t
aaaaaactacgaaccccgaacgaaacgttaacttcacgcccgcccgaaaaaccgccgcgactcgtcccctccaaacctaaacaccgccgtaatacgtatcgactataatcgctccgaaatctacgcgacgacgactcgaaaaaacctaacgaacgacgacgaaaaactatacccaatttatatccaatcaaaaaatacgaactatactcgaacctaacaacaatacgtaaacaaacccacgataactcctccgccccctcgacgctaccccgacccgcgccgccaacgcgcgccgaacgcgaatctactctcctcgcgcccgccgccgaccgcccaacccccgccccgaccgctcgcacccccgctaccccgcccgccccgccgacgcgaactccctcacctaccgcccctnacgcgaacgatcgactaccacgccccgcgcgacccgcccgaatcgtaacctctcgaaaacaaaataaaaacgatacgcgaaaacaccaacgacttccccgcccgacgcgacccaaaaaaatttctaacgtaactattttccgcgaaaccgaaaaaaaaaccccgaaaaccaaacgaaccgacgaacgaaaaaaaccgcctaacgccccgaaatcacaaattacctaacctaacctcgatacgaaccgataaaaacgcgaccgaactaacgacgcgaaaaaaaactaaaaacacgacgaaaccgaacgaccgaacgaacaaaaaaaaaaccccgaaaaactttctcttccccaaaaacgccttccaatcctaaccgcgaccccgcgaaacaacgactccctaactaa

SEQ ID NO: 14105 - DNA, 1020 bp, Artificial Sequence
  chemically treated genomic DNA (Homo sapiens) CpG-island No: 14105
gtaggtgtacgttgcggtttttagggcgatagtttcggaaaaggcgtattttcggttgtgggtttttcgggggcggggcgtaggggcggggcggggcgaggggttcgtagaggtttcgggttggtcgagtcgggagggaggagtattagtattagtatagttttcgttttttgcgcgtagtagtgtttagtaattcgagcggaggcggtcgttgtagttcggcgttgaatgggttggcggcgttcggtttcgttttgttcgcggtcggttttcgcgtttgtttttttttcgttcgggtttttgtcggtcgtcgttagttttcgtttcgattgtgaatgaaaggcgggcgtcgtcgagggttggttgggaacgtcgtagcgacgtcggtttttcgagaggcgcgcgtttcgtcgagatgtacggtaaggagggtttcgcgttcgggttcgggttcgcgggggcgatttcgtaaattttttcggcgcggattattgtttttttgtacggttttggcgcggggttaggtcgttgatttggtgttcggcggggttgttgcggtcgttttgtgcgcgcgcgtttgcgttgcgaggataaagatttttcgggtcggggattttggggttttttttaggttcggcgcgtgtcggtgttgggcggtggtttttcggggggcggaggtttaggggaaagcgggtttttcggagtcgagtagatcgggagtgttggaggaggtggtcgtgtggtagtatttgcggaattaataaaagcggtttgtgtttgggagttttttgtgggaagtcggtttagggttgagggagacgttcgcggtcggtcgtttgcgcggttcggagaaggcgggaggcggcgcggcgcgagaggttcggggagtagttagtggtcgagtttcgtttcgttcgtttgaatggattcggtttttgtttgtttttgtcgtttcgcggatttaggtttattaatttttagatttttttttcgtagtgatgaagggaggagacgttgttg

SEQ ID NO: 14106 - DNA, 1020 bp, Artificial Sequence
  chemically treated genomic DNA (Homo sapiens) CpG-island No: 14106
caacaacgtctcctcccttcatcactacgaaaaaaaaatctaaaaattaataaacctaaatccgcgaaacgacaaaaacaaacaaaaaccgaatccattcaaacgaacgaaacgaaactcgaccactaactactccccgaacctctcgcgccgcgccgcctcccgccttctccgaaccgcgcaaacgaccgaccgcgaacgtctccctcaaccctaaaccgacttcccacaaaaaactcccaaacacaaaccgcttttattaattccgcaaatactaccacacgaccacctcctccaacactcccgatctactcgactccgaaaaacccgctttcccctaaacctccgccccccgaaaaaccaccgcccaacaccgacacgcgccgaacctaaaaaaaaccccaaaatccccgacccgaaaaatctttatcctcgcaacgcaaacgcgcgcgcacaaaacgaccgcaacaaccccgccgaacaccaaatcaacgacctaaccccgcgccaaaaccgtacaaaaaaacaataatccgcgccgaaaaaatttacgaaatcgcccccgcgaacccgaacccgaacgcgaaaccctccttaccgtacatctcgacgaaacgcgcgcctctcgaaaaaccgacgtcgctacgacgttcccaaccaaccctcgacgacgcccgcctttcattcacaatcgaaacgaaaactaacgacgaccgacaaaaacccgaacgaaaaaaaaacaaacgcgaaaaccgaccgcgaacaaaacgaaaccgaacgccgccaacccattcaacgccgaactacaacgaccgcctccgctcgaattactaaacactactacgcgcaaaaaacgaaaactatactaatactaatactcctccctcccgactcgaccaacccgaaacctctacgaacccctcgccccgccccgcccctacgccccgcccccgaaaaacccacaaccgaaaatacgccttttccgaaactatcgccctaaaaaccgcaacgtacacctac

SEQ ID NO: 14107 - DNA, 1020 bp, Artificial Sequence
  chemically treated genomic DNA (Homo sapiens) CpG-island No: 14107
tagtagcgttttttttttttattattgcggagggaaaatttggaagttggtgaatttggattcgcggggcggtaggggtaggtagaggtcgagtttatttaggcgggcgagacgagattcggttattggttgtttttcgggtttttcgcgtcgcgtcgtttttcgtttttttcgagtcgcgtagacgatcggtcgcgggcgttttttttagttttggatcggttttttatagaaaatttttaggtataaatcgtttttgttaatttcgtaaatgttgttatacgattattttttttagtattttcggtttgttcggtttcgggagattcgtttttttttgagttttcgtttttcgaaggattatcgtttagtatcggtacgcgtcgggtttggagaggattttagggttttcggttcgagggatttttgttttcgtagcgtagacgcgcgcgtatagagcgatcgtaatagtttcgtcgggtattaggttagcggtttggtttcgcgttagggtcgtgtagggggataatggttcgcgtcggggaagtttgcggagtcgttttcgcgggttcgggttcgggcgcggagttttttttatcgtatatttcggcggggcgcgcgtttttcgagaggtcggcgtcgttgcggcgtttttagttagttttcggcggcgttcgttttttatttatagtcggggcggggattggcggcggtcgataggggttcgggcggggagggagtagacgcgggggtcggtcgcgggtaggacggagtcgggcgtcgttagtttatttagcgtcgggttgtagcggtcgttttcgttcgggttgttgggtattgttgcgcgtagggggcgggggttatgttaatattaatgtttttttttttcggttcggttaattcgaggtttttgcgagtttttcgtttcgtttcgtttttgcgtttcgttttcgagaaatttatagtcggagatgcgtttttttcgaggttgtcgttttaagggtcgtagcgtgtatttgt

SEQ ID NO: 14108 - DNA, 1020 bp, Artificial Sequence
  chemically treated genomic DNA (Homo sapiens) CpG-island No: 14108
acaaatacacgctacgacccttaaaacgacaacctcgaaaaaaacgcatctccgactataaatttctcgaaaacgaaacgcaaaaacgaaacgaaacgaaaaactcgcaaaaacctcgaattaaccgaaccgaaaaaaaaaaacattaatattaacataacccccgccccctacgcgcaacaatacccaacaacccgaacgaaaacgaccgctacaacccgacgctaaataaactaacgacgcccgactccgtcctacccgcgaccgacccccgcgtctactccctccccgcccgaacccctatcgaccgccgccaatccccgccccgactataaataaaaaacgaacgccgccgaaaactaactaaaaacgccgcaacgacgccgacctctcgaaaaacgcgcgccccgccgaaatatacgataaaaaaaactccgcgcccgaacccgaacccgcgaaaacgactccgcaaacttccccgacgcgaaccattatccccctacacgaccctaacgcgaaaccaaaccgctaacctaatacccgacgaaactattacgatcgctctatacgcgcgcgtctacgctacgaaaacaaaaatccctcgaaccgaaaaccctaaaatcctctccaaacccgacgcgtaccgatactaaacgataatccttcgaaaaacgaaaactcaaaaaaaaacgaatctcccgaaaccgaacaaaccgaaaatactaaaaaaaataatcgtataacaacatttacgaaattaacaaaaacgatttatacctaaaaattttctataaaaaaccgatccaaaactaaaaaaaacgcccgcgaccgatcgtctacgcgactcgaaaaaaacgaaaaacgacgcgacgcgaaaaacccgaaaaacaaccaataaccgaatctcgtctcgcccgcctaaataaactcgacctctacctacccctaccgccccgcgaatccaaattcaccaacttccaaattttccctccgcaataataaaaaaaaaaaacgctacta

SEQ ID NO: 14109 - DNA, 615 bp, Artificial Sequence
  chemically treated genomic DNA (Homo sapiens) CpG-island No: 14109
tttcgtggtagtcggtgcgttgtgtggggcggagaggggttcggggtgggtttcggggcgcgggttaaggggagcgagttcggttcgcggttttagcgtttttcggtcggcgcggaaggggtgaggttgggcgttcgcgcgagtttcgagaaaaggaaagataaaaagttttggcggttaggggtttttcgggcgtttatttcgaaatttttttcgtcgttttttgtttgaaatatgtcgagttcggtacggttttgtcgttttattttttgttgcggtttttatttcgagttgggtttagttaatttgttgtgatagttgtcggtagtcgttttttcgtttcgtgatatttcgtaggttttagaatcgcggcgtcgcgggtatagatttcgggtttagagcgcgcggtttttttttttgcggtcgtcgttttttgaaagtggttgcgcgggtgtgaagaatttgtttaatgcgttttgtaggatttattgtttttttttcggtcgcggtgcgacgatggtcgaggagtttagtttttcgttttttgtttttttttttttttttttttttttttttttttttttgttttttcgtttattcgtcgtagttttatag

SEQ ID NO: 14110 - DNA, 615 bp, Artificial Sequence
  chemically treated genomic DNA (Homo sapiens) CpG-island No: 14110
ctataaaactacgacgaataaacgaaaaaacaaaaaaaaaaaaaaaaaaaaaaaaaaaaaaaaaaaaacaaaaaacgaaaaactaaactcctcgaccatcgtcgcaccgcgaccgaaaaaaaaacaataaatcctacaaaacgcattaaacaaattcttcacacccgcgcaaccactttcaaaaaacgacgaccgcaaaaaaaaaaaccgcgcgctctaaacccgaaatctatacccgcgacgccgcgattctaaaacctacgaaatatcacgaaacgaaaaaacgactaccgacaactatcacaacaaattaactaaacccaactcgaaataaaaaccgcaacaaaaaataaaacgacaaaaccgtaccgaactcgacatatttcaaacaaaaaacgacgaaaaaaatttcgaaataaacgcccgaaaaacccctaaccgccaaaactttttatctttccttttctcgaaactcgcgcgaacgcccaacctcaccccttccgcgccgaccgaaaaacgctaaaaccgcgaaccgaactcgctccccttaacccgcgccccgaaacccaccccgaacccctctccgccccacacaacgcaccgactaccacgaaa

SEQ ID NO: 14111 - DNA, 615 bp, Artificial Sequence
  chemically treated genomic DNA (Homo sapiens) CpG-island No: 14111
ttgtggggttgcggcgggtgggcggagagataggagaggaaaagagaaaagggaagagaaggaaggggtagggggcgagaagttgggtttttcgattatcgtcgtatcgcggtcgaaagagggatagtggattttataaagcgtattgagtaagttttttatattcgcgtagttatttttaggaaacggcggtcgtagaggaaagggtcgcgcgttttggattcggagtttgtgttcgcggcgtcgcgattttgaaatttgcgggatgttacggggcggaggggcggttgtcgatagttgttataataaattagttgagtttagttcgaggtggaaatcgtagtaggaagtgggacgatagagtcgtatcgggttcggtatattttaggtaagagacggcgaaaagagtttcgagataaacgttcgggaagtttttggtcgttaaaattttttgtttttttttttttcgaagttcgcgcggacgtttagttttatttttttcgcgtcggtcggggagcgttgaagtcgcgggtcgggttcgttttttttggttcgcgtttcgaaatttatttcgggttttttttcgttttatatagcgtatcgattgttacgagg

SEQ ID NO: 14112 - DNA, 615 bp, Artificial Sequence
  chemically treated genomic DNA (Homo sapiens) CpG-island No: 14112
cctcgtaacaatcgatacgctatataaaacgaaaaaaaacccgaaataaatttcgaaacgcgaaccaaaaaaaacgaacccgacccgcgacttcaacgctccccgaccgacgcgaaaaaaataaaactaaacgtccgcgcgaacttcgaaaaaaaaaaaaacaaaaaattttaacgaccaaaaacttcccgaacgtttatctcgaaactcttttcgccgtctcttacctaaaatataccgaacccgatacgactctatcgtcccacttcctactacgatttccacctcgaactaaactcaactaatttattataacaactatcgacaaccgcccctccgccccgtaacatcccgcaaatttcaaaatcgcgacgccgcgaacacaaactccgaatccaaaacgcgcgaccctttcctctacgaccgccgtttcctaaaaataactacgcgaatataaaaaacttactcaatacgctttataaaatccactatccctctttcgaccgcgatacgacgataatcgaaaaacccaacttctcgccccctaccccttccttctcttcccttttctcttttcctctcctatctctccgcccacccgccgcaaccccacaa

SEQ ID NO: 14113 - DNA, 852 bp, Artificial Sequence
  chemically treated genomic DNA (Homo sapiens) CpG-island No: 14113
gttcgtttttcgggttcgggttttttacgtttagtttcggttttttcggttttcgcggatttttttttcgggtttaatgcgttagttggtttcgtagggtcggaaaagcgcgtttttcggtagtttggcgtcgtcgggaaggtgcgcgtagttcgttcggtagtttcgggatggcgtgagggtcgttttttcggttagttttagcggatttttgtcgttagtaggtcgtttttttttcgcgggttttcgggagcgggttttggcgttagcgcgatttttcgggtttcggcgaatcgagggagcgtttttttttttcgtttgacgggcgtcgatttcgttttgcggtgtcgcggtcgtcgagttttcgacgcgtttttaggtttcgggttcgcgttaggaggttttttcgggttttcgtcggtcggttagcgttcgtaaagttcggcgttttttatagcgggcgggtaaggggcgggagtttacggtttcgcgttttgcggtttcgagcggagcggcgtttcgcgggttcgtttcgtcgtttgttttggttgcggttcgcggtttcgttgtttatcgtttatcgttcgatttcgttcgttagttttcgtttgcgttcgtcgcgttcgttttttatttgcgacgcgtttcggtttttagcgtatcgttttggatcggttgtgtatatcggaagttacgttttcggttcggtttcgttttcgtttcgggcggacgcggggaggttgcggatttcgcgtttagagcggatttttttttcgtattagaggggagggggcgtttcggagtttttttttttgggattttgggtttttaagcgggacggtcggggcggag

SEQ ID NO: 14114 - DNA, 852 bp, Artificial Sequence
  chemically treated genomic DNA (Homo sapiens) CpG-island No: 14114
ctccgccccgaccgtcccgcttaaaaacccaaaatcccaaaaaaaaaaactccgaaacgccccctcccctctaatacgaaaaaaaaatccgctctaaacgcgaaatccgcaacctccccgcgtccgcccgaaacgaaaacgaaaccgaaccgaaaacgtaacttccgatatacacaaccgatccaaaacgatacgctaaaaaccgaaacgcgtcgcaaataaaaaacgaacgcgacgaacgcaaacgaaaactaacgaacgaaatcgaacgataaacgataaacaacgaaaccgcgaaccgcaaccaaaacaaacgacgaaacgaacccgcgaaacgccgctccgctcgaaaccgcaaaacgcgaaaccgtaaactcccgccccttacccgcccgctataaaaaacgccgaactttacgaacgctaaccgaccgacgaaaacccgaaaaaacctcctaacgcgaacccgaaacctaaaaacgcgtcgaaaactcgacgaccgcgacaccgcaaaacgaaatcgacgcccgtcaaacgaaaaaaaaaaacgctccctcgattcgccgaaacccgaaaaatcgcgctaacgccaaaacccgctcccgaaaacccgcgaaaaaaaaacgacctactaacgacaaaaatccgctaaaactaaccgaaaaaacgaccctcacgccatcccgaaactaccgaacgaactacgcgcaccttcccgacgacgccaaactaccgaaaaacgcgcttttccgaccctacgaaaccaactaacgcattaaacccgaaaaaaaaatccgcgaaaaccgaaaaaaccgaaactaaacgtaaaaaacccgaacccgaaaaacgaac

SEQ ID NO: 14115 - DNA, 852 bp, Artificial Sequence
  chemically treated genomic DNA (Homo sapiens) CpG-island No: 14115
tttcgtttcggtcgtttcgtttgggggtttagggttttaggagaggaggtttcggggcgtttttttttttttaatgcgagaggagagttcgttttaggcgcgggattcgtaattttttcgcgttcgttcgaggcgggggcggggtcggatcggagacgtaattttcggtgtatatagtcggtttaaggcggtgcgttgggggtcggggcgcgtcgtaggtgaggagcgggcgcggcgggcgtaggcgggggttggcgggcggggtcgggcggtgggcggtgggtagcggggtcgcgggtcgtagttagggtagacggcgagacgggttcgcggggcgtcgtttcgttcggggtcgtagggcgcggggtcgtgggttttcgttttttgttcgttcgttgtggaggacgtcgggttttgcgggcgttggtcggtcgacggaagttcggaggggttttttggcgcgaattcgggatttgggggcgcgtcggagattcggcggtcgcggtatcgtagggcggggtcggcgttcgttaggcggggaaaggggacgttttttcggttcgtcggggttcgggaggtcgcgttggcgttaggattcgttttcggaagttcgcggagggagggcggtttgttggcggtaggggttcgttggggttagtcggggaggcggtttttacgttatttcggggttgtcgggcgggttgcgcgtattttttcggcggcgttaggttgtcgaggaacgcgttttttcggttttgcggagttagttggcgtattgggttcgaggggagggttcgcggggatcgggagggtcggggttgagcgtggaggattcgagttcgagggacgagt

SEQ ID NO: 14116 - DNA, 852 bp, Artificial Sequence
  chemically treated genomic DNA (Homo sapiens) CpG-island No: 14116
actcgtccctcgaactcgaatcctccacgctcaaccccgaccctcccgatccccgcgaaccctcccctcgaacccaatacgccaactaactccgcaaaaccgaaaaaacgcgttcctcgacaacctaacgccgccgaaaaaatacgcgcaacccgcccgacaaccccgaaataacgtaaaaaccgcctccccgactaaccccaacgaacccctaccgccaacaaaccgccctccctccgcgaacttccgaaaacgaatcctaacgccaacgcgacctcccgaaccccgacgaaccgaaaaaacgtcccctttccccgcctaacgaacgccgaccccgccctacgataccgcgaccgccgaatctccgacgcgcccccaaatcccgaattcgcgccaaaaaacccctccgaacttccgtcgaccgaccaacgcccgcaaaacccgacgtcctccacaacgaacgaacaaaaaacgaaaacccacgaccccgcgccctacgaccccgaacgaaacgacgccccgcgaacccgtctcgccgtctaccctaactacgacccgcgaccccgctacccaccgcccaccgcccgaccccgcccgccaacccccgcctacgcccgccgcgcccgctcctcacctacgacgcgccccgacccccaacgcaccgccttaaaccgactatatacaccgaaaattacgtctccgatccgaccccgcccccgcctcgaacgaacgcgaaaaaattacgaatcccgcgcctaaaacgaactctcctctcgcattaaaaaaaaaaaaacgccccgaaacctcctctcctaaaaccctaaacccccaaacgaaacgaccgaaacgaaa

SEQ ID NO: 14117 - DNA, 585 bp, Artificial Sequence
  chemically treated genomic DNA (Homo sapiens) CpG-island No: 14117
ggtttcgttagtagagggtacggtttcggtttcgttgtagtttcgggatttatcgaggtttttaggtttttacgttcgttttcgagcgcgttttcgttttcgcgttacgtgacgtggtcgcggaatttgagttgcggggtttaagtcgagttaaattcgttgtaggtggtcgcggcgggtgtaattataaaggttaattcgaaggagtcggggaggttcgtggagtcgatgtttttttttttaagttaggtcggttttcgttatttttttagtattcgtcgtttcggtttttttgagcgcgtgtatgaggtttttcgcgtggggaagtttcggtgattatgtaggggagaagagtgaggaagtttttggtgtttgggacgaggttagcgttgtcggcgcgttgttttagcgtttattatattttggtgcgggtcgacgggttttgggttttggtgggagtttcggttttcggttaaggtttggtcgggagcgttacgaattttcgcgtcgtttcgcgagagtttaagttaaagaatatggcgacgtttaatttgttaaaggtaagatttttattttagtttgggt

SEQ ID NO: 14118 - DNA, 585 bp, Artificial Sequence
  chemically treated genomic DNA (Homo sapiens) CpG-island No: 14118
acccaaactaaaataaaaatcttacctttaacaaattaaacgtcgccatattctttaacttaaactctcgcgaaacgacgcgaaaattcgtaacgctcccgaccaaaccttaaccgaaaaccgaaactcccaccaaaacccaaaacccgtcgacccgcaccaaaatataataaacgctaaaacaacgcgccgacaacgctaacctcgtcccaaacaccaaaaacttcctcactcttctcccctacataatcaccgaaacttccccacgcgaaaaacctcatacacgcgctcaaaaaaaccgaaacgacgaatactaaaaaaataacgaaaaccgacctaacttaaaaaaaaaaacatcgactccacgaacctccccgactccttcgaattaacctttataattacacccgccgcgaccacctacaacgaatttaactcgacttaaaccccgcaactcaaattccgcgaccacgtcacgtaacgcgaaaacgaaaacgcgctcgaaaacgaacgtaaaaacctaaaaacctcgataaatcccgaaactacaacgaaaccgaaaccgtaccctctactaacgaaacc

SEQ ID NO: 14119 - DNA, 585 bp, Artificial Sequence
  chemically treated genomic DNA (Homo sapiens) CpG-island No: 14119
atttaagttggagtgagggttttatttttaatagattagacgtcgttatgttttttaatttggattttcgcgagacgacgcgagaattcgtggcgttttcggttaggttttgatcggaggtcggagtttttattagggtttagggttcgtcggttcgtattagggtgtggtgggcgttggagtagcgcgtcgatagcgttgatttcgttttaagtattaggagtttttttattttttttttttatatggttatcggagtttttttacgcgaaagattttatgtacgcgtttaggaagatcggaacggcgaatgttgagaaggtaacgggagtcgatttgatttggaagaggaagtatcgattttacgagttttttcgattttttcggattagtttttgtggttgtattcgtcgcggttatttgtaacgaatttagttcggtttaggtttcgtagtttaggtttcgcggttacgttacgtgacgcgagggcggggacgcgttcgggagcgagcgtgggagtttggaagtttcggtgggtttcgaggttgtagcgaggtcgggatcgtgttttttgttggcgggatt

SEQ ID NO: 14120 - DNA, 585 bp, Artificial Sequence
  chemically treated genomic DNA (Homo sapiens) CpG-island No: 14120
aatcccgccaacaaaaaacacgatcccgacctcgctacaacctcgaaacccaccgaaacttccaaactcccacgctcgctcccgaacgcgtccccgccctcgcgtcacgtaacgtaaccgcgaaacctaaactacgaaacctaaaccgaactaaattcgttacaaataaccgcgacgaatacaaccacaaaaactaatccgaaaaaatcgaaaaaactcgtaaaatcgatacttcctcttccaaatcaaatcgactcccgttaccttctcaacattcgccgttccgatcttcctaaacgcgtacataaaatctttcgcgtaaaaaaactccgataaccatataaaaaaaaaaaataaaaaaactcctaatacttaaaacgaaatcaacgctatcgacgcgctactccaacgcccaccacaccctaatacgaaccgacgaaccctaaaccctaataaaaactccgacctccgatcaaaacctaaccgaaaacgccacgaattctcgcgtcgtctcgcgaaaatccaaattaaaaaacataacgacgtctaatctattaaaaataaaaccctcactccaacttaaat

SEQ ID NO: 14121 - DNA, 525 bp, Artificial Sequence
  chemically treated genomic DNA (Homo sapiens) CpG-island No: 14121
ttttatttcggttgtttttcgcgcgttttatttttcgtttttgtcggattcgtttttttgcgttgggtttagcgcgtcgttagggaaggggtcggagtttgggagttcgtttcgtcgtcgttcgtttttcgttcgtaggtttattcgtagcggttacgtgaaggatcgagcgtcgcgcgttaggcggggttttcgttagtacgaggagggtagagttcgttgcggttgtcgtttcgacgttcgcgtattttcgttcgtcgcgttcgtcgtcgcgatgttcggggtcggtttagtcgcggtggtgagttgtttgcgttcgtagttcggcgaggagtcgtagatttatgaggtaaggaggattttttggttgtgttcggagggcgttcggacggtagcgttttttgttttttcgttgtttttttggtgtcgggcgttttcgggatttttagggagaaagcgaattcgttggaagttacggtcggttgtagagaatgagggtttttgggggttagcgggattaggaat

SEQ ID NO: 14122 - DNA, 525 bp, Artificial Sequence
  chemically treated genomic DNA (Homo sapiens) CpG-island No: 14122
attcctaatcccgctaacccccaaaaaccctcattctctacaaccgaccgtaacttccaacgaattcgctttctccctaaaaatcccgaaaacgcccgacaccaaaaaaacaacgaaaaaacaaaaaacgctaccgtccgaacgccctccgaacacaaccaaaaaatcctccttacctcataaatctacgactcctcgccgaactacgaacgcaaacaactcaccaccgcgactaaaccgaccccgaacatcgcgacgacgaacgcgacgaacgaaaatacgcgaacgtcgaaacgacaaccgcaacgaactctaccctcctcgtactaacgaaaaccccgcctaacgcgcgacgctcgatccttcacgtaaccgctacgaataaacctacgaacgaaaaacgaacgacgacgaaacgaactcccaaactccgaccccttccctaacgacgcgctaaacccaacgcaaaaaaacgaatccgacaaaaacgaaaaataaaacgcgcgaaaaacaaccgaaataaaa

SEQ ID NO: 14123 - DNA, 525 bp, Artificial Sequence
  chemically treated genomic DNA (Homo sapiens) CpG-island No: 14123
gtttttagtttcgttgatttttaagggtttttattttttgtagtcggtcgtggtttttagcgggttcgttttttttttgggagtttcggaggcgttcggtattaggagggtaacgaaggggtaggaggcgttgtcgttcgggcgtttttcgagtatagttaggaagttttttttattttatgggtttgcggtttttcgtcgggttgcgggcgtaggtagtttattatcgcggttaggtcggtttcggatatcgcggcggcgggcgcggcgagcggggatgcgcgggcgtcggggcggtagtcgtaacggattttgtttttttcgtgttagcggaggtttcgtttggcgcgcggcgttcggttttttacgtgatcgttgcgggtgggtttgcgggcggaggacgggcgacggcggggcgggtttttaggtttcggttttttttttggcggcgcgttgggtttagcgtagggaagcggattcggtagggacggggagtgggacgcgcgaggggtagtcggggtaaga

SEQ ID NO: 14124 - DNA, 525 bp, Artificial Sequence
  chemically treated genomic DNA (Homo sapiens) CpG-island No: 14124
tcttaccccgactacccctcgcgcgtcccactccccgtccctaccgaatccgcttccctacgctaaacccaacgcgccgccaaaaaaaaaaccgaaacctaaaaacccgccccgccgtcgcccgtcctccgcccgcaaacccacccgcaacgatcacgtaaaaaaccgaacgccgcgcgccaaacgaaacctccgctaacacgaaaaaaacaaaatccgttacgactaccgccccgacgcccgcgcatccccgctcgccgcgcccgccgccgcgatatccgaaaccgacctaaccgcgataataaactacctacgcccgcaacccgacgaaaaaccgcaaacccataaaataaaaaaaacttcctaactatactcgaaaaacgcccgaacgacaacgcctcctaccccttcgttaccctcctaataccgaacgcctccgaaactcccaaaaaaaaaacgaacccgctaaaaaccacgaccgactacaaaaaataaaaacccttaaaaatcaacgaaactaaaaac

SEQ ID NO: 14125 - DNA, 719 bp, Artificial Sequence
  chemically treated genomic DNA (Homo sapiens) CpG-island No: 14125
aatgcgaaagtgaggggcgtgtgtgtagcgtgggcgcgtggaggcgtgtaaatggtcgggtgagtcgcgtgtgtgtatatgcggggcgtgcgatgcgatgcgtattcggagtggtcgggcgggtaagggcgtttagcgtgcgcggttgttcggtattcgttcgtgtgtaagcgcggcgcgtatggtgtaggagcgcggagtgcgtgagttttggggtttcgggtttagggttgagatgtggggttgcgtgcgttcgcgattagggtgcgatttcggtcgcgtacgggggtcggcggggtgcgtatttattcgggtttcgcggaggggtcgtcgtttcggttgggttttagttgtcggttcgtttttcgtagcgttacgtatttgcgtttagttcggtcgtcgcggtaacgtatatttttgtagtgtcgtcgggttttcgttttcgaggagcgcgggcgagtcgggggttcggcgggtcggggcggcggatcggagtgcgtcgtagttcgggtacgtttttaggagttcgtcgcgtttttttcgcgttcgttcgtttgttcgttcgtttttttttgaatttaaagtgataagttcgagcgttgtttttgtttttggggttcgagtcggagatttttaagcgcgttcgggatttagggacgttttgagtgtaattttaatttttcgtttttacgtttggggataggggtgggtggggacgt

SEQ ID NO: 14126 - DNA, 719 bp, Artificial Sequence
  chemically treated genomic DNA (Homo sapiens) CpG-island No: 14126
acgtccccacccacccctatccccaaacgtaaaaacgaaaaattaaaattacactcaaaacgtccctaaatcccgaacgcgcttaaaaatctccgactcgaaccccaaaaacaaaaacaacgctcgaacttatcactttaaattcaaaaaaaaacgaacgaacaaacgaacgaacgcgaaaaaaacgcgacgaactcctaaaaacgtacccgaactacgacgcactccgatccgccgccccgacccgccgaacccccgactcgcccgcgctcctcgaaaacgaaaacccgacgacactacaaaaatatacgttaccgcgacgaccgaactaaacgcaaatacgtaacgctacgaaaaacgaaccgacaactaaaacccaaccgaaacgacgacccctccgcgaaacccgaataaatacgcaccccgccgacccccgtacgcgaccgaaatcgcaccctaatcgcgaacgcacgcaaccccacatctcaaccctaaacccgaaaccccaaaactcacgcactccgcgctcctacaccatacgcgccgcgcttacacacgaacgaataccgaacaaccgcgcacgctaaacgcccttacccgcccgaccactccgaatacgcatcgcatcgcacgccccgcatatacacacacgcgactcacccgaccatttacacgcctccacgcgcccacgctacacacacgcccctcactttcgcatt

SEQ ID NO: 14127 - DNA, 719 bp, Artificial Sequence
  chemically treated genomic DNA (Homo sapiens) CpG-island No: 14127
acgtttttatttatttttgtttttaggcgtgggagcgaggggttggggttgtatttagggcgtttttggatttcggacgcgtttggggattttcggttcggattttaggagtagagatagcgttcgagtttgttattttaaatttaagagggagcgggcgggtaagcgggcgagcgcgagggaggcgcggcgggtttttgggagcgtgttcggattgcggcgtatttcggttcgtcgtttcggttcgtcgagttttcggttcgttcgcgtttttcggaggcgggagttcggcgatattgtaggggtgtgcgttgtcgcggcggtcgggttaggcgtaggtgcgtggcgttgcgggaggcgggtcggtagttggagtttagtcggagcggcggttttttcgcggagttcgggtgagtacgtatttcgtcgattttcgtgcgcggtcgggatcgtattttgatcgcggacgtacgtagttttatattttagttttgggttcgggattttagagtttacgtatttcgcgtttttgtattatgcgcgtcgcgtttgtatacgaacgaatgtcgggtaatcgcgtacgttgggcgtttttattcgttcggttatttcgagtgcgtatcgtatcgtacgtttcgtatgtgtatatacgcggtttattcggttatttatacgtttttacgcgtttacgttgtatatacgttttttattttcgtatt

SEQ ID NO: 14128 - DNA, 719 bp, Artificial Sequence
  chemically treated genomic DNA (Homo sapiens) CpG-island No: 14128
aatacgaaaataaaaaacgtatatacaacgtaaacgcgtaaaaacgtataaataaccgaataaaccgcgtatatacacatacgaaacgtacgatacgatacgcactcgaaataaccgaacgaataaaaacgcccaacgtacgcgattacccgacattcgttcgtatacaaacgcgacgcgcataatacaaaaacgcgaaatacgtaaactctaaaatcccgaacccaaaactaaaatataaaactacgtacgtccgcgatcaaaatacgatcccgaccgcgcacgaaaatcgacgaaatacgtactcacccgaactccgcgaaaaaaccgccgctccgactaaactccaactaccgacccgcctcccgcaacgccacgcacctacgcctaacccgaccgccgcgacaacgcacacccctacaatatcgccgaactcccgcctccgaaaaacgcgaacgaaccgaaaactcgacgaaccgaaacgacgaaccgaaatacgccgcaatccgaacacgctcccaaaaacccgccgcgcctccctcgcgctcgcccgcttacccgcccgctccctcttaaatttaaaataacaaactcgaacgctatctctactcctaaaatccgaaccgaaaatccccaaacgcgtccgaaatccaaaaacgccctaaatacaaccccaacccctcgctcccacgcctaaaaacaaaaataaataaaaacgt

SEQ ID NO: 14129 - DNA, 700 bp, Artificial Sequence
  chemically treated genomic DNA (Homo sapiens) CpG-island No: 14129
acgggaggcggagtgcgagagtaaggaataaggaaagttttcgttttatacgtcgcggttttttgtagagttgagttatatttagtacgatggggataatttgggttttcgattttgatagatttgggttcgaatttttagggatttcgcgcgaggcgttttagttagtttttttatttgtaaaatgggttcgagagtaagaatgaggtagttcgtaggcggacgttgcggaggggcgttcgggggttgtagtcgggggcgggttcgggggcgggtttagtcggtcgagttttcgcgcgagggggaggggcgtcgttcgttgcgtcgcgtcgcgtatcgcgtatagttcgtcgttgttttttttagtcgttattcgcggagttcgcgtcgtttttgcgcgcgcgatttttatataagcgtttttcgtagcggtgtcggcgtacgtttattcgtttcgattcgtcgcgggaagaggatcgtgcggagcgcggcggatatttattttttcgtcgtcgttagttttcgtcgtcgtttttatcgttgttgtttttattgatagagaatagttgcggttttcgtgtaatcgaatttgttgtagtttcggtttcgttttacggattttttattggtttagatagtttaatttttttcgttattgggtagtgtttttcgttatttttcgtttttaggttttggattt

SEQ ID NO: 14130 - DNA, 700 bp, Artificial Sequence
  chemically treated genomic DNA (Homo sapiens) CpG-island No: 14130
aaatccaaaacctaaaaacgaaaaataacgaaaaacactacccaataacgaaaaaaattaaactatctaaaccaataaaaaatccgtaaaacgaaaccgaaactacaacaaattcgattacacgaaaaccgcaactattctctatcaataaaaacaacaacgataaaaacgacgacgaaaactaacgacgacgaaaaaataaatatccgccgcgctccgcacgatcctcttcccgcgacgaatcgaaacgaataaacgtacgccgacaccgctacgaaaaacgcttatataaaaatcgcgcgcgcaaaaacgacgcgaactccgcgaataacgactaaaaaaaacaacgacgaactatacgcgatacgcgacgcgacgcaacgaacgacgcccctccccctcgcgcgaaaactcgaccgactaaacccgcccccgaacccgcccccgactacaacccccgaacgcccctccgcaacgtccgcctacgaactacctcattcttactctcgaacccattttacaaataaaaaaactaactaaaacgcctcgcgcgaaatccctaaaaattcgaacccaaatctatcaaaatcgaaaacccaaattatccccatcgtactaaatataactcaactctacaaaaaaccgcgacgtataaaacgaaaactttccttattccttactctcgcactccgcctcccgt

SEQ ID NO: 14131 - DNA, 700 bp, Artificial Sequence
  chemically treated genomic DNA (Homo sapiens) CpG-island No: 14131
gagtttagagtttaggggcgaggagtgacggagaatattgtttaataacgggaggggttgggttgtttgggttaataggaagttcgtaaggcggggtcgggattgtagtaagttcggttgtacggagatcgtagttgttttttgttagtggaggtagtagcggtagaggcggcggcgaggattggcgacggcgaggaggtgagtgttcgtcgcgtttcgtacggtttttttttcgcggcgggtcggagcgggtggacgtgcgtcggtatcgttgcgagggacgtttatgtaagggtcgcgcgcgtaaaggcggcgcgggtttcgcgagtgacggttggaggagatagcgacgggttgtgcgcggtgcgcgacgcgacgtagcggacggcgtttttttttttcgcgcgggggttcggtcggttggattcgttttcggattcgttttcggttgtagttttcgagcgttttttcgtagcgttcgtttgcgggttgttttatttttgttttcgggtttattttgtagatggagaaattgattaaagcgtttcgcgcgaggtttttgagggttcgaatttaagtttgttaggatcgggagtttaagttgtttttatcgtattggatgtggtttagttttgtaggaagtcgcggcgtgtaaggcgagggttttttttgttttttgttttcgtatttcgtttttcgt

SEQ ID NO: 14132 - DNA, 700 bp, Artificial Sequence
  chemically treated genomic DNA (Homo sapiens) CpG-island No: 14132
acgaaaaacgaaatacgaaaacaaaaaacaaaaaaaaccctcgccttacacgccgcgacttcctacaaaactaaaccacatccaatacgataaaaacaacttaaactcccgatcctaacaaacttaaattcgaaccctcaaaaacctcgcgcgaaacgctttaatcaatttctccatctacaaaataaacccgaaaacaaaaataaaacaacccgcaaacgaacgctacgaaaaaacgctcgaaaactacaaccgaaaacgaatccgaaaacgaatccaaccgaccgaacccccgcgcgaaaaaaaaaaacgccgtccgctacgtcgcgtcgcgcaccgcgcacaacccgtcgctatctcctccaaccgtcactcgcgaaacccgcgccgcctttacgcgcgcgacccttacataaacgtccctcgcaacgataccgacgcacgtccacccgctccgacccgccgcgaaaaaaaaaccgtacgaaacgcgacgaacactcacctcctcgccgtcgccaatcctcgccgccgcctctaccgctactacctccactaacaaaaaacaactacgatctccgtacaaccgaacttactacaatcccgaccccgccttacgaacttcctattaacccaaacaacccaacccctcccgttattaaacaatattctccgtcactcctcgcccctaaactctaaactc

SEQ ID NO: 14133 - DNA, 727 bp, Artificial Sequence
  chemically treated genomic DNA (Homo sapiens) CpG-island No: 14133
  misc_feature (224)..(224): n is either a, c, g or t
gtagtttgttattacgttaagatgttagcgattttgcgcgttgttattttattgcgttaaatcgtcgtttagttgtaatatatagcggttagtttgagtatttagttgatcgttatcggtttttgaacgttcgtgtttttcgatatgacgtatttatatattgtttgtcgatttttgagaatgtagtgaatttgtatattgcggtttatttagacggtcgtgtnaacgatgggttaaatagcgagttggttgcgggtaatgttgttgatatagttttcgtttttcgggcgataaattgatgggtttttcggatttataatagggggattattgatgggatcgggtgtattcgttggcgttacgtcgttttatttattggttagattttagtttttttcgttattttttttttttttagttagcgtgtagacgtaagttttagtttcgatagtttcggtggttagcgcgaagttatttgtagaattatcgttaattttaatgagtttaatatcgttgatcgtttgtgtatcgacgtcgttaatgttattaattcgaacgcgagtgtttttttgggtatcgttttttacgtttattttagcggtgggcgaattatcgtcgtttagcgtcgcgttgaacgttattaggttattgttttcggtatagttgtcgttaacggttagtatatttaagaaaaatttttttcgttatttatttgaatcggtcgtta

SEQ ID NO: 14134 - DNA, 727 bp, Artificial Sequence
  chemically treated genomic DNA (Homo sapiens) CpG-island No: 14134
  misc_feature (504)..(504): n is either a, c, g or t
taacgaccgattcaaataaataacgaaaaaaatttttcttaaatatactaaccgttaacgacaactataccgaaaacaataacctaataacgttcaacgcgacgctaaacgacgataattcgcccaccgctaaaataaacgtaaaaaacgatacccaaaaaaacactcgcgttcgaattaataacattaacgacgtcgatacacaaacgatcaacgatattaaactcattaaaattaacgataattctacaaataacttcgcgctaaccaccgaaactatcgaaactaaaacttacgtctacacgctaactaaaaaaaaaaaaaataacgaaaaaaactaaaatctaaccaataaataaaacgacgtaacgccaacgaatacacccgatcccatcaataatccccctattataaatccgaaaaacccatcaatttatcgcccgaaaaacgaaaactatatcaacaacattacccgcaaccaactcgctatttaacccatcgttnacacgaccgtctaaataaaccgcaatatacaaattcactacattctcaaaaatcgacaaacaatatataaatacgtcatatcgaaaaacacgaacgttcaaaaaccgataacgatcaactaaatactcaaactaaccgctatatattacaactaaacgacgatttaacgcaataaaataacaacgcgcaaaatcgctaacatcttaacgtaataacaaactac

SEQ ID NO: 14135 - DNA, 727 bp, Artificial Sequence
  chemically treated genomic DNA (Homo sapiens) CpG-island No: 14135
  misc_feature (504)..(504): n is either a, c, g or t
tggcggtcggtttaaatgaatagcgaagggggttttttttgaatgtattgatcgttaacggtaattgtgtcggaaataatggtttgatgacgtttaacgcgacgttgggcggcgataattcgtttatcgttaagatgaacgtgaaaggcgatatttaagggaatattcgcgttcgggttgataatattggcggcgtcggtgtataaacggttaacggtattgaatttattgaggttggcggtaattttgtaggtaatttcgcgttgattatcggaattgtcgaagttggggtttacgtttatacgttggttaaagggaaggggaatgacgagaaaaattgggatttgattagtaaatgggacggcgtaacgttagcggatatattcgattttattaataatttttttgttgtggattcgggaggtttattagtttatcgttcggagggcggaagttatattagtaatattgttcgtagttaattcgttgtttaatttatcgttnatacgatcgtttgggtgagtcgtagtatatagatttattgtatttttaggggtcggtaagtagtatgtggatgcgttatgtcggagggtacgaacgtttaagggtcggtgacggttagttaaatatttaggttaatcgttatgtattgtagttaggcggcgatttggcgtagtggagtagtaacgcgtaggatcgttggtattttggcgtgatggtaggttat

SEQ ID NO: 14136 - DNA, 727 bp, Artificial Sequence
  chemically treated genomic DNA (Homo sapiens) CpG-island No: 14136
  misc_feature (224)..(224): n is either a, c, g or t
ataacctaccatcacgccaaaataccaacgatcctacgcgttactactccactacgccaaatcgccgcctaactacaatacataacgattaacctaaatatttaactaaccgtcaccgacccttaaacgttcgtaccctccgacataacgcatccacatactacttaccgacccctaaaaatacaataaatctatatactacgactcacccaaacgatcgtatnaacgataaattaaacaacgaattaactacgaacaatattactaatataacttccgccctccgaacgataaactaataaacctcccgaatccacaacaaaaaaattattaataaaatcgaatatatccgctaacgttacgccgtcccatttactaatcaaatcccaatttttctcgtcattccccttccctttaaccaacgtataaacgtaaaccccaacttcgacaattccgataatcaacgcgaaattacctacaaaattaccgccaacctcaataaattcaataccgttaaccgtttatacaccgacgccgccaatattatcaacccgaacgcgaatattcccttaaatatcgcctttcacgttcatcttaacgataaacgaattatcgccgcccaacgtcgcgttaaacgtcatcaaaccattatttccgacacaattaccgttaacgatcaatacattcaaaaaaaacccccttcgctattcatttaaaccgaccgcca

SEQ ID NO: 14137 - DNA, 880 bp, Artificial Sequence
  chemically treated genomic DNA (Homo sapiens) CpG-island No: 14137
atattgttcgcggttatcggggaggttttgtttggaagtttttgtttgtcgcgggcgcggttaggcgggttttatgagggggattttttcggtaatcgagtttttcggtttgggtcgcggggttacggtagtgattgcgtttatacgcggtagtcggggaaggggcgaggggtcggttaggggtcgcggggttagttttcgggcgcgggttaggcggggtcgcgtttgtagttcgttttcggagttgtaggtggggttgtgcggttgtttgtttttaggaagttttatgtgttttcgtcggtcgcgtcggtttttaggatatagtgcggatcggtcgggcgttaaaggcgttgacgtaattgcgggcggcgtagggtaggggtagttagggagtagcggcggtagagatagggttgggcgggcgtcgtttgcggagagtatcgggaggcgggttttgcgtggaggtcgcgcgtagtagcggcgacgattttatttgggtcgcgggggatagcgtagggttatggaggaggcggtcgtagtttcggtaagggcgattagcgcgcgtacgaattcgcggtttggatttttcgggcgattcgggttcggtatacgggggttgcgggagtcgagtcgtattatcgcgtttggggtttcggggaatagggtcgcgcgtttgtcgggtttattgcgtttgttagtcgggttttttatttcgttcgagttcgagcgttggcggaacggttgttttcgtttcgggtcgttttacgttaagatttttgcgttcgggttttttgttttcgttttagtcgttgaattttatatttgcgtttttttattcgaggtttttttttttgtttggcgttcggtttgtgggtttttt

SEQ ID NO: 14138 - DNA, 880 bp, Artificial Sequence
  chemically treated genomic DNA (Homo sapiens) CpG-island No: 14138
aaaaaacccacaaaccgaacgccaaacaaaaaaaaaaacctcgaataaaaaaacgcaaatataaaattcaacgactaaaacgaaaacaaaaaacccgaacgcaaaaatcttaacgtaaaacgacccgaaacgaaaacaaccgttccgccaacgctcgaactcgaacgaaataaaaaacccgactaacaaacgcaataaacccgacaaacgcgcgaccctattccccgaaaccccaaacgcgataatacgactcgactcccgcaacccccgtataccgaacccgaatcgcccgaaaaatccaaaccgcgaattcgtacgcgcgctaatcgcccttaccgaaactacgaccgcctcctccataaccctacgctatcccccgcgacccaaataaaatcgtcgccgctactacgcgcgacctccacgcaaaacccgcctcccgatactctccgcaaacgacgcccgcccaaccctatctctaccgccgctactccctaactacccctaccctacgccgcccgcaattacgtcaacgcctttaacgcccgaccgatccgcactatatcctaaaaaccgacgcgaccgacgaaaacacataaaacttcctaaaaacaaacaaccgcacaaccccacctacaactccgaaaacgaactacaaacgcgaccccgcctaacccgcgcccgaaaactaaccccgcgacccctaaccgacccctcgccccttccccgactaccgcgtataaacgcaatcactaccgtaaccccgcgacccaaaccgaaaaactcgattaccgaaaaaatccccctcataaaacccgcctaaccgcgcccgcgacaaacaaaaacttccaaacaaaacctccccgataaccgcgaacaatat

SEQ ID NO: 14139 - DNA, 880 bp, Artificial Sequence
  chemically treated genomic DNA (Homo sapiens) CpG-island No: 14139
gagggatttataggtcgagcgttaagtagagaaaagagtttcgggtggggggacgtagatgtagggtttagcggttggggcgggggtaggaagttcggacgtaagaattttggcgtggggcggttcggggcggggataatcgtttcgttagcgttcgggttcgagcggagtggggggttcggttggtaagcgtagtaggttcggtagacgcgcggttttgtttttcggagttttaggcgcggtagtacggttcggttttcgtagttttcgtgtgtcgggttcgggtcgttcggggaatttaggtcgcgagttcgtgcgcgcgttggtcgtttttatcggagttgcggtcgttttttttatggttttgcgttgtttttcgcggtttagataaagtcgtcgtcgttgttgcgcgcggtttttacgtagggttcgtttttcggtgtttttcgtaggcggcgttcgtttagttttgtttttgtcgtcgttgttttttgattgtttttgttttgcgtcgttcgtagttgcgttaacgtttttagcgttcggtcggttcgtattgtattttgggagtcggcgcggtcgacgaaggtatatgaggttttttggaggtaggtagtcgtatagttttatttgtagtttcggaggcgaattgtaggcgcgatttcgtttggttcgcgttcgggagttgatttcgcgatttttggtcgatttttcgtttttttttcgattgtcgcgtgtgggcgtagttattgtcgtggtttcgcgatttaggtcgagggattcggttatcgaaagagttttttttataagattcgtttggtcgcgttcgcggtaagtaggggtttttaggtagggttttttcggtgatcgcgggtagtgt

SEQ ID NO: 14140 - DNA, 880 bp, Artificial Sequence
  chemically treated genomic DNA (Homo sapiens) CpG-island No: 14140
acactacccgcgatcaccgaaaaaaccctacctaaaaacccctacttaccgcgaacgcgaccaaacgaatcttataaaaaaaactctttcgataaccgaatccctcgacctaaatcgcgaaaccacgacaataactacgcccacacgcgacaatcgaaaaaaaaacgaaaaatcgaccaaaaatcgcgaaatcaactcccgaacgcgaaccaaacgaaatcgcgcctacaattcgcctccgaaactacaaataaaactatacgactacctacctccaaaaaacctcatataccttcgtcgaccgcgccgactcccaaaatacaatacgaaccgaccgaacgctaaaaacgttaacgcaactacgaacgacgcaaaacaaaaacaatcaaaaaacaacgacgacaaaaacaaaactaaacgaacgccgcctacgaaaaacaccgaaaaacgaaccctacgtaaaaaccgcgcgcaacaacgacgacgactttatctaaaccgcgaaaaacaacgcaaaaccataaaaaaaacgaccgcaactccgataaaaacgaccaacgcgcgcacgaactcgcgacctaaattccccgaacgacccgaacccgacacacgaaaactacgaaaaccgaaccgtactaccgcgcctaaaactccgaaaaacaaaaccgcgcgtctaccgaacctactacgcttaccaaccgaaccccccactccgctcgaacccgaacgctaacgaaacgattatccccgccccgaaccgccccacgccaaaattcttacgtccgaacttcctacccccgccccaaccgctaaaccctacatctacgtccccccacccgaaactcttttctctacttaacgctcgacctataaatccctc

SEQ ID NO: 14141 - DNA, 788 bp, Artificial Sequence
  chemically treated genomic DNA (Homo sapiens) CpG-island No: 14141
  misc_feature (325)..(325): n is either a, c, g or t
  misc_feature (374)..(374): n is either a, c, g or t
  misc_feature (384)..(384): n is either a, c, g or t
  misc_feature (780)..(780): n is either a, c, g or t
gtcgcgagtttatggtgcgggcgaggcgagggcgattgacggcgtgggtttggagggcggcggtataggtattcgcgttgggatcgcgggtacgatcggcgtgagcgcgtttagttttagtgtttggcgttcgcgtttcggtttagtttaatggttgcgtttttcgcgttatcgcgttacgttgtttatttagggttgcggggagcgtttgttatgatttattagatagcgacgaggttgcgattcggcggttggttttttttttttttttttttttaggcgttttcgtttttacgttcgtagcgtacgtttcgcgcgatatcgnttcggggatcgcggcgagtggggaggagtagcgtcgtcgtcgcgtgttncgggtttcgngtattgttttgcggttgcggcgtattttagttttgttgtcgcggggtgtttgtgggtcggggaggggacgcggcgtttaggttggcgcgtggttgttgtggcggggcgggtgtggggcgtcggcgaggggttcggttggtgtcgttgcggttgggttgcggttggggcgcgcgttttttttgttgcggcggtttcgggggagtggcgggttgtttttgcgtttgcggggtatgagtttttttgtggggggtaagtcgatcgtgttgtatggggtggtttggtcggttgtttttgtttttggtgttcggcgtttcgaatgttatgttttttggaattttggttgggtgggtagtttggagtgttagttgtaggatggggtgagcgttcgttgtagtnatttggtt

SEQ ID NO: 14142 - DNA, 788 bp, Artificial Sequence
  chemically treated genomic DNA (Homo sapiens) CpG-island No: 14142
  misc_feature (9)..(9): n is either a, c, g or t
  misc_feature (405)..(405): n is either a, c, g or t
  misc_feature (415)..(415): n is either a, c, g or t
  misc_feature (464)..(464): n is either a, c, g or t
aaccaaatnactacaacgaacgctcaccccatcctacaactaacactccaaactacccacccaaccaaaattccaaaaaacataacattcgaaacgccgaacaccaaaaacaaaaacaaccgaccaaaccaccccatacaacacgatcgacttaccccccacaaaaaaactcataccccgcaaacgcaaaaacaacccgccactcccccgaaaccgccgcaacaaaaaaaacgcgcgccccaaccgcaacccaaccgcaacgacaccaaccgaacccctcgccgacgccccacacccgccccgccacaacaaccacgcgccaacctaaacgccgcgtcccctccccgacccacaaacaccccgcgacaacaaaactaaaatacgccgcaaccgcaaaacaatacncgaaacccgnaacacgcgacgacgacgctactcctccccactcgccgcgatccccgaancgatatcgcgcgaaacgtacgctacgaacgtaaaaacgaaaacgcctaaaaaaaaaaaaaaaaaaaaaaccaaccgccgaatcgcaacctcgtcgctatctaataaatcataacaaacgctccccgcaaccctaaataaacaacgtaacgcgataacgcgaaaaacgcaaccattaaactaaaccgaaacgcgaacgccaaacactaaaactaaacgcgctcacgccgatcgtacccgcgatcccaacgcgaatacctataccgccgccctccaaacccacgccgtcaatcgccctcgcctcgcccgcaccataaactcgcgac

SEQ ID NO: 14143 - DNA, 788 bp, Artificial Sequence
  chemically treated genomic DNA (Homo sapiens) CpG-island No: 14143
  misc_feature (9)..(9): n is either a, c, g or t
  misc_feature (405)..(405): n is either a, c, g or t
  misc_feature (415)..(415): n is either a, c, g or t
  misc_feature (464)..(464): n is either a, c, g or t
aattagatnattgtaacgaacgtttattttattttatagttagtattttaaattatttatttaattaagattttaaagagtatgatattcgaggcgtcgaatattagaaataagaatagtcggttaaattattttatatagtacgatcggtttattttttatagaagagtttatatttcgtaaacgtaaaagtaattcgttattttttcgaaatcgtcgtagtaaaggaagcgcgcgttttagtcgtagtttagtcgtaacgatattagtcgaatttttcgtcggcgttttatattcgtttcgttatagtagttacgcgttagtttgagcgtcgcgtttttttttcgatttataggtatttcgcggtaataaggttgaggtacgtcgtagtcgtaggataatgtncggagttcgngatacgcggcggcggcgttgtttttttttattcgtcgcggttttcgagncggtgtcgcgcggggcgtgcgttacggacgtggaggcgggggcgtttggggggggaggggaggggaggattagtcgtcgagtcgtagtttcgtcgttgtttggtgagttatggtaggcgtttttcgtagttttggatggatagcgtagcgcggtggcgcggggggcgtagttattgggttgggtcggggcgcgagcgttaggtattagagttgagcgcgtttacgtcgatcgtattcgcggttttagcgcgggtgtttgtgtcgtcgttttttaagtttacgtcgttagtcgttttcgtttcgttcgtattatgaattcgcggt

SEQ ID NO: 14144 - DNA, 788 bp, Artificial Sequence
  chemically treated genomic DNA (Homo sapiens) CpG-island No: 14144
  misc_feature (325)..(325): n is either a, c, g or t
  misc_feature (374)..(374): n is either a, c, g or t
  misc_feature (384)..(384): n is either a, c, g or t
  misc_feature (780)..(780): n is either a, c, g or t
accgcgaattcataatacgaacgaaacgaaaacgactaacgacgtaaacttaaaaaacgacgacacaaacacccgcgctaaaaccgcgaatacgatcgacgtaaacgcgctcaactctaatacctaacgctcgcgccccgacccaacccaataactacgccccccgcgccaccgcgctacgctatccatccaaaactacgaaaaacgcctaccataactcaccaaacaacgacgaaactacgactcgacgactaatcctcccctcccctccccccccaaacgcccccgcctccacgtccgtaacgcacgccccgcgcgacaccgnctcgaaaaccgcgacgaataaaaaaaaacaacgccgccgccgcgtatcncgaactccgnacattatcctacgactacgacgtacctcaaccttattaccgcgaaatacctataaatcgaaaaaaaaacgcgacgctcaaactaacgcgtaactactataacgaaacgaatataaaacgccgacgaaaaattcgactaatatcgttacgactaaactacgactaaaacgcgcgcttcctttactacgacgatttcgaaaaaataacgaattacttttacgtttacgaaatataaactcttctataaaaaataaaccgatcgtactatataaaataatttaaccgactattcttatttctaatattcgacgcctcgaatatcatactctttaaaatcttaattaaataaataatttaaaatactaactataaaataaaataaacgttcgttacaatnatctaatt

SEQ ID NO: 14145 - DNA, 508 bp, Artificial Sequence
  chemically treated genomic DNA (Homo sapiens) CpG-island No: 14145
cgtggtcggggcgtattgcgcgtcgacggcggggggtcgaagggtacgtagtgtcggcgttatggcggttttcgcgtacggttttgtttgggggtcgttgcggtttggtattttcggtttgtgttgtcgtcggtcgtttttgggtttgtacgcgcgtatgcggcggttgttcgggtcggaggtgtttgggcggagcgtggttgcggttagcggatcgggcgtttggggtattgattattattgtttggagttgttgcggtgagcgagtacgattttttttggcgcggcgggaagcggggtttcggggtgggagcggttgcgtttcgcgtttggtttgacgtttgagcgagcggatcggcgtttttttcgtgtttttttgggtgtgcgttttagtgggcgtcgggtgcgggtgtgcggaggtagcgggtttataggaatatttatatgggttataaaattatggtaaaattttttcgattgtttacgtttgtcgttttatttgaatttt

SEQ ID NO: 14146 - DNA, 508 bp, Artificial Sequence
  chemically treated genomic DNA (Homo sapiens) CpG-island No: 14146
aaaattcaaataaaacgacaaacgtaaacaatcgaaaaaattttaccataattttataacccatataaatattcctataaacccgctacctccgcacacccgcacccgacgcccactaaaacgcacacccaaaaaaacacgaaaaaaacgccgatccgctcgctcaaacgtcaaaccaaacgcgaaacgcaaccgctcccaccccgaaaccccgcttcccgccgcgccaaaaaaaatcgtactcgctcaccgcaacaactccaaacaataataatcaataccccaaacgcccgatccgctaaccgcaaccacgctccgcccaaacacctccgacccgaacaaccgccgcatacgcgcgtacaaacccaaaaacgaccgacgacaacacaaaccgaaaataccaaaccgcaacgacccccaaacaaaaccgtacgcgaaaaccgccataacgccgacactacgtacccttcgaccccccgccgtcgacgcgcaatacgccccgaccacg

SEQ ID NO: 14147 - DNA, 508 bp, Artificial Sequence
  chemically treated genomic DNA (Homo sapiens) CpG-island No: 14147
aaggtttagataaggcgataagcgtgggtagtcgaaggaattttgttataattttgtgatttatgtgaatgtttttgtgggttcgttgttttcgtatattcgtattcgacgtttattagaacgtatatttagaggggtacgaggaaggcgtcggttcgttcgtttaaacgttaggttagacgcgaggcgtagtcgtttttatttcgggatttcgtttttcgtcgcgttagggaaggtcgtgttcgtttatcgtagtagttttaggtagtagtggttagtgttttaggcgttcggttcgttggtcgtagttacgtttcgtttagatattttcggttcgggtagtcgtcgtatgcgcgcgtatagatttagaggcggtcggcggtagtataggtcggggatgttaagtcgtaacggtttttagatagagtcgtgcgcggaggtcgttatgacgtcggtattgcgtgtttttcgatttttcgtcgtcggcgcgtagtacgtttcggttacg

SEQ ID NO: 14148 - DNA, 508 bp, Artificial Sequence
  chemically treated genomic DNA (Homo sapiens) CpG-island No: 14148
cgtaaccgaaacgtactacgcgccgacgacgaaaaatcgaaaaacacgcaataccgacgtcataacgacctccgcgcacgactctatctaaaaaccgttacgacttaacatccccgacctatactaccgccgaccgcctctaaatctatacgcgcgcatacgacgactacccgaaccgaaaatatctaaacgaaacgtaactacgaccaacgaaccgaacgcctaaaacactaaccactactacctaaaactactacgataaacgaacacgaccttccctaacgcgacgaaaaacgaaatcccgaaataaaaacgactacgcctcgcgtctaacctaacgtttaaacgaacgaaccgacgccttcctcgtacccctctaaatatacgttctaataaacgtcgaatacgaatatacgaaaacaacgaacccacaaaaacattcacataaatcacaaaattataacaaaattccttcgactacccacgcttatcgccttatctaaacctt

SEQ ID NO: 14149 - DNA, 995 bp, Artificial Sequence
  chemically treated genomic DNA (Homo sapiens) CpG-island No: 14149
ttttaacgcgtcgcggagcgcgtttcgattttatatatggataagtttcgttcgcggtcggtttgagtgggtgtggttttcgttaaaggtttcgtttttagagcgcgtcgcgaggggcgcgaggggcggggcgagggaattggtaagaaagggcggggagcgaggggtgtgggtgtgttcgtgttcgcgcgttcgcgttcggagtgtggacgggggcgcgtcgtgcgcgcgtaggggagaggttagtttaggtagtcgttgtcgggttcgattggaggggcgggggagttatttgcgagcggttgcgttggcggttagttcgtttatcgcgtttggatcgcgtcggttgcgcggggttgcggatagtatatattttggaagtttcggcggggaacgggtagagttcgcgttttgcgttcgcgattaggaggatcggattttcgttttcgttgtcgtcgtcgtcgtcgttcgcggtcgtcggggtaggtgaagttcgggtgggtggttcgtcggtttttgacgggtcgggaggggagacgcgaaatttttcgggcgttttttttcgcggtttcggagtcgtcgtagcgtcgggaggtgtcgtcgtcgcgggcggtggcggtcgacgttatgttggggtttgtgagaaacggggcgttttcggtcgtttttttcgcgtcggggtcggttcgcgggttagttgtcgtcgtcgtttcgttagttcgggagcgagtcgcgttcgttcgtaggacgtcgtcgtcgtcgcggggggacgggggtcgtcgggtagggttcggtttacgggtttgcggggcgggggtcggcggacgcgggaaggagtttcgaggtcgggcgagaagttgtggggtttgaggacgggggttttggatacggtcgggggcgttttagggtcgcgataaatttttggtcgaaaagtttgtagggtttgcgtgtcggggattttatgatttgaattatatatttgtatgttatttggg

SEQ ID NO: 14150 - DNA, 995 bp, Artificial Sequence
  chemically treated genomic DNA (Homo sapiens) CpG-island No: 14150
cccaaataacatacaaatatataattcaaatcataaaatccccgacacgcaaaccctacaaacttttcgaccaaaaatttatcgcgaccctaaaacgcccccgaccgtatccaaaacccccgtcctcaaaccccacaacttctcgcccgacctcgaaactccttcccgcgtccgccgacccccgccccgcaaacccgtaaaccgaaccctacccgacgacccccgtccccccgcgacgacgacgacgtcctacgaacgaacgcgactcgctcccgaactaacgaaacgacgacgacaactaacccgcgaaccgaccccgacgcgaaaaaaacgaccgaaaacgccccgtttctcacaaaccccaacataacgtcgaccgccaccgcccgcgacgacgacacctcccgacgctacgacgactccgaaaccgcgaaaaaaaacgcccgaaaaatttcgcgtctcccctcccgacccgtcaaaaaccgacgaaccacccacccgaacttcacctaccccgacgaccgcgaacgacgacgacgacgacaacgaaaacgaaaatccgatcctcctaatcgcgaacgcaaaacgcgaactctacccgttccccgccgaaacttccaaaatatatactatccgcaaccccgcgcaaccgacgcgatccaaacgcgataaacgaactaaccgccaacgcaaccgctcgcaaataactcccccgcccctccaatcgaacccgacaacgactacctaaactaacctctcccctacgcgcgcacgacgcgcccccgtccacactccgaacgcgaacgcgcgaacacgaacacacccacacccctcgctccccgccctttcttaccaattccctcgccccgcccctcgcgcccctcgcgacgcgctctaaaaacgaaacctttaacgaaaaccacacccactcaaaccgaccgcgaacgaaacttatccatatataaaatcgaaacgcgctccgcgacgcgttaaaa

SEQ ID NO: 14151 - DNA, 995 bp, Artificial Sequence
  chemically treated genomic DNA (Homo sapiens) CpG-island No: 14151
tttaagtgatatataaatatgtagtttaggttataaggttttcgatacgtagattttgtaaatttttcggttagaaatttgtcgcgattttgagacgttttcggtcgtgtttaggattttcgtttttaggttttataatttttcgttcggtttcggggttttttttcgcgttcgtcggttttcgtttcgtagattcgtggatcggattttattcggcggttttcgttttttcgcggcggcggcggcgttttacgggcgggcgcggttcgttttcgggttggcgggacggcggcggtaattggttcgcgggtcggtttcggcgcgaggggagcggtcgggagcgtttcgttttttatagattttaatatggcgtcggtcgttatcgttcgcgacgacgatatttttcggcgttgcgacggtttcgggatcgcgggaggaagcgttcggaaagtttcgcgttttttttttcggttcgttaggagtcggcggattatttattcgggttttatttatttcgacggtcgcgggcggcggcggcggcgatagcgaaggcgaaggttcgatttttttggtcgcggacgtagggcgcggattttgttcgtttttcgtcggggtttttagggtgtgtgttgttcgtagtttcgcgtagtcggcgcgatttagacgcggtgggcgggttggtcgttagcgtagtcgttcgtaggtgattttttcgtttttttagtcgaattcgataacggttgtttgggttggttttttttttgcgcgcgtacggcgcgttttcgtttatatttcgggcgcgagcgcgcgggtacgagtatatttatatttttcgtttttcgtttttttttgttagttttttcgtttcgtttttcgcgtttttcgcgacgcgttttaggggcggggtttttggcggaggttatatttatttaggtcggtcgcgggcggagtttgtttatgtgtgaggtcgggacgcgtttcgcgacgcgttgagg

SEQ ID NO: 14152 - DNA, 995 bp, Artificial Sequence
  chemically treated genomic DNA (Homo sapiens) CpG-island No: 14152
cctcaacgcgtcgcgaaacgcgtcccgacctcacacataaacaaactccgcccgcgaccgacctaaataaatataacctccgccaaaaaccccgcccctaaaacgcgtcgcgaaaaacgcgaaaaacgaaacgaaaaaactaacaaaaaaaaacgaaaaacgaaaaatataaatatactcgtacccgcgcgctcgcgcccgaaatataaacgaaaacgcgccgtacgcgcgcaaaaaaaaaaccaacccaaacaaccgttatcgaattcgactaaaaaaacgaaaaaatcacctacgaacgactacgctaacgaccaacccgcccaccgcgtctaaatcgcgccgactacgcgaaactacgaacaacacacaccctaaaaaccccgacgaaaaacgaacaaaatccgcgccctacgtccgcgaccaaaaaaatcgaaccttcgccttcgctatcgccgccgccgccgcccgcgaccgtcgaaataaataaaacccgaataaataatccgccgactcctaacgaaccgaaaaaaaaaacgcgaaactttccgaacgcttcctcccgcgatcccgaaaccgtcgcaacgccgaaaaatatcgtcgtcgcgaacgataacgaccgacgccatattaaaatctataaaaaacgaaacgctcccgaccgctcccctcgcgccgaaaccgacccgcgaaccaattaccgccgccgtcccgccaacccgaaaacgaaccgcgcccgcccgtaaaacgccgccgccgccgcgaaaaaacgaaaaccgccgaataaaatccgatccacgaatctacgaaacgaaaaccgacgaacgcgaaaaaaaaccccgaaaccgaacgaaaaattataaaacctaaaaacgaaaatcctaaacacgaccgaaaacgtctcaaaatcgcgacaaatttctaaccgaaaaatttacaaaatctacgtatcgaaaaccttataacctaaactacatatttatatatcacttaaa

SEQ ID NO: 14153 - DNA, 825 bp, Artificial Sequence
  chemically treated genomic DNA (Homo sapiens) CpG-island No: 14153
cggcggatcggggtaaggaaagggtcgaatagttattatgttattttggggtcgtttttttgattggttcgagtttttttagttcgagtcgcggcgttttaaggaagggggcggagtttttatgttgcgttattatttttttcgatatttcgtcggtgttttttaatttagttatttataagtttatttcgagaggttttgtgtgacgttacgatacgttttcgttaatcgcggcggcgaggggcgggattttacggtttttttatcgtttttattttgtgttttttcgaattttttttgtttttttttttttttttcgttttttttttttttagttcggttttaaaagacgcgttgtttaatgaataatagggtcgatttagagtggcggtcgcgtttattaattcgcggacggcgagggcggagcgttcgtaacgagtttttgacgtcgggcggcgtgtgacgtagtcgggttttttgcgcgttgcgttcgaagcggcggtcggtggtaggggtggtagcggcggcggcgacggtttcgtgggggtcgcgcgttgttttgtgagcggcgggtggtagtaggggatttttgatatttttttttttttatcgaatcgcggtaagtcgggagttcgagttgtagcggtcgagatcggtaggttttttttttttttcgggcgggcggacgcgcggggcgttttagggttttttcgtttcgaagtttagcgtcgttgcgcgtattttttggtttgagagaggggcggtgttgaggattcgggggttcggagttcgggaggttcggttttggaggttttgggagagaat

SEQ ID NO: 14154 - DNA, 825 bp, Artificial Sequence
  chemically treated genomic DNA (Homo sapiens) CpG-island No: 14154
attctctcccaaaacctccaaaaccgaacctcccgaactccgaacccccgaatcctcaacaccgcccctctctcaaaccaaaaaatacgcgcaacgacgctaaacttcgaaacgaaaaaaccctaaaacgccccgcgcgtccgcccgcccgaaaaaaaaaaaaaacctaccgatctcgaccgctacaactcgaactcccgacttaccgcgattcgataaaaaaaaaaaaatatcaaaaatcccctactaccacccgccgctcacaaaacaacgcgcgacccccacgaaaccgtcgccgccgccgctaccacccctaccaccgaccgccgcttcgaacgcaacgcgcaaaaaacccgactacgtcacacgccgcccgacgtcaaaaactcgttacgaacgctccgccctcgccgtccgcgaattaataaacgcgaccgccactctaaatcgaccctattattcattaaacaacgcgtcttttaaaaccgaactaaaaaaaaaaaaaacgaaaaaaaaaaaaaaaaacaaaaaaaattcgaaaaaacacaaaataaaaacgataaaaaaaccgtaaaatcccgcccctcgccgccgcgattaacgaaaacgtatcgtaacgtcacacaaaacctctcgaaataaacttataaataactaaattaaaaaacaccgacgaaatatcgaaaaaaataataacgcaacataaaaactccgcccccttccttaaaacgccgcgactcgaactaaaaaaactcgaaccaatcaaaaaaacgaccccaaaataacataataactattcgaccctttccttaccccgatccgccg

SEQ ID NO: 14155 - DNA, 825 bp, Artificial Sequence
  chemically treated genomic DNA (Homo sapiens) CpG-island No: 14155
atttttttttagggtttttaaagtcgggtttttcgggtttcgggttttcgggtttttagtatcgttttttttttaggttagaaggtgcgcgtagcggcgttagatttcgaagcggagaggttttgagacgtttcgcgcgttcgttcgttcggaaggggggagaaatttgtcggtttcggtcgttgtagttcgggttttcgatttatcgcggttcggtggggaaggggaagtgttaggagttttttgttgttattcgtcgtttatagagtagcgcgcggtttttacgaaatcgtcgtcgtcgtcgttattatttttgttatcgatcgtcgtttcgggcgtagcgcgtagagggttcgattgcgttatacgtcgttcggcgttagaggttcgttgcggacgtttcgttttcgtcgttcgcgaattggtggacgcggtcgttattttgggtcgattttgttatttattgggtaacgcgttttttgaaatcgaattgaagggggaaggggcgagagggaagaggaggggtagaaggagttcggggaggtatagggtaggagcggtgagagggtcgtggagtttcgtttttcgtcgtcgcggttggcgggagcgtgtcgtgacgttatatagggtttttcgaagtgggtttgtgaatggttagattgggaagtatcggcggggtgtcgggaagggtggtgacgtaatatagagatttcgtttttttttttggagcgtcgcgattcgggttgagggagttcgggttaattagagggacggttttagaatggtatggtaattattcgattttttttttgtttcggttcgtcg

SEQ ID NO: 14156 - DNA, 825 bp, Artificial Sequence
  chemically treated genomic DNA (Homo sapiens) CpG-island No: 14156
cgacgaaccgaaacaaaaaaaaaatcgaataattaccataccattctaaaaccgtccctctaattaacccgaactccctcaacccgaatcgcgacgctccaaaaaaaaaaacgaaatctctatattacgtcaccacccttcccgacaccccgccgatacttcccaatctaaccattcacaaacccacttcgaaaaaccctatataacgtcacgacacgctcccgccaaccgcgacgacgaaaaacgaaactccacgaccctctcaccgctcctaccctatacctccccgaactccttctacccctcctcttccctctcgccccttcccccttcaattcgatttcaaaaaacgcgttacccaataaataacaaaatcgacccaaaataacgaccgcgtccaccaattcgcgaacgacgaaaacgaaacgtccgcaacgaacctctaacgccgaacgacgtataacgcaatcgaaccctctacgcgctacgcccgaaacgacgatcgataacaaaaataataacgacgacgacgacgatttcgtaaaaaccgcgcgctactctataaacgacgaataacaacaaaaaactcctaacacttccccttccccaccgaaccgcgataaatcgaaaacccgaactacaacgaccgaaaccgacaaatttctccccccttccgaacgaacgaacgcgcgaaacgtctcaaaacctctccgcttcgaaatctaacgccgctacgcgcaccttctaacctaaaaaaaaaacgatactaaaaacccgaaaacccgaaacccgaaaaacccgactttaaaaaccctaaaaaaaaat

SEQ ID NO: 14157 - DNA, 614 bp, Artificial Sequence
  chemically treated genomic DNA (Homo sapiens) CpG-island No: 14157
cgcggggtcggtgagtttttttcgttcggcgcggttatttttttgaagattcgataaggacgggggcgggggtttttttcgattagcgggtcgggcgtattcggaaagtagaggtcggggggtgtttggttagtatgcggtttttattcgtttcgtttatttgaatacgtcggggtcgatagcgtcgttcgtcgtttgcgttagttcgtatagttttattttttcggtgtttagtattttttttcgtcgtagcgttagtttttgtcgggtcgtttttagtttcgggggcgttatcgatttcggtttaggttttacgttttgcgtcgttattttcgcggttcgcggaaaggtgcgtttcgtttcgtcgcgttttttagcggttgcgtttattattttttttttgtagcgttaacgtttggtttttcgggttgttttggcgggaggggcgggagcgcggggacggggtcgttttcgcggtgttttgaagtttaatagttattgggcgtttacggtgtgttgagcggcgttttaggagtcgggagtggtatggcggatcgtaggtttggatttggcgatttgggtttttttgatagattgtattggtcgtgttcgtt

SEQ ID NO: 14158 - DNA, 614 bp, Artificial Sequence
  chemically treated genomic DNA (Homo sapiens) CpG-island No: 14158
aacgaacacgaccaatacaatctatcaaaaaaacccaaatcgccaaatccaaacctacgatccgccataccactcccgactcctaaaacgccgctcaacacaccgtaaacgcccaataactattaaacttcaaaacaccgcgaaaacgaccccgtccccgcgctcccgcccctcccgccaaaacaacccgaaaaaccaaacgttaacgctacaaaaaaaaaataataaacgcaaccgctaaaaaacgcgacgaaacgaaacgcacctttccgcgaaccgcgaaaataacgacgcaaaacgtaaaacctaaaccgaaatcgataacgcccccgaaactaaaaacgacccgacaaaaactaacgctacgacgaaaaaaaatactaaacaccgaaaaaataaaactatacgaactaacgcaaacgacgaacgacgctatcgaccccgacgtattcaaataaacgaaacgaataaaaaccgcatactaaccaaacaccccccgacctctactttccgaatacgcccgacccgctaatcgaaaaaaacccccgcccccgtccttatcgaatcttcaaaaaaataaccgcgccgaacgaaaaaaactcaccgaccccgcg

SEQ ID NO: 14159 - DNA, 614 bp, Artificial Sequence
  chemically treated genomic DNA (Homo sapiens) CpG-island No: 14159
agcgagtacgattaatgtagtttattagggaggtttagatcgttaagtttaagtttgcggttcgttatgttattttcggtttttagagcgtcgtttagtatatcgtgagcgtttaataattgttgggttttaaggtatcgcggaggcggtttcgttttcgcgttttcgtttttttcgttagggtagttcgggaggttagacgttgacgttgtagggagagggtggtgggcgtagtcgttagggggcgcggcggggcggagcgtattttttcgcgggtcgcggggatggcggcgtagggcgtagggtttgggtcggggtcggtggcgttttcggggttggaggcggttcggtagaagttggcgttgcggcggaagaaggtgttgagtatcgaggagatggagttgtacgagttggcgtaggcggcgggcggcgttatcgatttcgacgtgtttaagtgagcggggcgggtgggggtcgtatgttagttagatatttttcgatttttgtttttcgggtacgttcggttcgttggtcgggaggagttttcgttttcgtttttgtcgggtttttagggaggtggtcgcgtcgggcggagagggtttatcggtttcgcg

SEQ ID NO: 14160 - DNA, 614 bp, Artificial Sequence
  chemically treated genomic DNA (Homo sapiens) CpG-island No: 14160
cgcgaaaccgataaaccctctccgcccgacgcgaccacctccctaaaaacccgacaaaaacgaaaacgaaaactcctcccgaccaacgaaccgaacgtacccgaaaaacaaaaatcgaaaaatatctaactaacatacgacccccacccgccccgctcacttaaacacgtcgaaatcgataacgccgcccgccgcctacgccaactcgtacaactccatctcctcgatactcaacaccttcttccgccgcaacgccaacttctaccgaaccgcctccaaccccgaaaacgccaccgaccccgacccaaaccctacgccctacgccgccatccccgcgacccgcgaaaaaatacgctccgccccgccgcgccccctaacgactacgcccaccaccctctccctacaacgtcaacgtctaacctcccgaactaccctaacgaaaaaaacgaaaacgcgaaaacgaaaccgcctccgcgataccttaaaacccaacaattattaaacgctcacgatatactaaacgacgctctaaaaaccgaaaataacataacgaaccgcaaacttaaacttaacgatctaaacctccctaataaactacattaatcgtactcgct

SEQ ID NO: 14161 - DNA, 620 bp, Artificial Sequence
  chemically treated genomic DNA (Homo sapiens) CpG-island No: 14161
tttacgtcggttggcgaggggttttcgttcggtttattcggatttcgggtagtttcgcgtgtttttcgcgttttcgtttttggagagtattcggatttagagttaaagttcgaagttaggaattcgtttatcgttagtttcgttagcgttttttgcggcgtcgtttatttgttatgatattagttcgtagttggcgttttattttcggttttagaatgtcgcgcggttacgtattttcgtcgtttaggtttcgtttcgttattcgtttcgtcgcgttacgtttagtcgagtggttttacggtttttcgatcgtagcgttcgcgttttcgggcgggaggggcgttcgcgtgttcggtgcgggtagtttcggtggggtttagatgcgtttttcgttcggcgttcggtttcgtaggacgcggcgacgtcggtgttcgttttggggaagagagattaggagtttcgtcgcgttcgtagtttattcggcgtttcgagggtatgcgtttgcgagaacgttaggttgcgacggcggggtttttatgtaaagagtttttataaattaataataaaaagtagagggtttaggagaaagcgtaaatggcggtgggaatcgtattgatgtt

SEQ ID NO: 14162 - DNA, 620 bp, Artificial Sequence
  chemically treated genomic DNA (Homo sapiens) CpG-island No: 14162
aacatcaatacgattcccaccgccatttacgctttctcctaaaccctctactttttattattaatttataaaaactctttacataaaaaccccgccgtcgcaacctaacgttctcgcaaacgcataccctcgaaacgccgaataaactacgaacgcgacgaaactcctaatctctcttccccaaaacgaacaccgacgtcgccgcgtcctacgaaaccgaacgccgaacgaaaaacgcatctaaaccccaccgaaactacccgcaccgaacacgcgaacgcccctcccgcccgaaaacgcgaacgctacgatcgaaaaaccgtaaaaccactcgactaaacgtaacgcgacgaaacgaataacgaaacgaaacctaaacgacgaaaatacgtaaccgcgcgacattctaaaaccgaaaataaaacgccaactacgaactaatatcataacaaataaacgacgccgcaaaaaacgctaacgaaactaacgataaacgaattcctaacttcgaactttaactctaaatccgaatactctccaaaaacgaaaacgcgaaaaacacgcgaaactacccgaaatccgaataaaccgaacgaaaacccctcgccaaccgacgtaaa

SEQ ID NO: 14163 - DNA, 620 bp, Artificial Sequence
  chemically treated genomic DNA (Homo sapiens) CpG-island No: 14163
aatattagtgcggtttttatcgttatttgcgtttttttttggattttttgttttttattgttgatttgtgggagttttttgtataggggtttcgtcgtcgtagtttggcgttttcgtaggcgtatgttttcggaacgtcgggtgggttgcgggcgcgacgggatttttggttttttttttttaggacggatatcggcgtcgtcgcgttttacgaagtcgggcgtcgagcgggaggcgtatttgggttttatcggggttgttcgtatcgagtacgcgaacgtttttttcgttcggaggcgcgggcgttgcggtcggagaatcgtagagttattcggttgggcgtggcgcggcggggcgggtaacggggcgggatttgggcgacggaagtgcgtagtcgcgcggtattttggggtcggaagtggggcgttagttgcgggttggtgttatggtaggtgggcggcgtcgtaggaggcgttggcggagttgacggtggacgagtttttagtttcgggttttgattttaagttcgaatattttttagaagcggagacgcgggaggtacgcgaggttgttcggagttcggatgagtcgggcgggagtttttcgttagtcggcgtaaa

SEQ ID NO: 14164 - DNA, 620 bp, Artificial Sequence
  chemically treated genomic DNA (Homo sapiens) CpG-island No: 14164
tttacgccgactaacgaaaaactcccgcccgactcatccgaactccgaacaacctcgcgtacctcccgcgtctccgcttctaaaaaatattcgaacttaaaatcaaaacccgaaactaaaaactcgtccaccgtcaactccgccaacgcctcctacgacgccgcccacctaccataacaccaacccgcaactaacgccccacttccgaccccaaaataccgcgcgactacgcacttccgtcgcccaaatcccgccccgttacccgccccgccgcgccacgcccaaccgaataactctacgattctccgaccgcaacgcccgcgcctccgaacgaaaaaaacgttcgcgtactcgatacgaacaaccccgataaaacccaaatacgcctcccgctcgacgcccgacttcgtaaaacgcgacgacgccgatatccgtcctaaaaaaaaaaaaccaaaaatcccgtcgcgcccgcaacccacccgacgttccgaaaacatacgcctacgaaaacgccaaactacgacgacgaaacccctatacaaaaaactcccacaaatcaacaataaaaaacaaaaaatccaaaaaaaaacgcaaataacgataaaaaccgcactaatatt

SEQ ID NO: 14165 - DNA, 591 bp, Artificial Sequence
  chemically treated genomic DNA (Homo sapiens) CpG-island No: 14165
agtcgatagtcggagattcgcggtggtatgttagtgaattggttatattacggtaaatattttacggcgggtagtatttcgtatgtaggttcgttaggcgacggttatttgatacgtcgacggtagttatgttgcgttcggcgtcgcgttgtagtttcgatcgttttagtttgttcgttgtggtcgtcggcgattagttcgggattttttcgtaggggcggggcggttgttggaggcgggcggggcgggagggggcgtttaaagttcggcgattaatttcgggtacgttcgttaacgttattttttcgcggttcggattacgttgagttagcgagggcggtcggaggagtttttggggagtcgcggggaggattcggtatttggggggagggatttttcgggttttaggggaaaggatcgggaagttatttcgacgttttcgaattttcgaggatacgttgtttggggcgtagatttttcgagggttgggacggcgacgagggtttgagggttcgatttttgttttagtttgttgagtttagtttttgggaacgcggtagggttcgaagggaggaggtaggcgtagaggtt

SEQ ID NO: 14166 - DNA, 591 bp, Artificial Sequence
  chemically treated genomic DNA (Homo sapiens) CpG-island No: 14166
aacctctacgcctacctcctcccttcgaaccctaccgcgttcccaaaaactaaactcaacaaactaaaacaaaaatcgaaccctcaaaccctcgtcgccgtcccaaccctcgaaaaatctacgccccaaacaacgtatcctcgaaaattcgaaaacgtcgaaataacttcccgatcctttcccctaaaacccgaaaaatccctccccccaaataccgaatcctccccgcgactccccaaaaactcctccgaccgccctcgctaactcaacgtaatccgaaccgcgaaaaaataacgttaacgaacgtacccgaaattaatcgccgaactttaaacgccccctcccgccccgcccgcctccaacaaccgccccgcccctacgaaaaaatcccgaactaatcgccgacgaccacaacgaacaaactaaaacgatcgaaactacaacgcgacgccgaacgcaacataactaccgtcgacgtatcaaataaccgtcgcctaacgaacctacatacgaaatactacccgccgtaaaatatttaccgtaatataaccaattcactaacataccaccgcgaatctccgactatcgact

SEQ ID NO: 14167 - DNA, 591 bp, Artificial Sequence
  chemically treated genomic DNA (Homo sapiens) CpG-island No: 14167
agtttttgcgtttgtttttttttttcggattttgtcgcgtttttagaggttggatttagtaagttggaataggaatcgaatttttaggttttcgtcgtcgttttagttttcgaggaatttgcgttttaggtaacgtgttttcggaggttcgggagcgtcggagtgatttttcgatttttttttttgggattcgagggatttttttttttaagtgtcgggtttttttcgcggttttttaggggttttttcggtcgttttcgttgatttagcgtaattcgagtcgcggaggggtggcgttggcggacgtgttcggggttaatcgtcgagttttgaacgttttttttcgtttcgttcgtttttagtagtcgtttcgtttttgcgagagagtttcgggttggtcgtcggcggttatagcggataggttggagcgatcgaggttgtagcgcggcgtcgggcgtagtatgattgtcgtcggcgtgttaggtagtcgtcgtttggcgggtttgtatacgggatgttgttcgtcgtgaaatgtttgtcgtggtatgattaatttattgatatattatcgcgagttttcggttgtcggtt

SEQ ID NO: 14168 - DNA, 591 bp, Artificial Sequence
  chemically treated genomic DNA (Homo sapiens) CpG-island No: 14168
aaccgacaaccgaaaactcgcgataatatatcaataaattaatcataccacgacaaacatttcacgacgaacaacatcccgtatacaaacccgccaaacgacgactacctaacacgccgacgacaatcatactacgcccgacgccgcgctacaacctcgatcgctccaacctatccgctataaccgccgacgaccaacccgaaactctctcgcaaaaacgaaacgactactaaaaacgaacgaaacgaaaaaaaacgttcaaaactcgacgattaaccccgaacacgtccgccaacgccacccctccgcgactcgaattacgctaaatcaacgaaaacgaccgaaaaaacccctaaaaaaccgcgaaaaaaacccgacacttaaaaaaaaaaatccctcgaatcccaaaaaaaaaaatcgaaaaatcactccgacgctcccgaacctccgaaaacacgttacctaaaacgcaaattcctcgaaaactaaaacgacgacgaaaacctaaaaattcgattcctattccaacttactaaatccaacctctaaaaacgcgacaaaatccgaaaaaaaaaaacaaacgcaaaaact

SEQ ID NO: 14169 - DNA, 503 bp, Artificial Sequence
  chemically treated genomic DNA (Homo sapiens) CpG-island No: 14169
tcgaggtcggagaaagggcgagattgtcgttttttcgggtttttagtttgtagaagggcgtagtatttatcgagtgcgcggcgtaggcgagtagtatcggtagtagtagttgttgtagcggcggcgataggtggggacgtatggtgttcgtacgtttttcgagggcgtttcgacgttcgtttgttcgtgttttttgttcgttcgggagtttagcgtttcgtatgggtttcgggtttcggtcgatcgttgcgtttcgaggagttatggttgagttattcgatttgcggcgggtttcgggattgttttttttcggattaggtggtcgcgcgcgttaagtcgttcgttttattgattaggacgcggttttgcggcgcgttttttttattcggtagggattggcgcggggtcggcgcggaggttggtaggggaggaggtagagggagggcgcggggattcggagtcggttttcgtaggttgggtttaagttggaggaggttaggaga

SEQ ID NO: 14170 - DNA, 503 bp, Artificial Sequence
  chemically treated genomic DNA (Homo sapiens) CpG-island No: 14170
tctcctaacctcctccaacttaaacccaacctacgaaaaccgactccgaatccccgcgccctccctctacctcctcccctaccaacctccgcgccgaccccgcgccaatccctaccgaataaaaaaaacgcgccgcaaaaccgcgtcctaatcaataaaacgaacgacttaacgcgcgcgaccacctaatccgaaaaaaaacaatcccgaaacccgccgcaaatcgaataactcaaccataactcctcgaaacgcaacgatcgaccgaaacccgaaacccatacgaaacgctaaactcccgaacgaacaaaaaacacgaacaaacgaacgtcgaaacgccctcgaaaaacgtacgaacaccatacgtccccacctatcgccgccgctacaacaactactactaccgatactactcgcctacgccgcgcactcgataaatactacgcccttctacaaactaaaaacccgaaaaaacgacaatctcgccctttctccgacctcga

SEQ ID NO: 14171 - DNA, 503 bp, Artificial Sequence
  chemically treated genomic DNA (Homo sapiens) CpG-island No: 14171
ttttttggttttttttagtttgggtttagtttgcgggagtcgatttcgggttttcgcgttttttttttgtttttttttttgttagttttcgcgtcgatttcgcgttagtttttgtcgggtggaggaggcgcgtcgtaaagtcgcgttttgattaatggggcgggcggtttagcgcgcgcggttatttggttcgaggaggagtagtttcggggttcgtcgtaggtcgggtgatttagttatggtttttcggggcgtagcggtcggtcggagttcgggatttatgcggggcgttgagttttcgagcgggtagagggtacgggtaggcggacgtcggggcgttttcggggaacgtgcgggtattatgcgtttttatttgtcgtcgtcgttgtagtagttattattgtcggtgttgttcgtttgcgtcgcgtattcggtgagtattgcgtttttttgtaggttggggattcgagggagcgatagtttcgtttttttttcggtttcgg

SEQ ID NO: 14172 - DNA, 503 bp, Artificial Sequence
  chemically treated genomic DNA (Homo sapiens) CpG-island No: 14172
ccgaaaccgaaaaaaaaacgaaactatcgctccctcgaatccccaacctacaaaaaaacgcaatactcaccgaatacgcgacgcaaacgaacaacaccgacaataataactactacaacgacgacgacaaataaaaacgcataatacccgcacgttccccgaaaacgccccgacgtccgcctacccgtaccctctacccgctcgaaaactcaacgccccgcataaatcccgaactccgaccgaccgctacgccccgaaaaaccataactaaatcacccgacctacgacgaaccccgaaactactcctcctcgaaccaaataaccgcgcgcgctaaaccgcccgccccattaatcaaaacgcgactttacgacgcgcctcctccacccgacaaaaactaacgcgaaatcgacgcgaaaactaacaaaaaaaaaaacaaaaaaaaaacgcgaaaacccgaaatcgactcccgcaaactaaacccaaactaaaaaaaaccaaaaaa

SEQ ID NO: 14173 - DNA, 611 bp, Artificial Sequence
  chemically treated genomic DNA (Homo sapiens) CpG-island No: 14173
gttcgtatttcggtagttgtggatgcggcggttcgtgttaggcggtagcgttgggtagggttgcggttcgtcgtcgaagttgagttatacgggtagtacgacgcgcggattgcgattgtagaagatgatttgggagggttcgcgcgagtttatcgagcgtagtacgggtcgcggtcgttcggtttttatttttttttcggcgtttagttttttcgggtcggattttttcggggtcggatttttcggcgttcgattttttttcgtcgttttttttagggtcgtatttttcgacgtttgtttttttcgcgtttatttcggtttcgttttagtttttcgtttttcggggtatttttttcgcgatttagattattcgggtcggacgtcgcgggattcgcgggtcggacgcggggcggagttgcgtgcgcgttttcgagtcgattttcgtagttttcgcgcgcgttcggtagaggatggaacgcgttcgcggaaatagtcggtcggaggttgtgcgcgtgcgtagaaggattttttagtatcgtaggtcgttgtaacggaggcgaggttaggttaattcgttattgtatttttattataaaattttttttcgtttt

SEQ ID NO: 14174 - DNA, 611 bp, Artificial Sequence
  chemically treated genomic DNA (Homo sapiens) CpG-island No: 14174
aaaacgaaaaaaaattttataataaaaatacaataacgaattaacctaacctcgcctccgttacaacgacctacgatactaaaaaatccttctacgcacgcgcacaacctccgaccgactatttccgcgaacgcgttccatcctctaccgaacgcgcgcgaaaactacgaaaatcgactcgaaaacgcgcacgcaactccgccccgcgtccgacccgcgaatcccgcgacgtccgacccgaataatctaaatcgcgaaaaaaataccccgaaaaacgaaaaactaaaacgaaaccgaaataaacgcgaaaaaaacaaacgtcgaaaaatacgaccctaaaaaaaacgacgaaaaaaaatcgaacgccgaaaaatccgaccccgaaaaaatccgacccgaaaaaactaaacgccgaaaaaaaaataaaaaccgaacgaccgcgacccgtactacgctcgataaactcgcgcgaaccctcccaaatcatcttctacaatcgcaatccgcgcgtcgtactacccgtataactcaacttcgacgacgaaccgcaaccctacccaacgctaccgcctaacacgaaccgccgcatccacaactaccgaaatacgaac

SEQ ID NO: 14175 - DNA, 611 bp, Artificial Sequence
  chemically treated genomic DNA (Homo sapiens) CpG-island No: 14175
ggggcgaaaaaaaattttatagtggaaatatagtaacgagttggtttagtttcgttttcgttataacggtttacggtgttggaggatttttttgcgtacgcgtatagttttcggtcggttattttcgcgagcgcgttttattttttatcgagcgcgcgcgaagattacggaggtcgattcgggagcgcgtacgtagtttcgtttcgcgttcgattcgcggatttcgcggcgttcggttcgggtggtttggatcgcggagggaatgtttcggagggcggagaattgggacgaggtcgaggtaggcgcggaggaggtaggcgtcgaagagtacggttttgaagaagacggcggggaggagtcgggcgtcgaggagttcggtttcggaagagttcggttcggaggaattgggcgtcgaggaggagatggaggtcgggcggtcgcggttcgtgttgcgttcggtgaattcgcgcgagtttttttaggttattttttgtaatcgtagttcgcgcgtcgtgttgttcgtatggtttaatttcgacggcgagtcgtagttttatttaacgttgtcgtttggtacgggtcgtcgtatttatagttatcgaggtacgggt

SEQ ID NO: 14176 - DNA, 611 bp, Artificial Sequence
  chemically treated genomic DNA (Homo sapiens) CpG-island No: 14176
acccgtacctcgataactataaatacgacgacccgtaccaaacgacaacgttaaataaaactacgactcgccgtcgaaattaaaccatacgaacaacacgacgcgcgaactacgattacaaaaaataacctaaaaaaactcgcgcgaattcaccgaacgcaacacgaaccgcgaccgcccgacctccatctcctcctcgacgcccaattcctccgaaccgaactcttccgaaaccgaactcctcgacgcccgactcctccccgccgtcttcttcaaaaccgtactcttcgacgcctacctcctccgcgcctacctcgacctcgtcccaattctccgccctccgaaacattccctccgcgatccaaaccacccgaaccgaacgccgcgaaatccgcgaatcgaacgcgaaacgaaactacgtacgcgctcccgaatcgacctccgtaatcttcgcgcgcgctcgataaaaaataaaacgcgctcgcgaaaataaccgaccgaaaactatacgcgtacgcaaaaaaatcctccaacaccgtaaaccgttataacgaaaacgaaactaaaccaactcgttactatatttccactataaaattttttttcgcccc

SEQ ID NO: 14177 - DNA, 592 bp, Artificial Sequence
  chemically treated genomic DNA (Homo sapiens) CpG-island No: 14177
tattatattcggtacgatttttgtacggattatatttaacgttttttttattttttgtatcggtttttttaatatttttgtatcgtcgttgtttgttatattatttttttttttaatcgtttttttaatttatttttatcggtttttatttttttttattcgttatattttttcgtagtttattttttttagtttcgagttttttttttttttttatcgtttattattatcgttttttatcgttcgcggggcggagcgcgaaggagggcggcggagagaagagatacggacgtgtcgaggaggatgagcggaggagtggcgggtgtggcggcgagaagaacgggaaggagagggagaggggcgtgaagagcggtggggggagtgatggtggaggtcggaggagggtgtgagaggatgggcggtataagagaggggcggggtaagggtgcggtatcgagaggaggggcgacgcgcgggtgaaagtggaggggtagtgagtagcggtgacgagtgggggggagggaggtcgggtagtagtagagcgcgggtggttgggggaagtgttgttggagatagggtgttaaggtgttag

SEQ ID NO: 14178 - DNA, 592 bp, Artificial Sequence
  chemically treated genomic DNA (Homo sapiens) CpG-island No: 14178
ctaacaccttaacaccctatctccaacaacacttcccccaaccacccgcgctctactactacccgacctccctcccccccactcgtcaccgctactcactacccctccactttcacccgcgcgtcgcccctcctctcgataccgcacccttaccccgcccctctcttataccgcccatcctctcacaccctcctccgacctccaccatcactccccccaccgctcttcacgcccctctccctctccttcccgttcttctcgccgccacacccgccactcctccgctcatcctcctcgacacgtccgtatctcttctctccgccgccctccttcgcgctccgccccgcgaacgataaaaaacgataataataaacgataaaaaaaaaaaaaaaactcgaaactaaaaaaaataaactacgaaaaaatataacgaataaaaaaaaataaaaaccgataaaaataaattaaaaaaacgattaaaaaaaaaaataatataacaaacaacgacgatacaaaaatattaaaaaaaccgatacaaaaaataaaaaaaacgttaaatataatccgtacaaaaatcgtaccgaatataata

SEQ ID NO: 14179 - DNA, 592 bp, Artificial Sequence
  chemically treated genomic DNA (Homo sapiens) CpG-island No: 14179
ttaatattttgatattttgtttttaataatattttttttagttattcgcgttttgttgttgttcgattttttttttttttattcgttatcgttgtttattgtttttttatttttattcgcgcgtcgttttttttttcgatgtcgtatttttatttcgttttttttttatgtcgtttatttttttatattttttttcgatttttattattattttttttatcgttttttacgtttttttttttttttttttcgtttttttcgtcgttatattcgttattttttcgtttatttttttcgatacgttcgtgtttttttttttcgtcgttttttttcgcgtttcgtttcgcgagcgatggggagcggtgatgataggcggtgaggagggaagagaggttcgggattggaggggataggttgcgaaagaatgtggcgagtaaggagagatgggggtcgatgagggtgggttagaagaacgattgaggagaggagtgatgtaataggtagcgacgatataggggtgttgagaggatcggtgtaaagggtggagagggcgttgaatgtggttcgtgtaggggtcgtgtcgggtgtggtg

SEQ ID NO: 14180 - DNA, 592 bp, Artificial Sequence
  chemically treated genomic DNA (Homo sapiens) CpG-island No: 14180
caccacacccgacacgacccctacacgaaccacattcaacgccctctccaccctttacaccgatcctctcaacacccctatatcgtcgctacctattacatcactcctctcctcaatcgttcttctaacccaccctcatcgacccccatctctccttactcgccacattctttcgcaacctatcccctccaatcccgaacctctcttccctcctcaccgcctatcatcaccgctccccatcgctcgcgaaacgaaacgcgaaaaaaaacgacgaaaaaaaaaaacacgaacgtatcgaaaaaaataaacgaaaaaataacgaatataacgacgaaaaaaacgaaaaaaaaaaaaaaaaaaacgtaaaaaacgataaaaaaaataataataaaaatcgaaaaaaaatataaaaaaataaacgacataaaaaaaaaacgaaataaaaatacgacatcgaaaaaaaaaacgacgcgcgaataaaaataaaaaaacaataaacaacgataacgaataaaaaaaaaaaaaatcgaacaacaacaaaacgcgaataactaaaaaaaatattattaaaaacaaaatatcaaaatattaa

SEQ ID NO: 14181 - DNA, 879 bp, Artificial Sequence
  chemically treated genomic DNA (Homo sapiens) CpG-island No: 14181
cggacgaagggggcgcggggaaggggatattaatcggggacggtagggtttggttttatcgtttgttttttagcgacgtcgtttcggaaaatagcgtaggcgggtcgcgcggttcgggtgtagttcgggtttcggggtaggtaggcggggatttttaggacgtttcgggcggacggcggatattaggtttagtcgcgtttttgtttttgttttttagtttgcgttcgtgtttgtatttgcgcggggtagtcgtcggggtatagcgggtagtttcgaggcgatttcgcgttatcgcgttgtcggtatcgcgttggagatttttttcgttgaggtttagtacggtcgatagtggtcgatatagcggatagttaggcgtagcgtttcgattttggttaggttttggttcgcggcgttacggacggcggtagaaagcggcgtattcgtgtagggcgcgggttagcgtgcgtatgtttagttttattcgtttattggcgttttgtttttgttcgttgtttaggcgttgttgcgcgcgtcgagtttatttacggagggggcgcggggtttcggagggtgtttggtcgcgcggggttcgttacggggttgtcggttggggtgttgttttatgagtttggggacgagacgagggagcggtcgtagtttttgtcggagggcggcggtcgtcgagttgggttttaggtcgtagagagtatttaggattcggagagcggcgggtataggggttgggttatggtagcggcggcgcgtttgggggtcggcggtcggcggtcgttttatgtcgagttcgaggtgtgaagtggttttttttaggtcgtattagtatattaaagtgggttcggggtttggagggggcggagtttg

SEQ ID NO: 14182 - DNA, 879 bp, Artificial Sequence
  chemically treated genomic DNA (Homo sapiens) CpG-island No: 14182
caaactccgccccctccaaaccccgaacccactttaatatactaatacgacctaaaaaaaaccacttcacacctcgaactcgacataaaacgaccgccgaccgccgacccccaaacgcgccgccgctaccataacccaacccctatacccgccgctctccgaatcctaaatactctctacgacctaaaacccaactcgacgaccgccgccctccgacaaaaactacgaccgctccctcgtctcgtccccaaactcataaaacaacaccccaaccgacaaccccgtaacgaaccccgcgcgaccaaacaccctccgaaaccccgcgccccctccgtaaataaactcgacgcgcgcaacaacgcctaaacaacgaacaaaaacaaaacgccaataaacgaataaaactaaacatacgcacgctaacccgcgccctacacgaatacgccgctttctaccgccgtccgtaacgccgcgaaccaaaacctaaccaaaatcgaaacgctacgcctaactatccgctatatcgaccactatcgaccgtactaaacctcaacgaaaaaaatctccaacgcgataccgacaacgcgataacgcgaaatcgcctcgaaactacccgctataccccgacgactaccccgcgcaaatacaaacacgaacgcaaactaaaaaacaaaaacaaaaacgcgactaaacctaatatccgccgtccgcccgaaacgtcctaaaaatccccgcctacctaccccgaaacccgaactacacccgaaccgcgcgacccgcctacgctattttccgaaacgacgtcgctaaaaaacaaacgataaaaccaaaccctaccgtccccgattaatatccccttccccgcgcccccttcgtccg

SEQ ID NO: 14183 - DNA, 879 bp, Artificial Sequence
  chemically treated genomic DNA (Homo sapiens) CpG-island No: 14183
taggtttcgttttttttaagtttcgagtttattttgatgtgttgatgcggtttggaaggggttattttatatttcgggttcggtataaagcggtcgtcggtcgtcggtttttagacgcgtcgtcgttgttatggtttagtttttgtgttcgtcgtttttcgagttttggatgttttttgcggtttggggtttaattcggcggtcgtcgtttttcgataaggattgcggtcgttttttcgtttcgtttttagatttatggggtagtattttagtcgatagtttcgtggcgagtttcgcgcggttaggtatttttcgggatttcgcgtttttttcgtaggtaggttcggcgcgcgtagtagcgtttgggtagcgggtagaggtagagcgttagtgagcgggtgaaattgggtatgcgtacgttggttcgcgttttgtacgagtgcgtcgttttttatcgtcgttcgtggcgtcgcgggttagagtttgattaagatcgagacgttgcgtttggttattcgttatatcggttattgtcggtcgtgttaggttttagcgaggagagtttttagcgcggtgtcggtagcgcggtgacgcggggtcgtttcggggttgttcgttgtgtttcgacgattgtttcgcgtagatgtagatacggacgtaggttgaggggtaggggtaggggcgcggttgggtttggtattcgtcgttcgttcggggcgttttggggattttcgtttgtttgtttcggagttcgagttgtattcgagtcgcgcgattcgtttgcgttgtttttcgaggcggcgtcgttgaagggtaggcgatggagttaagttttatcgttttcggttagtgttttttttttcgcgtttttttcgttcg

SEQ ID NO: 14184 - DNA, 879 bp, Artificial Sequence
  chemically treated genomic DNA (Homo sapiens) CpG-island No: 14184
cgaacgaaaaaaacgcgaaaaaaaaaacactaaccgaaaacgataaaacttaactccatcgcctacccttcaacgacgccgcctcgaaaaacaacgcaaacgaatcgcgcgactcgaatacaactcgaactccgaaacaaacaaacgaaaatccccaaaacgccccgaacgaacgacgaataccaaacccaaccgcgcccctacccctacccctcaacctacgtccgtatctacatctacgcgaaacaatcgtcgaaacacaacgaacaaccccgaaacgaccccgcgtcaccgcgctaccgacaccgcgctaaaaactctcctcgctaaaacctaacacgaccgacaataaccgatataacgaataaccaaacgcaacgtctcgatcttaatcaaactctaacccgcgacgccacgaacgacgataaaaaacgacgcactcgtacaaaacgcgaaccaacgtacgcatacccaatttcacccgctcactaacgctctacctctacccgctacccaaacgctactacgcgcgccgaacctacctacgaaaaaaacgcgaaatcccgaaaaatacctaaccgcgcgaaactcgccacgaaactatcgactaaaatactaccccataaatctaaaaacgaaacgaaaaaacgaccgcaatccttatcgaaaaacgacgaccgccgaattaaaccccaaaccgcaaaaaacatccaaaactcgaaaaacgacgaacacaaaaactaaaccataacaacgacgacgcgtctaaaaaccgacgaccgacgaccgctttataccgaacccgaaatataaaataaccccttccaaaccgcatcaacacatcaaaataaactcgaaacttaaaaaaaacgaaaccta

SEQ ID NO: 14185 - DNA, 554 bp, Artificial Sequence
  chemically treated genomic DNA (Homo sapiens) CpG-island No: 14185
gggaagttgatcggaaggttcgggtgcgggacgtgtgtattttacggcgttcgggagttgtttcggtgtcgattcgcgagtttttcggcgtgtttcgcgttttttcgtaattattttcggggcgggtttcgggggcggtgtttcggcgagggagcgtggcggcgagttgtttgggggggttggcgacggtagttcgagggcgcgtaaggtttgaggtttagtataggtgggtttcgcggcggttcggttttagtatttgtcggtatttgtagttcgtttagattcggcgttcgggcgtttcgcgttgtatttgttcgtcgcgtgattggaggatcgagtttttatattttttttatgtggttgtggtgggggtatagtaatgttttgtgcgtcgtagcgtttttgtggggatgtggtcggggggcgtcgggaagcgttattgttgtgagttacgggtttgtcggttagggattcgtttcggggttagtgagttatttttgcgatgcggttttacggggcgagagggggtgtttgggtgtttttatagatttttt

SEQ ID NO: 14186 - DNA, 554 bp, Artificial Sequence
  chemically treated genomic DNA (Homo sapiens) CpG-island No: 14186
aaaaaatctataaaaacacccaaacaccccctctcgccccgtaaaaccgcatcgcaaaaataactcactaaccccgaaacgaatccctaaccgacaaacccgtaactcacaacaataacgcttcccgacgccccccgaccacatccccacaaaaacgctacgacgcacaaaacattactatacccccaccacaaccacataaaaaaaatataaaaactcgatcctccaatcacgcgacgaacaaatacaacgcgaaacgcccgaacgccgaatctaaacgaactacaaataccgacaaatactaaaaccgaaccgccgcgaaacccacctatactaaacctcaaaccttacgcgccctcgaactaccgtcgccaacccccccaaacaactcgccgccacgctccctcgccgaaacaccgcccccgaaacccgccccgaaaataattacgaaaaaacgcgaaacacgccgaaaaactcgcgaatcgacaccgaaacaactcccgaacgccgtaaaatacacacgtcccgcacccgaaccttccgatcaacttccc

SEQ ID NO: 14187 - DNA, 554 bp, Artificial Sequence
  chemically treated genomic DNA (Homo sapiens) CpG-island No: 14187
aggaggtttgtgaaagtatttaggtattttttttcgtttcgtggaatcgtatcgtaaaggtagtttattggtttcggggcgggtttttggtcgataaattcgtaatttatagtagtgacgtttttcgacgtttttcggttatatttttataggaacgttacggcgtatagggtattattgtgtttttattataattatataaagaaaatgtgggggttcggttttttagttacgcggcgagtaagtgtagcgcgggacgttcgagcgtcgggtttaggcgggttgtaggtgtcggtaagtgttggggtcgggtcgtcgcggaatttatttgtgttgggttttaggttttgcgcgttttcgggttgtcgtcgttaatttttttaaatagttcgtcgttacgttttttcgtcggggtatcgttttcggaattcgtttcggaagtagttgcgggagggcgcggagtacgtcgggaagttcgcgggtcggtatcgggatagttttcgggcgtcgtggaatgtatacgtttcgtattcggatttttcggttagtttttt

SEQ ID NO: 14188 - DNA, 554 bp, Artificial Sequence
  chemically treated genomic DNA (Homo sapiens) CpG-island No: 14188
aaaaaactaaccgaaaaatccgaatacgaaacgtatacattccacgacgcccgaaaactatcccgataccgacccgcgaacttcccgacgtactccgcgccctcccgcaactacttccgaaacgaattccgaaaacgataccccgacgaaaaaacgtaacgacgaactatttaaaaaaattaacgacgacaacccgaaaacgcgcaaaacctaaaacccaacacaaataaattccgcgacgacccgaccccaacacttaccgacacctacaacccgcctaaacccgacgctcgaacgtcccgcgctacacttactcgccgcgtaactaaaaaaccgaacccccacattttctttatataattataataaaaacacaataataccctatacgccgtaacgttcctataaaaatataaccgaaaaacgtcgaaaaacgtcactactataaattacgaatttatcgaccaaaaacccgccccgaaaccaataaactacctttacgatacgattccacgaaacgaaaaaaaatacctaaatactttcacaaacctcct

SEQ ID NO: 14189 - DNA, 742 bp, Artificial Sequence
  chemically treated genomic DNA (Homo sapiens) CpG-island No: 14189
ttttcgcgttgtttttcggcgttttcggcgcgagaggattttatttttcgacgtgtttcgggatcggaggcggagggtcgcgtaggcgtcgggtttcgggtcgagtcgggggttgggggttcgaggcgttttcgcggtcgtggacgagcgttcgtgcggtttggttcgggttatgttcgcgtgaggatttcgtcgttgtcgtcgttttcgtttcggttttggttttttgttcggtagcgtcgcgtattatgggttttatttttagtcgtcgtatcgcgggggtggaggatatcgatatttaggcgaattcggtttatcgttatttttcgaagttcggtgagcgttcggttttaggcgcggattgttaggtacgcgttggaacgcggattcggcggcgcgggggcggggattcggggcggggcgtttgttcggtttttttcgggtatcgttgttatatcgagttttcgcgcggttttacggtttcgatttgtaggcgtggttgggagttcggatgaatttgttcgagtcgtatttggcgttgttattgttcggtttgggtgacgttggggtagttttttcgtatcgagtattttagtttcgtttttgtaatagtggtgagtttttgggggaattcgtaggttgggcggggtgttgatcgtaggttcggtcgatcgattttgttagaaattttcgtgtacgagttcgatttcgtatcgatggtatagttgttttttgtgtgaag

SEQ ID NO: 14190 - DNA, 742 bp, Artificial Sequence
  chemically treated genomic DNA (Homo sapiens) CpG-island No: 14190
cttcacacaaaaaacaactataccatcgatacgaaatcgaactcgtacacgaaaatttctaacaaaatcgatcgaccgaacctacgatcaacaccccgcccaacctacgaattcccccaaaaactcaccactattacaaaaacgaaactaaaatactcgatacgaaaaaactaccccaacgtcacccaaaccgaacaataacaacgccaaatacgactcgaacaaattcatccgaactcccaaccacgcctacaaatcgaaaccgtaaaaccgcgcgaaaactcgatataacaacgatacccgaaaaaaaccgaacaaacgccccgccccgaatccccgcccccgcgccgccgaatccgcgttccaacgcgtacctaacaatccgcgcctaaaaccgaacgctcaccgaacttcgaaaaataacgataaaccgaattcgcctaaatatcgatatcctccacccccgcgatacgacgactaaaaataaaacccataatacgcgacgctaccgaacaaaaaaccaaaaccgaaacgaaaacgacgacaacgacgaaatcctcacgcgaacataacccgaaccaaaccgcacgaacgctcgtccacgaccgcgaaaacgcctcgaacccccaacccccgactcgacccgaaacccgacgcctacgcgaccctccgcctccgatcccgaaacacgtcgaaaaataaaatcctctcgcgccgaaaacgccgaaaaacaacgcgaaaa

SEQ ID NO: 14191 - DNA, 742 bp, Artificial Sequence
  chemically treated genomic DNA (Homo sapiens) CpG-island No: 14191
ttttatatagaaaatagttatattatcgatacgaaatcgagttcgtatacgagagtttttagtagaatcgatcggtcggatttgcgattagtatttcgtttagtttacgggtttttttaagagtttattattgttgtaaggacggagttgaggtgttcggtgcgaaggaattgttttaacgttatttaagtcgagtagtagtagcgttaggtacggttcgagtaggtttattcgagtttttagttacgtttatagatcggagtcgtggggtcgcgcgaaggttcggtgtagtaacgatgttcggagggggtcgagtaagcgtttcgtttcgagttttcgttttcgcgtcgtcgggttcgcgttttagcgcgtgtttagtagttcgcgtttggggtcgggcgtttatcggatttcggagggtagcgataggtcgagttcgtttggatgtcgatgttttttattttcgcgatgcggcggttgagaatggagtttatggtgcgcggcgttgtcgggtagagggttagggtcggaacgggagcggcgatagcggcggggtttttacgcggatatggttcggattaggtcgtacggacgttcgtttacggtcgcggaggcgtttcgagtttttaattttcggttcggttcggggttcgacgtttacgcggtttttcgttttcggtttcggggtacgtcgggaaatggagttttttcgcgtcgaaggcgtcgggaagtagcgcgggaa

SEQ ID NO: 14192 - DNA, 742 bp, Artificial Sequence
  chemically treated genomic DNA (Homo sapiens) CpG-island No: 14192
ttcccgcgctacttcccgacgccttcgacgcgaaaaaactccatttcccgacgtaccccgaaaccgaaaacgaaaaaccgcgtaaacgtcgaaccccgaaccgaaccgaaaattaaaaactcgaaacgcctccgcgaccgtaaacgaacgtccgtacgacctaatccgaaccatatccgcgtaaaaaccccgccgctatcgccgctcccgttccgaccctaaccctctacccgacaacgccgcgcaccataaactccattctcaaccgccgcatcgcgaaaataaaaaacatcgacatccaaacgaactcgacctatcgctaccctccgaaatccgataaacgcccgaccccaaacgcgaactactaaacacgcgctaaaacgcgaacccgacgacgcgaaaacgaaaactcgaaacgaaacgcttactcgaccccctccgaacatcgttactacaccgaaccttcgcgcgaccccacgactccgatctataaacgtaactaaaaactcgaataaacctactcgaaccgtacctaacgctactactactcgacttaaataacgttaaaacaattccttcgcaccgaacacctcaactccgtccttacaacaataataaactcttaaaaaaacccgtaaactaaacgaaatactaatcgcaaatccgaccgatcgattctactaaaaactctcgtatacgaactcgatttcgtatcgataatataactattttctatataaaa

SEQ ID NO: 14193 - DNA, 871 bp, Artificial Sequence
  chemically treated genomic DNA (Homo sapiens) CpG-island No: 14193
agttcgtcgaaacgtatttgtatttgtaagggagcgcgggttatagttcggggtcgacggacgttttcgttcggttcgtcgcgtcggtatttttcgttcgcgttttcgttcgtttttattagtatcgagaagcgtatggggatgcggtcgaagagttgtttagggttggcggcgtatagtatggcgtggtacgagtgttttagttcggttttagcgtatcgtttttattcggttgatttgttttagtttcggaatcgtcgtcgtcgatattttggtattgatttcgttttcgtcgttgttatttaagagtatgtcgagttcgttttcgtcgtgtttcgttaattcgcggcgtcgcgttttcgggttcggttttttcgttaatcgtcggcgcgtttcgggatcgagtttttcgtaggtttcggtgcgtcgtcgagaggtgttgcgggcgtgtgtaaaggagtgcggtgcgcgttagtcgttatttaatagtcgtatatttttggcggcggttcgttttcgacgtgagagtttagacgattggtcggtgtcgtggtggtttaaggttgatattgtgggcgacgaatattttttttggcgttttaaagcggatagtcgaaatattttgcggtttttttattttcgatggcgtcgatttttttgcgtttattcgtttttttttaggaggtcgattcggttcgtatggtttcgtttattcgtaatggtatttttggtacgattatacgagttagagatgtttcggagttttgtttcgttagcgttatcggatttaagttcggagggagatggttttcgtttgttatgtacgatagttgtttcgatttagttattttgttggtaggttcgatttagg

SEQ ID NO: 14194 - DNA, 871 bp, Artificial Sequence
  chemically treated genomic DNA (Homo sapiens) CpG-island No: 14194
cctaaatcgaacctaccaacaaaataactaaatcgaaacaactatcgtacataacaaacgaaaaccatctccctccgaacttaaatccgataacgctaacgaaacaaaactccgaaacatctctaactcgtataatcgtaccaaaaataccattacgaataaacgaaaccatacgaaccgaatcgacctcctaaaaaaaaacgaataaacgcaaaaaaatcgacgccatcgaaaataaaaaaaccgcaaaatatttcgactatccgctttaaaacgccaaaaaaaatattcgtcgcccacaatatcaaccttaaaccaccacgacaccgaccaatcgtctaaactctcacgtcgaaaacgaaccgccgccaaaaatatacgactattaaataacgactaacgcgcaccgcactcctttacacacgcccgcaacacctctcgacgacgcaccgaaacctacgaaaaactcgatcccgaaacgcgccgacgattaacgaaaaaaccgaacccgaaaacgcgacgccgcgaattaacgaaacacgacgaaaacgaactcgacatactcttaaataacaacgacgaaaacgaaatcaataccaaaatatcgacgacgacgattccgaaactaaaacaaatcaaccgaataaaaacgatacgctaaaaccgaactaaaacactcgtaccacgccatactatacgccgccaaccctaaacaactcttcgaccgcatccccatacgcttctcgatactaataaaaacgaacgaaaacgcgaacgaaaaataccgacgcgacgaaccgaacgaaaacgtccgtcgaccccgaactataacccgcgctcccttacaaatacaaatacgtttcgacgaact

SEQ ID NO: 14195 - DNA, 871 bp, Artificial Sequence
  chemically treated genomic DNA (Homo sapiens) CpG-island No: 14195
tttggatcgagtttgttagtagggtggttaggtcgggatagttgtcgtgtatggtaggcgaaggttattttttttcgggtttgggttcggtggcgttggcggagtaaggtttcggggtatttttggttcgtgtggtcgtgttaagggtgttattgcggatggacggggttatgcgggtcgggtcggttttttggggagaaacgggtgggcgtaaggggatcggcgttatcgagggtggagaaatcgtaggatatttcggttgttcgttttggggcgttaaggaagatgttcgtcgtttataatgttaattttgagttattacggtatcgattagtcgtttaggtttttacgtcggaggcgggtcgtcgttaagggtgtgcgattattgggtgacggttgacgcgtatcgtatttttttgtatacgttcgtagtatttttcgacgacgtatcggggtttgcgaggggttcggtttcggggcgcgtcggcgattggcgggggaatcggattcgggggcgcggcgtcgcggattggcgaggtacggcgggggcgggttcggtatgtttttaagtggtagcggcggggacggggttagtgttaagatgtcgacggcggcggtttcggagttgaagtagattagtcgggtggaggcgatgcgttagggtcgggttggagtattcgtgttacgttatgttgtacgtcgttaattttgggtagtttttcggtcgtatttttatgcgtttttcggtgttggtgaggacgggcgagggcgcgggcgagaggtgtcggcgcggcgggtcgggcgggggcgttcgtcgatttcgggttgtgattcgcgtttttttgtagatgtagatgcgtttcgacgggtt

SEQ ID NO: 14196 - DNA, 871 bp, Artificial Sequence
  chemically treated genomic DNA (Homo sapiens) CpG-island No: 14196
aacccgtcgaaacgcatctacatctacaaaaaaacgcgaatcacaacccgaaatcgacgaacgcccccgcccgacccgccgcgccgacacctctcgcccgcgccctcgcccgtcctcaccaacaccgaaaaacgcataaaaatacgaccgaaaaactacccaaaattaacgacgtacaacataacgtaacacgaatactccaacccgaccctaacgcatcgcctccacccgactaatctacttcaactccgaaaccgccgccgtcgacatcttaacactaaccccgtccccgccgctaccacttaaaaacataccgaacccgcccccgccgtacctcgccaatccgcgacgccgcgcccccgaatccgattcccccgccaatcgccgacgcgccccgaaaccgaacccctcgcaaaccccgatacgtcgtcgaaaaatactacgaacgtatacaaaaaaatacgatacgcgtcaaccgtcacccaataatcgcacacccttaacgacgacccgcctccgacgtaaaaacctaaacgactaatcgataccgtaataactcaaaattaacattataaacgacgaacatcttccttaacgccccaaaacgaacaaccgaaatatcctacgatttctccaccctcgataacgccgatccccttacgcccacccgtttctccccaaaaaaccgacccgacccgcataaccccgtccatccgcaataacacccttaacacgaccacacgaaccaaaaataccccgaaaccttactccgccaacgccaccgaacccaaacccgaaaaaaaataaccttcgcctaccatacacgacaactatcccgacctaaccaccctactaacaaactcgatccaaa

SEQ ID NO: 14197 - DNA, 551 bp, Artificial Sequence
  chemically treated genomic DNA (Homo sapiens) CpG-island No: 14197
  misc_feature (54)..(54): n is either a, c, g or t
  misc_feature (436)..(436): n is either a, c, g or t
ttacggttgtcggtaaatttggaatattttcggcggcgcgttttgtcgttgatncgatattaatcgttgcgggcgttgcggtttttcggtcggcgaatattggatttattgagttattgggtagggttttgtcgtcgttgttgattcggttgttttttttttttttttttttttttcggtgttcgtttcggtgggcgttcggggcgtttattttcgcggttttgttttttcgttttcgtcgtttttttttttttttcgtttcgtgtcgtttttttttttttgttcggggtttttcgttcgtttttttgtatttttcgtttcgtcggttttttttttttttttttttttttttcgtttttttttttttttcgtcgcgtttttcgtgtttcgttttcggcgggtttttttttgtttcgtgcgcgtttttcgtgtgttnggggttttgtgttttcgtcggtgggggttttcgtcgtgcgttttagagttaaaaataaaaaaaataattatttttttattttatttttttagtagttaagtgtggttataagata

SEQ ID NO: 14198 - DNA, 551 bp, Artificial Sequence
  chemically treated genomic DNA (Homo sapiens) CpG-island No: 14198
  misc_feature (116)..(116): n is either a, c, g or t
  misc_feature (498)..(498): n is either a, c, g or t
tatcttataaccacacttaactactaaaaaaataaaataaaaaaataattattttttttatttttaactctaaaacgcacgacgaaaacccccaccgacgaaaacacaaaaccccnaacacacgaaaaacgcgcacgaaacaaaaaaaaacccgccgaaaacgaaacacgaaaaacgcgacgaaaaaaaaaaaaaaacgaaaaaaaaaaaaaaaaaaaaaaaaaaccgacgaaacgaaaaatacaaaaaaacgaacgaaaaaccccgaacaaaaaaaaaaaaacgacacgaaacgaaaaaaaaaaaaaaacgacgaaaacgaaaaaacaaaaccgcgaaaataaacgccccgaacgcccaccgaaacgaacaccgaaaaaaaaaaaaaaaaaaaaaaaacaaccgaatcaacaacgacgacaaaaccctacccaataactcaataaatccaatattcgccgaccgaaaaaccgcaacgcccgcaacgattaatatcgnatcaacgacaaaacgcgccgccgaaaatattccaaatttaccgacaaccgtaa

SEQ ID NO: 14199 - DNA, 551 bp, Artificial Sequence
  chemically treated genomic DNA (Homo sapiens) CpG-island No: 14199
  misc_feature (116)..(116): n is either a, c, g or t
  misc_feature (498)..(498): n is either a, c, g or t
tgttttatagttatatttagttgttggaggggtggaataggaaagtgattattttttttgtttttggttttggggcgtacggcgagagtttttatcgacggaggtataagattttngatatacggagggcgcgtacgaagtagggaaaggttcgtcgaagacgaaatacggggggcgcgacgaaaagggggggaaaacgggaaagagagaggggggggggaggaatcggcgggacggggggtgtaaagggacgagcgaagggtttcggataggggggagagggcggtacggaacgagggggaagaggggacggcggaggcggagggatagaatcgcggaaataaacgtttcgggcgtttatcggggcgggtatcggaagggggaggggaaggaagagggtaatcggattaataacggcgataaagttttgtttagtgatttagtaagtttaatattcgtcggtcggggggtcgtagcgttcgtagcggttgatatcgngttagcggtaggacgcgtcgtcgggggtgttttaggtttgtcggtagtcgtag

SEQ ID NO: 14200 - DNA, 551 bp, Artificial Sequence
  chemically treated genomic DNA (Homo sapiens) CpG-island No: 14200
  misc_feature (54)..(54): n is either a, c, g or t
  misc_feature (436)..(436): n is either a, c, g or t
ctacgactaccgacaaacctaaaacacccccgacgacgcgtcctaccgctaacncgatatcaaccgctacgaacgctacgaccccccgaccgacgaatattaaacttactaaatcactaaacaaaactttatcgccgttattaatccgattaccctcttccttcccctcccccttccgatacccgccccgataaacgcccgaaacgtttatttccgcgattctatccctccgcctccgccgtcccctcttccccctcgttccgtaccgccctctcccccctatccgaaacccttcgctcgtccctttacaccccccgtcccgccgattcctcccccccccctctctctttcccgttttcccccccttttcgtcgcgccccccgtatttcgtcttcgacgaacctttccctacttcgtacgcgccctccgtatatcnaaaatcttatacctccgtcgataaaaactctcgccgtacgccccaaaaccaaaaacaaaaaaaataatcactttcctattccacccctccaacaactaaatataactataaaaca

SEQ ID NO: 14201 - DNA, 533 bp, Artificial Sequence
  chemically treated genomic DNA (Homo sapiens) CpG-island No: 14201
  misc_feature (36)..(37): n is either a, c, g or t
  misc_feature (41)..(41): n is either a, c, g or t
  misc_feature (43)..(44): n is either a, c, g or t
  misc_feature (52)..(52): n is either a, c, g or t
  misc_feature (58)..(58): n is either a, c, g or t
  misc_feature (72)..(72): n is either a, c, g or t
  misc_feature (77)..(77): n is either a, c, g or t
  misc_feature (134)..(134): n is either a, c, g or t
agcgcgtgttcggcgacgaacggtagtttgcgtttnncgtntnntatttttncgtcgngatcgttggttttnttttntagttcgtcgggttttttttgggcggtgcggttcggtcggcgcggttcgggtttggnttcgcgttcgttcgtgggtggttggttttggttgtttgtggttggcgcgcggtggttttcgcgtttttttcgtttgtttcgcgcggggtggtgcggcgtttcgttggtgcggcgcgggtttcgcgcgggtttttggttggtcgtcgggcgcggcgtcgttgtcgttttggcggtgtgtttcgtttgttttcggcggggggtgtttcggcggtggcgttggttgtcgggttttttttgtttcgttggtttcgggttgcgtttcgcgttcggttgtggcgcgtttgtcgcgggttttcgcgtcggggcggcgttggtgcggtttcggggcgttttgcgttcgtgcgcgtgtgtggtagaaaataaaaaaaagaatataaatttgatttaattatagttaaa

SEQ ID NO: 14202 - DNA, 533 bp, Artificial Sequence
  chemically treated genomic DNA (Homo sapiens) CpG-island No: 14202
  misc_feature (400)..(400): n is either a, c, g or t
  misc_feature (457)..(457): n is either a, c, g or t
  misc_feature (462)..(462): n is either a, c, g or t
  misc_feature (476)..(476): n is either a, c, g or t
  misc_feature (482)..(482): n is either a, c, g or t
  misc_feature (490)..(491): n is either a, c, g or t
  misc_feature (493)..(493): n is either a, c, g or t
  misc_feature (497)..(498): n is either a, c, g or t
tttaactataattaaatcaaatttatattcttttttttattttctaccacacacgcgcacgaacgcaaaacgccccgaaaccgcaccaacgccgccccgacgcgaaaacccgcgacaaacgcgccacaaccgaacgcgaaacgcaacccgaaaccaacgaaacaaaaaaaacccgacaaccaacgccaccgccgaaacaccccccgccgaaaacaaacgaaacacaccgccaaaacgacaacgacgccgcgcccgacgaccaaccaaaaacccgcgcgaaacccgcgccgcaccaacgaaacgccgcaccaccccgcgcgaaacaaacgaaaaaaacgcgaaaaccaccgcgcgccaaccacaaacaaccaaaaccaaccacccacgaacgaacgcgaanccaaacccgaaccgcgccgaccgaaccgcaccgcccaaaaaaaacccgacgaactanaaaanaaaaccaacgatcncgacgnaaaaatannanacgnnaaacgcaaactaccgttcgtcgccgaacacgcgct

SEQ ID NO: 14203 - DNA, 533 bp, Artificial Sequence
  chemically treated genomic DNA (Homo sapiens) CpG-island No: 14203
  misc_feature (400)..(400): n is either a, c, g or t
  misc_feature (457)..(457): n is either a, c, g or t
  misc_feature (462)..(462): n is either a, c, g or t
  misc_feature (476)..(476): n is either a, c, g or t
  misc_feature (482)..(482): n is either a, c, g or t
  misc_feature (490)..(491): n is either a, c, g or t
  misc_feature (493)..(493): n is either a, c, g or t
  misc_feature (497)..(498): n is either a, c, g or t
tttaattataattaaattaagtttgtgtttttttttttattttttattatatacgcgtacgagcgtagggcgtttcggggtcgtattagcgtcgtttcggcgcggaggttcgcgataaacgcgttataatcgaacgcggggcgtagttcgagattagcggaatagaaagggttcgataattagcgttatcgtcgagatatttttcgtcgggagtagacggagtatatcgttagggcggtaacggcgtcgcgttcgacgattaattagaggttcgcgcgagattcgcgtcgtattagcggaacgtcgtattatttcgcgcggagtaaacgaggggggcgcgaggattatcgcgcgttagttataggtaattagagttagttatttacgggcgggcgcgggnttagattcgagtcgcgtcggtcggatcgtatcgtttaggagagattcggcgagttgnggagngaagttagcgattncggcgngggaatanngngcgnngaacgtaaattgtcgttcgtcgtcgggtacgcgtt

SEQ ID NO: 14204 - DNA, 533 bp, Artificial Sequence
  chemically treated genomic DNA (Homo sapiens) CpG-island No: 14204
  misc_feature (36)..(37): n is either a, c, g or t
  misc_feature (41)..(41): n is either a, c, g or t
  misc_feature (43)..(44): n is either a, c, g or t
  misc_feature (52)..(52): n is either a, c, g or t
  misc_feature (58)..(58): n is either a, c, g or t
  misc_feature (72)..(72): n is either a, c, g or t
  misc_feature (77)..(77): n is either a, c, g or t
  misc_feature (134)..(134): n is either a, c, g or t
aacgcgtacccgacgacgaacgacaatttacgttcnncgcncnntattcccncgccgnaatcgctaacttcnctccncaactcgccgaatctctcctaaacgatacgatccgaccgacgcgactcgaatctaancccgcgcccgcccgtaaataactaactctaattacctataactaacgcgcgataatcctcgcgcccccctcgtttactccgcgcgaaataatacgacgttccgctaatacgacgcgaatctcgcgcgaacctctaattaatcgtcgaacgcgacgccgttaccgccctaacgatatactccgtctactcccgacgaaaaatatctcgacgataacgctaattatcgaaccctttctattccgctaatctcgaactacgccccgcgttcgattataacgcgtttatcgcgaacctccgcgccgaaacgacgctaatacgaccccgaaacgccctacgctcgtacgcgtatataataaaaaataaaaaaaaaaacacaaacttaatttaattataattaaa

SEQ ID NO: 14205 - DNA, 755 bp, Artificial Sequence
  chemically treated genomic DNA (Homo sapiens) CpG-island No: 14205
cgaggaaatttaaattttcgggcgcgcgtaggtcgacgggattcgaggaggaggggtaggacgaaggggtcgcgcgcgttacgtcgggcgcgtcgtcgttgttcgagttcggtattggtgggaacgcggcgcgtttttgaggtttagttacgtttcgttcgcggggtaggcgggtatttttacgcgcgcgggtatgagtcgtggtaggagtgcgcggcggtagcggtggtcgttttttggggtttggggtgtgtttatttgtataagcgggcgcgcgtcgttcgggttgggtggattcggcgggatttgattgtttcgttgtttagaggcggagaagaagaggtagcgagtggacgtgattgttttatttcgggtaaaagggatagaattagaggtggggagtttgggtagtcggcgattcgcgaagatttgaggtgtcgtagcggtattcggagtagcgtcgggtttttttcggggtgtagtcgtcgtcgggggaagggcgttataggtcgggaagattttttttttttgtgtttagtagtggggtttatcggagggcggttcgtgggtcgggttttatcgcggcgtttcgggattgtggggttaggttgcgttgggtggacgtttatttcgttaattttcggaggtttttgggggttttcgtgcgtttcggggttgtagagatttaggggaggcgtttgtgaggttcggatttgtttcggggcgaagggtatgtggcgagatagagttttgta

SEQ ID NO: 14206 - DNA, 755 bp, Artificial Sequence
  chemically treated genomic DNA (Homo sapiens) CpG-island No: 14206
tacaaaactctatctcgccacatacccttcgccccgaaacaaatccgaacctcacaaacgcctcccctaaatctctacaaccccgaaacgcacgaaaacccccaaaaacctccgaaaattaacgaaataaacgtccacccaacgcaacctaaccccacaatcccgaaacgccgcgataaaacccgacccacgaaccgccctccgataaaccccactactaaacacaaaaaaaaaaaatcttcccgacctataacgcccttcccccgacgacgactacaccccgaaaaaaacccgacgctactccgaataccgctacgacacctcaaatcttcgcgaatcgccgactacccaaactccccacctctaattctatcccttttacccgaaataaaacaatcacgtccactcgctacctcttcttctccgcctctaaacaacgaaacaatcaaatcccgccgaatccacccaacccgaacgacgcgcgcccgcttatacaaataaacacaccccaaaccccaaaaaacgaccaccgctaccgccgcgcactcctaccacgactcatacccgcgcgcgtaaaaatacccgcctaccccgcgaacgaaacgtaactaaacctcaaaaacgcgccgcgttcccaccaataccgaactcgaacaacgacgacgcgcccgacgtaacgcgcgcgaccccttcgtcctacccctcctcctcgaatcccgtcgacctacgcgcgcccgaaaatttaaatttcctcg

SEQ ID NO: 14207 - DNA, 755 bp, Artificial Sequence
  chemically treated genomic DNA (Homo sapiens) CpG-island No: 14207
tgtagggttttgtttcgttatatatttttcgtttcggggtaggttcgggttttataggcgttttttttggatttttgtagtttcggggcgtacgaagatttttagggattttcgaaggttggcgaggtgggcgtttatttaacgtagtttgattttatagtttcggagcgtcgcggtgaggttcggtttacgggtcgtttttcggtggattttattattggatataaagggaggaggttttttcggtttgtggcgtttttttttcgacggcggttgtatttcggagggagttcggcgttatttcggatgtcgttgcggtattttaagttttcgcgggtcgtcgattgtttagattttttatttttggttttattttttttgttcgggatagagtagttacgtttattcgttattttttttttttcgtttttggatagcggagtagttaaatttcgtcggatttatttagttcggacggcgcgcgttcgtttatgtaaataaatatattttaagttttaaggggcggttatcgttgtcgtcgcgtatttttgttacggtttatgttcgcgcgcgtagaagtgttcgtttatttcgcggacggggcgtggttaagttttagggacgcgtcgcgtttttattaatgtcggattcgggtagcggcggcgcgttcgacgtggcgcgcgcgattttttcgttttgtttttttttttcgggtttcgtcggtttgcgcgcgttcgggagtttgaattttttcg

SEQ ID NO: 14208 - DNA, 755 bp, Artificial Sequence
  chemically treated genomic DNA (Homo sapiens) CpG-island No: 14208
cgaaaaaattcaaactcccgaacgcgcgcaaaccgacgaaacccgaaaaaaaaaaacaaaacgaaaaaatcgcgcgcgccacgtcgaacgcgccgccgctacccgaatccgacattaataaaaacgcgacgcgtccctaaaacttaaccacgccccgtccgcgaaataaacgaacacttctacgcgcgcgaacataaaccgtaacaaaaatacgcgacgacaacgataaccgccccttaaaacttaaaatatatttatttacataaacgaacgcgcgccgtccgaactaaataaatccgacgaaatttaactactccgctatccaaaaacgaaaaaaaaaaaataacgaataaacgtaactactctatcccgaacaaaaaaaataaaaccaaaaataaaaaatctaaacaatcgacgacccgcgaaaacttaaaataccgcaacgacatccgaaataacgccgaactccctccgaaatacaaccgccgtcgaaaaaaaaacgccacaaaccgaaaaaacctcctccctttatatccaataataaaatccaccgaaaaacgacccgtaaaccgaacctcaccgcgacgctccgaaactataaaatcaaactacgttaaataaacgcccacctcgccaaccttcgaaaatccctaaaaatcttcgtacgccccgaaactacaaaaatccaaaaaaaacgcctataaaacccgaacctaccccgaaacgaaaaatatataacgaaacaaaaccctaca

SEQ ID NO: 14209 - DNA, 521 bp, Artificial Sequence
  chemically treated genomic DNA (Homo sapiens) CpG-island No: 14209
  misc_feature (173)..(173): n is either a, c, g or t
tcgcggtatttatgttatttatttttacgggttttatacggtttgtgagtttgtttatcgcgtttttttttttataaaatcgcgttatcggtttttagcggcggtaattttttttaacgcgtcgttatatgcgttcggagcgggttataaattcgttatattgcgcgcgttancgcgttgtaatagcgcgttttttgacgtttagtatggcgcgcgaattacgttattgtattagtttgttatatcgtcgtttatagcggtcgttatatagtcgttattagttcgcgtttataatgcgtttatatttcgcgtatttttaagcgagcgttataagtagtcggttataacggatttgtttgtatatacgcgttggaaacgcgcgtcgatttaattatcgttgttattatcgcggtttgaacgagcggcggttttaagtatttttgtaaattcgcgttttttagatatttcgttttatattttcgatgcgtaagtaatcgttatgatacgcgttttttagttta

SEQ ID NO: 14210 - DNA, 521 bp, Artificial Sequence
  chemically treated genomic DNA (Homo sapiens) CpG-island No: 14210
  misc_feature (349)..(349): n is either a, c, g or t
taaactaaaaaacgcgtatcataacgattacttacgcatcgaaaatataaaacgaaatatctaaaaaacgcgaatttacaaaaatacttaaaaccgccgctcgttcaaaccgcgataataacaacgataattaaatcgacgcgcgtttccaacgcgtatatacaaacaaatccgttataaccgactacttataacgctcgcttaaaaatacgcgaaatataaacgcattataaacgcgaactaataacgactatataacgaccgctataaacgacgatataacaaactaatacaataacgtaattcgcgcgccatactaaacgtcaaaaaacgcgctattacaacgcgntaacgcgcgcaatataacgaatttataacccgctccgaacgcatataacgacgcgttaaaaaaaattaccgccgctaaaaaccgataacgcgattttataaaaaaaaaaacgcgataaacaaactcacaaaccgtataaaacccgtaaaaataaataacataaataccgcga

SEQ ID NO: 14211 - DNA, 521 bp, Artificial Sequence
  chemically treated genomic DNA (Homo sapiens) CpG-island No: 14211
  misc_feature (349)..(349): n is either a, c, g or t
tgaattaaaaaacgcgtattatggcggttgtttacgtatcggggatgtaagacgaggtatttggagggcgcggatttatagagatgtttgagatcgtcgttcgtttaagtcgcggtggtaatagcgatagttggatcggcgcgcgtttttagcgcgtgtgtataagtaggttcgttatgatcgattgtttgtagcgttcgtttgagagtgcgcggagtataggcgtattgtgagcgcgggttgatagcgattgtataacggtcgttgtaggcggcggtgtgatagattgatatagtggcgtggttcgcgcgttatgttagacgttaggaagcgcgttgttatagcgcgntaacgcgcgtagtatagcgggtttatggttcgtttcgggcgtatatagcggcgcgttgaggaggattatcgtcgttgagggtcggtagcgcggttttgtggaggagaaagcgcggtaaataggtttataagtcgtgtgaagttcgtgggggtaagtgatatgggtgtcgcgg

SEQ ID NO: 14212 - DNA, 521 bp, Artificial Sequence
  chemically treated genomic DNA (Homo sapiens) CpG-island No: 14212
  misc_feature (173)..(173): n is either a, c, g or t
ccgcgacacccatatcacttacccccacgaacttcacacgacttataaacctatttaccgcgctttctcctccacaaaaccgcgctaccgaccctcaacgacgataatcctcctcaacgcgccgctatatacgcccgaaacgaaccataaacccgctatactacgcgcgttancgcgctataacaacgcgcttcctaacgtctaacataacgcgcgaaccacgccactatatcaatctatcacaccgccgcctacaacgaccgttatacaatcgctatcaacccgcgctcacaatacgcctatactccgcgcactctcaaacgaacgctacaaacaatcgatcataacgaacctacttatacacacgcgctaaaaacgcgcgccgatccaactatcgctattaccaccgcgacttaaacgaacgacgatctcaaacatctctataaatccgcgccctccaaatacctcgtcttacatccccgatacgtaaacaaccgccataatacgcgttttttaattca

SEQ ID NO: 14213 - DNA, 1027 bp, Artificial Sequence
  chemically treated genomic DNA (Homo sapiens) CpG-island No: 14213
cgttatcggataacggcgacgtagggtatcggtagtacgtcgcgtatcgagcgtcgcgttgatttttttttgttagtttataatgttgtcgcgttgtaatattcgtcggtgttcggggttattagcgtttgtttaagacgttgttgttgttcgttattttttgttagtacggtagtttgttgcggatttagttttagtttgcggaatagttgtaggtttttattttttttcggattcgggcgtggttatagtttgtaatcgtagaaaatcgagtttgcgtttgttataaagtatatcgtttgagtttgtcgtttatttgttcgcgttcggtaaaaaggcgtacgtacgaggttggtattaagattcgcgcggatcggattggggtaaataaaagtaagggtatcggttttttttatttttagtttagcgggcgttttttttaaatttttaaacgagacggcgtggtggggtttatttttttttcgcgggggcgattttacggttaacggttaaatgcgataaatcgtatttcgtcgttaaattcgtttacgttttataatcgttcgtaaatgcgttaatcgtcggttatcgttgtagtaaaacgttattgtttatcgttttttacgcggcggtatacgcggcgcgaatatagtttgtttttaagacgtcgcgtatacgatgtttttttgtatataagtatcgtattagcggttgacgttcgtttagcgtttatgttgattcgttgaaatataatcgcgttcgtgtatatcggtcgtgatatacgcgacgcgtttcgatcgtattagttttcgatatatacgtcgtttttacgtttcgatgtgataacgacgtacggtcggaaatttgtcggttttttatgttagttattatcgtatcgatcgacgtttagttatgtttcgatcggaatttatcgttggcgtaattatcgtcgtggcgttataacgtcggcgtgtagtttttcgttttttattattatgatacgcggtatattattttattatagttt

SEQ ID NO: 14214 - DNA, 1027 bp, Artificial Sequence
  chemically treated genomic DNA (Homo sapiens) CpG-island No: 14214
aaactataataaaataatataccgcgtatcataataataaaaaacgaaaaactacacgccgacgttataacgccacgacgataattacgccaacgataaattccgatcgaaacataactaaacgtcgatcgatacgataataactaacataaaaaaccgacaaatttccgaccgtacgtcgttatcacatcgaaacgtaaaaacgacgtatatatcgaaaactaatacgatcgaaacgcgtcgcgtatatcacgaccgatatacacgaacgcgattatatttcaacgaatcaacataaacgctaaacgaacgtcaaccgctaatacgatacttatatacaaaaaaacatcgtatacgcgacgtcttaaaaacaaactatattcgcgccgcgtataccgccgcgtaaaaaacgataaacaataacgttttactacaacgataaccgacgattaacgcatttacgaacgattataaaacgtaaacgaatttaacgacgaaatacgatttatcgcatttaaccgttaaccgtaaaatcgcccccgcgaaaaaaaaataaaccccaccacgccgtctcgtttaaaaatttaaaaaaaacgcccgctaaactaaaaataaaaaaaaccgatacccttacttttatttaccccaatccgatccgcgcgaatcttaataccaacctcgtacgtacgcctttttaccgaacgcgaacaaataaacgacaaactcaaacgatatactttataacaaacgcaaactcgattttctacgattacaaactataaccacgcccgaatccgaaaaaaaataaaaacctacaactattccgcaaactaaaactaaatccgcaacaaactaccgtactaacaaaaaataacgaacaacaacaacgtcttaaacaaacgctaataaccccgaacaccgacgaatattacaacgcgacaacattataaactaacaaaaaaaaatcaacgcgacgctcgatacgcgacgtactaccgataccctacgtcgccgttatccgataacg

SEQ ID NO: 14215 - DNA, 1027 bp, Artificial Sequence
  chemically treated genomic DNA (Homo sapiens) CpG-island No: 14215
aaattgtgatgaaataatgtatcgcgtattatggtggtgaggagcggaaaattatacgtcggcgttataacgttacggcgatgattgcgttagcgatggatttcggtcgggatatagttagacgtcggtcgatacgatggtggttgatataagaggtcggtaggttttcgatcgtacgtcgttattatatcgaggcgtgaggacgacgtatgtgtcgagagttagtgcggtcggggcgcgtcgcgtgtgttacgatcggtgtgtacgaacgcgattgtattttagcggattaatatgagcgttagacgaacgttagtcgttggtacgatgtttgtatatagagaagtatcgtgtgcgcggcgttttaaaagtaggttgtattcgcgtcgcgtatgtcgtcgcgtagagagcggtaaatagtggcgttttgttgtagcggtggtcggcggttggcgtatttacggacgattatggggcgtaagcggatttagcggcgaagtgcggtttatcgtatttggtcgttagtcgtggagtcgttttcgcggggaaagggtgggttttattacgtcgtttcgtttaaaggtttaaagggagcgttcgttgggttagagatggggaaggtcgatgtttttgtttttatttgttttagttcggttcgcgcggattttgatgttaatttcgtacgtgcgtttttttgtcgggcgcgagtagatgaacgatagatttaggcgatgtgttttatggtaggcgtaaattcgattttttacggttgtaaattgtgattacgttcgaattcggaagaagataaagatttgtaattgtttcgtaaattggggttaaattcgtagtaaattgtcgtgttggtaggggataacgaataatagtaacgttttgaataggcgttgatgatttcggatatcgacgaatattataacgcggtagtattatgagttggtaggagaaaattaacgcggcgttcgatgcgcggcgtgttgtcgatgttttgcgtcgtcgttattcggtggcg

SEQ ID NO: 14216 - DNA, 1027 bp, Artificial Sequence
  chemically treated genomic DNA (Homo sapiens) CpG-island No: 14216
cgccaccgaataacgacgacgcaaaacatcgacaacacgccgcgcatcgaacgccgcgttaattttctcctaccaactcataatactaccgcgttataatattcgtcgatatccgaaatcatcaacgcctattcaaaacgttactattattcgttatcccctaccaacacgacaatttactacgaatttaaccccaatttacgaaacaattacaaatctttatcttcttccgaattcgaacgtaatcacaatttacaaccgtaaaaaatcgaatttacgcctaccataaaacacatcgcctaaatctatcgttcatctactcgcgcccgacaaaaaaacgcacgtacgaaattaacatcaaaatccgcgcgaaccgaactaaaacaaataaaaacaaaaacatcgaccttccccatctctaacccaacgaacgctccctttaaacctttaaacgaaacgacgtaataaaacccaccctttccccgcgaaaacgactccacgactaacgaccaaatacgataaaccgcacttcgccgctaaatccgcttacgccccataatcgtccgtaaatacgccaaccgccgaccaccgctacaacaaaacgccactatttaccgctctctacgcgacgacatacgcgacgcgaatacaacctacttttaaaacgccgcgcacacgatacttctctatatacaaacatcgtaccaacgactaacgttcgtctaacgctcatattaatccgctaaaatacaatcgcgttcgtacacaccgatcgtaacacacgcgacgcgccccgaccgcactaactctcgacacatacgtcgtcctcacgcctcgatataataacgacgtacgatcgaaaacctaccgacctcttatatcaaccaccatcgtatcgaccgacgtctaactatatcccgaccgaaatccatcgctaacgcaatcatcgccgtaacgttataacgccgacgtataattttccgctcctcaccaccataatacgcgatacattatttcatcacaattt

SEQ ID NO: 14217 - DNA, 837 bp, Artificial Sequence
  chemically treated genomic DNA (Homo sapiens) CpG-island No: 14217
ggcgtaattaaacgaattcgcgtcggtttttttagggtttttcggggtttcgtttcgttttagcgggtttcggcggggttgggaaatcggttgaggttcgttttacggtggggaggagcgacgggaggcggaagtttttcggttcgggtttcgttttcgtattcgttttcgtttcgtcgcgattttttattcgtcgttaatttatgtgcgttggtgacgttatcgcgtttattagttcggaagtgcgcgtggcggcggtggcggttgcggtaatagcggggtcggtaagcgggcgcgcgtcgtttagaggggtagagttggtggcgtgagttgttgtttttttttttttgttgtgggttagaggcgttatcgcgttcggttttcgaggaagacgggagcgggacgtggcgagaggtttttttagtagtgggtaaaatagtttcgacgcggaggtcgtgttttcgttacgttttcggcgatcgtaggcgcggattttttggttttttttagtattttttttttcgcgcggacggtttcgagacgtttttttattgggttttgtcgttagtattcggcgtggggggtgagacgcgtttttttagggttggggttttttagagcgtttttttaagtcgaggcggaggtgcgaggaaattgagtgggttttttcgttttacgtggtttgtcgggaagcgcggtttttttattcgttttcgtggaatggaatggtttttttttgtaggtttatatcggggttattcgagagttgttgcggtttttttatgggtaggattttcgtttggggagaacgaggatgtgatatgtagaagggaaggt

SEQ ID NO: 14218 - DNA, 837 bp, Artificial Sequence
  chemically treated genomic DNA (Homo sapiens) CpG-island No: 14218
accttcccttctacatatcacatcctcgttctccccaaacgaaaatcctacccataaaaaaaccgcaacaactctcgaataaccccgatataaacctacaaaaaaaaaccattccattccacgaaaacgaataaaaaaaccgcgcttcccgacaaaccacgtaaaacgaaaaaacccactcaatttcctcgcacctccgcctcgacttaaaaaaacgctctaaaaaaccccaaccctaaaaaaacgcgtctcaccccccacgccgaatactaacgacaaaacccaataaaaaaacgtctcgaaaccgtccgcgcgaaaaaaaaaatactaaaaaaaaccaaaaaatccgcgcctacgatcgccgaaaacgtaacgaaaacacgacctccgcgtcgaaactattttacccactactaaaaaaacctctcgccacgtcccgctcccgtcttcctcgaaaaccgaacgcgataacgcctctaacccacaacaaaaaaaaaaaaacaacaactcacgccaccaactctacccctctaaacgacgcgcgcccgcttaccgaccccgctattaccgcaaccgccaccgccgccacgcgcacttccgaactaataaacgcgataacgtcaccaacgcacataaattaacgacgaataaaaaatcgcgacgaaacgaaaacgaatacgaaaacgaaacccgaaccgaaaaacttccgcctcccgtcgctcctccccaccgtaaaacgaacctcaaccgatttcccaaccccgccgaaacccgctaaaacgaaacgaaaccccgaaaaaccctaaaaaaaccgacgcgaattcgtttaattacgcc

SEQ ID NO: 14219 - DNA, 837 bp, Artificial Sequence
  chemically treated genomic DNA (Homo sapiens) CpG-island No: 14219
gtttttttttttatatattatattttcgttttttttaaacgggggttttgtttataaggaggtcgtagtagttttcgagtgatttcggtgtaaatttgtagagaaaaattattttattttacggaagcgggtggaggagtcgcgtttttcggtaggttacgtggggcggaaagatttatttagttttttcgtattttcgtttcgatttaggaaaacgttttggggaattttagttttgaaaaggcgcgttttattttttacgtcgggtgttggcgataaggtttagtgaaaaagcgtttcggggtcgttcgcgcggaggggaaagtgttgagggaagttaaggaattcgcgtttgcggtcgtcggaaacgtggcggggatacgattttcgcgtcggggttattttgtttattgttgaggaggtttttcgttacgtttcgttttcgtttttttcgaggatcgggcgcggtggcgtttttggtttatagtaggaaggaaggggtagtaatttacgttattaattttgtttttttgagcggcgcgcgttcgtttatcggtttcgttgttgtcgtagtcgttatcgtcgttacgcgtattttcgggttggtgaacgcggtgacgttattaacgtatatgggttggcggcgaatgggaagtcgcggcggggcgagggcgagtgcgggggcggggttcggatcgaagggttttcgtttttcgtcgtttttttttatcgtgaggcgaattttagtcggttttttagtttcgtcgaggttcgttggggcgaagcggagtttcggggggttttgaggaaatcggcgcgggttcgtttaattacgtt

SEQ ID NO: 14220 - DNA, 837 bp, Artificial Sequence
  chemically treated genomic DNA (Homo sapiens) CpG-island No: 14220
aacgtaattaaacgaacccgcgccgatttcctcaaaaccccccgaaactccgcttcgccccaacgaacctcgacgaaactaaaaaaccgactaaaattcgcctcacgataaaaaaaaacgacgaaaaacgaaaacccttcgatccgaaccccgcccccgcactcgccctcgccccgccgcgacttcccattcgccgccaacccatatacgttaataacgtcaccgcgttcaccaacccgaaaatacgcgtaacgacgataacgactacgacaacaacgaaaccgataaacgaacgcgcgccgctcaaaaaaacaaaattaataacgtaaattactaccccttccttcctactataaaccaaaaacgccaccgcgcccgatcctcgaaaaaaacgaaaacgaaacgtaacgaaaaacctcctcaacaataaacaaaataaccccgacgcgaaaatcgtatccccgccacgtttccgacgaccgcaaacgcgaattccttaacttccctcaacactttcccctccgcgcgaacgaccccgaaacgctttttcactaaaccttatcgccaacacccgacgtaaaaaataaaacgcgccttttcaaaactaaaattccccaaaacgttttcctaaatcgaaacgaaaatacgaaaaaactaaataaatctttccgccccacgtaacctaccgaaaaacgcgactcctccacccgcttccgtaaaataaaataatttttctctacaaatttacaccgaaatcactcgaaaactactacgacctccttataaacaaaacccccgtttaaaaaaaacgaaaatataatatataaaaaaaaaaac

SEQ ID NO: 14221 - DNA, 562 bp, Artificial Sequence
  chemically treated genomic DNA (Homo sapiens) CpG-island No: 14221
aaagcgtcgcgattttatcgttggtcgagggtcgacgtgaagtagtttttcggtgcggttttgttgggttggttcgttaggtttggcgtttttacgttcgttttttaggtttagttgtatcgttagcggtttcgagtttcgttttattttcgattatagggaattatttcgggcggttattaggtaggagcggtaggtggttgtttatgttgtgcgtagcgttttgttgatttttttcgtcggttatgtttgtttattcgtaaaggaggttgggatagggcggtgtcgaagatttcgagggagggttcgtgtcgcgcggttgtcgcgtatcggggttatagcgttttttggcggttttaggggagtagacggcggcgcgtatttaagtttgaaagtgatggtttaggcgggagggataattataggtttgcgtttcgtttcggggatagaacgttaacgtcgttttttgttatttacggttgagtgttcggcgtatacgttgtagagtttttattttgttttagtttttagtatgatttatttaattttgatattttgtata

SEQ ID NO: 14222 - DNA, 562 bp, Artificial Sequence
  chemically treated genomic DNA (Homo sapiens) CpG-island No: 14222
tatacaaaatatcaaaattaaataaatcatactaaaaactaaaacaaaataaaaactctacaacgtatacgccgaacactcaaccgtaaataacaaaaaacgacgttaacgttctatccccgaaacgaaacgcaaacctataattatccctcccgcctaaaccatcactttcaaacttaaatacgcgccgccgtctactcccctaaaaccgccaaaaaacgctataaccccgatacgcgacaaccgcgcgacacgaaccctccctcgaaatcttcgacaccgccctatcccaacctcctttacgaataaacaaacataaccgacgaaaaaaatcaacaaaacgctacgcacaacataaacaaccacctaccgctcctacctaataaccgcccgaaataattccctataatcgaaaataaaacgaaactcgaaaccgctaacgatacaactaaacctaaaaaacgaacgtaaaaacgccaaacctaacgaaccaacccaacaaaaccgcaccgaaaaactacttcacgtcgaccctcgaccaacgataaaatcgcgacgcttt

SEQ ID NO: 14223 - DNA, 562 bp, Artificial Sequence
  chemically treated genomic DNA (Homo sapiens) CpG-island No: 14223
tatgtaaaatattaggattaaataagttatgttaagggttggaataaagtgagggttttgtagcgtgtacgtcgggtatttagtcgtggatggtaggggacggcgttggcgttttgttttcgggacggagcgtaggtttgtaattgtttttttcgtttaggttattatttttaggtttgggtacgcgtcgtcgtttgtttttttggggtcgttagggggcgttgtggtttcggtgcgcggtagtcgcgcgatacggattttttttcggagttttcggtatcgttttgttttagttttttttgcgggtaaatagatatggtcggcgaaggagattagtaggacgttgcgtataatatgggtaattatttgtcgtttttgtttggtaatcgttcggagtagttttttgtagtcgggagtggggcgaggttcggagtcgttagcggtgtagttgggtttgggaggcgggcgtgggggcgttaagtttggcgagttagtttagtagggtcgtatcggaaagttgttttacgtcggttttcggttagcgatggagtcgcggcgtttt

SEQ ID NO: 14224 - DNA, 562 bp, Artificial Sequence
  chemically treated genomic DNA (Homo sapiens) CpG-island No: 14224
aaaacgccgcgactccatcgctaaccgaaaaccgacgtaaaacaactttccgatacgaccctactaaactaactcgccaaacttaacgcccccacgcccgcctcccaaacccaactacaccgctaacgactccgaacctcgccccactcccgactacaaaaaactactccgaacgattaccaaacaaaaacgacaaataattacccatattatacgcaacgtcctactaatctccttcgccgaccatatctatttacccgcaaaaaaaactaaaacaaaacgataccgaaaactccgaaaaaaaatccgtatcgcgcgactaccgcgcaccgaaaccacaacgccccctaacgaccccaaaaaaacaaacgacgacgcgtacccaaacctaaaaataataacctaaacgaaaaaaacaattacaaacctacgctccgtcccgaaaacaaaacgccaacgccgtcccctaccatccacgactaaatacccgacgtacacgctacaaaaccctcactttattccaacccttaacataacttatttaatcctaatattttacata

SEQ ID NO: 14225 - DNA, 617 bp, Artificial Sequence
  chemically treated genomic DNA (Homo sapiens) CpG-island No: 14225
cgaaaatcggcggttcgtcgttggtgtagcgtacgtcggaggtgtttttttggatgagcgtttggacgaaagtaagcgattgttcgagcgcgtaagtgtttttggaataagtgtttaggattcgcgcgtttagcgttacgttgggtagtaggttgggattattgttgatttggtttagggcgtagagtatcgtttttagtttgtggatttcgtttttttttttgatgtcgtcgtagggtatttcgttgggatttttggcgtgtacggggaatagtttttcgagggtgacgtttttttcgattcggattgagtgtaaggcgtatattttttggtcgcgcgtcgtcgtcgttagcgcgtataggagtatttttagtacgtagggggattttttagagtcgtacgacgatgcggtggggtgggtgggtgggttttcgcgggtgtgagttggcggtttttttgttggggcgtatcgtggggtgtttggtgtttgttgggggtggggggcggtttcgcgtgtttcgcgcgtggtagcgtcgcgttgggtcgcgttttttttggatcgtttcgatagcgcgggtttttcgtaggcgggtagggatagtattgggagatatatt

SEQ ID NO: 14226 - DNA, 617 bp, Artificial Sequence
  chemically treated genomic DNA (Homo sapiens) CpG-island No: 14226
aatatatctcccaatactatccctacccgcctacgaaaaacccgcgctatcgaaacgatccaaaaaaaacgcgacccaacgcgacgctaccacgcgcgaaacacgcgaaaccgccccccacccccaacaaacaccaaacaccccacgatacgccccaacaaaaaaaccgccaactcacacccgcgaaaacccacccacccaccccaccgcatcgtcgtacgactctaaaaaatccccctacgtactaaaaatactcctatacgcgctaacgacgacgacgcgcgaccaaaaaatatacgccttacactcaatccgaatcgaaaaaaacgtcaccctcgaaaaactattccccgtacacgccaaaaatcccaacgaaataccctacgacgacatcaaaaaaaaaaacgaaatccacaaactaaaaacgatactctacgccctaaaccaaatcaacaataatcccaacctactacccaacgtaacgctaaacgcgcgaatcctaaacacttattccaaaaacacttacgcgctcgaacaatcgcttactttcgtccaaacgctcatccaaaaaaacacctccgacgtacgctacaccaacgacgaaccgccgattttcg

SEQ ID NO: 14227 - DNA, 617 bp, Artificial Sequence
  chemically treated genomic DNA (Homo sapiens) CpG-island No: 14227
ggtatattttttaatgttatttttattcgtttgcgggggattcgcgttgtcgaggcgatttagggagaacgcggtttagcgcgacgttgttacgcgcggggtacgcgaggtcgttttttatttttaataaatattaaatattttacgatgcgttttaatagagaagtcgttagtttatattcgcggaaatttatttatttattttatcgtatcgtcgtgcgattttagaggatttttttgcgtgttggaggtgtttttgtgcgcgttggcggcggcggcgcgcggttaggagatgtacgttttgtatttaattcggatcgagggggacgttattttcggggggttgtttttcgtgtacgttaagggttttagcggagtgttttgcggcgatattaagagggaaaacgggatttataggttggaagcgatgttttacgttttggattagattaatagtgattttaatttattgtttaacgtgacgttgggcgcgcggattttggatatttgttttagggatatttacgcgttcgaatagtcgtttattttcgtttaggcgtttatttagaaggatattttcgacgtgcgttgtattaacggcgaatcgtcggttttcg

SEQ ID NO: 14228 - DNA, 617 bp, Artificial Sequence
  chemically treated genomic DNA (Homo sapiens) CpG-island No: 14228
cgaaaaccgacgattcgccgttaatacaacgcacgtcgaaaatatccttctaaataaacgcctaaacgaaaataaacgactattcgaacgcgtaaatatccctaaaacaaatatccaaaatccgcgcgcccaacgtcacgttaaacaataaattaaaatcactattaatctaatccaaaacgtaaaacatcgcttccaacctataaatcccgttttccctcttaatatcgccgcaaaacactccgctaaaacccttaacgtacacgaaaaacaaccccccgaaaataacgtccccctcgatccgaattaaatacaaaacgtacatctcctaaccgcgcgccgccgccgccaacgcgcacaaaaacacctccaacacgcaaaaaaatcctctaaaatcgcacgacgatacgataaaataaataaataaatttccgcgaatataaactaacgacttctctattaaaacgcatcgtaaaatatttaatatttattaaaaataaaaaacgacctcgcgtaccccgcgcgtaacaacgtcgcgctaaaccgcgttctccctaaatcgcctcgacaacgcgaatcccccgcaaacgaataaaaataacattaaaaaatatacc

SEQ ID NO: 14229 - DNA, 621 bp, Artificial Sequence
  chemically treated genomic DNA (Homo sapiens) CpG-island No: 14229
aattaattcgattattgatatgcgtaggcggttattatttttatttcgtaattacgtcgttttttttttcgtttttagttttaacgttcgataattttcgttacgggtaatttaatgtattcgttttaatatatcgttcgttgataaattacgtcgcgtttaaaattcgttggtttattattacgcgttcgaatataattacggtattcgaaatatacggttgttttaaaaagacgaggtgcgatataattttcggttcgattaaaatcgtcgtttttataaatagggtgtcggaaaaaaaaaacgtgttggtacgtataagtcgaggattataataatacgttcgtcgttttattatattcgttttcgtattagtaaggacggatacgtaatatataatacgtgcgtttttaataacgttttacgcggtgatacgaaaagattacgtgcgcgtatttattataaatatatgcgttttacgcgaaaatataatattcgcggcgcgtatatatatatttgcgtcgtcgttcgatattttacgtttcggcgggatacgaatatatacgaattacggggatcgcgaataatatatatacgtattatttttgatatataataata

SEQ ID NO: 14230 - DNA, 621 bp, Artificial Sequence
  chemically treated genomic DNA (Homo sapiens) CpG-island No: 14230
tattattatatatcaaaaataatacgtatatatattattcgcgatccccgtaattcgtatatattcgtatcccgccgaaacgtaaaatatcgaacgacgacgcaaatatatatatacgcgccgcgaatattatattttcgcgtaaaacgcatatatttataataaatacgcgcacgtaatcttttcgtatcaccgcgtaaaacgttattaaaaacgcacgtattatatattacgtatccgtccttactaatacgaaaacgaatataataaaacgacgaacgtattattataatcctcgacttatacgtaccaacacgttttttttttccgacaccctatttataaaaacgacgattttaatcgaaccgaaaattatatcgcacctcgtctttttaaaacaaccgtatatttcgaataccgtaattatattcgaacgcgtaataataaaccaacgaattttaaacgcgacgtaatttatcaacgaacgatatattaaaacgaatacattaaattacccgtaacgaaaattatcgaacgttaaaactaaaaacgaaaaaaaaaacgacgtaattacgaaataaaaataataaccgcctacgcatatcaataatcgaattaatt

SEQ ID NO: 14231 - DNA, 621 bp, Artificial Sequence
  chemically treated genomic DNA (Homo sapiens) CpG-island No: 14231
tgttgttgtatgttagagatggtgcgtatatatgttattcgcgattttcgtagttcgtatgtattcgtatttcgtcgaggcgtagggtatcgggcggcggcgtagatatatgtgtacgcgtcgcgggtattgtattttcgcgtgaggcgtatatgtttgtggtgagtgcgcgtacgtggttttttcgtgttatcgcgtggggcgttgttaggggcgtacgtgttgtatattgcgtgttcgtttttgttggtgcgaggacgaatgtggtgaggcggcgggcgtgttgttgtagttttcggtttgtacgtgttagtacgtttttttttttcgatattttgtttatgggggcggcgattttggtcgggtcgggagttgtgtcgtatttcgtttttttggggtagtcgtgtgtttcgggtgtcgtggttgtattcgggcgcgtggtaataagttagcggattttaaacgcggcgtgatttgttagcgagcggtgtgttgaggcgggtgtattgaattattcgtggcggggattgtcgggcgttagaattagaggcggaaggagaggcggcgtggttacggggtgaggatagtggtcgtttgcgtatgttagtggtcgagttggtt

SEQ ID NO: 14232 - DNA, 621 bp, Artificial Sequence
  chemically treated genomic DNA (Homo sapiens) CpG-island No: 14232
aaccaactcgaccactaacatacgcaaacgaccactatcctcaccccgtaaccacgccgcctctccttccgcctctaattctaacgcccgacaatccccgccacgaataattcaatacacccgcctcaacacaccgctcgctaacaaatcacgccgcgtttaaaatccgctaacttattaccacgcgcccgaatacaaccacgacacccgaaacacacgactaccccaaaaaaacgaaatacgacacaactcccgacccgaccaaaatcgccgcccccataaacaaaatatcgaaaaaaaaaaacgtactaacacgtacaaaccgaaaactacaacaacacgcccgccgcctcaccacattcgtcctcgcaccaacaaaaacgaacacgcaatatacaacacgtacgcccctaacaacgccccacgcgataacacgaaaaaaccacgtacgcgcactcaccacaaacatatacgcctcacgcgaaaatacaatacccgcgacgcgtacacatatatctacgccgccgcccgataccctacgcctcgacgaaatacgaatacatacgaactacgaaaatcgcgaataacatatatacgcaccatctctaacatacaacaaca

SEQ ID NO: 14233 - DNA, 658 bp, Artificial Sequence
  chemically treated genomic DNA (Homo sapiens) CpG-island No: 14233
aaattcgcgggtattcgcgcggatatcggcgatatcgcgtttaatttcgggaaaagcgggttaatcggggggtaaatgggcgtattgcggcggtattgtcgggaacgcgggagattttcggtgtgaaaggcggggtcgttttaaatggggggtaaagggggaaataggcggaatttcgcgttgaattcggattattggcgggagttggcgggaaagggggtggaattcggggataacgggggggatcggcgtgaacgtcgggggaattcggttaaatttcggggaatgtttggcgaatcggggggtgattggcgtgaatgtcgggggatttgcgggaaattttcggggaatatggcgggaaattgcggggaaatttcgggaaatttcgggggagttcgcggggaattacgggagggatattgggtggaaacgcggcggggaaatcggggcgtaaatttttgcgagatttcgcggggtaaatttcgggtaaaatttcggggcgattaagcgcgagaaaatcgggggagatttcggggttaaatttgggcgcggataagacgggggagatatatcgcggcgaaattggggggggaaaatagagcgggtttcggaagttgattgtcgttcgaatcgtttttagagattttcgatacgaata

SEQ ID NO: 14234 - DNA, 658 bp, Artificial Sequence
  chemically treated genomic DNA (Homo sapiens) CpG-island No: 14234
tattcgtatcgaaaatctctaaaaacgattcgaacgacaatcaacttccgaaacccgctctattttccccccccaatttcgccgcgatatatctcccccgtcttatccgcgcccaaatttaaccccgaaatctcccccgattttctcgcgcttaatcgccccgaaattttacccgaaatttaccccgcgaaatctcgcaaaaatttacgccccgatttccccgccgcgtttccacccaatatccctcccgtaattccccgcgaactcccccgaaatttcccgaaatttccccgcaatttcccgccatattccccgaaaatttcccgcaaatcccccgacattcacgccaatcaccccccgattcgccaaacattccccgaaatttaaccgaattcccccgacgttcacgccgatcccccccgttatccccgaattccaccccctttcccgccaactcccgccaataatccgaattcaacgcgaaattccgcctatttccccctttaccccccatttaaaacgaccccgcctttcacaccgaaaatctcccgcgttcccgacaataccgccgcaatacgcccatttaccccccgattaacccgcttttcccgaaattaaacgcgatatcgccgatatccgcgcgaatacccgcgaattt

SEQ ID NO: 14235 - DNA, 658 bp, Artificial Sequence
  chemically treated genomic DNA (Homo sapiens) CpG-island No: 14235
tgttcgtgtcgggaatttttagaggcgattcgaacggtaattaattttcggggttcgttttattttttttttttaatttcgtcgcggtatgtttttttcgttttgttcgcgtttaagtttagtttcgaaatttttttcggttttttcgcgtttgatcgtttcgggattttgttcggaatttgtttcgcgaaatttcgtagaaatttacgtttcgattttttcgtcgcgtttttatttagtatttttttcgtaatttttcgcgaattttttcgaaatttttcgaaattttttcgtaatttttcgttatatttttcgggaatttttcgtaaatttttcggtatttacgttaattatttttcgattcgttaggtatttttcgggatttggtcggattttttcgacgtttacgtcgatttttttcgttgttttcgaattttattttttttttcgttaattttcgttaatggttcggatttaacgcgagatttcgtttatttttttttttgttttttatttggggcggtttcgttttttatatcgagagtttttcgcgttttcggtaatatcgtcgtaatgcgtttatttatttttcgattggttcgtttttttcgggattaggcgcgatgtcgtcggtattcgcgcggatgttcgcgagttt

SEQ ID NO: 14236 - DNA, 658 bp, Artificial Sequence
  chemically treated genomic DNA (Homo sapiens) CpG-island No: 14236
aaactcgcgaacatccgcgcgaataccgacgacatcgcgcctaatcccgaaaaaaacgaaccaatcgaaaaataaataaacgcattacgacgatattaccgaaaacgcgaaaaactctcgatataaaaaacgaaaccgccccaaataaaaaacaaaaaaaaaaataaacgaaatctcgcgttaaatccgaaccattaacgaaaattaacgaaaaaaaaaataaaattcgaaaacaacgaaaaaaatcgacgtaaacgtcgaaaaaatccgaccaaatcccgaaaaatacctaacgaatcgaaaaataattaacgtaaataccgaaaaatttacgaaaaattcccgaaaaatataacgaaaaattacgaaaaaatttcgaaaaatttcgaaaaaattcgcgaaaaattacgaaaaaaatactaaataaaaacgcgacgaaaaaatcgaaacgtaaatttctacgaaatttcgcgaaacaaattccgaacaaaatcccgaaacgatcaaacgcgaaaaaaccgaaaaaaatttcgaaactaaacttaaacgcgaacaaaacgaaaaaaacataccgcgacgaaattaaaaaaaaaaaataaaacgaaccccgaaaattaattaccgttcgaatcgcctctaaaaattcccgacacgaaca

SEQ ID NO: 14237 - DNA, 640 bp, Artificial Sequence
  chemically treated genomic DNA (Homo sapiens) CpG-island No: 14237
gattacgcgatattttcgcgttgcgcgggtagatagatttcgacgttttatggttattcgttgatatcgttatatcgggtacgtgtacgtattatgtgtgtgtatgcgagatcgtaacgtcgaatttagtacgtttatacgcgtagatcggcgtatttttatgtaggagatgttcgcgtattagttacgaggtattttacgagtgttcggtgtatgagtagtagttcgtgtatagatttattcgttgcgttagacgtttttacgtgtcgcgtagtacgtatagagtcgttgtggaagatcgattatcggatattaagtttcgtcgtatagtgattattaggacgcgtagggtaagcgtagtttattcgattagtaacgtcgtacgttcggtgaggcgtcgtgttatcggtaataacgacgattatgaggtaatgtgagattgacgatagatattgagcggtcgatttggaacgttcgtttttagaaacgagttcgttggcgtacgagagcgacgttcgtagtcgaggtcggttggtagaagtcggggatatgatatagttcgggaaagggtgagtttagtcgttaggcgtagaaggagtagaatttttgtgcgtaagtatatgttttaggtaagatatat

SEQ ID NO: 14238 - DNA, 640 bp, Artificial Sequence
  chemically treated genomic DNA (Homo sapiens) CpG-island No: 14238
atatatcttacctaaaacatatacttacgcacaaaaattctactccttctacgcctaacgactaaactcaccctttcccgaactatatcatatccccgacttctaccaaccgacctcgactacgaacgtcgctctcgtacgccaacgaactcgtttctaaaaacgaacgttccaaatcgaccgctcaatatctatcgtcaatctcacattacctcataatcgtcgttattaccgataacacgacgcctcaccgaacgtacgacgttactaatcgaataaactacgcttaccctacgcgtcctaataatcactatacgacgaaacttaatatccgataatcgatcttccacaacgactctatacgtactacgcgacacgtaaaaacgtctaacgcaacgaataaatctatacacgaactactactcatacaccgaacactcgtaaaatacctcgtaactaatacgcgaacatctcctacataaaaatacgccgatctacgcgtataaacgtactaaattcgacgttacgatctcgcatacacacacataatacgtacacgtacccgatataacgatatcaacgaataaccataaaacgtcgaaatctatctacccgcgcaacgcgaaaatatcgcgtaatc

SEQ ID NO: 14239 - DNA, 640 bp, Artificial Sequence
  chemically treated genomic DNA (Homo sapiens) CpG-island No: 14239
atatgttttgtttggagtatgtatttgcgtataaagattttgttttttttacgtttagcggttagatttattttttttcggattatattatgttttcggtttttattaatcgatttcgattgcgggcgtcgttttcgtgcgttaacgggttcgtttttgggaacgaacgttttaaatcggtcgtttagtatttatcgttagttttatattattttatggtcgtcgttattgtcgataatacggcgttttatcgagcgtacggcgttgttggtcgagtgggttacgtttgttttacgcgttttggtggttattgtgcggcgggatttggtgttcggtggtcgattttttatagcggttttgtacgtgttgcgcggtacgtgggggcgtttagcgtaacgagtaggtttgtgtacgagttattgtttatatatcgaatattcgtagaatgtttcgtggttagtgcgcggatattttttatatgagagtgcgtcgatttgcgcgtgtgagcgtgttgagttcgacgttgcggtttcgtatgtatatatataatacgtatacgtgttcggtgtggcggtgttagcgagtagttataggacgtcggagtttatttgttcgcgtagcgcgagggtgtcgcgtggtt

SEQ ID NO: 14240 - DNA, 640 bp, Artificial Sequence
  chemically treated genomic DNA (Homo sapiens) CpG-island No: 14240
aaccacgcgacaccctcgcgctacgcgaacaaataaactccgacgtcctataactactcgctaacaccgccacaccgaacacgtatacgtattatatatatacatacgaaaccgcaacgtcgaactcaacacgctcacacgcgcaaatcgacgcactctcatataaaaaatatccgcgcactaaccacgaaacattctacgaatattcgatatataaacaataactcgtacacaaacctactcgttacgctaaacgcccccacgtaccgcgcaacacgtacaaaaccgctataaaaaatcgaccaccgaacaccaaatcccgccgcacaataaccaccaaaacgcgtaaaacaaacgtaacccactcgaccaacaacgccgtacgctcgataaaacgccgtattatcgacaataacgacgaccataaaataatataaaactaacgataaatactaaacgaccgatttaaaacgttcgttcccaaaaacgaacccgttaacgcacgaaaacgacgcccgcaatcgaaatcgattaataaaaaccgaaaacataatataatccgaaaaaaaataaatctaaccgctaaacgtaaaaaaaacaaaatctttatacgcaaatacatactccaaacaaaacatat

SEQ ID NO: 14241 - DNA, 553 bp, Artificial Sequence
  chemically treated genomic DNA (Homo sapiens) CpG-island No: 14241
cggggaaacgtttttttttttatcgaagtcggtcgcggtacgtcgtttttttattggagtttgcggtttcggcggtttcgatcgtatttcgtagttagttaaattttattatgcgtacgcgtacgcggcgaagtcggcgtttcgggttgggttgggaagtgttcgcgttagtcgagggtttcgcgttttttataggaggcggggtacggagggggcggggcgatcgcgaggtttcgttttgtttttggcggcgttgggttatgcggaggtttacgtgagtagattgttcgttggtttacgggtcggggcgcgtaggcgtacggcggggttgggtggagggcggaggtggtaaaagggtgaaggcggaggagggagtgtttgggaataggcgtatacgtttggcgcggtgtttcgtagttgtttgcgggtggggtcgtcgtttttttttgtagacgaaagttgttgacgggaaaattacgcgggaggggaacgtttaggttttggttttttttttttaaaggtcgcgggaatatagggttggggaattttggta

SEQ ID NO: 14242 - DNA, 553 bp, Artificial Sequence
  chemically treated genomic DNA (Homo sapiens) CpG-island No: 14242
taccaaaattccccaaccctatattcccgcgacctttaaaaaaaaaaaaccaaaacctaaacgttcccctcccgcgtaattttcccgtcaacaactttcgtctacaaaaaaaaacgacgaccccacccgcaaacaactacgaaacaccgcgccaaacgtatacgcctattcccaaacactccctcctccgccttcacccttttaccacctccgccctccacccaaccccgccgtacgcctacgcgccccgacccgtaaaccaacgaacaatctactcacgtaaacctccgcataacccaacgccgccaaaaacaaaacgaaacctcgcgatcgccccgccccctccgtaccccgcctcctataaaaaacgcgaaaccctcgactaacgcgaacacttcccaacccaacccgaaacgccgacttcgccgcgtacgcgtacgcataataaaatttaactaactacgaaatacgatcgaaaccgccgaaaccgcaaactccaataaaaaaacgacgtaccgcgaccgacttcgataaaaaaaaaaacgtttccccg

SEQ ID NO: 14243 - DNA, 553 bp, Artificial Sequence
  chemically treated genomic DNA (Homo sapiens) CpG-island No: 14243
tgttaggattttttagttttatgttttcgcggtttttgaggggaaagggttagggtttagacgtttttttttcgcgtggttttttcgttagtagttttcgtttgtaagggaaagcggcggttttattcgtagatagttgcgaggtatcgcgttaagcgtatgcgtttgtttttaggtattttttttttcgtttttatttttttgttattttcgttttttatttagtttcgtcgtgcgtttgcgcgtttcggttcgtgggttagcgggtagtttatttacgtgggttttcgtatggtttagcgtcgttaagggtaaggcggagtttcgcgatcgtttcgtttttttcgtgtttcgttttttgtagggagcgcgggattttcggttggcgcgggtattttttagtttagttcggggcgtcggtttcgtcgcgtgcgcgtgcgtatggtggggtttggttggttgcgggatgcggtcgaggtcgtcgaggtcgtaaattttagtgggaaggcggcgtgtcgcggtcggtttcggtggaggagggggcgttttttcg

SEQ ID NO: 14244 - DNA, 553 bp, Artificial Sequence
  chemically treated genomic DNA (Homo sapiens) CpG-island No: 14244
cgaaaaaacgccccctcctccaccgaaaccgaccgcgacacgccgccttcccactaaaatttacgacctcgacgacctcgaccgcatcccgcaaccaaccaaaccccaccatacgcacgcgcacgcgacgaaaccgacgccccgaactaaactaaaaaatacccgcgccaaccgaaaatcccgcgctccctacaaaaaacgaaacacgaaaaaaacgaaacgatcgcgaaactccgccttacccttaacgacgctaaaccatacgaaaacccacgtaaataaactacccgctaacccacgaaccgaaacgcgcaaacgcacgacgaaactaaataaaaaacgaaaataacaaaaaaataaaaacgaaaaaaaaaatacctaaaaacaaacgcatacgcttaacgcgatacctcgcaactatctacgaataaaaccgccgctttcccttacaaacgaaaactactaacgaaaaaaccacgcgaaaaaaaaacgtctaaaccctaaccctttcccctcaaaaaccgcgaaaacataaaactaaaaaatcctaaca

SEQ ID NO: 14245 - DNA, 577 bp, Artificial Sequence
  chemically treated genomic DNA (Homo sapiens) CpG-island No: 14245
  misc_feature (398)..(398): n is either a, c, g or t
gcgacgatcgtagcggacgagatttcgttgtttgtatttcgattttggtataatttttatagttttatattttttgggtttcgcgtgtagatttttaaggatacgtatcgttttttttatatttttttttagacgtatattttttttattttcggatagcgatacgtttttattcgtagagttatattcgtcgttacgttttaattatatacgattttttcgcgtacgagtgttattacgtgcgtcgtcgtatatatttttatttcgtattgttttttattttacgagttacgttatagcgtagtttacgtttgtttacgttagcggatttcgcgatatcgttattacgcgacgtttttatttttatttttacgagtttatgttcgacgacgagatangacggatttttttcgttagattaggtttcgacgtagtcgttacgttaataattttttttttagtttttttttagtcgtagtattattcgcgcgtttttttcgtttcggttatcggttcgtaagtgtttatttaattttttgtttttattatttttttaattatttaaggttaatattgt

SEQ ID NO: 14246 - DNA, 577 bp, Artificial Sequence
  chemically treated genomic DNA (Homo sapiens) CpG-island No: 14246
  misc_feature (180)..(180): n is either a, c, g or t
acaatattaaccttaaataattaaaaaaataataaaaacaaaaaattaaataaacacttacgaaccgataaccgaaacgaaaaaaacgcgcgaataatactacgactaaaaaaaaactaaaaaaaaaattattaacgtaacgactacgtcgaaacctaatctaacgaaaaaaatccgtcntatctcgtcgtcgaacataaactcgtaaaaataaaaataaaaacgtcgcgtaataacgatatcgcgaaatccgctaacgtaaacaaacgtaaactacgctataacgtaactcgtaaaataaaaaacaatacgaaataaaaatatatacgacgacgcacgtaataacactcgtacgcgaaaaaatcgtatataattaaaacgtaacgacgaatataactctacgaataaaaacgtatcgctatccgaaaataaaaaaaatatacgtctaaaaaaaaatataaaaaaaacgatacgtatccttaaaaatctacacgcgaaacccaaaaaatataaaactataaaaattataccaaaatcgaaatacaaacaacgaaatctcgtccgctacgatcgtcgc

SEQ ID NO: 14247 - DNA, 577 bp, Artificial Sequence
  chemically treated genomic DNA (Homo sapiens) CpG-island No: 14247
  misc_feature (180)..(180): n is either a, c, g or t
ataatgttggttttgagtaattaggaaaataataaaggtaaggagttgggtgaatatttacgaatcgatggtcggggcgagagaggcgcgcgagtggtgttgcggttggagaggggttggagggagagttattgacgtgacggttgcgtcgggatttagtttggcggaagaaattcgttntgtttcgtcgtcgagtatggattcgtggagatgaaaatgaggacgtcgcgtggtggcgatgtcgcggagttcgttagcgtgggtagacgtggattgcgttgtggcgtggttcgtggggtgaggaataatacgaaatggagatatgtgcggcgacgtacgtggtgatattcgtgcgcggaggagtcgtgtgtgattggggcgtaacggcgggtgtagttttgcggatgggagcgtgtcgttgttcggggatgagggaggtgtgcgtttgagagggggtgtgagaaaggcggtgcgtgtttttaaaggtttatacgcggagtttagagagtgtggggttgtgaaggttatgttagagtcgaggtgtaggtagcggggtttcgttcgttgcggtcgtcgt

SEQ ID NO: 14248 - DNA, 577 bp, Artificial Sequence
  chemically treated genomic DNA (Homo sapiens) CpG-island No: 14248
  misc_feature (398)..(398): n is either a, c, g or t
acgacgaccgcaacgaacgaaaccccgctacctacacctcgactctaacataaccttcacaaccccacactctctaaactccgcgtataaacctttaaaaacacgcaccgcctttctcacaccccctctcaaacgcacacctccctcatccccgaacaacgacacgctcccatccgcaaaactacacccgccgttacgccccaatcacacacgactcctccgcgcacgaatatcaccacgtacgtcgccgcacatatctccatttcgtattattcctcaccccacgaaccacgccacaacgcaatccacgtctacccacgctaacgaactccgcgacatcgccaccacgcgacgtcctcattttcatctccacgaatccatactcgacgacgaaacanaacgaatttcttccgccaaactaaatcccgacgcaaccgtcacgtcaataactctccctccaacccctctccaaccgcaacaccactcgcgcgcctctctcgccccgaccatcgattcgtaaatattcacccaactccttacctttattattttcctaattactcaaaaccaacattat

SEQ ID NO: 14249 - DNA, 505 bp, Artificial Sequence
  chemically treated genomic DNA (Homo sapiens) CpG-island No: 14249
ttgaaaagcggttttcgatagggcgcggcgggaattcgagtcgggagtagggttacgagttaaagcggcgggggcgggaggatgcgcgggcggcggacggggcgtttttttttcgtttgattttgggcggagcggggttcgaggttgttggagtcgttcgttgattcgttttgcgttttcgtcgcggatatcggagttgcggtcgtttttcgttgttttttaggtgagttcgcggggcgttgtttcggggcgtcgggtgtcgcgggaacggcgttcgcggcgtatagggagggtcggggaggtcgggaggtagcgagttgtcggggacgtcgcgggaaggtcgggtcgggtagtcggcgttatggagggtaggcgggttggagttgggcgcgagatgtagttgtttcgcgtcgtttttaagtcgttcgtaggttagtggaggagcgcgtttgtcgggtttgttcggggttgggcgggtgggggtgttttgtttttcggttttttt

SEQ ID NO: 14250 - DNA, 505 bp, Artificial Sequence
  chemically treated genomic DNA (Homo sapiens) CpG-island No: 14250
aaaaaaaccgaaaaacaaaacacccccacccgcccaaccccgaacaaacccgacaaacgcgctcctccactaacctacgaacgacttaaaaacgacgcgaaacaactacatctcgcgcccaactccaacccgcctaccctccataacgccgactacccgacccgaccttcccgcgacgtccccgacaactcgctacctcccgacctccccgaccctccctatacgccgcgaacgccgttcccgcgacacccgacgccccgaaacaacgccccgcgaactcacctaaaaaacaacgaaaaacgaccgcaactccgatatccgcgacgaaaacgcaaaacgaatcaacgaacgactccaacaacctcgaaccccgctccgcccaaaatcaaacgaaaaaaaaacgccccgtccgccgcccgcgcatcctcccgcccccgccgctttaactcgtaaccctactcccgactcgaattcccgccgcgccctatcgaaaaccgcttttcaa

SEQ ID NO: 14251 - DNA, 505 bp, Artificial Sequence
  chemically treated genomic DNA (Homo sapiens) CpG-island No: 14251
agggggatcgaggagtagagtatttttattcgtttagtttcgggtaggttcggtaggcgcgtttttttattgatttgcgggcggtttgggggcggcgcggaatagttgtatttcgcgtttagttttagttcgtttgttttttatggcgtcgattgttcggttcggttttttcgcggcgttttcgatagttcgttgtttttcggttttttcggttttttttgtgcgtcgcgggcgtcgttttcgcgatattcgacgtttcggggtagcgtttcgcgggtttatttgggggatagcggggagcggtcgtagtttcggtgttcgcggcgagggcgtagggcgagttagcgagcgattttagtagtttcgagtttcgtttcgtttagagttagacgggaggagagcgtttcgttcgtcgttcgcgtattttttcgttttcgtcgttttaattcgtgattttattttcggttcgggttttcgtcgcgttttgtcgggggtcgttttttag

SEQ ID NO: 14252 - DNA, 505 bp, Artificial Sequence
  chemically treated genomic DNA (Homo sapiens) CpG-island No: 14252
ctaaaaaacgacccccgacaaaacgcgacgaaaacccgaaccgaaaataaaatcacgaattaaaacgacgaaaacgaaaaaatacgcgaacgacgaacgaaacgctctcctcccgtctaactctaaacgaaacgaaactcgaaactactaaaatcgctcgctaactcgccctacgccctcgccgcgaacaccgaaactacgaccgctccccgctatcccccaaataaacccgcgaaacgctaccccgaaacgtcgaatatcgcgaaaacgacgcccgcgacgcacaaaaaaaaccgaaaaaaccgaaaaacaacgaactatcgaaaacgccgcgaaaaaaccgaaccgaacaatcgacgccataaaaaacaaacgaactaaaactaaacgcgaaatacaactattccgcgccgcccccaaaccgcccgcaaatcaataaaaaaacgcgcctaccgaacctacccgaaactaaacgaataaaaatactctactcctcgatccccct

SEQ ID NO: 14253 - DNA, 541 bp, Artificial Sequence
  chemically treated genomic DNA (Homo sapiens) CpG-island No: 14253
ttcggaataggaaatatcgtttacggtcgatttatttcgttttcgtcgtaacgcgttcgtcgaagttggagttttgtaaagcggggttttttttttttattttttttgtcggtcgcgtggtgcgcgtagatttcggttcgagagtaggcgtcgtagtcgtggagtgcggcgggtagttttcgggcggttgaaaggcggttttgtgtgtattttgtaggatgcggcgcgtggttaggcgttttcgtttcgtttttaaggggttgtttcgtttcgtttcgtttcgtcgttttttatcggggatcggagtttttttagttggggttttaggggatttattttacgttttagcggattagttttttcgcgttttcggagaagggggtcggcgacgcggaggcggggtgggggtcgtaggggatggaatcgaggcgcgcgcgagaagagtcgaggaagtaagtagttttaaaagggggcggcggtggggtttttagggaggcgtggggtacgttaagggcgtcgtggggtattgatttgtggtgcg

SEQ ID NO: 14254 - DNA, 541 bp, Artificial Sequence
  chemically treated genomic DNA (Homo sapiens) CpG-island No: 14254
cgcaccacaaatcaataccccacgacgcccttaacgtaccccacgcctccctaaaaaccccaccgccgcccccttttaaaactacttacttcctcgactcttctcgcgcgcgcctcgattccatcccctacgacccccaccccgcctccgcgtcgccgacccccttctccgaaaacgcgaaaaaactaatccgctaaaacgtaaaataaatcccctaaaaccccaactaaaaaaactccgatccccgataaaaaacgacgaaacgaaacgaaacgaaacaaccccttaaaaacgaaacgaaaacgcctaaccacgcgccgcatcctacaaaatacacacaaaaccgcctttcaaccgcccgaaaactacccgccgcactccacgactacgacgcctactctcgaaccgaaatctacgcgcaccacgcgaccgacaaaaaaaataaaaaaaaaaaaccccgctttacaaaactccaacttcgacgaacgcgttacgacgaaaacgaaataaatcgaccgtaaacgatatttcctattccgaa

SEQ ID NO: 14255 - DNA, 541 bp, Artificial Sequence
  chemically treated genomic DNA (Homo sapiens) CpG-island No: 14255
cgtattataggttagtgttttacggcgtttttggcgtgttttacgtttttttgggggttttatcgtcgtttttttttgggattgtttattttttcggtttttttcgcgcgcgtttcggttttattttttacggtttttatttcgttttcgcgtcgtcgattttttttttcgggagcgcggggaggttggttcgttgaagcgtggaataagttttttaggattttaattggggaagtttcggttttcggtaggaggcggcggggcggggcggggcggggtagttttttgggggcggggcgggagcgtttggttacgcgtcgtattttgtagggtgtatatagagtcgttttttagtcgttcgagaattgttcgtcgtattttacgattgcggcgtttgttttcgggtcggggtttgcgcgtattacgcggtcggtagaaagggtaagagaagggaatttcgttttgtagggttttaatttcggcggacgcgttacggcgagggcgaaatgagtcggtcgtgaacggtgttttttgtttcgaa

SEQ ID NO: 14256 - DNA, 541 bp, Artificial Sequence
  chemically treated genomic DNA (Homo sapiens) CpG-island No: 14256
ttcgaaacaaaaaacaccgttcacgaccgactcatttcgccctcgccgtaacgcgtccgccgaaattaaaaccctacaaaacgaaattcccttctcttaccctttctaccgaccgcgtaatacgcgcaaaccccgacccgaaaacaaacgccgcaatcgtaaaatacgacgaacaattctcgaacgactaaaaaacgactctatatacaccctacaaaatacgacgcgtaaccaaacgctcccgccccgcccccaaaaaactaccccgccccgccccgccccgccgcctcctaccgaaaaccgaaacttccccaattaaaatcctaaaaaacttattccacgcttcaacgaaccaacctccccgcgctcccgaaaaaaaaaatcgacgacgcgaaaacgaaataaaaaccgtaaaaaataaaaccgaaacgcgcgcgaaaaaaaccgaaaaaataaacaatcccaaaaaaaaacgacgataaaacccccaaaaaaacgtaaaacacgccaaaaacgccgtaaaacactaacctataatacg

SEQ ID NO: 14257 - DNA, 528 bp, Artificial Sequence
  chemically treated genomic DNA (Homo sapiens) CpG-island No: 14257
ttgtttagcgttgagtgagttcgtagacgattgatttgtgttgatcgtttgtgtgtgcgtgtttggttaggttttcgtatgcggttcgttttcgagcgtgtgtggcgtttcgggtcgcggaaggttttttgtattgaattttatagttcgagcggtagcgttacgaaatttattgggcgtgttatgggttgtttgtaagagatatggtagagggtcgggtgggtttatcgtagatataattggtttcgatttttattcggataggatttgcgtggcgtaatcgttacggtaacggtaagtgtaatgataatcgttcgtaaaggttttgcgaatttgttttgtgtaagtttatcggtaaaggttgcgcgttacggagtgtatatggttttttaagtgggacgggtattcgcgcgcgcgtgtgtttgcgtgtgtgtacgcgtattcgtttgtggcgtgttacgtgttttggtttgttaagaattttttatagagagtgtgtttgggggaagttatatatattagagtttt

SEQ ID NO: 14258 - DNA, 528 bp, Artificial Sequence
  chemically treated genomic DNA (Homo sapiens) CpG-island No: 14258
aaaactctaatatatataacttcccccaaacacactctctataaaaaattcttaacaaaccaaaacacgtaacacgccacaaacgaatacgcgtacacacacgcaaacacacgcgcgcgcgaatacccgtcccacttaaaaaaccatatacactccgtaacgcgcaacctttaccgataaacttacacaaaacaaattcgcaaaacctttacgaacgattatcattacacttaccgttaccgtaacgattacgccacgcaaatcctatccgaataaaaatcgaaaccaattatatctacgataaacccacccgaccctctaccatatctcttacaaacaacccataacacgcccaataaatttcgtaacgctaccgctcgaactataaaattcaatacaaaaaaccttccgcgacccgaaacgccacacacgctcgaaaacgaaccgcatacgaaaacctaaccaaacacgcacacacaaacgatcaacacaaatcaatcgtctacgaactcactcaacgctaaacaa

SEQ ID NO: 14259 - DNA, 528 bp, Artificial Sequence
  chemically treated genomic DNA (Homo sapiens) CpG-island No: 14259
agagttttgatgtgtgtggttttttttaggtatattttttatgaggaatttttagtaaattagggtacgtagtacgttataggcgagtacgcgtgtatatacgtaggtatacgcgcgcgcgggtgttcgttttatttgaaaggttatgtgtatttcgtggcgcgtagtttttatcggtaagtttgtataagatagattcgtagggtttttgcgggcgattattattatatttgtcgttatcgtgacggttacgttacgtaaattttgttcgaatgggaatcgagattagttgtgtttacggtgggtttattcgattttttattatgttttttatagatagtttatggtacgtttagtgagtttcgtgacgttatcgttcgggttatgaagtttagtgtagaaggtttttcgcgattcgaagcgttatatacgttcggaggcgggtcgtatgcgagggtttagttaggtacgtatatataggcggttagtataagttaatcgtttacggatttatttagcgttaggtaa

SEQ ID NO: 14260 - DNA, 528 bp, Artificial Sequence
  chemically treated genomic DNA (Homo sapiens) CpG-island No: 14260
ttacctaacgctaaataaatccgtaaacgattaacttatactaaccgcctatatatacgtacctaactaaaccctcgcatacgacccgcctccgaacgtatataacgcttcgaatcgcgaaaaaccttctacactaaacttcataacccgaacgataacgtcacgaaactcactaaacgtaccataaactatctataaaaaacataataaaaaatcgaataaacccaccgtaaacacaactaatctcgattcccattcgaacaaaatttacgtaacgtaaccgtcacgataacgacaaatataataataatcgcccgcaaaaaccctacgaatctatcttatacaaacttaccgataaaaactacgcgccacgaaatacacataacctttcaaataaaacgaacacccgcgcgcgcgtatacctacgtatatacacgcgtactcgcctataacgtactacgtaccctaatttactaaaaattcctcataaaaaatatacctaaaaaaaaccacacacatcaaaactct

SEQ ID NO: 14261 - DNA, 563 bp, Artificial Sequence
  chemically treated genomic DNA (Homo sapiens) CpG-island No: 14261
cgttcgagcggggtaaagattcgtttaggttgtttttataggcgagcgcggggcgggtttggttgggggcggtgtcgcgcggtttcgttcgtttataaggagttgttcgttattcgggtgttgattttagttttcgcgttcgacgaggtggatttggttgtttatcgagtttcggcgtttgtcgttttaattgggtttggatttgtatcgttaaggaggggggaagagaaggaagaggcgggcgaggaaggcgagtttagttagcggttgttgcggggatcgtagttttagttgtagtttcgaagaatttttcgttacggtttcggtggagcgtttgggtacgggatggagtgaaagagcgagtgtttttttaagcgggggtgggagggggttaggttgtgtagaggagagagatagcgagaagaagtcgcggttggttattgcgaatttgggattcgattgggagggatcgtttattcgggggaaatggattttttattacggttgattagcgttttgattttgttgttttttggtttgtggtatttaggattaatagcgat

SEQ ID NO: 14262 - DNA, 563 bp, Artificial Sequence
  chemically treated genomic DNA (Homo sapiens) CpG-island No: 14262
atcgctattaatcctaaataccacaaaccaaaaaacaacaaaatcaaaacgctaatcaaccgtaataaaaaatccatttcccccgaataaacgatccctcccaatcgaatcccaaattcgcaataaccaaccgcgacttcttctcgctatctctctcctctacacaacctaaccccctcccacccccgcttaaaaaaacactcgctctttcactccatcccgtacccaaacgctccaccgaaaccgtaacgaaaaattcttcgaaactacaactaaaactacgatccccgcaacaaccgctaactaaactcgccttcctcgcccgcctcttccttctcttcccccctccttaacgatacaaatccaaacccaattaaaacgacaaacgccgaaactcgataaacaaccaaatccacctcgtcgaacgcgaaaactaaaatcaacacccgaataacgaacaactccttataaacgaacgaaaccgcgcgacaccgcccccaaccaaacccgccccgcgctcgcctataaaaacaacctaaacgaatctttaccccgctcgaacg

SEQ ID NO: 14263 - DNA, 563 bp, Artificial Sequence
  chemically treated genomic DNA (Homo sapiens) CpG-island No: 14263
gtcgttgttaattttaaatgttataagttagagaatagtaaagttaaaacgttggttagtcgtggtaaagaatttatttttttcgagtgagcggttttttttaatcgaattttaaattcgtagtagttagtcgcggttttttttcgttgttttttttttttgtatagtttgatttttttttattttcgtttggagaggtattcgtttttttattttatttcgtgtttagacgttttatcgaaatcgtggcgggggatttttcggagttgtagttggggttacggttttcgtaatagtcgttagttggattcgtttttttcgttcgttttttttttttttttttttttttttaacggtgtaaatttaaatttaattagaacgataggcgtcggagttcggtggatagttaaatttatttcgtcgggcgcgagagttggaattagtattcgggtggcggatagttttttataggcgagcggggtcgcgcggtatcgtttttagttaggttcgtttcgcgttcgtttataagagtagtttgggcgggtttttgtttcgttcgggcg

SEQ ID NO: 14264 - DNA, 563 bp, Artificial Sequence
  chemically treated genomic DNA (Homo sapiens) CpG-island No: 14264
cgcccgaacgaaacaaaaacccgcccaaactactcttataaacgaacgcgaaacgaacctaactaaaaacgataccgcgcgaccccgctcgcctataaaaaactatccgccacccgaatactaattccaactctcgcgcccgacgaaataaatttaactatccaccgaactccgacgcctatcgttctaattaaatttaaatttacaccgttaaaaaaaaaaaaaaaaaaaaaaaaaacgaacgaaaaaaacgaatccaactaacgactattacgaaaaccgtaaccccaactacaactccgaaaaatcccccgccacgatttcgataaaacgtctaaacacgaaataaaataaaaaaacgaatacctctccaaacgaaaataaaaaaaaatcaaactatacaaaaaaaaaaaacaacgaaaaaaaaccgcgactaactactacgaatttaaaattcgattaaaaaaaaccgctcactcgaaaaaaataaattctttaccacgactaaccaacgttttaactttactattctctaacttataacatttaaaattaacaacgac

SEQ ID NO: 14265 - DNA, 558 bp, Artificial Sequence
  chemically treated genomic DNA (Homo sapiens) CpG-island No: 14265
  misc_feature (16)..(16): n is either a, c, g or t
  misc_feature (23)..(24): n is either a, c, g or t
  misc_feature (36)..(36): n is either a, c, g or t
  misc_feature (49)..(49): n is either a, c, g or t
  misc_feature (85)..(85): n is either a, c, g or t
  misc_feature (140)..(140): n is either a, c, g or t
  misc_feature (184)..(184): n is either a, c, g or t
cgcgttcgcgcgtttncgcggtnntttcgcgggttntcggtcgtcggtntcggtttcggtcgcgtcgtcgttcgcgggttcggtntcggttcgggttcggggtttcgcgcgttcgtcgtcgcgcgtcgcgtcgttcgttntcggtcggcgcggttcgttttcgtcggcgttcggggtcggcgtngttcgtcgcgcggggcggcggcggggtcgttcgttcgtaagtcggcgattttcgtcggtaagcgtcgtcgcgtacggtaattcgttacgcggagaagagatacgtaggcgtttatcgataatagcgttacgatgattcgtattttatgttttttcgtttatgtttttttgttacgtgtatttgcgttttcgcgtttacgtattttttgtgcgggtttaagcgtatttgttgattgttcgtacggttggcgtgatattgcgtttagtgattatcgtttatggcgaataagtttgattcgtcgattggtgatatcgtggtgtttgagtaaattgtagttatgtttatagttgatcgaggagtggaggattttttgt

SEQ ID NO: 14266 - DNA, 558 bp, Artificial Sequence
  chemically treated genomic DNA (Homo sapiens) CpG-island No: 14266
  misc_feature (375)..(375): n is either a, c, g or t
  misc_feature (419)..(419): n is either a, c, g or t
  misc_feature (474)..(474): n is either a, c, g or t
  misc_feature (510)..(510): n is either a, c, g or t
  misc_feature (523)..(523): n is either a, c, g or t
  misc_feature (535)..(536): n is either a, c, g or t
  misc_feature (543)..(543): n is either a, c, g or t
acaaaaaatcctccactcctcgatcaactataaacataactacaatttactcaaacaccacgatatcaccaatcgacgaatcaaacttattcgccataaacgataatcactaaacgcaatatcacgccaaccgtacgaacaatcaacaaatacgcttaaacccgcacaaaaaatacgtaaacgcgaaaacgcaaatacacgtaacaaaaaaacataaacgaaaaaacataaaatacgaatcatcgtaacgctattatcgataaacgcctacgtatctcttctccgcgtaacgaattaccgtacgcgacgacgcttaccgacgaaaatcgccgacttacgaacgaacgaccccgccgccgccccgcgcgacgaacnacgccgaccccgaacgccgacgaaaacgaaccgcgccgaccganaacgaacgacgcgacgcgcgacgacgaacgcgcgaaaccccgaacccgaaccganaccgaacccgcgaacgacgacgcgaccgaaaccganaccgacgaccganaacccgcgaaannaccgcgnaaacgcgcgaacgcg

SEQ ID NO: 14267 - DNA, 558 bp, Artificial Sequence
  chemically treated genomic DNA (Homo sapiens) CpG-island No: 14267
  misc_feature (375)..(375): n is either a, c, g or t
  misc_feature (419)..(419): n is either a, c, g or t
  misc_feature (474)..(474): n is either a, c, g or t
  misc_feature (510)..(510): n is either a, c, g or t
  misc_feature (523)..(523): n is either a, c, g or t
  misc_feature (535)..(536): n is either a, c, g or t
  misc_feature (543)..(543): n is either a, c, g or t
ataagggattttttatttttcggttagttatggatataattgtaatttatttagatattacggtattattagtcgacggattagatttgttcgttataggcggtagttattgaacgtagtgttacgttaatcgtacgagtagttagtaggtgcgtttgagttcgtataagaggtgcgtagacgcggaagcgtagatgtacgtggtagaggaatataagcgagagagtatggaatacgagttatcgtagcgttgttgtcggtagacgtttgcgtgtttttttttcgcgtggcgggttgtcgtgcgcggcggcgtttgtcggcgggggtcgtcggtttgcgggcgggcggtttcgtcgtcgtttcgcgcggcgggtngcgtcggtttcgggcgtcggcgggggcgggtcgcgtcggtcggnggcgggcggcgcggcgcgcggcggcgggcgcgcggggtttcgggttcgggtcggngtcgggttcgcgggcggcggcgcggtcggggtcggngtcggcggtcggnggttcgcggggnngtcgcgngggcgcgcgggcgcg

SEQ ID NO: 14268 - DNA, 558 bp, Artificial Sequence
  chemically treated genomic DNA (Homo sapiens) CpG-island No: 14268
  misc_feature (16)..(16): n is either a, c, g or t
  misc_feature (23)..(24): n is either a, c, g or t
  misc_feature (36)..(36): n is either a, c, g or t
  misc_feature (49)..(49): n is either a, c, g or t
  misc_feature (85)..(85): n is either a, c, g or t
  misc_feature (140)..(140): n is either a, c, g or t
  misc_feature (184)..(184): n is either a, c, g or t
cgcgcccgcgcgcccncgcgacnnccccgcgaaccnccgaccgccgacnccgaccccgaccgcgccgccgcccgcgaacccgacnccgacccgaacccgaaaccccgcgcgcccgccgccgcgcgccgcgccgcccgccnccgaccgacgcgacccgcccccgccgacgcccgaaaccgacgcnacccgccgcgcgaaacgacgacgaaaccgcccgcccgcaaaccgacgacccccgccgacaaacgccgccgcgcacgacaacccgccacgcgaaaaaaaaacacgcaaacgtctaccgacaacaacgctacgataactcgtattccatactctctcgcttatattcctctaccacgtacatctacgcttccgcgtctacgcacctcttatacgaactcaaacgcacctactaactactcgtacgattaacgtaacactacgttcaataactaccgcctataacgaacaaatctaatccgtcgactaataataccgtaatatctaaataaattacaattatatccataactaaccgaaaaataaaaaatcccttat

SEQ ID NO: 14269 - DNA, 1061 bp, Artificial Sequence
  chemically treated genomic DNA (Homo sapiens) CpG-island No: 14269
ggggttaggtaggacgtcggagtataggagcgggcgtagatgtagcgattgtaggcggttggtcgcgttttttgtttcggttttattgtttgtcgaaaatgttgagggtagtaagtttggggaaggtttggtagcggtcgttagtcgtagtaagtgcgttataatagagtttgtaattttagcgcggttcggttcggttttggcgtttttttcgttcgtgttttttttttttcgttttcgtatcgtacgtcgtatcgaattagatagaatttttttgaggtgtatatcgtgaggtgtatatttttaaatggggagggggcggcggagggcgacgaagcgaacgtttgtaaggtttataattaggttcgtaggttaggcgatatcggtgcgcgtcgcgtcgtttttattttatagattttttttttagaaggtaattatatcgaaatttacgttcgcgttttttttttagagcgtagcgttcgggttagggattaagtttcgcggcgttcggttcgcgtttttcgtcgatcgggcgttttttgatcgttattacgaaagtagcgtaggagataaagttcgggattcgggtttagagttttcggcgtagcgtaaagttcgcgttttttcgttagttcgtcgtcgcgtttcgtcgggtagtcgagggtttcgtacgtcgcgtttttggttcgcgttgtttcggtcgtagtcgtcgggaatatttttcgttttttttcgttttttttttcgcgttttgcgttcgtcgtcgtcggtatcgtcgattttttcgcgtcgttggcgtcgggtgttcgcgtttttaattggttcgcgcgcggtcgtttcgcgtcgtagttaatcggtagtcgcggtgggggcggcgtttacgggttaggtcgttaaaggcgaggcgattgttgataaattcgttttcgagcgttgttttggtcgtggtcgtggcggttgtcgtttcgtcggaggatttgagggtcggttggttcggttattttgtttatttttgtgtttttttcggatataagttttagtagttttcgtcgttttggata

SEQ ID NO: 14270 - DNA, 1061 bp, Artificial Sequence
  chemically treated genomic DNA (Homo sapiens) CpG-island No: 14270
tatccaaaacgacgaaaactactaaaacttatatccgaaaaaaacacaaaaataaacaaaataaccgaaccaaccgaccctcaaatcctccgacgaaacgacaaccgccacgaccacgaccaaaacaacgctcgaaaacgaatttatcaacaatcgcctcgcctttaacgacctaacccgtaaacgccgcccccaccgcgactaccgattaactacgacgcgaaacgaccgcgcgcgaaccaattaaaaacgcgaacacccgacgccaacgacgcgaaaaaatcgacgataccgacgacgacgaacgcaaaacgcgaaaaaaaaaacgaaaaaaaacgaaaaatattcccgacgactacgaccgaaacaacgcgaaccaaaaacgcgacgtacgaaaccctcgactacccgacgaaacgcgacgacgaactaacgaaaaaacgcgaactttacgctacgccgaaaactctaaacccgaatcccgaactttatctcctacgctactttcgtaataacgatcaaaaaacgcccgatcgacgaaaaacgcgaaccgaacgccgcgaaacttaatccctaacccgaacgctacgctctaaaaaaaaaacgcgaacgtaaatttcgatataattaccttctaaaaaaaaaatctataaaataaaaacgacgcgacgcgcaccgatatcgcctaacctacgaacctaattataaaccttacaaacgttcgcttcgtcgccctccgccgccccctccccatttaaaaatatacacctcacgatatacacctcaaaaaaattctatctaattcgatacgacgtacgatacgaaaacgaaaaaaaaaaaacacgaacgaaaaaaacgccaaaaccgaaccgaaccgcgctaaaattacaaactctattataacgcacttactacgactaacgaccgctaccaaaccttccccaaacttactaccctcaacattttcgacaaacaataaaaccgaaacaaaaaacgcgaccaaccgcctacaatcgctacatctacgcccgctcctatactccgacgtcctacctaacccc

SEQ ID NO: 14271 - DNA, 1061 bp, Artificial Sequence
  chemically treated genomic DNA (Homo sapiens) CpG-island No: 14271
tgtttaggacggcgggagttgttaaggtttgtgttcggaaggagtatagggatgggtagggtggtcgggttagtcggtttttaaatttttcgacgaagcggtagtcgttacgattacggttagagtagcgttcggaggcgagtttgttaataatcgtttcgtttttggcggtttgattcgtaggcgtcgtttttatcgcggttgtcgattggttgcggcgcggagcgatcgcgcgcggattaattgggaacgcgggtattcggcgttagcggcgcggggaggtcggcggtgtcggcggcggcgggcgtagagcgcgaggggaggagcgggaggaggcggaggatgttttcggcggttgcggtcggggtagcgcgggttagaggcgcggcgtgcggagttttcggttgttcggcggagcgcggcggcgggttggcgggaaggcgcgggttttgcgttgcgtcggggattttgaattcgagtttcgggttttgttttttgcgttgttttcgtggtgacggttagggggcgttcggtcggcgaagggcgcgggtcggacgtcgcggggtttggtttttggttcggacgttgcgttttgaagggaaggcgcggacgtgagtttcggtgtgattgttttttgaggggagggtttgtgggatgaaggcggcgcggcgcgtatcggtgtcgtttagtttgcggatttagttgtagattttgtaggcgttcgtttcgtcgtttttcgtcgttttttttttatttagagatgtgtattttacggtgtgtattttagagaagttttgtttgattcggtgcggcgtgcggtacgggagcgggagggagggagtacgggcggagagagcgttagagtcgggtcgagtcgcgttggagttataaattttattgtgacgtatttattacgattgacggtcgttgttagattttttttagatttgttgtttttagtattttcggtaaataatggggtcggagtagggaacgcggttagtcgtttgtaatcgttgtatttgcgttcgtttttgtgtttcggcgttttatttaatttt

SEQ ID NO: 14272 - DNA, 1061 bp, Artificial Sequence
  chemically treated genomic DNA (Homo sapiens) CpG-island No: 14272
aaaattaaataaaacgccgaaacacaaaaacgaacgcaaatacaacgattacaaacgactaaccgcgttccctactccgaccccattatttaccgaaaatactaaaaacaacaaatctaaaaaaaatctaacaacgaccgtcaatcgtaataaatacgtcacaataaaatttataactccaacgcgactcgacccgactctaacgctctctccgcccgtactccctccctcccgctcccgtaccgcacgccgcaccgaatcaaacaaaacttctctaaaatacacaccgtaaaatacacatctctaaataaaaaaaaaacgacgaaaaacgacgaaacgaacgcctacaaaatctacaactaaatccgcaaactaaacgacaccgatacgcgccgcgccgccttcatcccacaaaccctcccctcaaaaaacaatcacaccgaaactcacgtccgcgccttcccttcaaaacgcaacgtccgaaccaaaaaccaaaccccgcgacgtccgacccgcgcccttcgccgaccgaacgccccctaaccgtcaccacgaaaacaacgcaaaaaacaaaacccgaaactcgaattcaaaatccccgacgcaacgcaaaacccgcgccttcccgccaacccgccgccgcgctccgccgaacaaccgaaaactccgcacgccgcgcctctaacccgcgctaccccgaccgcaaccgccgaaaacatcctccgcctcctcccgctcctcccctcgcgctctacgcccgccgccgccgacaccgccgacctccccgcgccgctaacgccgaatacccgcgttcccaattaatccgcgcgcgatcgctccgcgccgcaaccaatcgacaaccgcgataaaaacgacgcctacgaatcaaaccgccaaaaacgaaacgattattaacaaactcgcctccgaacgctactctaaccgtaatcgtaacgactaccgcttcgtcgaaaaatttaaaaaccgactaacccgaccaccctacccatccctatactccttccgaacacaaaccttaacaactcccgccgtcctaaaca

SEQ ID NO: 14273 - DNA, 1465 bp, Artificial Sequence
  chemically treated genomic DNA (Homo sapiens) CpG-island No: 14273
tcgtgtttcgttagttaaattattatcgtagtttcgtaaatttttcgtaataggtttacgcgttttaaaaaattaagatacgaaatatttttatattgcgcggtcgttattttgagggcgtcggagtcggcggcgagattttttagttgggcgtatagttcgatattacgagtaggtttttagttttcgggtcggcgtcgaaaggtacgcgttgtttttttttttgttcggatttacgattttttattaggttcgcgcgtagtatttcgttttaagtcgtatttcggttaagagtttgtaggtttcgcgtgaacgatttttttttaaagagaatttgttcgagagggaattcgatttatacggatttttatttttcgtcggcgataagcggcgtcgatgtaagcgttttcgttcgtacgtgtacgggaagcgggtagtaggtggtgtcgttcgggttttagcgttagttttttttcggtgttaggttcgcgtttcgggatttggaggtatttattttgcgttttttagttcgagagttagagttagatatttgggggaataagggttaagaaagggcgtcgaggcggtggcggcgggaacgtagcgaatcgaatatcgcgatgatgcgatcgtagtgtggtagggttcgtagggtggttgtaagaattaagtggtggtagtggcggcggcggcggcggcggcggcggcggcggcggcggcggtagcggtagcggcgttggacgtagagttttaataaattgtagattaggcggttgcgcggagcgaagtgaaatttgcgcggttttgtagtttagttttggttggcggtttcgtttttacgtttaattattgcggatttcgttttcgttaggtttcgtttcggcgcgcgggttggtaagtttcgtttttttcggcgtcgcggtcgtcggcgcgtgtaggttcggataggtaaaggcgggggttgtttcgttgggttgtttttcgcgcgcgtcgtcgtttttggcgtgtttatcggagtaattttgtttgttggcggttatgtgcgcgtttattttttatttcgaagtgtattttagtttttcgtttatttattttaattcggcggcggtcgcggcgtgcgcggtatagagggggcgtttcggttatagttttcgttggttcggtcggcggtgtgaagtttcgggaggcgttttgcgtttttattgtgttttgagtttttaagtcgttttggggtaggcgcggggattgggttggttttcgcgaaggcgcggggcgaggtttttgagtttttttttttttgagggtttttggcgtcgggcgggacgcggattagtaggttgcgtatttttttcgttcgggtttttcgcgggatttaggtattttttttttgttatttcgtaggggttttttagtttttttttcgcgtttagtcgttttaagagatagaggtcgtgggggtaggacg

SEQ ID NO: 14274 - DNA, 1465 bp, Artificial Sequence
  chemically treated genomic DNA (Homo sapiens) CpG-island No: 14274
cgtcctacccccacgacctctatctcttaaaacgactaaacgcgaaaaaaaaactaaaaaacccctacgaaataacaaaaaaaaaatacctaaatcccgcgaaaaacccgaacgaaaaaaatacgcaacctactaatccgcgtcccgcccgacgccaaaaaccctcaaaaaaaaaaaaactcaaaaacctcgccccgcgccttcgcgaaaaccaacccaatccccgcgcctaccccaaaacgacttaaaaactcaaaacacaataaaaacgcaaaacgcctcccgaaacttcacaccgccgaccgaaccaacgaaaactataaccgaaacgccccctctataccgcgcacgccgcgaccgccgccgaattaaaataaataaacgaaaaactaaaatacacttcgaaataaaaaataaacgcgcacataaccgccaacaaacaaaattactccgataaacacgccaaaaacgacgacgcgcgcgaaaaacaacccaacgaaacaacccccgcctttacctatccgaacctacacgcgccgacgaccgcgacgccgaaaaaaacgaaacttaccaacccgcgcgccgaaacgaaacctaacgaaaacgaaatccgcaataattaaacgtaaaaacgaaaccgccaaccaaaactaaactacaaaaccgcgcaaatttcacttcgctccgcgcaaccgcctaatctacaatttattaaaactctacgtccaacgccgctaccgctaccgccgccgccgccgccgccgccgccgccgccgccgccgccactaccaccacttaattcttacaaccaccctacgaaccctaccacactacgatcgcatcatcgcgatattcgattcgctacgttcccgccgccaccgcctcgacgccctttcttaacccttattcccccaaatatctaactctaactctcgaactaaaaaacgcaaaataaatacctccaaatcccgaaacgcgaacctaacaccgaaaaaaaactaacgctaaaacccgaacgacaccacctactacccgcttcccgtacacgtacgaacgaaaacgcttacatcgacgccgcttatcgccgacgaaaaataaaaatccgtataaatcgaattccctctcgaacaaattctctttaaaaaaaaatcgttcacgcgaaacctacaaactcttaaccgaaatacgacttaaaacgaaatactacgcgcgaacctaataaaaaatcgtaaatccgaacaaaaaaaaaaacaacgcgtacctttcgacgccgacccgaaaactaaaaacctactcgtaatatcgaactatacgcccaactaaaaaatctcgccgccgactccgacgccctcaaaataacgaccgcgcaatataaaaatatttcgtatcttaattttttaaaacgcgtaaacctattacgaaaaatttacgaaactacgataataatttaactaacgaaacacga

SEQ ID NO: 14275 - DNA, 1465 bp, Artificial Sequence
  chemically treated genomic DNA (Homo sapiens) CpG-island No: 14275
cgttttgtttttacggtttttgttttttagggcgattgggcgcggaagaaaagttggagagtttttgcggggtggtaggaggagggtgtttgagtttcgcgagaggttcgggcgaggaagatgcgtagtttgttgattcgcgtttcgttcggcgttagggatttttagagggaggagagtttaaagatttcgtttcgcgttttcgcgaggattaatttagttttcgcgtttgttttagagcggtttagaaatttagggtatagtgagagcgtagggcgtttttcgaggttttatatcgtcggtcgggttagcggaggttgtgatcggagcgttttttttgtgtcgcgtacgtcgcggtcgtcgtcgggttggggtaggtgagcgggaggttagggtatatttcggggtgggggatgggcgcgtatatggtcgttagtaggtagagttatttcggtaaatacgttagggacggcggcgcgcgcgggaggtaatttagcggggtaattttcgtttttatttgttcgagtttgtacgcgtcggcggtcgcggcgtcgaggggggcggagtttgttagttcgcgcgtcggggcgggatttagcgggggcggggttcgtagtgattgggcgtaggagcggggtcgttagttagagttgggttgtagggtcgcgtaggttttatttcgtttcgcgtagtcgtttggtttgtagtttgttggagttttgcgtttagcgtcgttgtcgttgtcgtcgtcgtcgtcgtcgtcgtcgtcgtcgtcgtcgtcgttattattattatttgatttttgtagttattttgcgaattttgttatattgcgatcgtattatcgcggtattcggttcgttgcgttttcgtcgttatcgtttcggcgtttttttttggtttttgtttttttaaatgtttgattttgattttcggattgagaaacgtaaggtaaatatttttaaatttcggggcgcgggtttggtatcgaaggaagattagcgttggagttcgaacggtattatttattgttcgtttttcgtgtacgtgcgagcggagacgtttgtatcggcgtcgtttgtcgtcggcgggaggtggggattcgtgtggatcgggttttttttcgggtaggttttttttaaagaaaagtcgtttacgcggaatttgtaggtttttggtcgaagtgcggtttgggacgggatgttgcgcgcgggtttggtgaagggtcgtaggttcgggtaggaggagaggtagcgcgtgtttttcggcgtcggttcgggagttgaggatttgttcgtagtatcgggttgtgcgtttagttggaaagtttcgtcgtcggtttcggcgtttttagagtagcggtcgcgtagtgtgagggtgtttcgtgttttggttttttggggcgcgtgggtttgttgcggaggatttgcggaattgcggtggtgatttaattgacgagatacgg

SEQ ID NO: 14276 - DNA, 1465 bp, Artificial Sequence
  chemically treated genomic DNA (Homo sapiens) CpG-island No: 14276
ccgtatctcgtcaattaaatcaccaccgcaattccgcaaatcctccgcaacaaacccacgcgccccaaaaaaccaaaacacgaaacaccctcacactacgcgaccgctactctaaaaacgccgaaaccgacgacgaaactttccaactaaacgcacaacccgatactacgaacaaatcctcaactcccgaaccgacgccgaaaaacacgcgctacctctcctcctacccgaacctacgacccttcaccaaacccgcgcgcaacatcccgtcccaaaccgcacttcgaccaaaaacctacaaattccgcgtaaacgacttttctttaaaaaaaacctacccgaaaaaaaacccgatccacacgaatccccacctcccgccgacgacaaacgacgccgatacaaacgtctccgctcgcacgtacacgaaaaacgaacaataaataataccgttcgaactccaacgctaatcttccttcgataccaaacccgcgccccgaaatttaaaaatatttaccttacgtttctcaatccgaaaatcaaaatcaaacatttaaaaaaacaaaaaccaaaaaaaaacgccgaaacgataacgacgaaaacgcaacgaaccgaataccgcgataatacgatcgcaatataacaaaattcgcaaaataactacaaaaatcaaataataataataacgacgacgacgacgacgacgacgacgacgacgacgacgacaacgacaacgacgctaaacgcaaaactccaacaaactacaaaccaaacgactacgcgaaacgaaataaaacctacgcgaccctacaacccaactctaactaacgaccccgctcctacgcccaatcactacgaaccccgcccccgctaaatcccgccccgacgcgcgaactaacaaactccgcccccctcgacgccgcgaccgccgacgcgtacaaactcgaacaaataaaaacgaaaattaccccgctaaattacctcccgcgcgcgccgccgtccctaacgtatttaccgaaataactctacctactaacgaccatatacgcgcccatcccccaccccgaaatataccctaacctcccgctcacctaccccaacccgacgacgaccgcgacgtacgcgacacaaaaaaaacgctccgatcacaacctccgctaacccgaccgacgatataaaacctcgaaaaacgccctacgctctcactataccctaaatttctaaaccgctctaaaacaaacgcgaaaactaaattaatcctcgcgaaaacgcgaaacgaaatctttaaactctcctccctctaaaaatccctaacgccgaacgaaacgcgaatcaacaaactacgcatcttcctcgcccgaacctctcgcgaaactcaaacaccctcctcctaccaccccgcaaaaactctccaacttttcttccgcgcccaatcgccctaaaaaacaaaaaccgtaaaaacaaaacg

SEQ ID NO: 14277 - DNA, 741 bp, Artificial Sequence
  chemically treated genomic DNA (Homo sapiens) CpG-island No: 14277
aggaggttttgggttttcggagtcgttggaggacgcgcgtcgggtttcgtttagttatttcgttgtaagagggaaaaggtacgagcgtggatacggttaagtagattcggaggtcggagatcggttttaatcgggtttcgaagtttttatcgcggacgaattttgtttttcgcggtcgtttcgcgtcgtattcggggaaaagtaatataatttgttgcgcgggttgagagttcgaagttcgtcgtacgtcgtaatgtttcgcgtttttcgcggggtcgggcgatttagatagggatcggaaaagaattacgtagaagaaagttttattttttgtcgtttgtttttgtgtagttttgtagtttcgtcgttttcgcgtcgttcgttttcgcgattttgtgaatattttgaaaaataagagtcgggggaagtaacgggttaagcgttgttatttggggtattaaaaggaagtcggttagaggtggcgggtttatgcgtttttcgagatttaggtcgcgtcgggggttaagagtttttatagttttttttcgcgtcgtcgggaggttttttcggaattgggtcggagcgtagagaacgtagtgtgagaagggtttatgggttttaggttatttttttcgcgttggacgcgggtagagcggtgtttttttttgtttttgttaagagacgtggagggagggagaagggaggatggtttgtgttgaaagaaataagaatgaagtcggg

SEQ ID NO: 14278 - DNA, 741 bp, Artificial Sequence
  chemically treated genomic DNA (Homo sapiens) CpG-island No: 14278
cccgacttcattcttatttctttcaacacaaaccatcctcccttctccctccctccacgtctcttaacaaaaacaaaaaaaaacaccgctctacccgcgtccaacgcgaaaaaaataacctaaaacccataaacccttctcacactacgttctctacgctccgacccaattccgaaaaaacctcccgacgacgcgaaaaaaaactataaaaactcttaacccccgacgcgacctaaatctcgaaaaacgcataaacccgccacctctaaccgacttccttttaataccccaaataacaacgcttaacccgttacttcccccgactcttatttttcaaaatattcacaaaatcgcgaaaacgaacgacgcgaaaacgacgaaactacaaaactacacaaaaacaaacgacaaaaaataaaactttcttctacgtaattcttttccgatccctatctaaatcgcccgaccccgcgaaaaacgcgaaacattacgacgtacgacgaacttcgaactctcaacccgcgcaacaaattatattacttttccccgaatacgacgcgaaacgaccgcgaaaaacaaaattcgtccgcgataaaaacttcgaaacccgattaaaaccgatctccgacctccgaatctacttaaccgtatccacgctcgtaccttttccctcttacaacgaaataactaaacgaaacccgacgcgcgtcctccaacgactccgaaaacccaaaacctcct

SEQ ID NO: 14279 - DNA, 741 bp, Artificial Sequence
  chemically treated genomic DNA (Homo sapiens) CpG-island No: 14279
ttcgattttatttttgttttttttagtataagttatttttttttttttttttttttacgttttttggtagagatagaaagggatatcgttttgttcgcgtttagcgcgaaggaggtgatttaaaatttatgggttttttttatattgcgttttttgcgtttcggtttagtttcgggaggatttttcgacggcgcgggagaaggttgtaagggtttttggttttcgacgcggtttgggtttcgggggacgtatgaattcgttatttttggtcggtttttttttagtgttttaaatagtagcgtttagttcgttgtttttttcgatttttgttttttaaagtgtttatagggtcgcgagagcgagcgacgcgggggcggcgaggttgtaaggttgtataggaatagacgataagaaatagggtttttttttgcgtggttttttttcggtttttgtttgagtcgttcgatttcgcggggagcgcggagtattgcggcgtgcggcgggtttcgggtttttagttcgcgtagtaagttgtgttgttttttttcgggtgcgacgcgggacggtcgcgaagagtaaagttcgttcgcggtaggaatttcgaggttcggttaggatcgattttcggttttcgagtttatttagtcgtgtttacgttcgtgtttttttttttttgtagcgaaataattgggcggggttcgacgcgcgttttttagcgatttcgggaatttaaggtttttt

SEQ ID NO: 14280 - DNA, 741 bp, Artificial Sequence
  chemically treated genomic DNA (Homo sapiens) CpG-island No: 14280
aaaaaaccttaaattcccgaaatcgctaaaaaacgcgcgtcgaaccccgcccaattatttcgctacaaaaaaaaaaaaacacgaacgtaaacacgactaaataaactcgaaaaccgaaaatcgatcctaaccgaacctcgaaattcctaccgcgaacgaactttactcttcgcgaccgtcccgcgtcgcacccgaaaaaaaacaacacaacttactacgcgaactaaaaacccgaaacccgccgcacgccgcaatactccgcgctccccgcgaaatcgaacgactcaaacaaaaaccgaaaaaaaaccacgcaaaaaaaaaccctatttcttatcgtctattcctatacaaccttacaacctcgccgcccccgcgtcgctcgctctcgcgaccctataaacactttaaaaaacaaaaatcgaaaaaaacaacgaactaaacgctactatttaaaacactaaaaaaaaaccgaccaaaaataacgaattcatacgtcccccgaaacccaaaccgcgtcgaaaaccaaaaacccttacaaccttctcccgcgccgtcgaaaaatcctcccgaaactaaaccgaaacgcaaaaaacgcaatataaaaaaaacccataaattttaaatcacctccttcgcgctaaacgcgaacaaaacgatatccctttctatctctaccaaaaaacgtaaaaaaaaaaaaaaaaaaaaataacttatactaaaaaaaacaaaaataaaatcgaa

SEQ ID NO: 14281 - DNA, 1020 bp, Artificial Sequence
  chemically treated genomic DNA (Homo sapiens) CpG-island No: 14281
gtgtcgaggttgtgtgtgtgtgtgtgtgtgtgtgttcgagtacgtgtgtcgaggttgtgtgtgtgtgtgttcgagtacgtgtgttaaggttgtgtgtgttcgagtacgtgtgttaaggttgtgtgtgtgttcgagtacgtgtgtcgaggttgtgtgtgtgtgttcgagtatgtgtgtttaggttgtgtgtgtgtgtgtgttcgagtatgtgtgttaaagttgtgtgtgtgtgtgcgcgcgtttaagtatgtgtgtttaggttgtgtgtgtgtgtgcgttcgagtatgtgtgtcgaggttgtgtgtgtgtgtgtgtgtgttcgagtatgtgtgtttaggttgtgtgtgtgtgttcgagtacgtgtgtcgaggttgtgtgtgtgttcgagtacgtgtgtcgatgttgtgtgtgttcgagtacgtgtgttgaggttgtgtgtgtgtgtgttcgagtacgtgtgtcgaggttgtgtgtgtgtgttcgagtacgtgtgtcgaggttgtgtgtgtgttcgagtacgtgtgtcgaggttgtgtgtgtgtgttcgagtacgtgtgtcgaggttgtgtgtgtgtgttcgagtacgtgtgtcgaggttgtgtgtgtgttcgagtacgtgtgtcgaggtgtgtgttcgagtacgtgtgtcgaggttgtgtgtgtgtgtgttcgagtacgtgtcgaggttgtgtgtgtgtgttcgagtacgtgtgtcgaggttgtgtgtgtgtgttcgagtacgtgtgtcgaggtgtgtgtgtgtttaagtacgtgtcgaggttgtgtgtgtgtgttcgagtacgtgtgtcgaggtgtgtgtgtgtgttcgagtacgtgtgttaaggttgtgtgtgtgtgtgttcgagtacgtgtgtcgaggttgtgtgtgtgtgtgcgttcgagtacgtgtgtcgaggttgtgtgtgtgtgtgtgtgtgtgtgtgttcgagtacgtatgtcgggagggggataagaagaatatagtagtaggagatgagttttgaaacgtatgttgaggtt

SEQ ID NO: 14282 - DNA, 1020 bp, Artificial Sequence
  chemically treated genomic DNA (Homo sapiens) CpG-island No: 14282
aacctcaacatacgtttcaaaactcatctcctactactatattcttcttatccccctcccgacatacgtactcgaacacacacacacacacacacacacacaacctcgacacacgtactcgaacgcacacacacacacaacctcgacacacgtactcgaacacacacacacacaaccttaacacacgtactcgaacacacacacacacctcgacacacgtactcgaacacacacacacaacctcgacacgtacttaaacacacacacacctcgacacacgtactcgaacacacacacacaacctcgacacacgtactcgaacacacacacacaacctcgacacgtactcgaacacacacacacacaacctcgacacacgtactcgaacacacacctcgacacacgtactcgaacacacacacaacctcgacacacgtactcgaacacacacacacaacctcgacacacgtactcgaacacacacacacaacctcgacacacgtactcgaacacacacacaacctcgacacacgtactcgaacacacacacacaacctcgacacacgtactcgaacacacacacacacaacctcaacacacgtactcgaacacacacaacatcgacacacgtactcgaacacacacacaacctcgacacacgtactcgaacacacacacacaacctaaacacacatactcgaacacacacacacacacacacaacctcgacacacatactcgaacgcacacacacacacaacctaaacacacatacttaaacgcgcgcacacacacacacaactttaacacacatactcgaacacacacacacacacaacctaaacacacatactcgaacacacacacacaacctcgacacacgtactcgaacacacacacaaccttaacacacgtactcgaacacacacaaccttaacacacgtactcgaacacacacacacacaacctcgacacacgtactcgaacacacacacacacacacacacacaacctcgacac

SEQ ID NO: 14283 - DNA, 1020 bp, Artificial Sequence
  chemically treated genomic DNA (Homo sapiens) CpG-island No: 14283
gattttaatatacgttttaaggtttattttttgttgttgtgttttttttatttttttttcgatatacgtattcgagtatatatatatatatatatatatataatttcgatatacgtattcgagcgtatatatatatataatttcgatatacgtattcgagtatatatatatataattttgatatacgtattcgagtatatatatatatttcgatatacgtattcgagtatatatatataatttcgatacgtatttgagtatatatatatttcgatatacgtattcgagtatatatatataatttcgatatacgtattcgagtatatatatataatttcgatacgtattcgagtatatatatatataatttcgatatacgtattcgagtatatatttcgatatacgtattcgagtatatatataatttcgatatacgtattcgagtatatatatataatttcgatatacgtattcgagtatatatatataatttcgatatacgtattcgagtatatatataatttcgatatacgtattcgagtatatatatataatttcgatatacgtattcgagtatatatatatataattttaatatacgtattcgagtatatataatatcgatatacgtattcgagtatatatataatttcgatatacgtattcgagtatatatatataatttggatatatatattcgagtatatatatatatatatataatttcgatatatatattcgagcgtatatatatatataatttggatatatatatttgagcgcgcgtatatatatatataattttgatatatatattcgagtatatatatatatataatttggatatatatattcgagtatatatatataatttcgatatacgtattcgagtatatatataattttgatatacgtattcgagtatatataattttgatatacgtattcgagtatatatatatataatttcgatatacgtattcgagtatatatatatatatatatatataatttcgatat

SEQ ID NO: 14284 - DNA, 1020 bp, Artificial Sequence
  chemically treated genomic DNA (Homo sapiens) CpG-island No: 14284
atatcgaaattatatatatatatatatatatatactcgaatacgtatatcgaaattatatatatatatactcgaatacgtatatcaaaattatatatactcgaatacgtatatcaaaattatatatatactcgaatacgtatatcgaaattatatatatatactcgaatatatatatccaaattatatatatatatatactcgaatatatatatcaaaattatatatatatatacgcgcgctcaaatatatatatccaaattatatatatatatacgctcgaatatatatatcgaaattatatatatatatatatatactcgaatatatatatccaaattatatatatatactcgaatacgtatatcgaaattatatatatactcgaatacgtatatcgatattatatatactcgaatacgtatattaaaattatatatatatatactcgaatacgtatatcgaaattatatatatatactcgaatacgtatatcgaaattatatatatactcgaatacgtatatcgaaattatatatatatactcgaatacgtatatcgaaattatatatatatactcgaatacgtatatcgaaattatatatatactcgaatacgtatatcgaaatatatactcgaatacgtatatcgaaattatatatatatatactcgaatacgtatcgaaattatatatatatactcgaatacgtatatcgaaattatatatatatactcgaatacgtatatcgaaatatatatatactcaaatacgtatcgaaattatatatatatactcgaatacgtatatcgaaatatatatatatactcgaatacgtatatcaaaattatatatatatatactcgaatacgtatatcgaaattatatatatatatacgctcgaatacgtatatcgaaattatatatatatatatatatatatatactcgaatacgtatatcgaaaaaaaaataaaaaaaacacaacaacaaaaaataaaccttaaaacgtatattaaaatc

SEQ ID NO: 14285 - DNA, 587 bp, Artificial Sequence
  chemically treated genomic DNA (Homo sapiens) CpG-island No: 14285
tttttcgttttatttttttattttgagggtatttcgcgtcggtgtaggttttatcgttgttgtcggagtcggtcgggagggtgggcggttgagtcgggtttcgtaggaaggacggtacgaatttcgcggcgtgtacgttaggtacgaagggtttggcgttgacgttgagtttacggttgaaagtcgagttgaggggttcgcgttgggtttcggttatcgtagaggagattttattttcgttcggggtcgatttcggggattttatgtttatttggttttagtaatcgggcgtcgagtcgttgttgttgttgttcgaatttatggtttcggaatttgttgtgtggtagtgagggagcgggtttaataggttagaagagcgggtttcgtcggcggggttaaggtagtaagagcgaagggttaaggggtagcgatacgaattttagttgtatcgcggaggtagttaagcgtcgatgttgtattcgtaattgcggcggtagtagtagatatggcggtttaatattttttttttgtgtgtgagcggatttttttttttaaattttaattacgaattttttgtatattaaggt

SEQ ID NO: 14286 - DNA, 587 bp, Artificial Sequence
  chemically treated genomic DNA (Homo sapiens) CpG-island No: 14286
accttaatatacaaaaaattcgtaattaaaatttaaaaaaaaaaatccgctcacacacaaaaaaaaaatattaaaccgccatatctactactaccgccgcaattacgaatacaacatcgacgcttaactacctccgcgatacaactaaaattcgtatcgctaccccttaacccttcgctcttactaccttaaccccgccgacgaaacccgctcttctaacctattaaacccgctccctcactaccacacaacaaattccgaaaccataaattcgaacaacaacaacaacgactcgacgcccgattactaaaaccaaataaacataaaatccccgaaatcgaccccgaacgaaaataaaatctcctctacgataaccgaaacccaacgcgaacccctcaactcgactttcaaccgtaaactcaacgtcaacgccaaacccttcgtacctaacgtacacgccgcgaaattcgtaccgtccttcctacgaaacccgactcaaccgcccaccctcccgaccgactccgacaacaacgataaaacctacaccgacgcgaaataccctcaaaataaaaaaataaaacgaaaaa

SEQ ID NO: 14287 - DNA, 587 bp, Artificial Sequence
  chemically treated genomic DNA (Homo sapiens) CpG-island No: 14287
attttaatgtataaagaattcgtggttggggtttgggggaggagattcgtttatatataagaggagagtgttgagtcgttatatttgttgttgtcgtcgtagttgcgaatgtagtatcggcgtttagttgttttcgcggtgtagttaaggttcgtgtcgttattttttggtttttcgtttttgttgttttaatttcgtcggcggagttcgtttttttggtttgttgagttcgtttttttattgttatatagtaagtttcgagattatggattcgggtagtagtagtagcgattcggcgttcgattgttgggattaggtggatatggaattttcggggtcggtttcgagcggggatggagttttttttgcggtggtcgaggtttagcgcgagttttttagttcggtttttagtcgtaagtttaacgttaacgttaagtttttcgtgtttaacgtatacgtcgcggagttcgtgtcgttttttttgcggggttcgatttagtcgtttattttttcggtcggtttcggtagtaacgatgaaatttgtatcggcgcgggatatttttaaggtaaaaggatgggacgggggg

SEQ ID NO: 14288 - DNA, 587 bp, Artificial Sequence
  chemically treated genomic DNA (Homo sapiens) CpG-island No: 14288
ccccccgtcccatccttttaccttaaaaatatcccgcgccgatacaaatttcatcgttactaccgaaaccgaccgaaaaaataaacgactaaatcgaaccccgcaaaaaaaacgacacgaactccgcgacgtatacgttaaacacgaaaaacttaacgttaacgttaaacttacgactaaaaaccgaactaaaaaactcgcgctaaacctcgaccaccgcaaaaaaaactccatccccgctcgaaaccgaccccgaaaattccatatccacctaatcccaacaatcgaacgccgaatcgctactactactacccgaatccataatctcgaaacttactatataacaataaaaaaacgaactcaacaaaccaaaaaaacgaactccgccgacgaaattaaaacaacaaaaacgaaaaaccaaaaaataacgacacgaaccttaactacaccgcgaaaacaactaaacgccgatactacattcgcaactacgacgacaacaacaaatataacgactcaacactctcctcttatatataaacgaatctcctcccccaaaccccaaccacgaattctttatacattaaaat

SEQ ID NO: 14289 - DNA, 842 bp, Artificial Sequence
  chemically treated genomic DNA (Homo sapiens) CpG-island No: 14289
acgcgtttcggaggttgtaggcgttatgggtagagtgaggaatcgcgttattgtttagcggcggaggcgaaagcggttcggggattttttcgtcgtttgcgcggttatcgcggttacgggcgttagtcgcgcgtagtgttttcgggtttaagtcggggtcgggagttacgcggcggttaagaggtggttgggtaggtggcgacggaagcgtcgttggcggcgggttcggaaggcgggttttagagatttgttgtttttcgcgttaatttcggattcgtcggggttcgtttcgttttttaaggatttggatttgggcgtatagcgggagcgttgggagacgtttaggaagttgcggggttttagttgcgagggcgtcgttaaggttttgttggatattttcgagtattcgggtttcgtgtattatatcgggggttgttattgcggcgcggttcgttttgcggtttgggtttttgtagatttgcgcgtcgtggattgtagttgtaggttgtgtaggaagaagtagtatcgttattttttcgtttcggtttcgcgttttacgttgttttagggcgtagaaagtatcgttatttatcggtttaatacgtattcggcgttgtatagtttttgtagtaggtgcggggtgtagagtttttacgtagttgtttttgattttcgcgtgtacggcgtcgtttcgtattgtttggacgagggtatcgtgcgtagcgtggttatcgaggaggtcggcggtggcgattcgggggaggaggtcgtcgaggagtataaggttatttataagacgtttttttagttagtttttgtttgttttcgcgaataggagtagt

SEQ ID NO: 14290 - DNA, 842 bp, Artificial Sequence
  chemically treated genomic DNA (Homo sapiens) CpG-island No: 14290
actactcctattcgcgaaaacaaacaaaaactaactaaaaaaacgtcttataaataaccttatactcctcgacgacctcctcccccgaatcgccaccgccgacctcctcgataaccacgctacgcacgataccctcgtccaaacaatacgaaacgacgccgtacacgcgaaaatcaaaaacaactacgtaaaaactctacaccccgcacctactacaaaaactatacaacgccgaatacgtattaaaccgataaataacgatactttctacgccctaaaacaacgtaaaacgcgaaaccgaaacgaaaaaataacgatactacttcttcctacacaacctacaactacaatccacgacgcgcaaatctacaaaaacccaaaccgcaaaacgaaccgcgccgcaataacaacccccgatataatacacgaaacccgaatactcgaaaatatccaacaaaaccttaacgacgccctcgcaactaaaaccccgcaacttcctaaacgtctcccaacgctcccgctatacgcccaaatccaaatccttaaaaaacgaaacgaaccccgacgaatccgaaattaacgcgaaaaacaacaaatctctaaaacccgccttccgaacccgccgccaacgacgcttccgtcgccacctacccaaccacctcttaaccgccgcgtaactcccgaccccgacttaaacccgaaaacactacgcgcgactaacgcccgtaaccgcgataaccgcgcaaacgacgaaaaaatccccgaaccgctttcgcctccgccgctaaacaataacgcgattcctcactctacccataacgcctacaacctccgaaacgcgt

SEQ ID NO: 14291 - DNA, 842 bp, Artificial Sequence
  chemically treated genomic DNA (Homo sapiens) CpG-island No: 14291
attgtttttgttcgcggggataggtaggggttgattgggaggacgttttgtggatggttttgtgtttttcggcggttttttttttcgggtcgttatcgtcgattttttcgatgattacgttgcgtacggtgttttcgtttaggtagtgcggggcgacgtcgtatacgcgggggttagagatagttgcgtggaaattttgtatttcgtatttgttgtagaagttgtgtagcgtcgggtgcgtgttggatcgataggtgacgatgttttttgcgttttggagtagcgtgaagcgcgaggtcgggacgaggaagtggcggtgttgtttttttttgtatagtttgtagttgtaatttacgacgcgtagatttgtaggggtttagatcgtaaagcggatcgcgtcgtagtggtagttttcggtgtgatgtacgaggttcgggtattcgaaggtgtttagtaggattttggcggcgttttcgtagttgaggtttcgtagttttttgaacgttttttagcgttttcgttgtgcgtttaggtttagatttttgggggacggggcgggtttcggcgggttcggggttggcgcggagggtagtaggtttttggggttcgtttttcggattcgtcgttagcggcgttttcgtcgttatttatttagttattttttggtcgtcgcgtggttttcgatttcgatttggattcgggggtattgcgcgcggttggcgttcgtgatcgcgatggtcgcgtaggcggcgggaggattttcgggtcgttttcgttttcgtcgttgagtagtggcgcggttttttattttgtttatggcgtttgtagttttcggagcgcgt

SEQ ID NO: 14292 - DNA, 842 bp, Artificial Sequence
  chemically treated genomic DNA (Homo sapiens) CpG-island No: 14292
acgcgctccgaaaactacaaacgccataaacaaaataaaaaaccgcgccactactcaacgacgaaaacgaaaacgacccgaaaatcctcccgccgcctacgcgaccatcgcgatcacgaacgccaaccgcgcgcaatacccccgaatccaaatcgaaatcgaaaaccacgcgacgaccaaaaaataactaaataaataacgacgaaaacgccgctaacgacgaatccgaaaaacgaaccccaaaaacctactaccctccgcgccaaccccgaacccgccgaaacccgccccgtcccccaaaaatctaaacctaaacgcacaacgaaaacgctaaaaaacgttcaaaaaactacgaaacctcaactacgaaaacgccgccaaaatcctactaaacaccttcgaatacccgaacctcgtacatcacaccgaaaactaccactacgacgcgatccgctttacgatctaaacccctacaaatctacgcgtcgtaaattacaactacaaactatacaaaaaaaaacaacaccgccacttcctcgtcccgacctcgcgcttcacgctactccaaaacgcaaaaaacatcgtcacctatcgatccaacacgcacccgacgctacacaacttctacaacaaatacgaaatacaaaatttccacgcaactatctctaacccccgcgtatacgacgtcgccccgcactacctaaacgaaaacaccgtacgcaacgtaatcatcgaaaaaatcgacgataacgacccgaaaaaaaaaaccgccgaaaaacacaaaaccatccacaaaacgtcctcccaatcaacccctacctatccccgcgaacaaaaacaat

SEQ ID NO: 14293 - DNA, 1630 bp, Artificial Sequence
  chemically treated genomic DNA (Homo sapiens) CpG-island No: 14293
  misc_feature (19)..(19): n is either a, c, g or t
attacgtttgtgttttttncgtgttgatgagcgttagcggtaggtcgcgatggtcgtagtggtataggcgaatttttcgcgtcggtgtgtatatcgggtttatttggttttgtatttgcgttatcgttaggtcggacgatgttagttagcggcgggtttttttatttattcggttagttaggattttattttttagtcggtcgagtatttgtattagtatcggcgggaatattatattgttatcgttttcgttatcggattgttgaagggtattcgttaggttgcggcgttgcgttttcgttagtttatcggtggcggttttaattttgatgagtggcgtgaagtttttcggttgataaatcgtttggatgcgggttttgtcgttttgtatcggggataggcgggcgtcgttttagtcgtattaggatatttgcggtttgcgtgatagcgatatttagttcgtgaggtttcgtttacgtcgttatattcgttttgttattttgtcggtttaacgggtcgtaaagatagcgattttcgattagcggttttgtatattgggttcgcgtgtagtgtattaaacggtgttgattgtcgtaatggtattcgtgggtgcgtttattattcgtgcgggataatttttttcgggatgaggtcggttttttttgttagtttgtcgtgacggttatatcggtaaagatagtgcgcgttacggtcgatatggttattcggttttatgttgagggcgttgttcgggtgtagtttcgggtcgagtagacggttatttgtcgggtttgtggtattcgggattcggatatttatattttttgcggtggtgtgaacgtcggttagtttgtcggtggtattgtatttgtaatttcgggtttggcgcgggcggttgatgcggatgagttcgtcgttgtcgttttaggtgtattcgcggttagatagtagattgtttaggtgttggttttgtatttgttcggtaggggtataagcggtggtgagtttatagcggtcgaagttgcgtagcgtttttcggtataggcggtcgcgggtgtattttattatcggtgtgtcggcgagttttatgtttgttagttagtcgttgtcgtaggttagttattttacggcgggtaggttgttcggtatatagcggttcgttagtttttgtgcgttgtacgtatgtttggttttatgttgttagagtagtttattcgtttgcggataatgtatcgtttgataatgggcggcgattttattcgttggaaattatgttacgtatttattggatgtagtattggtataatttgaacgatggcgcgatggaagatgttttgtacgaaatcgtttttatgcgttggtttgttcggatatttttggatagcgtttggtcggatcgtattattattatgaattttcggtatttgttggagtagtattaattggatcggtaattgtttaagattattaatcgttggttggtcgaagtacgcgttatgatgatttaaggtattttgatcgatagttattattattgaggtatttagttcgattaagaataaagagtagtaacgcgattcggagatgtattagattaagaaaggtaattattggtattttgttatgaagg

SEQ ID NO: 14294 - DNA, 1630 bp, Artificial Sequence
  chemically treated genomic DNA (Homo sapiens) CpG-island No: 14294
  misc_feature (1612)..(1612): n is either a, c, g or t
ccttcataacaaaataccaataattacctttcttaatctaatacatctccgaatcgcgttactactctttattcttaatcgaactaaatacctcaataataataactatcgatcaaaataccttaaatcatcataacgcgtacttcgaccaaccaacgattaataatcttaaacaattaccgatccaattaatactactccaacaaataccgaaaattcataataataatacgatccgaccaaacgctatccaaaaatatccgaacaaaccaacgcataaaaacgatttcgtacaaaacatcttccatcgcgccatcgttcaaattataccaatactacatccaataaatacgtaacataatttccaacgaataaaatcgccgcccattatcaaacgatacattatccgcaaacgaataaactactctaacaacataaaaccaaacatacgtacaacgcacaaaaactaacgaaccgctatataccgaacaacctacccgccgtaaaataactaacctacgacaacgactaactaacaaacataaaactcgccgacacaccgataataaaatacacccgcgaccgcctataccgaaaaacgctacgcaacttcgaccgctataaactcaccaccgcttatacccctaccgaacaaatacaaaaccaacacctaaacaatctactatctaaccgcgaatacacctaaaacgacaacgacgaactcatccgcatcaaccgcccgcgccaaacccgaaattacaaatacaataccaccgacaaactaaccgacgttcacaccaccgcaaaaaatataaatatccgaatcccgaataccacaaacccgacaaataaccgtctactcgacccgaaactacacccgaacaacgccctcaacataaaaccgaataaccatatcgaccgtaacgcgcactatctttaccgatataaccgtcacgacaaactaacaaaaaaaaccgacctcatcccgaaaaaaattatcccgcacgaataataaacgcacccacgaataccattacgacaatcaacaccgtttaatacactacacgcgaacccaatatacaaaaccgctaatcgaaaatcgctatctttacgacccgttaaaccgacaaaataacaaaacgaatataacgacgtaaacgaaacctcacgaactaaatatcgctatcacgcaaaccgcaaatatcctaatacgactaaaacgacgcccgcctatccccgatacaaaacgacaaaacccgcatccaaacgatttatcaaccgaaaaacttcacgccactcatcaaaattaaaaccgccaccgataaactaacgaaaacgcaacgccgcaacctaacgaatacccttcaacaatccgataacgaaaacgataacaatataatattcccgccgatactaatacaaatactcgaccgactaaaaaataaaatcctaactaaccgaataaataaaaaaacccgccgctaactaacatcgtccgacctaacgataacgcaaatacaaaaccaaataaacccgatatacacaccgacgcgaaaaattcgcctataccactacgaccatcgcgacctaccgctaacgctcatcaacacgnaaaaaacacaaacgtaat

SEQ ID NO: 14295 - DNA, 1630 bp, Artificial Sequence
  chemically treated genomic DNA (Homo sapiens) CpG-island No: 14295
  misc_feature (1612)..(1612): n is either a, c, g or t
tttttatggtaaagtattagtaattgttttttttggtttgatgtattttcggatcgcgttgttgttttttgtttttggtcgagttgggtgttttaatgatggtggttatcgattaaggtgttttgagttattatgacgcgtgtttcggttagttagcgattgatggttttgaataattgtcggtttagttgatgttgttttagtaggtgtcggaaatttatgatggtggtgcggttcggttaggcgttatttagggatattcgggtaaattaacgtatggaggcgatttcgtatagagtattttttatcgcgttatcgtttaggttgtattaatgttgtatttagtgaatgcgtagtatggtttttagcggataaggtcgtcgtttattattagacggtgtattattcgtagacgaatgaattgttttggtagtatgagattagatatgcgtataacgtatagggattggcgaatcgttgtatatcggatagtttgttcgtcgtggaatggttgatttacggtagcggttggttggtaggtatgaaattcgtcgatatatcggtggtggagtatattcgcgatcgtttgtatcgggaaacgttgcgtagtttcggtcgttatgaatttattatcgtttatatttttgtcgggtagatatagagttagtatttgaatagtttgttgtttgatcgcgagtatatttggaacgataacggcgaatttattcgtattagtcgttcgcgttagattcggagttataggtatagtattatcggtaggttgatcggcgtttatattatcgtagggaatatggatattcggatttcgaatattatagattcggtaggtaatcgtttgttcgattcggagttgtattcggatagcgtttttagtatagggtcggataattatatcggtcgtgacgcgtattatttttatcggtatgatcgttacggtaggttgataaagaaaatcgattttatttcggaaggggttatttcgtacggatgatgagcgtatttacgggtattattacgatagttagtatcgtttggtgtattatacgcggatttaatatgtagagtcgttggtcgaaagtcgttatttttacgattcgttgggtcggtagggtggtaaaacgggtatgacggcgtgaacgggattttacgggttggatgtcgttgttacgtaaatcgtaagtgttttggtacggttgggacggcgttcgtttgttttcgatatagaacgatagaattcgtatttaggcgatttattagtcggggagttttacgttatttattagggttgaaatcgttatcggtgagttggcgaaaacgtagcgtcgtagtttggcggatattttttagtagttcggtggcgaagacggtggtagtgtggtgttttcgtcggtgttggtgtagatgttcgatcggttggaaagtgaaattttggttgatcgggtgagtgaggaaattcgtcgttggttggtatcgttcggtttggcggtggcgtagatgtaaagttagatggattcggtatatatatcggcgcgaaaaattcgtttgtattattgcgattatcgcggtttgtcgttggcgtttattagtacgnaaggggtataagcgtggt

SEQ ID NO: 14296 - DNA, 1630 bp, Artificial Sequence
  chemically treated genomic DNA (Homo sapiens) CpG-island No: 14296
  misc_feature (19)..(19): n is either a, c, g or t
accacgcttataccccttncgtactaataaacgccaacgacaaaccgcgataatcgcaataatacaaacgaatttttcgcgccgatatatataccgaatccatctaactttacatctacgccaccgccaaaccgaacgataccaaccaacgacgaatttcctcactcacccgatcaaccaaaatttcactttccaaccgatcgaacatctacaccaacaccgacgaaaacaccacactaccaccgtcttcgccaccgaactactaaaaaatatccgccaaactacgacgctacgttttcgccaactcaccgataacgatttcaaccctaataaataacgtaaaactccccgactaataaatcgcctaaatacgaattctatcgttctatatcgaaaacaaacgaacgccgtcccaaccgtaccaaaacacttacgatttacgtaacaacgacatccaacccgtaaaatcccgttcacgccgtcatacccgttttaccaccctaccgacccaacgaatcgtaaaaataacgactttcgaccaacgactctacatattaaatccgcgtataatacaccaaacgatactaactatcgtaataatacccgtaaatacgctcatcatccgtacgaaataaccccttccgaaataaaatcgattttctttatcaacctaccgtaacgatcataccgataaaaataatacgcgtcacgaccgatataattatccgaccctatactaaaaacgctatccgaatacaactccgaatcgaacaaacgattacctaccgaatctataatattcgaaatccgaatatccatattccctacgataatataaacgccgatcaacctaccgataatactatacctataactccgaatctaacgcgaacgactaatacgaataaattcgccgttatcgttccaaatatactcgcgatcaaacaacaaactattcaaatactaactctatatctacccgacaaaaatataaacgataataaattcataacgaccgaaactacgcaacgtttcccgatacaaacgatcgcgaatatactccaccaccgatatatcgacgaatttcatacctaccaaccaaccgctaccgtaaatcaaccattccacgacgaacaaactatccgatatacaacgattcgccaatccctatacgttatacgcatatctaatctcatactaccaaaacaattcattcgtctacgaataatacaccgtctaataataaacgacgaccttatccgctaaaaaccatactacgcattcactaaatacaacattaatacaacctaaacgataacgcgataaaaaatactctatacgaaatcgcctccatacgttaatttacccgaatatccctaaataacgcctaaccgaaccgcaccaccatcataaatttccgacacctactaaaacaacatcaactaaaccgacaattattcaaaaccatcaatcgctaactaaccgaaacacgcgtcataataactcaaaacaccttaatcgataaccaccatcattaaaacacccaactcgaccaaaaacaaaaaacaacaacgcgatccgaaaatacatcaaaccaaaaaaaacaattactaatactttaccataaaaa

SEQ ID NO: 14297 - DNA, 550 bp, Artificial Sequence
  chemically treated genomic DNA (Homo sapiens) CpG-island No: 14297
gatagttcgcgtttcgatcgtttttttttagtttcgtatttcgtttcgtataacgtcgtttttttttttaaagaagtgttcggggttttattttacgtcgcgttagtttattaggggtcgcggtgacgtcgttcgtttaagagttagttttttttaatttttttttaacggggcgtttcggcggggttcgcggttttcggtagtcgtcgttttttttcgcggtattttcggatttcggcgtcgtttttttaaggggtagtttttagtagcgtttttttcgttttttgttgtcggcgcgcgaggcgggggagtcgggttggagcggagcgcgcggttcgcgcggttattggagattaggcggtcggcggtcgggtaggcggcggcggagcgcgcggcggcgtggcggcggatggggacgcggagtcgggcggttgtggcggttgtggcggttgtggttgtggcggcggcggggaagtagttgacgggtcggcggggattttttagagtcgcgattttagaggatttttttatttttttatttgttgaaagg

SEQ ID NO: 14298 - DNA, 550 bp, Artificial Sequence
  chemically treated genomic DNA (Homo sapiens) CpG-island No: 14298
cctttcaacaaataaaaaaataaaaaaatcctctaaaatcgcgactctaaaaaatccccgccgacccgtcaactacttccccgccgccgccacaaccacaaccgccacaaccgccacaaccgcccgactccgcgtccccatccgccgccacgccgccgcgcgctccgccgccgcctacccgaccgccgaccgcctaatctccaataaccgcgcgaaccgcgcgctccgctccaacccgactcccccgcctcgcgcgccgacaacaaaaaacgaaaaaaacgctactaaaaactaccccttaaaaaaacgacgccgaaatccgaaaataccgcgaaaaaaaacgacgactaccgaaaaccgcgaaccccgccgaaacgccccgttaaaaaaaaattaaaaaaaactaactcttaaacgaacgacgtcaccgcgacccctaataaactaacgcgacgtaaaataaaaccccgaacacttctttaaaaaaaaaaacgacgttatacgaaacgaaatacgaaactaaaaaaaaacgatcgaaacgcgaactatc

SEQ ID NO: 14299 - DNA, 550 bp, Artificial Sequence
  chemically treated genomic DNA (Homo sapiens) CpG-island No: 14299
ttttttagtaggtggaggaataaggggattttttagagtcgcgattttagaggattttcgtcggttcgttagttgttttttcgtcgtcgttatagttatagtcgttatagtcgttatagtcgttcggtttcgcgtttttattcgtcgttacgtcgtcgcgcgtttcgtcgtcgtttgttcggtcgtcggtcgtttggtttttagtggtcgcgcggatcgcgcgtttcgttttagttcggttttttcgtttcgcgcgtcggtaatagggggcggggagagcgttgttgggggttgttttttaaaagggcgacgtcggggttcggaagtgtcgcgaggggaggcggcggttgtcgggagtcgcgagtttcgtcgggacgtttcgttaagagagagttaagggaggttggtttttaaacgggcgacgttatcgcgatttttggtgggttggcgcggcgtagagtggagtttcgggtatttttttaaaagggggaacggcgttgtgcgaggcggagtgcggagttagaagggggcggtcggagcgcgagttgtt

SEQ ID NO: 14300 - DNA, 550 bp, Artificial Sequence
  chemically treated genomic DNA (Homo sapiens) CpG-island No: 14300
aacaactcgcgctccgaccgcccccttctaactccgcactccgcctcgcacaacgccgttcccccttttaaaaaaatacccgaaactccactctacgccgcgccaacccaccaaaaatcgcgataacgtcgcccgtttaaaaaccaacctcccttaactctctcttaacgaaacgtcccgacgaaactcgcgactcccgacaaccgccgcctcccctcgcgacacttccgaaccccgacgtcgcccttttaaaaaacaacccccaacaacgctctccccgccccctattaccgacgcgcgaaacgaaaaaaccgaactaaaacgaaacgcgcgatccgcgcgaccactaaaaaccaaacgaccgacgaccgaacaaacgacgacgaaacgcgcgacgacgtaacgacgaataaaaacgcgaaaccgaacgactataacgactataacgactataactataacgacgacgaaaaaacaactaacgaaccgacgaaaatcctctaaaatcgcgactctaaaaaatccccttattcctccacctactaaaaaa

SEQ ID NO: 14301 - DNA, 601 bp, Artificial Sequence
  chemically treated genomic DNA (Homo sapiens) CpG-island No: 14301
tcgtttcgattcggggcgtttagcgtggtgaagtgcgggcgtggagttcgttttttattcggttggaagggtttgcgttttgatttgtgaggatttttgtatgtgtcgcgttttttggttttttacgggaaggtcgaggtcgttaggaagggttgtacggtcggatttttaatagcggttttttggtttggcgggagtagaggggcgtttatattcgtagtttcgggattttagagatagagcgtttcgtttcggtagcggcgtcgcgtttattggttgggttttttttcgtttcgtttagcgatcggttcgtttagagtttacgtatgcgtacgagtatttcgtcgtcgttgtcgtcgttatcgtcgtcgtcgtcgtcgtcgtcgcggttttagtattagcgttcggatagcggtgtcgtttacgggtatggacggtgatagtagtagtagtagcggcggtagcggttcggttttcggttcgggttcggaaggggagtaacggttcgagggggagtttttggttttagacggcggtttttcggataggtagggcggatagtttcgtagattcgtattatagatttttttagatttttttt

SEQ ID NO: 14302 - DNA, 601 bp, Artificial Sequence
  chemically treated genomic DNA (Homo sapiens) CpG-island No: 14302
aaaaaaaatctaaaaaaatctataatacgaatctacgaaactatccgccctacctatccgaaaaaccgccgtctaaaaccaaaaactccccctcgaaccgttactccccttccgaacccgaaccgaaaaccgaaccgctaccgccgctactactactactatcaccgtccatacccgtaaacgacaccgctatccgaacgctaatactaaaaccgcgacgacgacgacgacgacgacgataacgacgacaacgacgacgaaatactcgtacgcatacgtaaactctaaacgaaccgatcgctaaacgaaacgaaaaaaaacccaaccaataaacgcgacgccgctaccgaaacgaaacgctctatctctaaaatcccgaaactacgaatataaacgcccctctactcccgccaaaccaaaaaaccgctattaaaaatccgaccgtacaacccttcctaacgacctcgaccttcccgtaaaaaaccaaaaaacgcgacacatacaaaaatcctcacaaatcaaaacgcaaacccttccaaccgaataaaaaacgaactccacgcccgcacttcaccacgctaaacgccccgaatcgaaacga

SEQ ID NO: 14303 - DNA, 601 bp, Artificial Sequence
  chemically treated genomic DNA (Homo sapiens) CpG-island No: 14303
ggggagggtttgggagggtttgtgatacggatttgcggagttgttcgttttatttgttcggggagtcgtcgtttggggttaagggttttttttcgggtcgttgtttttttttcggattcgggtcgggagtcggatcgttgtcgtcgttgttgttgttgttgttatcgtttatgttcgtgggcggtatcgttgttcgggcgttggtgttgaagtcgcggcggcggcggcggcggcggcggtggcggcggtagcggcggcggggtgttcgtgcgtatgcgtaggttttgagcgggtcggtcgttgggcggggcgaggaggagtttagttaatgggcgcggcgtcgttgtcggagcggagcgttttgtttttaagatttcggggttgcggatgtgagcgtttttttgttttcgttaggttagagagtcgttgttaggagttcggtcgtgtaattttttttagcggtttcggttttttcgtaaggaattagagagcgcgatatatgtagagatttttataaattaaaacgtagatttttttagtcggatagagggcgagttttacgttcgtattttattacgttggacgtttcgggtcgaggcgg

SEQ ID NO: 14304 - DNA, 601 bp, Artificial Sequence
  chemically treated genomic DNA (Homo sapiens) CpG-island No: 14304
ccgcctcgacccgaaacgtccaacgtaataaaatacgaacgtaaaactcgccctctatccgactaaaaaaatctacgttttaatttataaaaatctctacatatatcgcgctctctaattccttacgaaaaaaccgaaaccgctaaaaaaaattacacgaccgaactcctaacaacgactctctaacctaacgaaaacaaaaaaacgctcacatccgcaaccccgaaatcttaaaaacaaaacgctccgctccgacaacgacgccgcgcccattaactaaactcctcctcgccccgcccaacgaccgacccgctcaaaacctacgcatacgcacgaacaccccgccgccgctaccgccgccaccgccgccgccgccgccgccgccgcgacttcaacaccaacgcccgaacaacgataccgcccacgaacataaacgataacaacaacaacaacaacgacgacaacgatccgactcccgacccgaatccgaaaaaaaaacaacgacccgaaaaaaaacccttaaccccaaacgacgactccccgaacaaataaaacgaacaactccgcaaatccgtatcacaaaccctcccaaaccctcccc

SEQ ID NO: 14305 - DNA, 546 bp, Artificial Sequence
  chemically treated genomic DNA (Homo sapiens) CpG-island No: 14305
  misc_feature (264)..(265): n is either a, c, g or t
  misc_feature (271)..(271): n is either a, c, g or t
cgcgacgcggtttcggtcgagcggggtaagtcggttatttatatcggggataagaaggcgaagatggcggttaagattaataagaagtgggttcggttcgttatcgtgttcgtttacgtgtttttcgtgtcgttggtcgttatcgtgttcgtcgtttattatagttttatttggtagtcggtgggcgtcgggatttcggggggagtcgttggttcgtttttcggcggttttaacgttattggttcgtttgggatttcggggcgnncgtcgncggggtttaatattattgggtcgtttcgtcgcgaggcgtcgcgcgacgtttttttattgtaggcggcgcgatcggcgttttcggagttttttgcggatagtttttcggtcgggtcgttcgagcggtttcgggggtcggacgaggacgaagaggaaacggcggcggcgttcgggagtcgttgaagtttttcgcgttgggggtcgtcgggaattattttttttaagtttagaggtaggatttcgtagtaggatggggtggagagttcgcgggagtga

SEQ ID NO: 14306 - DNA, 546 bp, Artificial Sequence
  chemically treated genomic DNA (Homo sapiens) CpG-island No: 14306
  misc_feature (276)..(276): n is either a, c, g or t
  misc_feature (282)..(283): n is either a, c, g or t
tcactcccgcgaactctccaccccatcctactacgaaatcctacctctaaacttaaaaaaaataattcccgacgacccccaacgcgaaaaacttcaacgactcccgaacgccgccgccgtttcctcttcgtcctcgtccgacccccgaaaccgctcgaacgacccgaccgaaaaactatccgcaaaaaactccgaaaacgccgatcgcgccgcctacaataaaaaaacgtcgcgcgacgcctcgcgacgaaacgacccaataatattaaaccccgncgacgnncgccccgaaatcccaaacgaaccaataacgttaaaaccgccgaaaaacgaaccaacgactccccccgaaatcccgacgcccaccgactaccaaataaaactataataaacgacgaacacgataacgaccaacgacacgaaaaacacgtaaacgaacacgataacgaaccgaacccacttcttattaatcttaaccgccatcttcgccttcttatccccgatataaataaccgacttaccccgctcgaccgaaaccgcgtcgcg

SEQ ID NO: 14307 - DNA, 546 bp, Artificial Sequence
  chemically treated genomic DNA (Homo sapiens) CpG-island No: 14307
  misc_feature (276)..(276): n is either a, c, g or t
  misc_feature (282)..(283): n is either a, c, g or t
ttattttcgcgggttttttattttattttgttgcgaagttttgtttttgggtttggggagaatggttttcggcggtttttagcgcggagggttttaacgattttcgggcgtcgtcgtcgtttttttttcgttttcgttcggttttcgaggtcgttcgagcggttcggtcggggggttgttcgtagggggtttcggaggcgtcggtcgcgtcgtttgtagtgggggaacgtcgcgcggcgtttcgcggcgggacgatttagtggtgttgggtttcgncggcgnncgtttcgaagttttagacgggttagtggcgttggagtcgtcggggggcgggttagcggtttttttcgaggtttcggcgtttatcggttgttagatgaggttgtagtagacggcgagtacgatggcggttagcgatacggagagtacgtaggcgaatacgatggcgagtcggatttattttttgttggttttggtcgttattttcgtttttttgttttcggtgtaggtggtcggtttgtttcgttcggtcggggtcgcgtcgcg

SEQ ID NO: 14308 - DNA, 546 bp, Artificial Sequence
  chemically treated genomic DNA (Homo sapiens) CpG-island No: 14308
  misc_feature (264)..(265): n is either a, c, g or t
  misc_feature (271)..(271): n is either a, c, g or t
cgcgacgcgaccccgaccgaacgaaacaaaccgaccacctacaccgaaaacaaaaaaacgaaaataacgaccaaaaccaacaaaaaataaatccgactcgccatcgtattcgcctacgtactctccgtatcgctaaccgccatcgtactcgccgtctactacaacctcatctaacaaccgataaacgccgaaacctcgaaaaaaaccgctaacccgccccccgacgactccaacgccactaacccgtctaaaacttcgaaacgnncgccgncgaaacccaacaccactaaatcgtcccgccgcgaaacgccgcgcgacgttcccccactacaaacgacgcgaccgacgcctccgaaaccccctacgaacaaccccccgaccgaaccgctcgaacgacctcgaaaaccgaacgaaaacgaaaaaaaaacgacgacgacgcccgaaaatcgttaaaaccctccgcgctaaaaaccgccgaaaaccattctccccaaacccaaaaacaaaacttcgcaacaaaataaaataaaaaacccgcgaaaataa

SEQ ID NO: 14309 - DNA, 706 bp, Artificial Sequence
  chemically treated genomic DNA (Homo sapiens) CpG-island No: 14309
gcggtagttgttcgaataggaatagttggcgatatttcgcgtcgaagcgttcgaaggggtggttgggtcggaagatttggtcgtcgggcggcggtagcgtgggtagtcgtaggcgggggttgatttcggcgatgtaggcgttttttgtcgttagtgttgcgaattagtagatttagatgtagcggaatttgatgacgtcgtagggtagtaggcgttggaagagtagacgcgaggtgttagtcgtcgtttttcgtaggtcgcggagtcgtcggtgtagcgttagtagtagtcgtcggggcgcgttgtttttttatcggtttcgcgttcggcgcgtatagtcgcgcgttaggtagcgttcgtggagtacggcggaggcgggtagttagattagcgtgagcgttaggtgtattagtatagtcgtgtttatgaagagggcgaggtagcgaacggtcggtaggcggtttaggtagttggtatagaaggtcgcgttcgtggtgaggtcggagattagtagtaggtagtcgaagtggtgtatggtgcggtttacgcgttgcgttagttttttcgacggtagttggtttttgttaaggcgttataggtcgaagaagatgagcgtgtggttggcgtagacgttgtttagtaggaggagggttgttagattgacgaaggggaagtaggttatgcggaaggttatttggtaaaggaa

SEQ ID NO: 14310 - DNA, 706 bp, Artificial Sequence
  chemically treated genomic DNA (Homo sapiens) CpG-island No: 14310
ttcctttaccaaataaccttccgcataacctacttccccttcgtcaatctaacaaccctcctcctactaaacaacgtctacgccaaccacacgctcatcttcttcgacctataacgccttaacaaaaaccaactaccgtcgaaaaaactaacgcaacgcgtaaaccgcaccatacaccacttcgactacctactactaatctccgacctcaccacgaacgcgaccttctataccaactacctaaaccgcctaccgaccgttcgctacctcgccctcttcataaacacgactatactaatacacctaacgctcacgctaatctaactacccgcctccgccgtactccacgaacgctacctaacgcgcgactatacgcgccgaacgcgaaaccgataaaaaaacaacgcgccccgacgactactactaacgctacaccgacgactccgcgacctacgaaaaacgacgactaacacctcgcgtctactcttccaacgcctactaccctacgacgtcatcaaattccgctacatctaaatctactaattcgcaacactaacgacaaaaaacgcctacatcgccgaaatcaacccccgcctacgactacccacgctaccgccgcccgacgaccaaatcttccgacccaaccaccccttcgaacgcttcgacgcgaaatatcgccaactattcctattcgaacaactaccgc

SEQ ID NO: 14311 - DNA, 706 bp, Artificial Sequence
  chemically treated genomic DNA (Homo sapiens) CpG-island No: 14311
tttttttattaggtggtttttcgtatggtttatttttttttcgttaatttggtagttttttttttgttgagtagcgtttgcgttaattatacgtttatttttttcgatttgtggcgttttagtaagagttagttgtcgtcgggggggttggcgtagcgcgtgggtcgtattatgtattatttcggttatttgttgttggttttcggttttattacgagcgcggttttttatgttagttatttgagtcgtttgtcggtcgttcgttgtttcgttttttttatgggtacggttgtgttggtgtatttggcgtttacgttggtttggttgttcgttttcgtcgtgttttacgagcgttatttggcgcgcggttgtgcgcgtcgggcgcggggtcggtgggagggtagcgcgtttcggcggttattgttggcgttgtatcggcggtttcgcggtttgcggagggcggcggttggtatttcgcgtttgtttttttagcgtttgttgttttgcggcgttattaagtttcgttatatttggatttgttggttcgtagtattggcggtagggggcgtttatatcgtcggagttagttttcgtttgcggttgtttacgttgtcgtcgttcggcggttaggtttttcggtttagttattttttcgagcgtttcgacgcggagtatcgttagttgtttttgttcgagtagttgtcgt

SEQ ID NO: 14312 - DNA, 706 bp, Artificial Sequence
  chemically treated genomic DNA (Homo sapiens) CpG-island No: 14312
acgacaactactcgaacaaaaacaactaacgatactccgcgtcgaaacgctcgaaaaaataactaaaccgaaaaacctaaccgccgaacgacgacaacgtaaacaaccgcaaacgaaaactaactccgacgatataaacgccccctaccgccaatactacgaaccaacaaatccaaatataacgaaacttaataacgccgcaaaacaacaaacgctaaaaaaacaaacgcgaaataccaaccgccgccctccgcaaaccgcgaaaccgccgatacaacgccaacaataaccgccgaaacgcgctaccctcccaccgaccccgcgcccgacgcgcacaaccgcgcgccaaataacgctcgtaaaacacgacgaaaacgaacaaccaaaccaacgtaaacgccaaatacaccaacacaaccgtacccataaaaaaaacgaaacaacgaacgaccgacaaacgactcaaataactaacataaaaaaccgcgctcgtaataaaaccgaaaaccaacaacaaataaccgaaataatacataatacgacccacgcgctacgccaacccccccgacgacaactaactcttactaaaacgccacaaatcgaaaaaaataaacgtataattaacgcaaacgctactcaacaaaaaaaaaactaccaaattaacgaaaaaaaaataaaccatacgaaaaaccacctaataaaaaaa

SEQ ID NO: 14313 - DNA, 511 bp, Artificial Sequence
  chemically treated genomic DNA (Homo sapiens) CpG-island No: 14313
aataagggggttcgggcggcggttcgcgtcgaacggtttttttttttattcgaaaatagacgttcgttttgggcgaaagagtattttcgttattaggggatcgaaagaaagaagaaaaggggcggtcggggcgggcgcgttttttcgttgcggggggagaagcgggcgtttttgggggtaggcgtacgtaacgagcgggtcggggttagcgggacgaatttagcgttcgtcgcgtttgttcgcgggggatcggtaggtgttcgtggtttcgtttcgggtttttatcgtagaggcgagaaggcggagggaggaattcggtatcggttatttagtttagcgttttcgtttagcgagggcgggcggaatgcgtcgcgtagtcggcggcggcgttcggttgtcgagcgtttatcgtgtcgggttcgcgcgcggcggggatatttcggcgtttcgcgtttttcgtcgtcgcgtcgttcgtcgcgttgggcgaagaggatagggggggcggttgagg

SEQ ID NO: 14314 - DNA, 511 bp, Artificial Sequence
  chemically treated genomic DNA (Homo sapiens) CpG-island No: 14314
cctcaaccgccccccctatcctcttcgcccaacgcgacgaacgacgcgacgacgaaaaacgcgaaacgccgaaatatccccgccgcgcgcgaacccgacacgataaacgctcgacaaccgaacgccgccgccgactacgcgacgcattccgcccgccctcgctaaacgaaaacgctaaactaaataaccgataccgaattcctccctccgccttctcgcctctacgataaaaacccgaaacgaaaccacgaacacctaccgatcccccgcgaacaaacgcgacgaacgctaaattcgtcccgctaaccccgacccgctcgttacgtacgcctacccccaaaaacgcccgcttctccccccgcaacgaaaaaacgcgcccgccccgaccgccccttttcttctttctttcgatcccctaataacgaaaatactctttcgcccaaaacgaacgtctattttcgaataaaaaaaaaaaccgttcgacgcgaaccgccgcccgaacccccttatt

SEQ ID NO: 14315 - DNA, 511 bp, Artificial Sequence
  chemically treated genomic DNA (Homo sapiens) CpG-island No: 14315
ttttagtcgttttttttatttttttcgtttagcgcgacgagcggcgcggcggcgggaggcgcggagcgtcggagtgttttcgtcgcgcgcgggttcggtacggtgagcgttcggtagtcggacgtcgtcgtcgattgcgcggcgtatttcgttcgttttcgttgagcggggacgttgagttgggtggtcggtatcggattttttttttcgttttttcgtttttacgatggggattcggggcgagattacgaatatttgtcggtttttcgcgaatagacgcggcggacgttggattcgtttcgttaatttcggttcgttcgttgcgtgcgtttgtttttaaaggcgttcgttttttttttcgtaacgggggagcgcgttcgtttcggtcgtttttttttttttttttttcggttttttaataacgggggtattttttcgtttaaaacgggcgtttattttcgggtgaaaaaggaaatcgttcggcgcggatcgtcgttcgggtttttttatt

SEQ ID NO: 14316 - DNA, 511 bp, Artificial Sequence
  chemically treated genomic DNA (Homo sapiens) CpG-island No: 14316
aataaaaaaacccgaacgacgatccgcgccgaacgatttcctttttcacccgaaaataaacgcccgttttaaacgaaaaaatacccccgttattaaaaaaccgaaaaaaaaaaaaaaaaaaacgaccgaaacgaacgcgctcccccgttacgaaaaaaaaaacgaacgcctttaaaaacaaacgcacgcaacgaacgaaccgaaattaacgaaacgaatccaacgtccgccgcgtctattcgcgaaaaaccgacaaatattcgtaatctcgccccgaatccccatcgtaaaaacgaaaaaacgaaaaaaaaaatccgataccgaccacccaactcaacgtccccgctcaacgaaaacgaacgaaatacgccgcgcaatcgacgacgacgtccgactaccgaacgctcaccgtaccgaacccgcgcgcgacgaaaacactccgacgctccgcgcctcccgccgccgcgccgctcgtcgcgctaaacgaaaaaaataaaaaaaacgactaaaa

SEQ ID NO: 14317 - DNA, 642 bp, Artificial Sequence
  chemically treated genomic DNA (Homo sapiens) CpG-island No: 14317
cgattcgaattgcgcgtattaggagtacggtatatacgtatatattagtattagtcgagatatagagaatcgtatacgtcgtaaatcgaagatataaggtagataaggttatggtaagcgtacgaaagtattaaacgtttagaacgtacgttagacgtcgaatataatcgaagtatattaatatattatcgattcgcgcggagcgagttggattagagacgaaagtagataaataatcgtaaagattatagaatagaagatattagtcgaaaacgtatcgcgcgatataggattcgtaatatatacgttgagttatatagttatacggagcgtatatattaattataagtattaataagattagaagttgcgaggtacgatattgagagtaaatattttataaaacgtcggacgatggcgatgaaggtatagatgataatagagacgacgacggaacgagcgtaacgagagtaggtttacgcgataggagatagaacgagacgagatagtaggttagtcgatacgatttagcgatagttaatcgtcgtagagcgcgtatttagcgagtacgcgaagataatattaattagataatacgaataaagagtttattaagatagagtaatacgttagcgaagataa

SEQ ID NO: 14318 - DNA, 642 bp, Artificial Sequence
  chemically treated genomic DNA (Homo sapiens) CpG-island No: 14318
ttatcttcgctaacgtattactctatcttaataaactctttattcgtattatctaattaatattatcttcgcgtactcgctaaatacgcgctctacgacgattaactatcgctaaatcgtatcgactaacctactatctcgtctcgttctatctcctatcgcgtaaacctactctcgttacgctcgttccgtcgtcgtctctattatcatctataccttcatcgccatcgtccgacgttttataaaatatttactctcaatatcgtacctcgcaacttctaatcttattaatacttataattaatatatacgctccgtataactatataactcaacgtatatattacgaatcctatatcgcgcgatacgttttcgactaatatcttctattctataatctttacgattatttatctactttcgtctctaatccaactcgctccgcgcgaatcgataatatattaatatacttcgattatattcgacgtctaacgtacgttctaaacgtttaatactttcgtacgcttaccataaccttatctaccttatatcttcgatttacgacgtatacgattctctatatctcgactaatactaatatatacgtatataccgtactcctaatacgcgcaattcgaatcg

SEQ ID NO: 14319 - DNA, 642 bp, Artificial Sequence
  chemically treated genomic DNA (Homo sapiens) CpG-island No: 14319
ttgttttcgttggcgtattattttgttttagtgggttttttattcgtgttgtttaattggtattgttttcgcgtattcgttggatgcgcgttttgcggcggttagttatcgttgggtcgtgtcggttggtttgttgtttcgtttcgttttgttttttgtcgcgtagatttgttttcgttgcgttcgtttcgtcgtcgtttttgttgttatttgtgtttttatcgttatcgttcggcgttttgtgaggtgtttgtttttagtatcgtgtttcgtagtttttagttttgttggtgtttgtggttggtgtgtgcgtttcgtgtggttgtatagtttagcgtgtgtgttgcgggttttgtgtcgcgcggtgcgttttcgattggtgttttttgttttgtgatttttgcgattgtttgtttattttcgtttttggtttagttcgtttcgcgcgggtcgatggtgtgttggtgtgtttcggttgtgttcggcgtttgacgtacgttttgggcgtttagtattttcgtgcgtttattatggttttgtttgttttgtgttttcgatttgcggcgtgtgcggttttttatgtttcggttggtgttggtgtgtgcgtatatgtcgtgtttttggtgcgcgtagttcgagtcg

SEQ ID NO: 14320 - DNA, 642 bp, Artificial Sequence
  chemically treated genomic DNA (Homo sapiens) CpG-island No: 14320
cgactcgaactacgcgcaccaaaaacacgacatatacgcacacaccaacaccaaccgaaacataaaaaaccgcacacgccgcaaatcgaaaacacaaaacaaacaaaaccataataaacgcacgaaaatactaaacgcccaaaacgtacgtcaaacgccgaacacaaccgaaacacaccaacacaccatcgacccgcgcgaaacgaactaaaccaaaaacgaaaataaacaaacaatcgcaaaaatcacaaaacaaaaaacaccaatcgaaaacgcaccgcgcgacacaaaacccgcaacacacacgctaaactatacaaccacacgaaacgcacacaccaaccacaaacaccaacaaaactaaaaactacgaaacacgatactaaaaacaaacacctcacaaaacgccgaacgataacgataaaaacacaaataacaacaaaaacgacgacgaaacgaacgcaacgaaaacaaatctacgcgacaaaaaacaaaacgaaacgaaacaacaaaccaaccgacacgacccaacgataactaaccgccgcaaaacgcgcatccaacgaatacgcgaaaacaataccaattaaacaacacgaataaaaaacccactaaaacaaaataatacgccaacgaaaacaa

SEQ ID NO: 14321 - DNA, 654 bp, Artificial Sequence
  chemically treated genomic DNA (Homo sapiens) CpG-island No: 14321
gggcgtcgtttagggtatcgttaaggaggacgtcgtttagggtatcgttaaagagggcgtcgtttacggtatcgttaacgaggacgtcgtttagggtatcgttaacgaggatttcgtttacggaatcgttagcgaggacgtcgtttacggtatcgttagcgaggacgtcgtttagggtatcgttaaggaggacgtcgtttagggtatcgttaacgaggacgtcgtttagggtatcgttaaggaggacgtcgtttagggtatcgttaaggaggacgtcgtttagggtatcgttaacgagggcgtcgtttagggtatcgttaaagaggacgtcgtttagggtatcgttaacgaggacgtcgtttagggtatcgttaacgaggacgtcgtttacggaatcgttagcgaggacgtcgtttacggtatcgttagcgaggacgtcgtttagggtatcgttaaggaggatgtcgtttagggtatcgttaacgaggacgtcgtttagggtatcgttaacgaggacgtcgtttagggtatcgttaaagaggacgtcgtttacggtatcgttaacgagttgtatacgatatcgttaacgaggatattttataagtcgtcgttaataagtatattgtatataatatcgttaatgagggtattgta

SEQ ID NO: 14322 - DNA, 654 bp, Artificial Sequence
  chemically treated genomic DNA (Homo sapiens) CpG-island No: 14322
tacaataccctcattaacgatattatatacaatatacttattaacgacgacttataaaatatcctcgttaacgatatcgtatacaactcgttaacgataccgtaaacgacgtcctctttaacgataccctaaacgacgtcctcgttaacgataccctaaacgacgtcctcgttaacgataccctaaacgacatcctccttaacgataccctaaacgacgtcctcgctaacgataccgtaaacgacgtcctcgctaacgattccgtaaacgacgtcctcgttaacgataccctaaacgacgtcctcgttaacgataccctaaacgacgtcctctttaacgataccctaaacgacgccctcgttaacgataccctaaacgacgtcctccttaacgataccctaaacgacgtcctccttaacgataccctaaacgacgtcctcgttaacgataccctaaacgacgtcctccttaacgataccctaaacgacgtcctcgctaacgataccgtaaacgacgtcctcgctaacgattccgtaaacgaaatcctcgttaacgataccctaaacgacgtcctcgttaacgataccgtaaacgacgccctctttaacgataccctaaacgacgtcctccttaacgataccctaaacgacgccc

SEQ ID NO: 14323 - DNA, 654 bp, Artificial Sequence
  chemically treated genomic DNA (Homo sapiens) CpG-island No: 14323
tatagtgtttttattagcgatgttgtgtatagtgtatttgttagcgacggtttgtagggtgttttcgttagcgatgtcgtatatagttcgttggcgatgtcgtgggcggcgttttttttggcgatgttttgggcggcgttttcgttggcgatgttttgggcggcgttttcgttggcgatgttttgggcggtattttttttggcgatgttttggacggcgttttcgttggcgatgtcgtgggcggcgttttcgttggcgatttcgtgggcggcgttttcgttggcgatgttttgggcggcgttttcgttggcgatgttttgggcggcgttttttttggcgatgttttgggcggcgttttcgttggcgatgttttgggcggcgttttttttggcgatgttttgggcggcgttttttttggcgatgttttgggcggcgttttcgttggcgatgttttgggcggcgttttttttggcgatgttttggacggcgttttcgttggcgatgtcgtgggcggcgttttcgttggcgatttcgtgggcggagttttcgttggcgatgttttgggcggcgttttcgttggcgatgtcgtgggcggcgttttttttggcgatgttttgggcggcgttttttttggcgatgttttgggcggcgttt

SEQ ID NO: 14324 - DNA, 654 bp, Artificial Sequence
  chemically treated genomic DNA (Homo sapiens) CpG-island No: 14324
aaacgccgcccaaaacatcgccaaaaaaaacgccgcccaaaacatcgccaaaaaaaacgccgcccacgacatcgccaacgaaaacgccgcccaaaacatcgccaacgaaaactccgcccacgaaatcgccaacgaaaacgccgcccacgacatcgccaacgaaaacgccgtccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgccaacgaaaacgccgcccaaaacatcgccaaaaaaaacgccgcccaaaacatcgccaacgaaaacgccgcccaaaacatcgccaacgaaaacgccgcccacgaaatcgccaacgaaaacgccgcccacgacatcgccaacgaaaacgccgtccaaaacatcgccaaaaaaaataccgcccaaaacatcgccaacgaaaacgccgcccaaaacatcgccaacgaaaacgccgcccaaaacatcgccaaaaaaaacgccgcccacgacatcgccaacgaactatatacgacatcgctaacgaaaacaccctacaaaccgtcgctaacaaatacactatacacaacatcgctaataaaaacactata

SEQ ID NO: 14325 - DNA, 652 bp, Artificial Sequence
  chemically treated genomic DNA (Homo sapiens) CpG-island No: 14325
ttggcgatgttttgggcggcgttttttttggcgatgttttgggcggcgttttttttggcgatgttttgggcggcgttttcgttggcgatgttttgggcggcgttttttttggcgatgttttggacggcgttttcgttggcgatgtcgtgggcggcgttttcgttggcgatttcgtgggcggagttttcgttggcgatgttttgggcggcgttttcgttggcgatgtcgtgggcggcgttttttttggcgatgttttgggcggcgttttttttggcgatgttttgggcggcgttttcgttggcgatgttttgggcggcgttttcgttggcgatgttttgggcggcgttttttttggcgatgttttgggcggcgttttcgttggcgatgttttgggcggcgttttcgttggcgatgttttgggcggcgttttcgttggcgatgtcgtgggcggcgttttcgttggcgatgtcgtgggcggcgttttcgttggcgatgtttttgtcggcggtttcgttagcgatgtcgtgtatagtattttcgttagcgatgtcgtgtgtggcgttttcgttagtgatgtcgtgtacggtgtttttatggggagttagaaaaatatagagttaaggttagtgttttggtggtggagattgtgaat

SEQ ID NO: 14326 - DNA, 652 bp, Artificial Sequence
  chemically treated genomic DNA (Homo sapiens) CpG-island No: 14326
attcacaatctccaccaccaaaacactaaccttaactctatatttttctaactccccataaaaacaccgtacacgacatcactaacgaaaacgccacacacgacatcgctaacgaaaatactatacacgacatcgctaacgaaaccgccgacaaaaacatcgccaacgaaaacgccgcccacgacatcgccaacgaaaacgccgcccacgacatcgccaacgaaaacgccgcccaaaacatcgccaacgaaaacgccgcccaaaacatcgccaacgaaaacgccgcccaaaacatcgccaaaaaaaacgccgcccaaaacatcgccaacgaaaacgccgcccaaaacatcgccaacgaaaacgccgcccaaaacatcgccaaaaaaaacgccgcccaaaacatcgccaaaaaaaacgccgcccacgacatcgccaacgaaaacgccgcccaaaacatcgccaacgaaaactccgcccacgaaatcgccaacgaaaacgccgcccacgacatcgccaacgaaaacgccgtccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgccaa

SEQ ID NO: 14327 - DNA, 652 bp, Artificial Sequence
  chemically treated genomic DNA (Homo sapiens) CpG-island No: 14327
atttatagtttttattattagggtattgattttaattttgtgtttttttagttttttatgaggatatcgtatacgatattattaacgaggacgttatatacgatatcgttaacgaggatattgtatacgatatcgttaacgaggtcgtcgataagggtatcgttaacgaggacgtcgtttacggtatcgttagcgaggacgtcgtttacggtatcgttagcgaggacgtcgtttagggtatcgttagcgaggacgtcgtttagggtatcgttagcgaggacgtcgtttagggtatcgttaaggaggacgtcgtttagggtatcgttaacgaggacgtcgtttagggtatcgttaacgagggcgtcgtttagggtatcgttaaggaggacgtcgtttagggtatcgttaaagagggcgtcgtttacggtatcgttaacgaggacgtcgtttagggtatcgttaacgaggatttcgtttacggaatcgttagcgaggacgtcgtttacggtatcgttagcgaggacgtcgtttagggtatcgttaaggaggacgtcgtttagggtatcgttaacgaggacgtcgtttagggtatcgttaaggaggacgtcgtttagggtatcgttaaggaggacgtcgtttagggtatcgttaa

SEQ ID NO: 14328 - DNA, 652 bp, Artificial Sequence
  chemically treated genomic DNA (Homo sapiens) CpG-island No: 14328
ttaacgataccctaaacgacgtcctccttaacgataccctaaacgacgtcctccttaacgataccctaaacgacgtcctcgttaacgataccctaaacgacgtcctccttaacgataccctaaacgacgtcctcgctaacgataccgtaaacgacgtcctcgctaacgattccgtaaacgaaatcctcgttaacgataccctaaacgacgtcctcgttaacgataccgtaaacgacgccctctttaacgataccctaaacgacgtcctccttaacgataccctaaacgacgccctcgttaacgataccctaaacgacgtcctcgttaacgataccctaaacgacgtcctccttaacgataccctaaacgacgtcctcgctaacgataccctaaacgacgtcctcgctaacgataccctaaacgacgtcctcgctaacgataccgtaaacgacgtcctcgctaacgataccgtaaacgacgtcctcgttaacgatacccttatcgacgacctcgttaacgatatcgtatacaatatcctcgttaacgatatcgtatataacgtcctcgttaataatatcgtatacgatatcctcataaaaaactaaaaaaacacaaaattaaaatcaataccctaataataaaaactataaat

SEQ ID NO: 14329 - DNA, 502 bp, Artificial Sequence
  chemically treated genomic DNA (Homo sapiens) CpG-island No: 14329
ggaagataataagtcggtcgtcgttagcgtatttattgtttttagtgggatcgtatcgttttttttttaagtagaggtttcggcgtcgtcgacgtaagttcgaggtttttgggaggagtcgggagcgttcgaacgtatagttttgttttttaggcggttatcgtcggtttttcgtttgatttggacgggcgagtgggttaatgggtacgggacggtgggcggagaggttaatggtacggcgggagggggtagtgttttcgggtgtattttggcgacggtattgggaattttcgtgcggttagtggcgttttcgttcgggtagcgggttgagtgagttgtcgtacgtcgtcgttagtcgtatagttagtcgtcgtacgttgtcgggggaggggcgttagtcgttcgtattgcgtttagagatttacgtagtatttagtttcgttagttcgttaatatagtagtgtcggtttttttttttgtttggtattgtttttttttttcg

SEQ ID NO: 14330 - DNA, 502 bp, Artificial Sequence
  chemically treated genomic DNA (Homo sapiens) CpG-island No: 14330
cgaaaaaaaaaaacaataccaaacaaaaaaaaaaaccgacactactatattaacgaactaacgaaactaaatactacgtaaatctctaaacgcaatacgaacgactaacgcccctcccccgacaacgtacgacgactaactatacgactaacgacgacgtacgacaactcactcaacccgctacccgaacgaaaacgccactaaccgcacgaaaattcccaataccgtcgccaaaatacacccgaaaacactaccccctcccgccgtaccattaacctctccgcccaccgtcccgtacccattaacccactcgcccgtccaaatcaaacgaaaaaccgacgataaccgcctaaaaaacaaaactatacgttcgaacgctcccgactcctcccaaaaacctcgaacttacgtcgacgacgccgaaacctctacttaaaaaaaaaacgatacgatcccactaaaaacaataaatacgctaacgacgaccgacttattatcttcc

SEQ ID NO: 14331 - DNA, 502 bp, Artificial Sequence
  chemically treated genomic DNA (Homo sapiens) CpG-island No: 14331
cggggagggggggtagtgttaggtaaagaggggggtcggtattattgtgttggcggattggcgggattgggtgttgcgtgagtttttgagcgtagtgcgggcggttggcgtttttttttcggtagcgtgcggcggttggttgtgcggttggcggcggcgtgcggtagtttatttagttcgttgttcgagcggaaacgttattgatcgtacggggatttttagtgtcgtcgttagggtgtattcgggagtattgttttttttcgtcgtgttattggttttttcgtttatcgtttcgtatttattggtttattcgttcgtttaaattaggcggagagtcgacggtggtcgtttagagaatagggttgtgcgttcgggcgttttcggttttttttagaagtttcgggtttacgtcggcgacgtcggaatttttgtttgggaaggggacggtgcggttttattgggggtaatgggtgcgttagcggcggtcggtttgttgtttttt

SEQ ID NO: 14332 - DNA, 502 bp, Artificial Sequence
  chemically treated genomic DNA (Homo sapiens) CpG-island No: 14332
aaaaaacaacaaaccgaccgccgctaacgcacccattacccccaataaaaccgcaccgtccccttcccaaacaaaaattccgacgtcgccgacgtaaacccgaaacttctaaaaaaaaccgaaaacgcccgaacgcacaaccctattctctaaacgaccaccgtcgactctccgcctaatttaaacgaacgaataaaccaataaatacgaaacgataaacgaaaaaaccaataacacgacgaaaaaaaacaatactcccgaatacaccctaacgacgacactaaaaatccccgtacgatcaataacgtttccgctcgaacaacgaactaaataaactaccgcacgccgccgccaaccgcacaaccaaccgccgcacgctaccgaaaaaaaaacgccaaccgcccgcactacgctcaaaaactcacgcaacacccaatcccgccaatccgccaacacaataataccgacccccctctttacctaacactaccccccctccccg

SEQ ID NO: 14333 - DNA, 635 bp, Artificial Sequence
  chemically treated genomic DNA (Homo sapiens) CpG-island No: 14333
tcggggcggcgcgggggtcggcggttgtcgcgatttttttttggtagcgggaggttgagcgggcggcgcgacgcgggggtcgacgggggcgtcgggtggtcgcgtcggaagtgttttgcgcggtagaggaagcgtagggatagagcggagtaggtcgagtcggcggaaagggtttttgttgttgcgttcgggtaggggttgtcgcggttttaggtttcgtttcgagacgcggcgcggtttaggcgggaggcgattttttaggaagggattcggggcgggaggaggaagtgaggtcgcgcggaaggaaggcggcgagtttcggggtttcgaggttttggtcgcgttatagtatttatatggtttttggagtgggcgcggttttcgaggaattgttttacgacggtacgtgtgacgagtgcgagttcgacgaggtttcgggggtcgaggaagtgtgtcgagaatgcggtttttgttattgtcgtcgttatgtcgaggcgtataggtagaagttttttagttattatttggtcgaatacgtttacggtttttaggtttggatttcgttagttgacggagagggggcggggaaggaagaagcggaggttaaggtggagtaggagagggagatagaaagt

SEQ ID NO: 14334 - DNA, 635 bp, Artificial Sequence
  chemically treated genomic DNA (Homo sapiens) CpG-island No: 14334
actttctatctccctctcctactccaccttaacctccgcttcttccttccccgccccctctccgtcaactaacgaaatccaaacctaaaaaccgtaaacgtattcgaccaaataataactaaaaaacttctacctatacgcctcgacataacgacgacaataacaaaaaccgcattctcgacacacttcctcgacccccgaaacctcgtcgaactcgcactcgtcacacgtaccgtcgtaaaacaattcctcgaaaaccgcgcccactccaaaaaccatataaatactataacgcgaccaaaacctcgaaaccccgaaactcgccgccttccttccgcgcgacctcacttcctcctcccgccccgaatcccttcctaaaaaatcgcctcccgcctaaaccgcgccgcgtctcgaaacgaaacctaaaaccgcgacaacccctacccgaacgcaacaacaaaaaccctttccgccgactcgacctactccgctctatccctacgcttcctctaccgcgcaaaacacttccgacgcgaccacccgacgcccccgtcgacccccgcgtcgcgccgcccgctcaacctcccgctaccaaaaaaaaatcgcgacaaccgccgacccccgcgccgccccga

SEQ ID NO: 14335 - DNA, 635 bp, Artificial Sequence
  chemically treated genomic DNA (Homo sapiens) CpG-island No: 14335
gttttttattttttttttttgttttattttgattttcgtttttttttttttcgtttttttttcgttagttggcggggtttaggtttgggagtcgtggacgtattcggttagatggtgattgaggaatttttgtttgtgcgtttcggtatggcggcggtagtagtagaagtcgtattttcggtatattttttcggttttcggagtttcgtcgggttcgtattcgttatacgtgtcgtcgtgaggtagtttttcgaaggtcgcgtttattttagaggttatgtgggtgttgtgacgcggttaaggtttcggggtttcggggttcgtcgtttttttttcgcgcggttttatttttttttttcgtttcgggtttttttttagggagtcgtttttcgtttggatcgcgtcgcgtttcgaagcgggatttggggtcgcggtagtttttgttcgggcgtagtagtaaagatttttttcgtcggttcggtttgtttcgttttgtttttgcgttttttttgtcgcgtaaggtattttcggcgcggttattcggcgttttcgtcggttttcgcgtcgcgtcgttcgtttagtttttcgttattagggagagatcgcggtagtcgtcggttttcgcgtcgtttcgg

SEQ ID NO: 14336 - DNA, 635 bp, Artificial Sequence
  chemically treated genomic DNA (Homo sapiens) CpG-island No: 14336
ccgaaacgacgcgaaaaccgacgactaccgcgatctctccctaataacgaaaaactaaacgaacgacgcgacgcgaaaaccgacgaaaacgccgaataaccgcgccgaaaataccttacgcgacaaaaaaaacgcaaaaacaaaacgaaacaaaccgaaccgacgaaaaaaatctttactactacgcccgaacaaaaactaccgcgaccccaaatcccgcttcgaaacgcgacgcgatccaaacgaaaaacgactccctaaaaaaaaacccgaaacgaaaaaaaaaaataaaaccgcgcgaaaaaaaaacgacgaaccccgaaaccccgaaaccttaaccgcgtcacaacacccacataacctctaaaataaacgcgaccttcgaaaaactacctcacgacgacacgtataacgaatacgaacccgacgaaactccgaaaaccgaaaaaatataccgaaaatacgacttctactactaccgccgccataccgaaacgcacaaacaaaaattcctcaatcaccatctaaccgaatacgtccacgactcccaaacctaaaccccgccaactaacgaaaaaaaaacgaaaaaaaaaaaaacgaaaatcaaaataaaacaaaaaaaaaaaataaaaaac

SEQ ID NO: 14337 - DNA, 1889 bp, Artificial Sequence
  chemically treated genomic DNA (Homo sapiens) CpG-island No: 14337
gtttggcgaggaagtcgaggcggcgttgtagtagttgagcgtgggggtttgtaagggcggttagttcggggaagcgaggttcgtggcgtcggtagaggcgtagtagtcgggtcgcggcgttttgttcgcggtgtagttttaggacgcgtcgcgcggttcgttcgcggaatacgtatattgattgtaatagcggttcgttatatttgttttatatgtttgttattcggtagtcgtgtattaagttcgttttattgtttagaaagattagcgtttcgttcggatcgcggtgtaggttgttggtggtacgttgtatgacgcgcgggttttattgtaggttgaagaggttgtttacgagtcggtcgaagttggtcgttaggtagtcgaaaaggattaagtcggtttattgtattaggtttattagtttcgtttggttgaggttggttagtttattttcggtatttcggagggggcgtagacggtcgtttttcgagcgttagggcgcgggtattattacgttcgtgaggttgggtagttagcgtgttaggtttattacgttgttttcggtttagtgcgtagcgcgtagttttttttgtatttgcgtttattgcgcgtttcgagtttttattcgagttagtgttagcggcggtacgtggcgttggaggtttagtaggcgcgttagatagtaagatagggtttcgttttgaatttgtttcgggttgatgtcgtagcgtacgtaggcgcgggtgtcgtcggtaaaacgggttagtcggttggagttgcgttcgtaattttcgcgttttagggttattattcgggcgtcgcgagtcgtttttagttacgtcgtcgtttgggttttcgaaaagttcgggggtatttgtttttttaggtcgcggttttagaagacgttttcgtgtatcgcggcgttttttttcggtcggggttgtttggttgatacgtgttatttgggttcgtttcgggattgtcggggcgggtcgttcgcgtcggtcgttagggtgagtagcgttcggaaagtttttagggagtcgtcgcgggcgttttacgttaggggcgggggtagagggaagcgaggcgcgggcgcggggtcgtcgtttcgggtcgggcgtcgtgggagtcggttttcgggcggtcgggaggcgggtagttcggttcgcggcggtaggagttttttttatagcgttagtagcgagtttagcgttagtagttagagtttcgcggtggcggcggcgtttcgtatttttttgtttatgttttcgcggttgtgtcggtgcgtcgtcgtcgttttaagtcgagtttaggtattcgggtttcggcggcgaggcgggttcggtagtttgtgggtttcggggtttcgggcgtttcggttttatcgcggtcgcggggcgttgcggggttttgttcggcgtttcgttcggcgttgggaattcgagttttcgtcgttttttagttgtttttgtatttcgttgtgagatttttcggtgggcgcgatttataggcgttcggattacgtgggagttagggggatttttttttttttttttcgttttcgtttttcgtttttcgttttttcgttttttttttttttttttttatttaaagcggcgatggtttttttcgagagggagaggcggttttatattcggttcgggatttgggggtttggaggaagtcggattggttgcgttcgcgtcggggcgtaggagggggtggcgtagagtcggagtttggggtttggcgggagggacgcgttttgggttttcgcgggggtgttttggtcgtcgggtttttttgtttaggtagcgcgggttttttgtaaattttagatagatttttattttttttcgagtttcgttaggttaggattaggtagg

SEQ ID NO: 14338 - DNA, 1889 bp, Artificial Sequence
  chemically treated genomic DNA (Homo sapiens) CpG-island No: 14338
cctacctaatcctaacctaacgaaactcgaaaaaaaataaaaatctatctaaaatttacaaaaaacccgcgctacctaaacaaaaaaacccgacgaccaaaacacccccgcgaaaacccaaaacgcgtccctcccgccaaaccccaaactccgactctacgccaccccctcctacgccccgacgcgaacgcaaccaatccgacttcctccaaacccccaaatcccgaaccgaatataaaaccgcctctccctctcgaaaaaaaccatcgccgctttaaataaaaaaaaaaaaaaaaaaaacgaaaaaacgaaaaacgaaaaacgaaaacgaaaaaaaaaaaaaaaaatccccctaactcccacgtaatccgaacgcctataaatcgcgcccaccgaaaaatctcacaacgaaatacaaaaacaactaaaaaacgacgaaaactcgaattcccaacgccgaacgaaacgccgaacaaaaccccgcaacgccccgcgaccgcgataaaaccgaaacgcccgaaaccccgaaacccacaaactaccgaacccgcctcgccgccgaaacccgaatacctaaactcgacttaaaacgacgacgacgcaccgacacaaccgcgaaaacataaacaaaaaaatacgaaacgccgccgccaccgcgaaactctaactactaacgctaaactcgctactaacgctataaaaaaaactcctaccgccgcgaaccgaactacccgcctcccgaccgcccgaaaaccgactcccacgacgcccgacccgaaacgacgaccccgcgcccgcgcctcgcttccctctacccccgcccctaacgtaaaacgcccgcgacgactccctaaaaactttccgaacgctactcaccctaacgaccgacgcgaacgacccgccccgacaatcccgaaacgaacccaaataacacgtatcaaccaaacaaccccgaccgaaaaaaaacgccgcgatacacgaaaacgtcttctaaaaccgcgacctaaaaaaacaaatacccccgaacttttcgaaaacccaaacgacgacgtaactaaaaacgactcgcgacgcccgaataataaccctaaaacgcgaaaattacgaacgcaactccaaccgactaacccgttttaccgacgacacccgcgcctacgtacgctacgacatcaacccgaaacaaattcaaaacgaaaccctatcttactatctaacgcgcctactaaacctccaacgccacgtaccgccgctaacactaactcgaataaaaactcgaaacgcgcaataaacgcaaatacaaaaaaaactacgcgctacgcactaaaccgaaaacaacgtaataaacctaacacgctaactacccaacctcacgaacgtaataatacccgcgccctaacgctcgaaaaacgaccgtctacgccccctccgaaataccgaaaataaactaaccaacctcaaccaaacgaaactaataaacctaatacaataaaccgacttaatccttttcgactacctaacgaccaacttcgaccgactcgtaaacaacctcttcaacctacaataaaacccgcgcgtcatacaacgtaccaccaacaacctacaccgcgatccgaacgaaacgctaatctttctaaacaataaaacgaacttaatacacgactaccgaataacaaacatataaaacaaatataacgaaccgctattacaatcaatatacgtattccgcgaacgaaccgcgcgacgcgtcctaaaactacaccgcgaacaaaacgccgcgacccgactactacgcctctaccgacgccacgaacctcgcttccccgaactaaccgcccttacaaacccccacgctcaactactacaacgccgcctcgacttcctcgccaaac

SEQ ID NO: 14339 - DNA, 1889 bp, Artificial Sequence
  chemically treated genomic DNA (Homo sapiens) CpG-island No: 14339
tttgtttgattttagtttggcggagttcggaaagaggtggaaatttgtttgaagtttgtaggagattcgcgttgtttaggtaaagggattcggcgattaagatattttcgcgagggtttagggcgcgtttttttcgttaggttttagatttcggttttgcgttatttttttttacgtttcggcgcgggcgtagttagttcggttttttttaggtttttaagtttcggatcgagtgtggggtcgtttttttttttcggaaggagttatcgtcgttttaagtggaagaggagaggaagggggcgggggagcggggggcggggagcggaggcggaggagggggagggggatttttttggtttttacgtggttcgggcgtttgtgaatcgcgtttatcggagggttttatagcgaaatataaaagtagttgggaagcggcggggattcgagtttttagcgtcgggcggagcgtcggatagagtttcgtagcgtttcgcggtcgcgatggggtcgaagcgttcgaagtttcggagtttataaattgtcgggttcgtttcgtcgtcgggattcgggtgtttgggttcggtttgaagcggcggcggcgtatcggtatagtcgcgggagtatgggtaggaggatgcggggcgtcgtcgttatcgcggggttttggttgttggcgttgggttcgttgttggcgttgtggggagggtttttgtcgtcgcggatcgagttgttcgtttttcggtcgttcgaagatcgatttttacggcgttcggttcggagcggcggtttcgcgttcgcgtttcgtttttttttgttttcgtttttggcgtgggacgttcgcggcggttttttgaaaatttttcgggcgttgtttattttggcggtcggcgcggacggttcgtttcggtagtttcggagcgagtttaggtggtacgtgttagttaggtagtttcggtcggaggagagcgtcgcggtgtacgggggcgttttttggagtcgcggtttggaggagtaggtgttttcgggtttttcggaggtttaggcggcggcgtggttggaggcggttcgcggcgttcggatggtggttttggagcgcgggggttgcgggcgtagttttaatcgattggttcgttttgtcgacggtattcgcgtttgcgtgcgttacggtattaattcggagtagatttagggcgaggttttgttttattatttggcgcgtttgttgggtttttagcgttacgtgtcgtcgttggtattggttcgggtggaggttcggggcgcgtagtgggcgtaggtgtaggaggagttgcgcgttgcgtattggatcgagggtagcgtggtgagtttgatacgttggttgtttaattttacggacgtggtggtgttcgcgttttggcgttcggaggacggtcgtttgcgtttttttcgggatgtcgggggtgagttggttaattttagttaggcggagttggtggatttagtataatggatcgatttaatttttttcgattatttgacggttaatttcgatcggttcgtaagtaatttttttagtttgtagtgggattcgcgcgttatgtagcgtgttattagtaatttgtatcgcggttcgggcggggcgttggtttttttggataatgaggcgggtttggtgtacggttatcgggtagtaggtatgtgggataagtataacgagtcgttgttgtagttagtgtgcgtgtttcgcgagcggatcgcgcggcgcgttttggagttgtatcgcggataggacgtcgcggttcggttgttgcgtttttatcggcgttacgagtttcgttttttcgagttggtcgtttttgtagatttttacgtttagttgttatagcgtcgtttcgattttttcgttaagt

SEQ ID NO: 14340 - DNA, 1889 bp, Artificial Sequence
  chemically treated genomic DNA (Homo sapiens) CpG-island No: 14340
acttaacgaaaaaatcgaaacgacgctataacaactaaacgtaaaaatctacaaaaacgaccaactcgaaaaaacgaaactcgtaacgccgataaaaacgcaacaaccgaaccgcgacgtcctatccgcgatacaactccaaaacgcgccgcgcgatccgctcgcgaaacacgcacactaactacaacaacgactcgttatacttatcccacatacctactacccgataaccgtacaccaaacccgcctcattatccaaaaaaaccaacgccccgcccgaaccgcgatacaaattactaataacacgctacataacgcgcgaatcccactacaaactaaaaaaattacttacgaaccgatcgaaattaaccgtcaaataatcgaaaaaaattaaatcgatccattatactaaatccaccaactccgcctaactaaaattaaccaactcacccccgacatcccgaaaaaaacgcaaacgaccgtcctccgaacgccaaaacgcgaacaccaccacgtccgtaaaattaaacaaccaacgtatcaaactcaccacgctaccctcgatccaatacgcaacgcgcaactcctcctacacctacgcccactacgcgccccgaacctccacccgaaccaataccaacgacgacacgtaacgctaaaaacccaacaaacgcgccaaataataaaacaaaacctcgccctaaatctactccgaattaataccgtaacgcacgcaaacgcgaataccgtcgacaaaacgaaccaatcgattaaaactacgcccgcaacccccgcgctccaaaaccaccatccgaacgccgcgaaccgcctccaaccacgccgccgcctaaacctccgaaaaacccgaaaacacctactcctccaaaccgcgactccaaaaaacgcccccgtacaccgcgacgctctcctccgaccgaaactacctaactaacacgtaccacctaaactcgctccgaaactaccgaaacgaaccgtccgcgccgaccgccaaaataaacaacgcccgaaaaattttcaaaaaaccgccgcgaacgtcccacgccaaaaacgaaaacaaaaaaaaacgaaacgcgaacgcgaaaccgccgctccgaaccgaacgccgtaaaaatcgatcttcgaacgaccgaaaaacgaacaactcgatccgcgacgacaaaaaccctccccacaacgccaacaacgaacccaacgccaacaaccaaaaccccgcgataacgacgacgccccgcatcctcctacccatactcccgcgactataccgatacgccgccgccgcttcaaaccgaacccaaacacccgaatcccgacgacgaaacgaacccgacaatttataaactccgaaacttcgaacgcttcgaccccatcgcgaccgcgaaacgctacgaaactctatccgacgctccgcccgacgctaaaaactcgaatccccgccgcttcccaactacttttatatttcgctataaaaccctccgataaacgcgattcacaaacgcccgaaccacgtaaaaaccaaaaaaatccccctccccctcctccgcctccgctccccgccccccgctcccccgcccccttcctctcctcttccacttaaaacgacgataactccttccgaaaaaaaaaaacgaccccacactcgatccgaaacttaaaaacctaaaaaaaaccgaactaactacgcccgcgccgaaacgtaaaaaaaaataacgcaaaaccgaaatctaaaacctaacgaaaaaaacgcgccctaaaccctcgcgaaaatatcttaatcgccgaatccctttacctaaacaacgcgaatctcctacaaacttcaaacaaatttccacctctttccgaactccgccaaactaaaatcaaacaaa

SEQ ID NO: 14341 - DNA, 897 bp, Artificial Sequence
  chemically treated genomic DNA (Homo sapiens) CpG-island No: 14341
cggcggtcgcggaatttaggaaataattttattcgttcgaggcgttttgtgggggcggtttcgattttttcgtcgttttttttcgcggagtattagattcggggtcgacggtcgcggggcggatagtttttttttcggggtcgggatgcgttgagtatttcggtttaatttgttttttcggggtggtgatttcgacgcgaaggatcgggcgagttgttgtttttcgggggatattagttttcggcgttcgtttaaggagggaggaaggaagggtttttatcgtgtttgcgtaggagtgagttttatttgttgtatttgcgggcgggcggggtcggcggttttaaggttagtcgaggtcggagtgcgcggttcgcggcgaggtcggtttcgtcgtcgtcgtcgatttttagttcgggttagttacggtcggcgtcggttcgcgggtagtttagtagcgcggtttggttgaagaagatatttttggtcgcgtaggtttcgcgttttttatattcgttcggttcgtttttagatattttttttagttcgttttcgttggcgtcgggcgggacgtttaggatgtcgtatagtttcgtgttagttacgttagttatggcggtcggtcgggtagtgttcggggagaaggtggcgaagtagatagagcggagtcgggtttataagcggcgtcggcggcggtataggtcgagggagatagcgagggggaagcgggggcggggttgaattttgatttagcgtacggtgcgtcgtgacgtcgttgtgtagagttcgttttcgagcgttcgaggcgcggttattggggtcgaagtattgaagagtgggttaggttttttgtttttttttaggtttaggcggttgggtagggttaacgtaggaaatgaa

SEQ ID NO: 14342 - DNA, 897 bp, Artificial Sequence
  chemically treated genomic DNA (Homo sapiens) CpG-island No: 14342
ttcatttcctacgttaaccctacccaaccgcctaaacctaaaaaaaaacaaaaaacctaacccactcttcaatacttcgaccccaataaccgcgcctcgaacgctcgaaaacgaactctacacaacgacgtcacgacgcaccgtacgctaaatcaaaattcaaccccgcccccgcttccccctcgctatctccctcgacctataccgccgccgacgccgcttataaacccgactccgctctatctacttcgccaccttctccccgaacactacccgaccgaccgccataactaacgtaactaacacgaaactatacgacatcctaaacgtcccgcccgacgccaacgaaaacgaactaaaaaaaatatctaaaaacgaaccgaacgaatataaaaaacgcgaaacctacgcgaccaaaaatatcttcttcaaccaaaccgcgctactaaactacccgcgaaccgacgccgaccgtaactaacccgaactaaaaatcgacgacgacgacgaaaccgacctcgccgcgaaccgcgcactccgacctcgactaaccttaaaaccgccgaccccgcccgcccgcaaatacaacaaataaaactcactcctacgcaaacacgataaaaacccttccttcctccctccttaaacgaacgccgaaaactaatatcccccgaaaaacaacaactcgcccgatccttcgcgtcgaaatcaccaccccgaaaaaacaaattaaaccgaaatactcaacgcatcccgaccccgaaaaaaaaactatccgccccgcgaccgtcgaccccgaatctaatactccgcgaaaaaaaacgacgaaaaaatcgaaaccgcccccacaaaacgcctcgaacgaataaaattatttcctaaattccgcgaccgccg

SEQ ID NO: 14343 - DNA, 897 bp, Artificial Sequence
  chemically treated genomic DNA (Homo sapiens) CpG-island No: 14343
tttattttttacgttggttttgtttagtcgtttggatttggaggaaaatagagaatttggtttattttttaatatttcgattttagtggtcgcgtttcgggcgttcgggggcgggttttgtatagcgacgttacggcgtatcgtgcgttgggttaaagtttagtttcgttttcgtttttttttcgttgtttttttcggtttgtgtcgtcgtcgacgtcgtttgtgggttcgatttcgttttgtttgtttcgttatttttttttcgagtattgttcggtcggtcgttatggttaacgtggttgatacgaagttgtacgatattttgggcgtttcgttcggcgttagcgagaacgagttgaagaaggtatttgggagcgggtcgggcgggtgtgaggggcgcggggtttgcgcggttagggatgttttttttagttaggtcgcgttattgggttgttcgcgagtcggcgtcggtcgtgattggttcgggttgggagtcggcggcggcggcgggatcggtttcgtcgcgagtcgcgtatttcggtttcggttgattttggggtcgtcggtttcgttcgttcgtagatgtagtaaataaaatttatttttgcgtaaatacgatgggagttttttttttttttttttttgaacgagcgtcgggggttggtatttttcgggaggtagtagttcgttcggtttttcgcgtcgaggttattatttcggaaaaataggttggatcgaggtgtttagcgtatttcggtttcgagagagaagttgttcgtttcgcggtcgtcggtttcgggtttggtgtttcgcggggaggaacggcggggaggtcgaggtcgtttttatagagcgtttcgggcggatggggttgttttttgggtttcgcggtcgtcg

SEQ ID NO: 14344 - DNA, 897 bp, Artificial Sequence
  chemically treated genomic DNA (Homo sapiens) CpG-island No: 14344
cgacgaccgcgaaacccaaaaaacaaccccatccgcccgaaacgctctataaaaacgacctcgacctccccgccgttcctccccgcgaaacaccaaacccgaaaccgacgaccgcgaaacgaacaacttctctctcgaaaccgaaatacgctaaacacctcgatccaacctatttttccgaaataataacctcgacgcgaaaaaccgaacgaactactacctcccgaaaaataccaacccccgacgctcgttcaaaaaaaaaaaaaaaaaaaactcccatcgtatttacgcaaaaataaattttatttactacatctacgaacgaacgaaaccgacgaccccaaaatcaaccgaaaccgaaatacgcgactcgcgacgaaaccgatcccgccgccgccgccgactcccaacccgaaccaatcacgaccgacgccgactcgcgaacaacccaataacgcgacctaactaaaaaaaacatccctaaccgcgcaaaccccgcgcccctcacacccgcccgacccgctcccaaataccttcttcaactcgttctcgctaacgccgaacgaaacgcccaaaatatcgtacaacttcgtatcaaccacgttaaccataacgaccgaccgaacaatactcgaaaaaaaaataacgaaacaaacaaaacgaaatcgaacccacaaacgacgtcgacgacgacacaaaccgaaaaaaacaacgaaaaaaaaacgaaaacgaaactaaactttaacccaacgcacgatacgccgtaacgtcgctatacaaaacccgcccccgaacgcccgaaacgcgaccactaaaatcgaaatattaaaaaataaaccaaattctctattttcctccaaatccaaacgactaaacaaaaccaacgtaaaaaataaa

SEQ ID NO: 14345 - DNA, 640 bp, Artificial Sequence
  chemically treated genomic DNA (Homo sapiens) CpG-island No: 14345
cgttttttttggcgttcgggggtatcggatcgcggttcgtcgggatggaggtaggtaggtagcgtttcgggagggttttagggagcggttcggagttgttcggcggggcgtttagggcgtagcgggtagcgtttatcgagggcgcgtaggtatttttcgaaattttcgttgattaatattttttagtatttagtgaagtcgattggtatttcggggagtgattggagttagttggttataagcgggcgggacggttggagattgtcgggatagcggttgtcggtgttacgcgggtggtgggcggttcggaaatgagcgtttttcggggatagggggttttgcggggcggcgatagttggatttttagcgcgtataaagtttgcgggaggatttattgtagcggtcgttttttttcgtttagcgagggcgggcgtaggggcgggggatgtcgaagggttaggtttgtttaggtcgcgttattttcgttttagacgtttagttcgttttttttataaaggaagaggagatcggagacgggacgtttgttttgttggtcgaatttttcggttgttggggattttttttaaacgttattaattttttatatttagtagttattcgggagttgggaaataatttt

SEQ ID NO: 14346 - DNA, 640 bp, Artificial Sequence
  chemically treated genomic DNA (Homo sapiens) CpG-island No: 14346
aaaattatttcccaactcccgaataactactaaatataaaaaattaataacgtttaaaaaaaatccccaacaaccgaaaaattcgaccaacaaaacaaacgtcccgtctccgatctcctcttcctttataaaaaaaacgaactaaacgtctaaaacgaaaataacgcgacctaaacaaacctaacccttcgacatcccccgcccctacgcccgccctcgctaaacgaaaaaaaacgaccgctacaataaatcctcccgcaaactttatacgcgctaaaaatccaactatcgccgccccgcaaaaccccctatccccgaaaaacgctcatttccgaaccgcccaccacccgcgtaacaccgacaaccgctatcccgacaatctccaaccgtcccgcccgcttataaccaactaactccaatcactccccgaaataccaatcgacttcactaaatactaaaaaatattaatcaacgaaaatttcgaaaaatacctacgcgccctcgataaacgctacccgctacgccctaaacgccccgccgaacaactccgaaccgctccctaaaaccctcccgaaacgctacctacctacctccatcccgacgaaccgcgatccgatacccccgaacgccaaaaaaaacg

SEQ ID NO: 14347 - DNA, 640 bp, Artificial Sequence
  chemically treated genomic DNA (Homo sapiens) CpG-island No: 14347
gagattgttttttaattttcgagtggttgttgagtgtgagaagttaatggcgtttgaaggaaatttttagtagtcgaagagttcggttaataaagtaaacgtttcgttttcggttttttttttttttgtaggggaaacgaattgaacgtttgaaacgaaggtggcgcggtttggataaatttgatttttcgatatttttcgtttttgcgttcgttttcgttaagcggggaggagcgatcgttataatggattttttcgtaggttttgtgcgcgttgggaatttagttgtcgtcgtttcgtagagttttttgttttcggagggcgtttattttcgggtcgtttattattcgcgtagtatcggtagtcgttgtttcggtagtttttagtcgtttcgttcgtttgtggttaattggttttagttatttttcgaaatgttagtcgattttattgggtattggaagatgttggttaacgagaatttcgaggagtatttgcgcgttttcggtaagcgttgttcgttgcgttttgggcgtttcgtcgagtagtttcgggtcgttttttagagttttttcgagacgttgtttgtttgtttttatttcggcgagtcgcggttcggtgttttcggacgttagaaagggcg

SEQ ID NO: 14348 - DNA, 640 bp, Artificial Sequence
  chemically treated genomic DNA (Homo sapiens) CpG-island No: 14348
cgccctttctaacgtccgaaaacaccgaaccgcgactcgccgaaataaaaacaaacaaacaacgtctcgaaaaaactctaaaaaacgacccgaaactactcgacgaaacgcccaaaacgcaacgaacaacgcttaccgaaaacgcgcaaatactcctcgaaattctcgttaaccaacatcttccaatacccaataaaatcgactaacatttcgaaaaataactaaaaccaattaaccacaaacgaacgaaacgactaaaaactaccgaaacaacgactaccgatactacgcgaataataaacgacccgaaaataaacgccctccgaaaacaaaaaactctacgaaacgacgacaactaaattcccaacgcgcacaaaacctacgaaaaaatccattataacgatcgctcctccccgcttaacgaaaacgaacgcaaaaacgaaaaatatcgaaaaatcaaatttatccaaaccgcgccaccttcgtttcaaacgttcaattcgtttcccctacaaaaaaaaaaaaaaccgaaaacgaaacgtttactttattaaccgaactcttcgactactaaaaatttccttcaaacgccattaacttctcacactcaacaaccactcgaaaattaaaaaacaatctc

SEQ ID NO: 14349 - DNA, 595 bp, Artificial Sequence
  chemically treated genomic DNA (Homo sapiens) CpG-island No: 14349
cggcgtttattaagttttcgagcgcggtttcggtttttttggtttcgttttttacgtttagtagttttttttcgttgtttcgtaggatcggtttcgtgggcgacgtgatttcgggtcggttttattggtagtttagtagcgtttttattagggcgtcgtgcgtgtgggtggttttgggcgtcgggtcgggtaggtgggcgcgattttcgagtttggtttttagtttttttttaaagtttttttacgagcgggattttagttcgcggaagttagatacgcgggacggtcggtttcgcgttttttgcgagttaaagaatttgaaggtttagtggattttggttaggtcgaatcggtaatttagataggtgaggaggcgtagggcggttcgtcggattcggttgtggcgggcggcgtcgttcgcggtgtttagtagtagtattattttgtgatagtatgttatatcggtcgtgtcgtcgtttcggggtttcggttcgggttcgcgttatcgttttttagtttttttttttagggaaatagtattatttattgtttttttttgggattttggtcgaaaggttttcgcgttttttaggaa

SEQ ID NO: 14350 - DNA, 595 bp, Artificial Sequence
  chemically treated genomic DNA (Homo sapiens) CpG-island No: 14350
ttcctaaaaaacgcgaaaacctttcgaccaaaatcccaaaaaaaaacaataaataatactatttccctaaaaaaaaaaactaaaaaacgataacgcgaacccgaaccgaaaccccgaaacgacgacacgaccgatataacatactatcacaaaataatactactactaaacaccgcgaacgacgccgcccgccacaaccgaatccgacgaaccgccctacgcctcctcacctatctaaattaccgattcgacctaaccaaaatccactaaaccttcaaattctttaactcgcaaaaaacgcgaaaccgaccgtcccgcgtatctaacttccgcgaactaaaatcccgctcgtaaaaaaactttaaaaaaaaactaaaaaccaaactcgaaaatcgcgcccacctacccgacccgacgcccaaaaccacccacacgcacgacgccctaataaaaacgctactaaactaccaataaaaccgacccgaaatcacgtcgcccacgaaaccgatcctacgaaacaacgaaaaaaaactactaaacgtaaaaaacgaaaccaaaaaaaccgaaaccgcgctcgaaaacttaataaacgccg

SEQ ID NO: 14351 - DNA, 595 bp, Artificial Sequence
  chemically treated genomic DNA (Homo sapiens) CpG-island No: 14351
tttttggagagcgcgggagtttttcgattagggttttaaaggaaagtagtgagtggtgttgtttttttgaaggaagggattaagggacggtggcgcgggttcggatcggggtttcggggcggcggtacggtcgatatggtatgttgttataaagtaatgttgttgttggatatcgcgggcggcgtcgttcgttatagtcgggttcggcgggtcgttttgcgtttttttatttatttgagttgtcgattcggtttggttagggtttattgggtttttaagttttttgattcgtagggggcgcggagtcggtcgtttcgcgtgtttgattttcgcgagttggggtttcgttcgtgggaggattttgaggaggagttggaggttaggttcgaggatcgcgtttatttgttcggttcggcgtttagggttatttatacgtacggcgttttgatggagacgttgttagattattagtgggatcggttcgagattacgtcgtttacgaagtcgattttgcggagtagcgggaggagattgttggacgtggagagcgaggttaaggaggtcgaggtcgcgttcgggggtttggtgaacgtcg

SEQ ID NO: 14352 - DNA, 595 bp, Artificial Sequence
  chemically treated genomic DNA (Homo sapiens) CpG-island No: 14352
cgacgttcaccaaacccccgaacgcgacctcgacctccttaacctcgctctccacgtccaacaatctcctcccgctactccgcaaaatcgacttcgtaaacgacgtaatctcgaaccgatcccactaataatctaacaacgtctccatcaaaacgccgtacgtataaataaccctaaacgccgaaccgaacaaataaacgcgatcctcgaacctaacctccaactcctcctcaaaatcctcccacgaacgaaaccccaactcgcgaaaatcaaacacgcgaaacgaccgactccgcgccccctacgaatcaaaaaacttaaaaacccaataaaccctaaccaaaccgaatcgacaactcaaataaataaaaaaacgcaaaacgacccgccgaacccgactataacgaacgacgccgcccgcgatatccaacaacaacattactttataacaacataccatatcgaccgtaccgccgccccgaaaccccgatccgaacccgcgccaccgtcccttaatcccttccttcaaaaaaacaacaccactcactactttcctttaaaaccctaatcgaaaaactcccgcgctctccaaaaa

SEQ ID NO: 14353 - DNA, 715 bp, Artificial Sequence
  chemically treated genomic DNA (Homo sapiens) CpG-island No: 14353
gttttcgtcggtatttattcgtcgtttttttttcggcggatttagtttcggcgacgaggttgtttttcgtttatttgtcgttcgcgggttttgtagcggggtttcgcgtgttttttattttaggattttacgattcgggtttagggtatcgaggcgtatttcgtcggcgagagtcggttttcgattacggaggggtagtgcgagaagagtcgagcggcgaggttcggttcgtcgtttttttttgttcgcgcgtttaaggatattttgtttttttttttaaggataaaggataataaaaggagttagggagttatttatcgggttcgagcgcggttatcggtattttttggtcgtttaaattcgagtttcgggtcggatcgttcgttcgagtttttcgttcgcgtcgggtttagtcgtcggggttcgggggagttttcgaggcggtaatcgtagcggcgttttcggcgtcgtgggttcggtcgttttgggcgtttttgtcgcgggttgtgacgtcgacgcgcgcggttcgtttcgttttagtcgcggtagttttattttcgcgggtttgttggtcgttcgggcgtagtttttcgtcggtcggcgggtttcgcggtcgcggcggaacgtttgatagttcggggtgttgttgttttttcggttattttgtgtcgtgtgtgtggtgtttttttttcgttttttttttaggttttatttt

SEQ ID NO: 14354 - DNA, 715 bp, Artificial Sequence
  chemically treated genomic DNA (Homo sapiens) CpG-island No: 14354
aaaataaaacctaaaaaaaaaacgaaaaaaaaacaccacacacacgacacaaaataaccgaaaaaacaacaacaccccgaactatcaaacgttccgccgcgaccgcgaaacccgccgaccgacgaaaaactacgcccgaacgaccaacaaacccgcgaaaataaaactaccgcgactaaaacgaaacgaaccgcgcgcgtcgacgtcacaacccgcgacaaaaacgcccaaaacgaccgaacccacgacgccgaaaacgccgctacgattaccgcctcgaaaactcccccgaaccccgacgactaaacccgacgcgaacgaaaaactcgaacgaacgatccgacccgaaactcgaatttaaacgaccaaaaaataccgataaccgcgctcgaacccgataaataactccctaactccttttattatcctttatccttaaaaaaaaaaacaaaatatccttaaacgcgcgaacaaaaaaaaacgacgaaccgaacctcgccgctcgactcttctcgcactacccctccgtaatcgaaaaccgactctcgccgacgaaatacgcctcgataccctaaacccgaatcgtaaaatcctaaaataaaaaacacgcgaaaccccgctacaaaacccgcgaacgacaaataaacgaaaaacaacctcgtcgccgaaactaaatccgccgaaaaaaaaacgacgaataaataccgacgaaaac

SEQ ID NO: 14355 - DNA, 715 bp, Artificial Sequence
  chemically treated genomic DNA (Homo sapiens) CpG-island No: 14355
ggagtaaagtttagagaggagacgggagagagatattatatatacggtataagatggtcggagaggtagtagtatttcgagttgttaggcgtttcgtcgcggtcgcgaggttcgtcggtcggcggggagttacgttcggacggttagtaggttcgcgggagtggggttgtcgcggttgaggcgaggcgggtcgcgcgcgtcggcgttatagttcgcggtagaggcgtttagggcggtcgggtttacgacgtcgaaagcgtcgttgcggttgtcgtttcggaggttttttcgggtttcggcggttggattcggcgcgggcgggaggttcgggcgggcggttcggttcgggattcgggtttgggcgattaggaggtgtcggtggtcgcgttcggattcggtgagtggttttttagttttttttattgttttttgtttttgggaggaaaagtaaaatgtttttgagcgcgcgagtaggagggggcggcgggtcgggtttcgtcgttcggtttttttcgtattgttttttcgtggtcgggggtcggttttcgtcggcgggatgcgtttcggtgttttgggttcgagtcgtagggttttggggtagggggtacgcggggtttcgttgtagagttcgcgggcggtaggtgggcggggggtagtttcgtcgtcgggattggattcgtcgggaaaggggcggcgggtgaatgtcggcgagagt

SEQ ID NO: 14356 - DNA, 715 bp, Artificial Sequence
  chemically treated genomic DNA (Homo sapiens) CpG-island No: 14356
actctcgccgacattcacccgccgcccctttcccgacgaatccaatcccgacgacgaaactaccccccgcccacctaccgcccgcgaactctacaacgaaaccccgcgtaccccctaccccaaaaccctacgactcgaacccaaaacaccgaaacgcatcccgccgacgaaaaccgacccccgaccacgaaaaaacaatacgaaaaaaaccgaacgacgaaacccgacccgccgccccctcctactcgcgcgctcaaaaacattttacttttcctcccaaaaacaaaaaacaataaaaaaaactaaaaaaccactcaccgaatccgaacgcgaccaccgacacctcctaatcgcccaaacccgaatcccgaaccgaaccgcccgcccgaacctcccgcccgcgccgaatccaaccgccgaaacccgaaaaaacctccgaaacgacaaccgcaacgacgctttcgacgtcgtaaacccgaccgccctaaacgcctctaccgcgaactataacgccgacgcgcgcgacccgcctcgcctcaaccgcgacaaccccactcccgcgaacctactaaccgtccgaacgtaactccccgccgaccgacgaacctcgcgaccgcgacgaaacgcctaacaactcgaaatactactacctctccgaccatcttataccgtatatataatatctctctcccgtctcctctctaaactttactcc

SEQ ID NO: 14357 - DNA, 738 bp, Artificial Sequence
  chemically treated genomic DNA (Homo sapiens) CpG-island No: 14357
cggaatttcgcgagtcggattaggcgttaagttatagtcgcgcgtcgttatcggtttttggtttcgttcggtcggggcgttttcgttagtcgttattggggggtttcggacgtttttttttcggggggttttcgcgggtagtcggatcgggttttttcggggcgcgggagtaaggtcgttcggtttagttttagttttagttttagttttattttcggatcgcgttattatcgcggcgaggttcgtttgtcgttttttcggtttgggttttgtttttcgcgggtcggtttcgggacgcgaagtttatagagggggtttttcggtcgtaggcgttggggtcgttttttttacggcgaggttcggggttgcgcgttgcgttttttgtagggttttcgtggttttttcgttacggttaggttaggcggtttttttattttcgagggcgatattcgtaggttttttcggttcgatcggttgcggaatagtcgggagttcggcgcgaagtcgtagaaggttcgggtttgggttcgcgtcgcgaacgcgtatgttttgtcgaggttcgtcgcgggcgttagcgtattttgatagagttattacgaggtttatttagtagagttttagtggcgtaatcggttagcgcgcggtatttatatagtagtatatgtagagtaatgtcgaggttgtgagttcgagttttatttggagtaagatttttttggatgttcgtaattttttttg

SEQ ID NO: 14358 - DNA, 738 bp, Artificial Sequence
  chemically treated genomic DNA (Homo sapiens) CpG-island No: 14358
caaaaaaaattacgaacatccaaaaaaatcttactccaaataaaactcgaactcacaacctcgacattactctacatatactactatataaataccgcgcgctaaccgattacgccactaaaactctactaaataaacctcgtaataactctatcaaaatacgctaacgcccgcgacgaacctcgacaaaacatacgcgttcgcgacgcgaacccaaacccgaaccttctacgacttcgcgccgaactcccgactattccgcaaccgatcgaaccgaaaaaacctacgaatatcgccctcgaaaataaaaaaaccgcctaacctaaccgtaacgaaaaaaccacgaaaaccctacaaaaaacgcaacgcgcaaccccgaacctcgccgtaaaaaaaacgaccccaacgcctacgaccgaaaaaccccctctataaacttcgcgtcccgaaaccgacccgcgaaaaacaaaacccaaaccgaaaaaacgacaaacgaacctcgccgcgataataacgcgatccgaaaataaaactaaaactaaaactaaaactaaaccgaacgaccttactcccgcgccccgaaaaaacccgatccgactacccgcgaaaaccccccgaaaaaaaaacgtccgaaaccccccaataacgactaacgaaaacgccccgaccgaacgaaaccaaaaaccgataacgacgcgcgactataacttaacgcctaatccgactcgcgaaattccg

SEQ ID NO: 14359 - DNA, 738 bp, Artificial Sequence
  chemically treated genomic DNA (Homo sapiens) CpG-island No: 14359
taaaaggggttgcgaatatttaaaagggttttgttttaggtgaggttcgaatttataatttcggtattgttttgtatgtattgttgtataagtatcgcgcgttaatcgattgcgttattggagttttgttgaatgggtttcgtgatggttttattagggtgcgttggcgttcgcggcgggtttcggtagagtatgcgcgttcgcggcgcgagtttaggttcgagttttttgcgatttcgcgtcgagttttcggttgtttcgtagtcgatcgagtcggggaagtttgcgagtgtcgttttcggggatggaggggtcgtttagtttggtcgtgacgggagggttacgggggttttgtaaagagcgtagcgcgtagtttcgggtttcgtcgtaggaggagcggttttagcgtttgcggtcggaaaattttttttatgggtttcgcgtttcggagtcggttcgcgaggggtagggtttaggtcggggaagcggtaggcgggtttcgtcgcggtggtgacgcggttcgggggtggggttggggttggggttggggttgagtcgggcggttttgttttcgcgtttcggggaggttcgattcgattgttcgcgggggtttttcggaaggagagcgttcggagttttttagtggcggttggcgggggcgtttcggtcgggcgaggttaggggtcggtggcggcgcgcggttgtggtttggcgtttggttcggttcgcgaggtttcg

SEQ ID NO: 14360 - DNA, 738 bp, Artificial Sequence
  chemically treated genomic DNA (Homo sapiens) CpG-island No: 14360
cgaaacctcgcgaaccgaaccaaacgccaaaccacaaccgcgcgccgccaccgacccctaacctcgcccgaccgaaacgcccccgccaaccgccactaaaaaactccgaacgctctccttccgaaaaacccccgcgaacaatcgaatcgaacctccccgaaacgcgaaaacaaaaccgcccgactcaaccccaaccccaaccccaaccccacccccgaaccgcgtcaccaccgcgacgaaacccgcctaccgcttccccgacctaaaccctacccctcgcgaaccgactccgaaacgcgaaacccataaaaaaaattttccgaccgcaaacgctaaaaccgctcctcctacgacgaaacccgaaactacgcgctacgctctttacaaaacccccgtaaccctcccgtcacgaccaaactaaacgacccctccatccccgaaaacgacactcgcaaacttccccgactcgatcgactacgaaacaaccgaaaactcgacgcgaaatcgcaaaaaactcgaacctaaactcgcgccgcgaacgcgcatactctaccgaaacccgccgcgaacgccaacgcaccctaataaaaccatcacgaaacccattcaacaaaactccaataacgcaatcgattaacgcgcgatacttatacaacaatacatacaaaacaataccgaaattataaattcgaacctcacctaaaacaaaacccttttaaatattcgcaacccctttta

SEQ ID NO: 14361 - DNA, 607 bp, Artificial Sequence
  chemically treated genomic DNA (Homo sapiens) CpG-island No: 14361
gcgcgttttagatcgggcgtattcggcgggtatttggttcgtcgtttttcggggggtttcgttagttgttttcgaagtcggttcggggtggcggggcgggttcgagcgttagtcgattttgggatcggtttttcggggcgcggtcgggtagtagttttcgttttttcgtttcgggggtcgggtcgggttttcggggggcggggattcgtttagtggtagtagcgttcgggtcggcggcgggcgtcgggcggttttttgtaggcggcgtcggggcgagtcgttgtcggttgtagttatcgtcgtcgggtcgtcgggtcgcgggggtcgcggcgttcgggtcgcgttcgtgtttttcgggcgcgttgcgcggtcgtcgttgttgttcgcgttcgtgtcgtcgtcgtcgtcgtcgtcgttgttgtcggttacgttagtttcgtcgtcgttcgttttgattttgcgtataggtagtttttaagtttgttattttgtaaaaatatagtttatttaatatattatatatattcgtatatatacgcgcgtatagggggttttttagagtttataaagagggttttaagttcgagtttaaatttaatatagttga

SEQ ID NO: 14362 - DNA, 607 bp, Artificial Sequence
  chemically treated genomic DNA (Homo sapiens) CpG-island No: 14362
tcaactatattaaatttaaactcgaacttaaaaccctctttataaactctaaaaaaccccctatacgcgcgtatatatacgaatatatataatatattaaataaactatatttttacaaaataacaaacttaaaaactacctatacgcaaaatcaaaacgaacgacgacgaaactaacgtaaccgacaacaacgacgacgacgacgacgacgacacgaacgcgaacaacaacgacgaccgcgcaacgcgcccgaaaaacacgaacgcgacccgaacgccgcgacccccgcgacccgacgacccgacgacgataactacaaccgacaacgactcgccccgacgccgcctacaaaaaaccgcccgacgcccgccgccgacccgaacgctactaccactaaacgaatccccgccccccgaaaacccgacccgacccccgaaacgaaaaaacgaaaactactacccgaccgcgccccgaaaaaccgatcccaaaatcgactaacgctcgaacccgccccgccaccccgaaccgacttcgaaaacaactaacgaaaccccccgaaaaacgacgaaccaaatacccgccgaatacgcccgatctaaaacgcgc

SEQ ID NO: 14363 - DNA, 607 bp, Artificial Sequence
  chemically treated genomic DNA (Homo sapiens) CpG-island No: 14363
ttagttatattaaatttagattcggatttgaagttttttttgtggattttagaggattttttgtgcgcgcgtgtgtgtgcgagtgtgtgtggtgtgttgagtaaattgtgtttttgtagaatgataggtttgggggttgtttatgcgtagaattagagcgggcggcggcggggttggcgtaatcggtagtagcggcggcggcggcggcggcggtacgagcgcgggtagtagcgacggtcgcgtagcgcgttcgggaggtacggacgcggttcgagcgtcgcggttttcgcgattcggcgattcggcggcggtggttgtagtcggtaacggttcgtttcggcgtcgtttgtaggaagtcgttcggcgttcgtcgtcggttcggacgttgttgttattgggcgagttttcgtttttcgggagttcggttcggttttcggggcggggaggcgggggttgttgttcggtcgcgtttcgggggatcggttttagagtcgattagcgttcgggttcgtttcgttatttcgggtcggtttcgggagtagttggcggggtttttcggggggcggcgggttaggtgttcgtcgggtgcgttcgatttggggcgcgt

SEQ ID NO: 14364 - DNA, 607 bp, Artificial Sequence
  chemically treated genomic DNA (Homo sapiens) CpG-island No: 14364
acgcgccccaaatcgaacgcacccgacgaacacctaacccgccgccccccgaaaaaccccgccaactactcccgaaaccgacccgaaataacgaaacgaacccgaacgctaatcgactctaaaaccgatcccccgaaacgcgaccgaacaacaacccccgcctccccgccccgaaaaccgaaccgaactcccgaaaaacgaaaactcgcccaataacaacaacgtccgaaccgacgacgaacgccgaacgacttcctacaaacgacgccgaaacgaaccgttaccgactacaaccaccgccgccgaatcgccgaatcgcgaaaaccgcgacgctcgaaccgcgtccgtacctcccgaacgcgctacgcgaccgtcgctactacccgcgctcgtaccgccgccgccgccgccgccgctactaccgattacgccaaccccgccgccgcccgctctaattctacgcataaacaacccccaaacctatcattctacaaaaacacaatttactcaacacaccacacacactcgcacacacacgcgcgcacaaaaaatcctctaaaatccacaaaaaaaacttcaaatccgaatctaaatttaatataactaa

SEQ ID NO: 14365 - DNA, 523 bp, Artificial Sequence
  chemically treated genomic DNA (Homo sapiens) CpG-island No: 14365
tatcgtcgcgtttatgacggcgttcggttacgttggtcgttcgcgttttttagtcggtttgttagtttaagttcgggtttttggtcgtcgtcggttcgcgtcgtcgtcgttcggttttgttaggacgcgtcgtttcggtttttattttatagtgtatcggagtttattatagcgtttgcggtttcgtcgtagggcgttcggttattagggttgcgcggttttagtaacggacgttcgcgcgtttcgttttttgttcgttttttagcgttcgcgtaggtaggagtgggggtttcgcgggagggatttgcgggagtgcggttgtgttagagtaggcggggcgcggcggggcggggaaaggggatttgggatcgggcgtttggttttttttttgtcgagcgacggtttcgggaagtcggtgttcgttcgcgttagaggcgattgtttgaggattgattaagaataaggtaatttttaagatttgtgtcgtttgttttttaaattttaagggttttcgaaggtattg

SEQ ID NO: 14366 - DNA, 523 bp, Artificial Sequence
  chemically treated genomic DNA (Homo sapiens) CpG-island No: 14366
caataccttcgaaaacccttaaaatttaaaaaacaaacgacacaaatcttaaaaattaccttattcttaatcaatcctcaaacaatcgcctctaacgcgaacgaacaccgacttcccgaaaccgtcgctcgacaaaaaaaaaaccaaacgcccgatcccaaatcccctttccccgccccgccgcgccccgcctactctaacacaaccgcactcccgcaaatccctcccgcgaaacccccactcctacctacgcgaacgctaaaaaacgaacaaaaaacgaaacgcgcgaacgtccgttactaaaaccgcgcaaccctaataaccgaacgccctacgacgaaaccgcaaacgctataataaactccgatacactataaaataaaaaccgaaacgacgcgtcctaacaaaaccgaacgacgacgacgcgaaccgacgacgaccaaaaacccgaacttaaactaacaaaccgactaaaaaacgcgaacgaccaacgtaaccgaacgccgtcataaacgcgacgata

SEQ ID NO: 14367 - DNA, 523 bp, Artificial Sequence
  chemically treated genomic DNA (Homo sapiens) CpG-island No: 14367
tagtgttttcgaaagtttttgagatttgggaaataggcggtatagattttggaggttattttgtttttaattagtttttaggtagtcgtttttaacgcgagcgaatatcggtttttcgaggtcgtcgttcggtagaggaggggttaggcgttcgattttagatttttttttttcgtttcgtcgcgtttcgtttgttttggtatagtcgtattttcgtaaatttttttcgcggaatttttatttttgtttgcgcgggcgttggaaggcgggtagggggcggggcgcgcgggcgttcgttgttaaggtcgcgtagttttagtgatcgaacgttttgcggcgagatcgtaggcgttgtggtgggtttcggtgtattgtgggatggaaatcggagcggcgcgttttggtaggatcgggcggcggcggcgcgggtcggcggcggttagggattcgggtttaggttggtaggtcggttgaggggcgcgggcggttagcgtggtcggacgtcgttatgaacgcggcggtg

SEQ ID NO: 14368 - DNA, 523 bp, Artificial Sequence
  chemically treated genomic DNA (Homo sapiens) CpG-island No: 14368
caccgccgcgttcataacgacgtccgaccacgctaaccgcccgcgcccctcaaccgacctaccaacctaaacccgaatccctaaccgccgccgacccgcgccgccgccgcccgatcctaccaaaacgcgccgctccgatttccatcccacaatacaccgaaacccaccacaacgcctacgatctcgccgcaaaacgttcgatcactaaaactacgcgaccttaacaacgaacgcccgcgcgccccgccccctacccgccttccaacgcccgcgcaaacaaaaataaaaattccgcgaaaaaaatttacgaaaatacgactataccaaaacaaacgaaacgcgacgaaacgaaaaaaaaaaatctaaaatcgaacgcctaacccctcctctaccgaacgacgacctcgaaaaaccgatattcgctcgcgttaaaaacgactacctaaaaactaattaaaaacaaaataacctccaaaatctataccgcctatttcccaaatctcaaaaactttcgaaaacacta

SEQ ID NO: 14369 - DNA, 1079 bp, Artificial Sequence
  chemically treated genomic DNA (Homo sapiens) CpG-island No: 14369
gtagttcgcgcgtagttattcggtagttcggtgttttatatacgttgttttatttttcggattttaggtttttgagttgcgaacgggggttcgagtttttaattttcggtgttatcgtagtttaaacgagcgtattttgcgcgggttcgattattttttatttgggatagggttaaggtatacgttttacgtcggcgtcgttttaagtcgaggagtttagtagtttaaggaattttcggcggcgtttcgttgttcgagtcggcgttgggatttcgatttgttcgaggttcgcgcgtcgcggcggttacgtaagtcgtagcgggtcgcgcgcgttatttatcgtcggtcgcgtcgcgttacgtcgttcgtcggtcgtttcgtcgattcgcggttttgtgtcgtcggattcgcgttcgttgtcgtcgcgtatagttgtacgtatttttttagcgtcgtcgatattagtcgcgtcgagtcgtcgttgttatatagtggaaaacgtgatcgcgcgtcgcgttcgttttcgttttcgttattggtcgcgatttcgttttatttgtatatatgaggggcggggtttacgaacgttcgcgtttattggtggtcgcgttcgtcgttttttttatataagacgtatatggaattttatgtttatttcgtcggttttttaatggagagcggcgcgttcgtgttattcgtcgttttttttagtggttttatttattttcggcgtcggcgttttttatttattacgtttttaagttcgttagttcggggagcgcggagtggcgcgtattattgcgggcgggggagttgggcgcggggtttttgcgtattttcggtcggtttggtagattcggcgcgcgaagtcggacgagggagatttttattttcggttatcggtagtaggttcgtttttagcggttagggcgggataagttcgcgcggtatgttttatttacgtatttatatttatttatttatttatttatttaatttatttatcgcggggtttcggagtagtttaggagaaggtggtagtatcgttttgtagtagtttcgggggtacgtttattcgg

SEQ ID NO: 14370 - DNA, 1079 bp, Artificial Sequence
  chemically treated genomic DNA (Homo sapiens) CpG-island No: 14370
ccgaataaacgtacccccgaaactactacaaaacgatactaccaccttctcctaaactactccgaaaccccgcgataaataaattaaataaataaataaataaataaatataaatacgtaaataaaacataccgcgcgaacttatcccgccctaaccgctaaaaacgaacctactaccgataaccgaaaataaaaatctccctcgtccgacttcgcgcgccgaatctaccaaaccgaccgaaaatacgcaaaaaccccgcgcccaactcccccgcccgcaataatacgcgccactccgcgctccccgaactaacgaacttaaaaacgtaataaataaaaaacgccgacgccgaaaataaataaaaccactaaaaaaaacgacgaataacacgaacgcgccgctctccattaaaaaaccgacgaaataaacataaaattccatatacgtcttatataaaaaaaacgacgaacgcgaccaccaataaacgcgaacgttcgtaaaccccgcccctcatatatacaaataaaacgaaatcgcgaccaataacgaaaacgaaaacgaacgcgacgcgcgatcacgttttccactatataacaacgacgactcgacgcgactaatatcgacgacgctaaaaaaatacgtacaactatacgcgacgacaacgaacgcgaatccgacgacacaaaaccgcgaatcgacgaaacgaccgacgaacgacgtaacgcgacgcgaccgacgataaataacgcgcgcgacccgctacgacttacgtaaccgccgcgacgcgcgaacctcgaacaaatcgaaatcccaacgccgactcgaacaacgaaacgccgccgaaaattccttaaactactaaactcctcgacttaaaacgacgccgacgtaaaacgtataccttaaccctatcccaaataaaaaataatcgaacccgcgcaaaatacgctcgtttaaactacgataacaccgaaaattaaaaactcgaacccccgttcgcaactcaaaaacctaaaatccgaaaaataaaacaacgtatataaaacaccgaactaccgaataactacgcgcgaactac

SEQ ID NO: 14371 - DNA, 1079 bp, Artificial Sequence
  chemically treated genomic DNA (Homo sapiens) CpG-island No: 14371
tcgggtgggcgtgttttcggagttgttgtagggcggtgttgttatttttttttgggttgtttcggggtttcgcgatgaatgagttgagtgaatgagtaaatgaatgaatgtgaatgcgtgaatgaagtatgtcgcgcggatttatttcgttttggtcgttgggggcgagtttattgtcggtggtcggaggtggaggtttttttcgttcggtttcgcgcgtcgggtttgttaggtcggtcggaggtgcgtaggagtttcgcgtttagttttttcgttcgtaatggtacgcgttatttcgcgtttttcgagttggcgggtttgagggcgtagtgaatggaaggcgtcgacgtcggaagtggatgagattattagggaggacgacgggtagtacgaacgcgtcgttttttattgaggaatcgacgaggtgaatatggagttttatgtgcgttttatgtaaaaagagcgacgggcgcggttattaatgggcgcgagcgttcgtaggtttcgttttttatgtatgtagatgagacggagtcgcggttaatggcggaggcgggagcgggcgcggcgcgcggttacgttttttattatgtgatagcggcgattcggcgcggttaatgtcgacggcgttgaggggatacgtgtagttgtgcgcggcggtagcgggcgcgggttcggcggtatagagtcgcgagtcggcggagcgatcggcggacggcgtgacgcggcgcggtcggcggtaagtggcgcgcgcggttcgttgcggtttacgtaatcgtcgcggcgcgcgggtttcgggtaggtcggggttttagcgtcggttcgggtagcggagcgtcgtcggaagttttttgggttgttggatttttcggtttgaaacggcgtcggcgtggggcgtgtgttttggttttgttttaggtggagagtggtcgagttcgcgtagggtgcgttcgtttgaattgcggtgatatcgagggttggggattcgaattttcgttcgtagtttaggagtttgaggttcgaaaggtgaggtagcgtgtgtagggtatcgagttatcgagtgattgcgcgcgggttgt

SEQ ID NO: 14372 - DNA, 1079 bp, Artificial Sequence
  chemically treated genomic DNA (Homo sapiens) CpG-island No: 14372
acaacccgcgcgcaatcactcgataactcgataccctacacacgctacctcacctttcgaacctcaaactcctaaactacgaacgaaaattcgaatccccaaccctcgatatcaccgcaattcaaacgaacgcaccctacgcgaactcgaccactctccacctaaaacaaaaccaaaacacacgccccacgccgacgccgtttcaaaccgaaaaatccaacaacccaaaaaacttccgacgacgctccgctacccgaaccgacgctaaaaccccgacctacccgaaacccgcgcgccgcgacgattacgtaaaccgcaacgaaccgcgcgcgccacttaccgccgaccgcgccgcgtcacgccgtccgccgatcgctccgccgactcgcgactctataccgccgaacccgcgcccgctaccgccgcgcacaactacacgtatcccctcaacgccgtcgacattaaccgcgccgaatcgccgctatcacataataaaaaacgtaaccgcgcgccgcgcccgctcccgcctccgccattaaccgcgactccgtctcatctacatacataaaaaacgaaacctacgaacgctcgcgcccattaataaccgcgcccgtcgctctttttacataaaacgcacataaaactccatattcacctcgtcgattcctcaataaaaaacgacgcgttcgtactacccgtcgtcctccctaataatctcatccacttccgacgtcgacgccttccattcactacgccctcaaacccgccaactcgaaaaacgcgaaataacgcgtaccattacgaacgaaaaaactaaacgcgaaactcctacgcacctccgaccgacctaacaaacccgacgcgcgaaaccgaacgaaaaaaacctccacctccgaccaccgacaataaactcgcccccaacgaccaaaacgaaataaatccgcgcgacatacttcattcacgcattcacattcattcatttactcattcactcaactcattcatcgcgaaaccccgaaacaacccaaaaaaaaataacaacaccgccctacaacaactccgaaaacacgcccacccga

SEQ ID NO: 14373 - DNA, 506 bp, Artificial Sequence
  chemically treated genomic DNA (Homo sapiens) CpG-island No: 14373
ttttttcgtcgtcgcgcggtttttcggagtcgattgtagatttttttagttcggtgtttttcgcgttcggacgtcgaggtcgcggtttcgtagaaattcgggtttttttattcgtttttagtaaatatggcggtacggcgagcggggcgggtagggggcgggtagggggcggggcgcgggttttcggttagggttttcggtcgggttttggttatttacgtgtggagatcgggtaggtgggtttggagagcgtgacgcggtgtcgagaggtatcggggagcggcgtttgagtcggggcggggataagggggcggggaggggcggagcgagtcggttttcgcgtgggtttgagattttaagtgcgagcggtaaggtggtggttttcgtcgcgtagagggaagcgggaaatcgagaaagaacgagggtgagggtgatgagggaagggtaaattttaaattttagcgggaggatacgagtttggatcgtttcgggtatttagttttttt

SEQ ID NO: 14374 - DNA, 506 bp, Artificial Sequence
  chemically treated genomic DNA (Homo sapiens) CpG-island No: 14374
aaaaaaactaaatacccgaaacgatccaaactcgtatcctcccgctaaaatttaaaatttacccttccctcatcaccctcaccctcgttctttctcgatttcccgcttccctctacgcgacgaaaaccaccaccttaccgctcgcacttaaaatctcaaacccacgcgaaaaccgactcgctccgcccctccccgcccccttatccccgccccgactcaaacgccgctccccgatacctctcgacaccgcgtcacgctctccaaacccacctacccgatctccacacgtaaataaccaaaacccgaccgaaaaccctaaccgaaaacccgcgccccgccccctacccgccccctacccgccccgctcgccgtaccgccatatttactaaaaacgaataaaaaaacccgaatttctacgaaaccgcgacctcgacgtccgaacgcgaaaaacaccgaactaaaaaaatctacaatcgactccgaaaaaccgcgcgacgacgaaaaaa

SEQ ID NO: 14375 - DNA, 506 bp, Artificial Sequence
  chemically treated genomic DNA (Homo sapiens) CpG-island No: 14375
aagaggattaggtgttcggggcgatttaggttcgtgttttttcgttggagtttgaggtttgttttttttttattatttttattttcgttttttttcggtttttcgtttttttttacgcggcggagattattattttatcgttcgtatttaagattttagatttacgcggaggtcggttcgtttcgttttttttcgtttttttgttttcgtttcggtttagacgtcgtttttcggtgtttttcggtatcgcgttacgttttttaggtttatttgttcggtttttatacgtgggtagttagagttcggtcgagagttttggtcgggagttcgcgtttcgttttttgttcgttttttgttcgtttcgttcgtcgtgtcgttatgtttattgagggcggatggaggggttcgagtttttgcgaagtcgcgatttcggcgttcggacgcggggaatatcgggttgagggagtttgtagtcggtttcgggaagtcgcgcggcgacgggggag

SEQ ID NO: 14376 - DNA, 506 bp, Artificial Sequence
  chemically treated genomic DNA (Homo sapiens) CpG-island No: 14376
ctcccccgtcgccgcgcgacttcccgaaaccgactacaaactccctcaacccgatattccccgcgtccgaacgccgaaatcgcgacttcgcaaaaactcgaacccctccatccgccctcaataaacataacgacacgacgaacgaaacgaacaaaaaacgaacaaaaaacgaaacgcgaactcccgaccaaaactctcgaccgaactctaactacccacgtataaaaaccgaacaaataaacctaaaaaacgtaacgcgataccgaaaaacaccgaaaaacgacgtctaaaccgaaacgaaaacaaaaaaacgaaaaaaaacgaaacgaaccgacctccgcgtaaatctaaaatcttaaatacgaacgataaaataataatctccgccgcgtaaaaaaaaacgaaaaaccgaaaaaaaacgaaaataaaaataataaaaaaaaaacaaacctcaaactccaacgaaaaaacacgaacctaaatcgccccgaacacctaatcctctt

SEQ ID NO: 14377 - DNA, 584 bp, Artificial Sequence
  chemically treated genomic DNA (Homo sapiens) CpG-island No: 14377
tcgcgcggttttggttggttgacggcgatgggttcgggttttcggtcggtcggggcggggtgttatttatttgttgcggcgtcgcgcggttttgggggtttagtttcgtgggcgtttttggttgttgcgtcgttcgcgtttcgtttttcgtcgttagtttttttcgggtcgttttacgtggtcgttttacgtcgttttttcggttggagtcgtcgttttggtcgggtagagttcggagttagtgttagtcgtcgtttcgttcgtcggatttggtttttcgtagttttattagcgttttcgttgcgttcgcggtcggaggggttgcgcgcgttcgtgtgagtgtgcgcgtgtgtgcgtgcgtgagtgcgtatgtgcgcgtgtgcgagttcgcgtgtgttcgtgagtgcgttcgtgtgtttgtgcgggtgtgtatatgcgtgtgatattgtgagcgtgagtgtgagtatgtgtaaggatgtacgtgtgtgagcgtgtatgtgtgcgcggatgtgtgcgtgtgtttgtatgtatatatgtgagtatagagagattaagagatagtgaggttagtgtgtattagaagt

SEQ ID NO: 14378 - DNA, 584 bp, Artificial Sequence
  chemically treated genomic DNA (Homo sapiens) CpG-island No: 14378
acttctaatacacactaacctcactatctcttaatctctctatactcacatatatacatacaaacacacgcacacatccgcgcacacatacacgctcacacacgtacatccttacacatactcacactcacgctcacaatatcacacgcatatacacacccgcacaaacacacgaacgcactcacgaacacacgcgaactcgcacacgcgcacatacgcactcacgcacgcacacacgcgcacactcacacgaacgcgcgcaacccctccgaccgcgaacgcaacgaaaacgctaataaaactacgaaaaaccaaatccgacgaacgaaacgacgactaacactaactccgaactctacccgaccaaaacgacgactccaaccgaaaaaacgacgtaaaacgaccacgtaaaacgacccgaaaaaaactaacgacgaaaaacgaaacgcgaacgacgcaacaaccaaaaacgcccacgaaactaaacccccaaaaccgcgcgacgccgcaacaaataaataacaccccgccccgaccgaccgaaaacccgaacccatcgccgtcaaccaaccaaaaccgcgcga

SEQ ID NO: 14379 - DNA, 584 bp, Artificial Sequence
  chemically treated genomic DNA (Homo sapiens) CpG-island No: 14379
atttttgatgtatattggttttattgttttttggtttttttgtatttatatgtgtgtatataggtatacgtatatattcgcgtatatatgtacgtttatatacgtgtatttttatatatgtttatatttacgtttataatgttatacgtatgtgtatattcgtataagtatacgagcgtatttacgagtatacgcggattcgtatacgcgtatatgcgtatttacgtacgtatatacgcgtatatttatacgggcgcgcgtagttttttcggtcgcgggcgtagcgggggcgttggtggagttgcgaagggttaggttcggcgggcggggcggcggttggtattggtttcggattttgttcggttagggcggcggttttagtcgggagggcgacgtggagcggttacgtggagcggttcgggggaggttggcggcgggaggcgaggcgcgggcggcgtagtagttaggagcgtttacggagttggatttttagagtcgcgcggcgtcgtagtaggtgggtgatatttcgtttcggtcggtcggagattcgagtttatcgtcgttagttagttagggtcgcgcgg

SEQ ID NO: 14380 - DNA, 584 bp, Artificial Sequence
  chemically treated genomic DNA (Homo sapiens) CpG-island No: 14380
ccgcgcgaccctaactaactaacgacgataaactcgaatctccgaccgaccgaaacgaaatatcacccacctactacgacgccgcgcgactctaaaaatccaactccgtaaacgctcctaactactacgccgcccgcgcctcgcctcccgccgccaacctcccccgaaccgctccacgtaaccgctccacgtcgccctcccgactaaaaccgccgccctaaccgaacaaaatccgaaaccaataccaaccgccgccccgcccgccgaacctaacccttcgcaactccaccaacgcccccgctacgcccgcgaccgaaaaaactacgcgcgcccgtataaatatacgcgtatatacgtacgtaaatacgcatatacgcgtatacgaatccgcgtatactcgtaaatacgctcgtatacttatacgaatatacacatacgtataacattataaacgtaaatataaacatatataaaaatacacgtatataaacgtacatatatacgcgaatatatacgtatacctatatacacacatataaatacaaaaaaaccaaaaaacaataaaaccaatatacatcaaaaat

SEQ ID NO: 14381 - DNA, 600 bp, Artificial Sequence
  chemically treated genomic DNA (Homo sapiens) CpG-island No: 14381
gaagtcggtgttgggcgattttgttttcgcgttaggggtggagaatcgaagtttcgtttcgggaaacgcggtttcgcggtcggttagtgttgacgcgtgtcggcgtttttgcgtttgcgcggagggagtcgcgagataggtgcgtatgttagtgcgcgtttgcgagatcgatttggacggagtcgagttgaggttcggttttttgttgatggttagggttttggtaatttttcggtgtgagaggggtagggagtgttttcggcggcgacggggtcgagtttattagtcgtcggggtagtagtcgaaggttcggcgcggtatgttttgggtgtcgcggtgcgggtagtgaacgcgcgtcgggcgggatgggtcgtcgggcgttagagttgtatcgggtttcgttttcgttgtacgcgttttaggtcgattttagtattgggttgtttatcgttgcgggcggaggaggcgtcgttaagataggtataaagaatggcgtggtgagagcgtagggttattggggttgggttttgttgcgggttggcggcgattttagggtggtcggggggtcgcggggcgggttatattttagtttcgggtttt

SEQ ID NO: 14382 - DNA, 600 bp, Artificial Sequence
  chemically treated genomic DNA (Homo sapiens) CpG-island No: 14382
aaaacccgaaactaaaatataacccgccccgcgaccccccgaccaccctaaaatcgccgccaacccgcaacaaaacccaaccccaataaccctacgctctcaccacgccattctttatacctatcttaacgacgcctcctccgcccgcaacgataaacaacccaatactaaaatcgacctaaaacgcgtacaacgaaaacgaaacccgatacaactctaacgcccgacgacccatcccgcccgacgcgcgttcactacccgcaccgcgacacccaaaacataccgcgccgaaccttcgactactaccccgacgactaataaactcgaccccgtcgccgccgaaaacactccctacccctctcacaccgaaaaattaccaaaaccctaaccatcaacaaaaaaccgaacctcaactcgactccgtccaaatcgatctcgcaaacgcgcactaacatacgcacctatctcgcgactccctccgcgcaaacgcaaaaacgccgacacgcgtcaacactaaccgaccgcgaaaccgcgtttcccgaaacgaaacttcgattctccacccctaacgcgaaaacaaaatcgcccaacaccgacttc

SEQ ID NO: 14383 - DNA, 600 bp, Artificial Sequence
  chemically treated genomic DNA (Homo sapiens) CpG-island No: 14383
agggttcgaagttggagtgtggttcgtttcgcgatttttcggttattttggaatcgtcgttagttcgtagtaagatttagttttagtggttttgcgtttttattacgttattttttatgtttgttttggcggcgtttttttcgttcgtagcgatgagtagtttagtgttggggtcgatttgaagcgcgtataacgggaacggagttcggtatagttttggcgttcggcggtttatttcgttcggcgcgcgtttattgttcgtatcgcggtatttaggatatgtcgcgtcgggttttcgattattgtttcggcggttggtgaattcggtttcgtcgtcgtcgggagtattttttattttttttatatcggggagttgttaaaattttgattattagtaggaagtcgagttttagttcggtttcgtttaagtcggtttcgtagacgcgtattggtatgcgtatttgtttcgcggtttttttcgcgtaggcgtaggagcgtcgatacgcgttagtattagtcggtcgcggggtcgcgtttttcggggcggggtttcggttttttatttttggcgcggaggtagagtcgtttagtatcgatttt

SEQ ID NO: 14384 - DNA, 600 bp, Artificial Sequence
  chemically treated genomic DNA (Homo sapiens) CpG-island No: 14384
aaaatcgatactaaacgactctacctccgcgccaaaaataaaaaaccgaaaccccgccccgaaaaacgcgaccccgcgaccgactaatactaacgcgtatcgacgctcctacgcctacgcgaaaaaaaccgcgaaacaaatacgcataccaatacgcgtctacgaaaccgacttaaacgaaaccgaactaaaactcgacttcctactaataatcaaaattttaacaactccccgatataaaaaaaataaaaaatactcccgacgacgacgaaaccgaattcaccaaccgccgaaacaataatcgaaaacccgacgcgacatatcctaaataccgcgatacgaacaataaacgcgcgccgaacgaaataaaccgccgaacgccaaaactataccgaactccgttcccgttatacgcgcttcaaatcgaccccaacactaaactactcatcgctacgaacgaaaaaaacgccgccaaaacaaacataaaaaataacgtaataaaaacgcaaaaccactaaaactaaatcttactacgaactaacgacgattccaaaataaccgaaaaatcgcgaaacgaaccacactccaacttcgaaccct

SEQ ID NO: 14385 - DNA, 776 bp, Artificial Sequence
  chemically treated genomic DNA (Homo sapiens) CpG-island No: 14385
gtcggtttcgtcgttgtattttcgttttagtttatttttcggtttcggggaggcggttattacggtttcgttagtcgcgtttcgagttacgttagttgtagttagttgtgcggtgtcgggtttaggcgcgcgttcgtagtttcgttttattttttacggttggattttttatcgtagtcgcgttcgaggtttcgttttagtcgcggtcgtaacgcgtcgcgcggagtcgacgagacggcggggttagagaggtcgtttcgatcgcgtttttcgtcggaagcggtttgttcgggtttgagttggcgttacgaagtttcggtttaggtttttgatttcgggtttgttcgttggtggcgtcggagtcgagtcggattggttaggttagaggtacgtaggggtcgttttacgggtttagtttcgtcgtggtcgtggtcgtggttggtttgtggggcgaggacgggtttttgcgagggcgaggagtgcgttagttcgtagtttagtttttttttttttcgtaggatgattacggacgtgtagttcgttattttcgttaatatgttgggcgtgtcgttttttttgtttgtcgttttttattattacgtggtcgttaataattttaagaagtaggaatgaaagtggcgtttttttcgttttaggtaacggttcggggttgtagcgtttagtttttagagttgagtggcgaggtcgcgttagggttagtagggttcgaaatttataattagaaagtgtcgggttaagtatgatatagtttagaa

SEQ ID NO: 14386 - DNA, 776 bp, Artificial Sequence
  chemically treated genomic DNA (Homo sapiens) CpG-island No: 14386
ttctaaactatatcatacttaacccgacactttctaattataaatttcgaaccctactaaccctaacgcgacctcgccactcaactctaaaaactaaacgctacaaccccgaaccgttacctaaaacgaaaaaaacgccactttcattcctacttcttaaaattattaacgaccacgtaataataaaaaacgacaaacaaaaaaaacgacacgcccaacatattaacgaaaataacgaactacacgtccgtaatcatcctacgaaaaaaaaaaaaactaaactacgaactaacgcactcctcgccctcgcaaaaacccgtcctcgccccacaaaccaaccacgaccacgaccacgacgaaactaaacccgtaaaacgacccctacgtacctctaacctaaccaatccgactcgactccgacgccaccaacgaacaaacccgaaatcaaaaacctaaaccgaaacttcgtaacgccaactcaaacccgaacaaaccgcttccgacgaaaaacgcgatcgaaacgacctctctaaccccgccgtctcgtcgactccgcgcgacgcgttacgaccgcgactaaaacgaaacctcgaacgcgactacgataaaaaatccaaccgtaaaaaataaaacgaaactacgaacgcgcgcctaaacccgacaccgcacaactaactacaactaacgtaactcgaaacgcgactaacgaaaccgtaataaccgcctccccgaaaccgaaaaataaactaaaacgaaaatacaacgacgaaaccgac

SEQ ID NO: 14387 - DNA, 776 bp, Artificial Sequence
  chemically treated genomic DNA (Homo sapiens) CpG-island No: 14387
ttttggattgtattatgtttggttcgatattttttgattgtaagtttcgaattttgttagttttggcgcggtttcgttatttagttttggggattgggcgttatagtttcgggtcgttatttggggcggagaaagcgttatttttatttttgttttttgggattgttgacggttacgtagtgatagagaacgataagtaagaagagcgatacgtttagtatgttggcgaagatggcgagttgtacgttcgtgattattttgcggagaagagaggggttgagttgcgggttggcgtatttttcgttttcgtaagaattcgttttcgttttataggttagttacggttacggttacggcggggttgggttcgtggaacggtttttgcgtgtttttgatttgattagttcggttcggtttcgacgttattagcgaataagttcgaagttagagatttggatcggaatttcgtagcgttagtttaggttcgaataagtcgttttcggcggggggcgcggtcgggacggtttttttagtttcgtcgtttcgtcggtttcgcgcggcgcgttacggtcgcggttggggcggggtttcgggcgcggttgcggtgggaggtttagtcgtagggggtggggcggggttgcggacgcgcgtttgggttcggtatcgtatagttggttgtagttggcgtggttcgggacgcggttagcgaagtcgtggtggtcgttttttcggagtcgaggagtgggttggggcgagggtgtagcggcggggtcggt

SEQ ID NO: 14388 - DNA, 776 bp, Artificial Sequence
  chemically treated genomic DNA (Homo sapiens) CpG-island No: 14388
accgaccccgccgctacaccctcgccccaacccactcctcgactccgaaaaaacgaccaccacgacttcgctaaccgcgtcccgaaccacgccaactacaaccaactatacgataccgaacccaaacgcgcgtccgcaaccccgccccaccccctacgactaaacctcccaccgcaaccgcgcccgaaaccccgccccaaccgcgaccgtaacgcgccgcgcgaaaccgacgaaacgacgaaactaaaaaaaccgtcccgaccgcgccccccgccgaaaacgacttattcgaacctaaactaacgctacgaaattccgatccaaatctctaacttcgaacttattcgctaataacgtcgaaaccgaaccgaactaatcaaatcaaaaacacgcaaaaaccgttccacgaacccaaccccgccgtaaccgtaaccgtaactaacctataaaacgaaaacgaattcttacgaaaacgaaaaatacgccaacccgcaactcaacccctctcttctccgcaaaataatcacgaacgtacaactcgccatcttcgccaacatactaaacgtatcgctcttcttacttatcgttctctatcactacgtaaccgtcaacaatcccaaaaaacaaaaataaaaataacgctttctccgccccaaataacgacccgaaactataacgcccaatccccaaaactaaataacgaaaccgcgccaaaactaacaaaattcgaaacttacaatcaaaaaatatcgaaccaaacataatacaatccaaaa

SEQ ID NO: 14389 - DNA, 1360 bp, Artificial Sequence
  chemically treated genomic DNA (Homo sapiens) CpG-island No: 14389
ttgtgacgttttttttacggaattttatacgttcgggattttcgtgacgttttttttacggaatgttatacgttcgggattttcgtgacgtttgttttacggaattttatatattcgggattttcgtgatatttgttttacggaattttatatattcgggattttcgtgacgtttgttttacggaattttatatattcgggattttcgtgacgtttgttttacggaatttcgtacgttcgggattttcgtgacgttttttttacggaattttatatatttaggattttcgtgacgtttgttttatggaattttacgtgttcgggatttttgtgatattttttttatacgtttaggatttttgtgacgttttttttacggaattttatacgttcgagattttcgtgacgttttttttacggaattttatacgttcgggatttttgtgacgtttgttttatggaattttatacgttcgggattttcgtgatgttttttttacggaattttatatattcgggattttcgtgacgtttgttttacggaattttatacgttcgggattttcgtgatatttgttttacggaattttgtacgttcgggattttcgtgacgttttttttacggaattttaaacgtttgggatttttgtgacgtttgttttacggaattttatacgttcgggattttcgtgatgttttttttacggaattttatatattcgggattttcgtgacgtttgttttatggaattttatatattcgggattttcgtgatatttgttttacggaatttcgtacgttcgggattttcgtgacgttttttttacggaattttatacgttcgggatttttgtgacgttttttttacggaattttatacgttcgggattttcgtgacgttttttttacggaattttatacgttcgggatttttgtgacgtttgttttatagaattttatacgttcgggattttcgtgacgttttttttacggaattttatatattcgggattttcgtgacgtttgttttacggaattttatatattcgggatttttatgatatttgttttatagaatcgcgtacgttcgggattttcgtgacgttttttttacggaatttcgtacgttcgggattttcgtgacgttttttttacggaattttatacgttcgggatttttgtgacgttttttttacggaattttagacgttcgggattttcgtgatgttttttttacggaattttatatattcgggacgttcgtgatatttgttttacggaattttatagttttttttaatagaatagcgatttattcgtttagtatttcgggggtaggaagagatgttgttttttttt

SEQ ID NO: 14390 - DNA, 1360 bp, Artificial Sequence
  chemically treated genomic DNA (Homo sapiens) CpG-island No: 14390
aaaaaaaaacaacatctcttcctacccccgaaatactaaacgaataaatcgctattctattaaaaaaaactataaaattccgtaaaacaaatatcacgaacgtcccgaatatataaaattccgtaaaaaaaacatcacgaaaatcccgaacgtctaaaattccgtaaaaaaaacgtcacaaaaatcccgaacgtataaaattccgtaaaaaaaacgtcacgaaaatcccgaacgtacgaaattccgtaaaaaaaacgtcacgaaaatcccgaacgtacgcgattctataaaacaaatatcataaaaatcccgaatatataaaattccgtaaaacaaacgtcacgaaaatcccgaatatataaaattccgtaaaaaaaacgtcacgaaaatcccgaacgtataaaattctataaaacaaacgtcacaaaaatcccgaacgtataaaattccgtaaaaaaaacgtcacgaaaatcccgaacgtataaaattccgtaaaaaaaacgtcacaaaaatcccgaacgtataaaattccgtaaaaaaaacgtcacgaaaatcccgaacgtacgaaattccgtaaaacaaatatcacgaaaatcccgaatatataaaattccataaaacaaacgtcacgaaaatcccgaatatataaaattccgtaaaaaaaacatcacgaaaatcccgaacgtataaaattccgtaaaacaaacgtcacaaaaatcccaaacgtttaaaattccgtaaaaaaaacgtcacgaaaatcccgaacgtacaaaattccgtaaaacaaatatcacgaaaatcccgaacgtataaaattccgtaaaacaaacgtcacgaaaatcccgaatatataaaattccgtaaaaaaaacatcacgaaaatcccgaacgtataaaattccataaaacaaacgtcacaaaaatcccgaacgtataaaattccgtaaaaaaaacgtcacgaaaatctcgaacgtataaaattccgtaaaaaaaacgtcacaaaaatcctaaacgtataaaaaaaatatcacaaaaatcccgaacacgtaaaattccataaaacaaacgtcacgaaaatcctaaatatataaaattccgtaaaaaaaacgtcacgaaaatcccgaacgtacgaaattccgtaaaacaaacgtcacgaaaatcccgaatatataaaattccgtaaaacaaacgtcacgaaaatcccgaatatataaaattccgtaaaacaaatatcacgaaaatcccgaatatataaaattccgtaaaacaaacgtcacgaaaatcccgaacgtataacattccgtaaaaaaaacgtcacgaaaatcccgaacgtataaaattccgtaaaaaaaacgtcacaa

SEQ ID NO: 14391 - DNA, 1360 bp, Artificial Sequence
  chemically treated genomic DNA (Homo sapiens) CpG-island No: 14391
aaagagaagtaatatttttttttgttttcggagtgttgggcggatgagtcgttgttttattgggaggagttgtgagatttcgtgaggtaaatgttacggacgtttcgggtgtgtgagatttcgtgagggaaatattacggagatttcgggcgtttgagatttcgtgagggaaacgttatagaggtttcgggcgtgtgagatttcgtgagggaaacgttacggaagtttcgggcgtgcgagatttcgtgagggaaacgttacggaggtttcgggcgtgcgcgattttgtgaggtaaatgttatggaggtttcgggtgtgtgagatttcgtgaggtaaacgttacggaggtttcgggtgtgtgagatttcgtgagggaaacgttacggaagtttcgggcgtgtgagattttgtgaggtaaacgttatagaggtttcgggcgtgtgagatttcgtgagggaaacgttacggaagtttcgggcgtgtgagatttcgtgagggaaacgttatagaggtttcgggcgtgtgagatttcgtgagggaaacgttacggaagtttcgggcgtgcgagatttcgtgaggtaaatgttacggaggtttcgggtgtgtgagattttatgaggtaaacgttacggaggtttcgggtgtgtgagatttcgtgagggaaatattacggaagtttcgggcgtgtgagatttcgtgaggtaaacgttatagaggttttaggcgtttgagatttcgtgagggaaacgttacggaagtttcgggcgtgtaagatttcgtgaggtaaatgttacggaggtttcgggcgtgtgagatttcgtgaggtaaacgttacgggggtttcgggtgtgtgagatttcgtgagggaaatattacggaagtttcgggcgtgtgagattttatgaggtaaacgttatagaggtttcgggcgtgtgagatttcgtgagggaaacgttacggaagtttcgggcgtgtgagatttcgtgagggaaacgttatagaggttttgggcgtgtgagggaaatgttatagaggtttcgggtacgtgagattttatgagataaacgttacggaggttttgggtgtgtgagatttcgtgagggaaacgttacggaggtttcgggcgtgcgagatttcgtgaggtaaacgttacggaggtttcgggtgtgtgagatttcgtgaagtaaacgttacggaggtttcgggtgtgtgagatttcgtgaggtaaatgttacggaggtttcgggtgtgtgagatttcgtgaggtaaacgttacggaggtttcgggcgtgtgatatttcgtgagggaaacgttacggaggtttcgggcgtgtgagatttcgtgagggaaacgttatag

SEQ ID NO: 14392 - DNA, 1360 bp, Artificial Sequence
  chemically treated genomic DNA (Homo sapiens) CpG-island No: 14392
ctataacgtttccctcacgaaatctcacacgcccgaaacctccgtaacgtttccctcacgaaatatcacacgcccgaaacctccgtaacgtttacctcacgaaatctcacacacccgaaacctccgtaacatttacctcacgaaatctcacacacccgaaacctccgtaacgtttacttcacgaaatctcacacacccgaaacctccgtaacgtttacctcacgaaatctcgcacgcccgaaacctccgtaacgtttccctcacgaaatctcacacacccaaaacctccgtaacgtttatctcataaaatctcacgtacccgaaacctctataacatttccctcacacgcccaaaacctctataacgtttccctcacgaaatctcacacgcccgaaacttccgtaacgtttccctcacgaaatctcacacgcccgaaacctctataacgtttacctcataaaatctcacacgcccgaaacttccgtaatatttccctcacgaaatctcacacacccgaaacccccgtaacgtttacctcacgaaatctcacacgcccgaaacctccgtaacatttacctcacgaaatcttacacgcccgaaacttccgtaacgtttccctcacgaaatctcaaacgcctaaaacctctataacgtttacctcacgaaatctcacacgcccgaaacttccgtaatatttccctcacgaaatctcacacacccgaaacctccgtaacgtttacctcataaaatctcacacacccgaaacctccgtaacatttacctcacgaaatctcgcacgcccgaaacttccgtaacgtttccctcacgaaatctcacacgcccgaaacctctataacgtttccctcacgaaatctcacacgcccgaaacttccgtaacgtttccctcacgaaatctcacacgcccgaaacctctataacgtttacctcacaaaatctcacacgcccgaaacttccgtaacgtttccctcacgaaatctcacacacccgaaacctccgtaacgtttacctcacgaaatctcacacacccgaaacctccataacatttacctcacaaaatcgcgcacgcccgaaacctccgtaacgtttccctcacgaaatctcgcacgcccgaaacttccgtaacgtttccctcacgaaatctcacacgcccgaaacctctataacgtttccctcacgaaatctcaaacgcccgaaatctccgtaatatttccctcacgaaatctcacacacccgaaacgtccgtaacatttacctcacgaaatctcacaactcctcccaataaaacaacgactcatccgcccaacactccgaaaacaaaaaaaaatattacttctcttt

SEQ ID NO: 14393 - DNA, 1601 bp, Artificial Sequence
  chemically treated genomic DNA (Homo sapiens) CpG-island No: 14393
tatttatttcgatttcgcgtgttatcgcgagtgggtttatacgtttatttcgatttcgcgtgttatcgcgagtggatttatacgtttatttcggtttcgcgtgttatcgcgagtggatttatatttttatttcgatttcgcgtgttatcgcgagtggatttatagttttatttcgatttcgcgtgttatcgcgagtggatttatacgtttatttcgattttacgtgttatcgcgagtgggtttatacgtttatttcgatttcgcgtgttatcgcgagtggatttatacgtttatttcgattttgcgtgttatcgcgagtggatttatatttttatttcgatttcgcgtgttatcgcgagtggatttatatatttatttcgattttgcgtgttatcgcgagtggatttatacgtttatttcgatttcgcgtgttatcgcgagtggatttatatttttatttcgatttcgcgtgttatcgcgagtggatttatatatttatttcgatttcgcgtgttatcgtgagtggatttatatttttatttcgatttcgcgtgttatcgcgagtggatttatacgtttatttcggtttcgcgtgttatcgcgaggggatttatatttttatttcgattttacgtgttatcgcgagtggatttatacgtttatttcgatttcgcgtgttatagtaagcgggtttatagttttatttcgattttgcgtgttatcgcgagtggatttatacgtttatttcgagtttcgcgtgttatcgcgtagtgggtttatatttttatttcgatttcgtatgttatcgcgagtgggtttatatttttatttcgatttcgcgtgttattacgagtgggtttatatttttatttcgatttcgcgtgttatcgcgagtgggtttatagttttatttcgatttcgcgtgttatcgcgagtggatttatacgtttatttcgattttgcgtgttattacgagtgggtttatagttttatttcgatttcgcgtgttatcgcgagtggatttatatttttatttcgatttcgcgtgttatcgcgagtggatttatacgtttatttcgatttcgcgtgttatcgcgagtgggtttatagcgttatttcgattttacgtgttatcgcgagtggatttatacgtttatttcgatttcgcgtgttatcgcgagtggatttatagttttatttcgatttcgcgtgttatcgcgagtggatttatacgtttatttcgatttcgcgtgttatcgcgagtgggtttatagttttatttcgatttcgcgtgttatcgcgagtggatttatacgtttatttcgatttcgcgtgttatcgcgagtgggtttatagttttatttcgattttatatgttatcgcgagtgggtttatacgtttatttcgatttcgcgtgttatcgcgagtggatttatacgtttatttcgatttcgcgtgttatcgcgagtgggtttatagttttatttcgatttcgcgtgttatcgcgagtggatttatacgtttatttcgattttatatgtttacgtgtttaatgaatattgtgttagaaggttagtagtaaatatgttatagtattttat

SEQ ID NO: 14394 - DNA, 1601 bp, Artificial Sequence
  chemically treated genomic DNA (Homo sapiens) CpG-island No: 14394
ataaaatactataacatatttactactaaccttctaacacaatattcattaaacacgtaaacatataaaatcgaaataaacgtataaatccactcgcgataacacgcgaaatcgaaataaaactataaacccactcgcgataacacgcgaaatcgaaataaacgtataaatccactcgcgataacacgcgaaatcgaaataaacgtataaacccactcgcgataacatataaaatcgaaataaaactataaacccactcgcgataacacgcgaaatcgaaataaacgtataaatccactcgcgataacacgcgaaatcgaaataaaactataaacccactcgcgataacacgcgaaatcgaaataaacgtataaatccactcgcgataacacgcgaaatcgaaataaaactataaatccactcgcgataacacgcgaaatcgaaataaacgtataaatccactcgcgataacacgtaaaatcgaaataacgctataaacccactcgcgataacacgcgaaatcgaaataaacgtataaatccactcgcgataacacgcgaaatcgaaataaaaatataaatccactcgcgataacacgcgaaatcgaaataaaactataaacccactcgtaataacacgcaaaatcgaaataaacgtataaatccactcgcgataacacgcgaaatcgaaataaaactataaacccactcgcgataacacgcgaaatcgaaataaaaatataaacccactcgtaataacacgcgaaatcgaaataaaaatataaacccactcgcgataacatacgaaatcgaaataaaaatataaacccactacgcgataacacgcgaaactcgaaataaacgtataaatccactcgcgataacacgcaaaatcgaaataaaactataaacccgcttactataacacgcgaaatcgaaataaacgtataaatccactcgcgataacacgtaaaatcgaaataaaaatataaatcccctcgcgataacacgcgaaaccgaaataaacgtataaatccactcgcgataacacgcgaaatcgaaataaaaatataaatccactcacgataacacgcgaaatcgaaataaatatataaatccactcgcgataacacgcgaaatcgaaataaaaatataaatccactcgcgataacacgcgaaatcgaaataaacgtataaatccactcgcgataacacgcaaaatcgaaataaatatataaatccactcgcgataacacgcgaaatcgaaataaaaatataaatccactcgcgataacacgcaaaatcgaaataaacgtataaatccactcgcgataacacgcgaaatcgaaataaacgtataaacccactcgcgataacacgtaaaatcgaaataaacgtataaatccactcgcgataacacgcgaaatcgaaataaaactataaatccactcgcgataacacgcgaaatcgaaataaaaatataaatccactcgcgataacacgcgaaaccgaaataaacgtataaatccactcgcgataacacgcgaaatcgaaataaacgtataaacccactcgcgataacacgcgaaatcgaaataaata

SEQ ID NO: 14395 - DNA, 1601 bp, Artificial Sequence
  chemically treated genomic DNA (Homo sapiens) CpG-island No: 14395
atggggtgttgtggtatgtttattgttgattttttagtatagtgtttattaaatacgtgaatatgtggggtcgggatgagcgtgtgaatttattcgcggtgatacgcggggtcgggatgaggttgtgaatttattcgcggtgatacgcggggtcgggatgagcgtgtgaatttattcgcggtgatacgcggggtcgggatgagcgtgtgaatttattcgcggtgatatgtggggtcgggatgaggttgtgaatttattcgcggtgatacgcgggatcgggatgagcgtgtgaatttattcgcggtgatacgcggggtcgggatgaggttgtgaatttattcgcggtgatacgcggggtcgggatgagcgtgtgagtttattcgcggtgatacgcggggtcgggatgaggttgtgaatttattcgcggtgatacgcggggtcgggatgagcgtgtgagtttattcgcggtgatacgtggggtcgggatgacgttgtgaatttattcgcggtgatacgcggggtcgggatgagcgtgtgagtttattcgcggtgatacgcggggtcgggatgagggtgtgaatttattcgcggtgatacgcggggtcgggatgaggttgtgaatttattcgtggtgatacgtagggtcgggatgagcgtgtgaatttattcgcggtgatacgcggggtcgggatgaggttgtgaatttattcgcggtgatacgcggggtcgggatgagggtgtgaatttattcgtggtgatacgcggggtcgggatgagggtgtgaatttattcgcggtgatatgcggggtcgggatgagggtgtgagtttattgcgcgataatacgcggggttcgggatgagcgtgtgaatttattcgcggtgatacgtagggtcgggatgaggttgtgaattcgtttgttgtgatacgcggggtcgggatgagcgtgtgagtttattcgcggtgatacgtggggtcgggatgagggtgtgagttttttcgcggtgatacgcggggtcgggatgagcgtgtgaatttattcgcggtgatacgcggggtcgggatgagggtgtgagtttatttacggtgatacgcggggtcgggatgagtgtgtgaatttattcgcggtgatacgcggggtcgggatgagggtgtgagtttattcgcggtgatacgcggggtcgggatgagcgtgtgaatttattcgcggtgatacgtagggtcgggatgagtgtgtgaatttattcgcggtgatacgcggggtcgggatgagggtgtgagtttattcgcggtgatacgtagggtcgggatgagcgtgtgagtttattcgcggtgatacgcggggtcgggatgagcgtgtgaatttattcgcggtgatacgtggggtcgggatgagcgtgtgaatttattcgcggtgatacgcggggtcgggatgaggttgtgaatttattcgcggtgatacgcggggtcgggatgagggtgtgagtttattcgcggtgatacgcggggtcgggatgagcgtgtgaatttattcgcggtgatacgcggggtcgggatgagcgtgtgaatttattcgcggtgatacgcggggtcgggatgagtg

SEQ ID NO: 14396 - DNA, 1601 bp, Artificial Sequence
  chemically treated genomic DNA (Homo sapiens) CpG-island No: 14396
cactcatcccgaccccgcgtatcaccgcgaataaattcacacgctcatcccgaccccgcgtatcaccgcgaataaattcacacgctcatcccgaccccgcgtatcaccgcgaataaactcacaccctcatcccgaccccgcgtatcaccgcgaataaattcacaacctcatcccgaccccgcgtatcaccgcgaataaattcacacgctcatcccgaccccacgtatcaccgcgaataaattcacacgctcatcccgaccccgcgtatcaccgcgaataaactcacacgctcatcccgaccctacgtatcaccgcgaataaactcacaccctcatcccgaccccgcgtatcaccgcgaataaattcacacactcatcccgaccctacgtatcaccgcgaataaattcacacgctcatcccgaccccgcgtatcaccgcgaataaactcacaccctcatcccgaccccgcgtatcaccgcgaataaattcacacactcatcccgaccccgcgtatcaccgtaaataaactcacaccctcatcccgaccccgcgtatcaccgcgaataaattcacacgctcatcccgaccccgcgtatcaccgcgaaaaaactcacaccctcatcccgaccccacgtatcaccgcgaataaactcacacgctcatcccgaccccgcgtatcacaacaaacgaattcacaacctcatcccgaccctacgtatcaccgcgaataaattcacacgctcatcccgaaccccgcgtattatcgcgcaataaactcacaccctcatcccgaccccgcatatcaccgcgaataaattcacaccctcatcccgaccccgcgtatcaccacgaataaattcacaccctcatcccgaccccgcgtatcaccgcgaataaattcacaacctcatcccgaccccgcgtatcaccgcgaataaattcacacgctcatcccgaccctacgtatcaccacgaataaattcacaacctcatcccgaccccgcgtatcaccgcgaataaattcacaccctcatcccgaccccgcgtatcaccgcgaataaactcacacgctcatcccgaccccgcgtatcaccgcgaataaattcacaacgtcatcccgaccccacgtatcaccgcgaataaactcacacgctcatcccgaccccgcgtatcaccgcgaataaattcacaacctcatcccgaccccgcgtatcaccgcgaataaactcacacgctcatcccgaccccgcgtatcaccgcgaataaattcacaacctcatcccgaccccgcgtatcaccgcgaataaattcacacgctcatcccgatcccgcgtatcaccgcgaataaattcacaacctcatcccgaccccacatatcaccgcgaataaattcacacgctcatcccgaccccgcgtatcaccgcgaataaattcacacgctcatcccgaccccgcgtatcaccgcgaataaattcacaacctcatcccgaccccgcgtatcaccgcgaataaattcacacgctcatcccgaccccacatattcacgtatttaataaacactatactaaaaaatcaacaataaacataccacaacaccccat

SEQ ID NO: 14397 - DNA, 1567 bp, Artificial Sequence
  chemically treated genomic DNA (Homo sapiens) CpG-island No: 14397
ggttagttcggtgtgcgtggttagttcggttttcgtggttagttcggtgtgcgtggtcgttttagtttttatggtcggttcggtttttatggtcggttcggtttttatggttagttcggtgtgcgtggttagtttggtgtgcgtggttagttcggtgtgcgtggttagttcggtgtgtatggttagttcggttttcgtgttaagtttggtttttgtggttagttcggtttttgtagtcggttcggtgtgtgtggttggttcggtatgtatgtttagttcggttttcgtggtcggttcggtgtgtatggtcggttcggtgtgtatgtttagttcggtgtgcgtggttagtttggtgtgcgtggttagtttggtgtgcgtggttagttcggtgtgcgtggttagttcggtgtgcgtggttagttcggtgtgcgtggttagtttggtgtgcgtggttagttcggtgtgcgtggttagttcggtgtgcgtggttagttcggttttcgtggttagtttggtttttgtggttagttcggtttttgtagtcggttcggtgtgtgtggttggttcggtatgtatgtttagttcggttttcgtggtcggttcggtgtgtatggtcggttcggtgtgtatgtttagttcggtgtgcgtggtcggtttattgtgtatggtcggttcggtatgtatggttagttcggtgtgcgtggttagttcggtgtgtatggtcggtttagttttcgtggttagttcggtgtgcgtggttggttcggtgtgtatggtttgtttagttttcgtggttagttcggttttcgtggttagttcggtgtgtatggtcggttcggtgtgcgtggttagttcggttttcgtggttagttcggttttcgtggtcggttcggtgtgcgtggtcggttcggtgtgcgtggttagttcgttgtacgtgttcggttcggtgtgtgttgttagttcggtttttatggttagtttagtgtgcgtggttagttcggtgtgtatggttagttcggtttttgtggttagttcggtttttatggttagttcggtgtgcgtggttagttcgggtttcgtggttagttcggtgtgtatggtcggtttagtgtgcgtggttagttcggtgtgcgtggtcggtttagtgtgcgtggttagtttggttttcgtggttagttcggtgtgcgtggtcggttcggtgtgcgtggtcggtttaatgtgcgtggtcggtttagttttcgtggtcgtttcggtgtgtatggtcggttcggttttcgtggtcgtttcggtgtgcgtggttggttcggttttcgtggtcggttcggtgtgcgtggtcggttcggtgcgtgtggtcggttcggttttcgtggtcggtttagtgtgcgtggttagttcggtgtgcgtggtcggttcgatattcgtggttggttcggtgtgcgtggtcggtttggtgtgtgtggtcggttcggttttcgtggtcggttcggtgtgtatggttagttagatttttgtggttagtttcgtttagaagaggtgtatatgaggggatatgatgttttgggttgtg

SEQ ID NO: 14398 - DNA, 1567 bp, Artificial Sequence
  chemically treated genomic DNA (Homo sapiens) CpG-island No: 14398
cacaacccaaaacatcatatcccctcatatacacctcttctaaacgaaactaaccacaaaaatctaactaaccatacacaccgaaccgaccacgaaaaccgaaccgaccacacacaccaaaccgaccacgcacaccgaaccaaccacgaatatcgaaccgaccacgcacaccgaactaaccacgcacactaaaccgaccacgaaaaccgaaccgaccacacgcaccgaaccgaccacgcacaccgaaccgaccacgaaaaccgaaccaaccacgcacaccgaaacgaccacgaaaaccgaaccgaccatacacaccgaaacgaccacgaaaactaaaccgaccacgcacattaaaccgaccacgcacaccgaaccgaccacgcacaccgaactaaccacgaaaaccaaactaaccacgcacactaaaccgaccacgcacaccgaactaaccacgcacactaaaccgaccatacacaccgaactaaccacgaaacccgaactaaccacgcacaccgaactaaccataaaaaccgaactaaccacaaaaaccgaactaaccatacacaccgaactaaccacgcacactaaactaaccataaaaaccgaactaacaacacacaccgaaccgaacacgtacaacgaactaaccacgcacaccgaaccgaccacgcacaccgaaccgaccacgaaaaccgaactaaccacgaaaaccgaactaaccacgcacaccgaaccgaccatacacaccgaactaaccacgaaaaccgaactaaccacgaaaactaaacaaaccatacacaccgaaccaaccacgcacaccgaactaaccacgaaaactaaaccgaccatacacaccgaactaaccacgcacaccgaactaaccatacataccgaaccgaccatacacaataaaccgaccacgcacaccgaactaaacatacacaccgaaccgaccatacacaccgaaccgaccacgaaaaccgaactaaacatacataccgaaccaaccacacacaccgaaccgactacaaaaaccgaactaaccacaaaaaccaaactaaccacgaaaaccgaactaaccacgcacaccgaactaaccacgcacaccgaactaaccacgcacaccaaactaaccacgcacaccgaactaaccacgcacaccgaactaaccacgcacaccgaactaaccacgcacaccaaactaaccacgcacaccaaactaaccacgcacaccgaactaaacatacacaccgaaccgaccatacacaccgaaccgaccacgaaaaccgaactaaacatacataccgaaccaaccacacacaccgaaccgactacaaaaaccgaactaaccacaaaaaccaaacttaacacgaaaaccgaactaaccatacacaccgaactaaccacgcacaccgaactaaccacgcacaccaaactaaccacgcacaccgaactaaccataaaaaccgaaccgaccataaaaaccgaaccgaccataaaaactaaaacgaccacgcacaccgaactaaccacgaaaaccgaactaaccacgcacaccgaactaacc

SEQ ID NO: 14399 - DNA, 1567 bp, Artificial Sequence
  chemically treated genomic DNA (Homo sapiens) CpG-island No: 14399
tatagtttaaagtattatgtttttttatatgtattttttttgaacggagttgattatagaaatttagttgattatgtatatcgagtcgattacggaaatcgagtcgattatatatattaagtcgattacgtatatcgagttaattacggatatcgagtcgattacgtatatcgagttgattacgtatattgagtcgattacggaaatcgagtcgattatacgtatcgagtcgattacgtatatcgagtcgattacggaaatcgagttaattacgtatatcgagacgattacggaaatcgagtcgattatgtatatcgagacgattacggaaattgagtcgattacgtatattgagtcgattacgtatatcgagtcgattacgtatatcgagttgattacggaaattaagttgattacgtatattgagtcgattacgtatatcgagttgattacgtatattgagtcgattatgtatatcgagttgattacggaattcgagttgattacgtatatcgagttgattatggaaatcgagttgattatagaaatcgagttgattatgtatatcgagttgattacgtatattgagttgattatggaaatcgagttgataatatatatcgagtcgaatacgtgtagcgagttgattacgtatatcgagtcgattacgtatatcgagtcgattacggaaatcgagttgattacggaaatcgagttgattacgtatatcgagtcgattatgtatatcgagttgattacggaaatcgagttgattacggaaattgagtagattatgtatatcgagttaattacgtatatcgagttgattacggaaattgagtcgattatgtatatcgagttgattacgtatatcgagttgattatgtatatcgagtcgattatgtataatgagtcgattacgtatatcgagttgaatatgtatatcgagtcgattatgtatatcgagtcgattacggaaatcgagttgaatatgtatatcgagttaattatatatatcgagtcgattatagaaatcgagttgattatagaaattaagttgattacggaaatcgagttgattacgtatatcgagttgattacgtatatcgagttgattacgtatattaagttgattacgtatatcgagttgattacgtatatcgagttgattacgtatatcgagttgattacgtatattaagttgattacgtatattaagttgattacgtatatcgagttgaatatgtatatcgagtcgattatgtatatcgagtcgattacggaaatcgagttgaatatgtatatcgagttaattatatatatcgagtcgattatagaaatcgagttgattatagaaattaagtttagtacggaaatcgagttgattatgtatatcgagttgattacgtatatcgagttgattacgtatattaagttgattacgtatatcgagttgattatggaaatcgagtcgattatggaaatcgagtcgattatggaaattgagacgattacgtatatcgagttgattacggaaatcgagttgattacgtatatcgagttgatt

SEQ ID NO: 14400 - DNA, 1567 bp, Artificial Sequence
  chemically treated genomic DNA (Homo sapiens) CpG-island No: 14400
aatcaactcgatatacgtaatcaactcgatttccgtaatcaactcgatatacgtaatcgtctcaatttccataatcgactcgatttccataatcgactcgatttccataatcaactcgatatacgtaatcaacttaatatacgtaatcaactcgatatacgtaatcaactcgatatacataatcaactcgatttccgtactaaacttaatttctataatcaactcgatttctataatcgactcgatatatataattaactcgatatacatattcaactcgatttccgtaatcgactcgatatacataatcgactcgatatacatattcaactcgatatacgtaatcaacttaatatacgtaatcaacttaatatacgtaatcaactcgatatacgtaatcaactcgatatacgtaatcaactcgatatacgtaatcaacttaatatacgtaatcaactcgatatacgtaatcaactcgatatacgtaatcaactcgatttccgtaatcaacttaatttctataatcaactcgatttctataatcgactcgatatatataattaactcgatatacatattcaactcgatttccgtaatcgactcgatatacataatcgactcgatatacatattcaactcgatatacgtaatcgactcattatacataatcgactcgatatacataatcaactcgatatacgtaatcaactcgatatacataatcgactcaatttccgtaatcaactcgatatacgtaattaactcgatatacataatctactcaatttccgtaatcaactcgatttccgtaatcaactcgatatacataatcgactcgatatacgtaatcaactcgatttccgtaatcaactcgatttccgtaatcgactcgatatacgtaatcgactcgatatacgtaatcaactcgctacacgtattcgactcgatatatattatcaactcgatttccataatcaactcaatatacgtaatcaactcgatatacataatcaactcgatttctataatcaactcgatttccataatcaactcgatatacgtaatcaactcgaattccgtaatcaactcgatatacataatcgactcaatatacgtaatcaactcgatatacgtaatcgactcaatatacgtaatcaacttaatttccgtaatcaactcgatatacgtaatcgactcgatatacgtaatcgactcaatatacgtaatcgactcaatttccgtaatcgtctcgatatacataatcgactcgatttccgtaatcgtctcgatatacgtaattaactcgatttccgtaatcgactcgatatacgtaatcgactcgatacgtataatcgactcgatttccgtaatcgactcaatatacgtaatcaactcgatatacgtaatcgactcgatatccgtaattaactcgatatacgtaatcgacttaatatatataatcgactcgatttccgtaatcgactcgatatacataatcaactaaatttctataatcaactccgttcaaaaaaaatacatataaaaaaacataatactttaaactata

SEQ ID NO: 14401 - DNA, 563 bp, Artificial Sequence
  chemically treated genomic DNA (Homo sapiens) CpG-island No: 14401
ttaagttttagtcgtatttgttttcgggttcgttttagttttcgaggggtttgcggaggcgacgttttagttaggagggatgcgcgtttgcgagtttttcggggatttcggagtcgttttattgcggtgtttgtcgttattttttttacgttttagtaattgcgacgcgacggtagatagtgtaggcggtaatcgacggtcgggacgtttaattttaagttttagtaagtttcgcggttacgttttttgattatttcgcgttagtaagatttaaattacggatttcgattgatttcgcgcggcgcgttacgttgttagttttagttaatcggtttcggataagtcggaggggagggagacgtagaggcggataagatggcggcggtagttgtatagggcgggagaagcggtggtagcggaggttgtagtggggttggtggtgtttttaattgcgggatagtaacgtggtcgtagcggtttgttggataaggtgaggagtcggtttttgggaatagttgaattttggggaggtttgggaggcggcgagtttatttttttatttt

SEQ ID NO: 14402 - DNA, 563 bp, Artificial Sequence
  chemically treated genomic DNA (Homo sapiens) CpG-island No: 14402
aaaataaaaaaataaactcgccgcctcccaaacctccccaaaattcaactattcccaaaaaccgactcctcaccttatccaacaaaccgctacgaccacgttactatcccgcaattaaaaacaccaccaaccccactacaacctccgctaccaccgcttctcccgccctatacaactaccgccgccatcttatccgcctctacgtctccctcccctccgacttatccgaaaccgattaactaaaactaacaacgtaacgcgccgcgcgaaatcaatcgaaatccgtaatttaaatcttactaacgcgaaataatcaaaaaacgtaaccgcgaaacttactaaaacttaaaattaaacgtcccgaccgtcgattaccgcctacactatctaccgtcgcgtcgcaattactaaaacgtaaaaaaaataacgacaaacaccgcaataaaacgactccgaaatccccgaaaaactcgcaaacgcgcatccctcctaactaaaacgtcgcctccgcaaacccctcgaaaactaaaacgaacccgaaaacaaatacgactaaaacttaa

SEQ ID NO: 14403 - DNA, 563 bp, Artificial Sequence
  chemically treated genomic DNA (Homo sapiens) CpG-island No: 14403
gggatgggaaggtgggttcgtcgttttttaggtttttttaggatttaattgtttttaagaatcggttttttattttatttaataagtcgttacggttacgttgttgtttcgtagttggaagtattattagttttattatagttttcgttattatcgtttttttcgttttgtatagttgtcgtcgttattttgttcgtttttgcgtttttttttttttcgatttgttcgaagtcgattggttggagttgatagcgtgacgcgtcgcgcggagttaatcgggattcgtagtttgggttttgttggcgcgaggtagttagaggacgtggtcgcggggtttgttgggatttgaggttagacgtttcggtcgtcggttgtcgtttatattgtttgtcgtcgcgtcgtagttattaaggcgtggggaagatagcggtaggtatcgtagtggagcggtttcgagattttcggggggttcgtaggcgcgtattttttttgattgggacgtcgttttcgtagatttttcggaggttgaagcgagttcggaggtaggtgcgattgaaatttag

SEQ ID NO: 14404 - DNA, 563 bp, Artificial Sequence
  chemically treated genomic DNA (Homo sapiens) CpG-island No: 14404
ctaaatttcaatcgcacctacctccgaactcgcttcaacctccgaaaaatctacgaaaacgacgtcccaatcaaaaaaaatacgcgcctacgaaccccccgaaaatctcgaaaccgctccactacgatacctaccgctatcttccccacgccttaataactacgacgcgacgacaaacaatataaacgacaaccgacgaccgaaacgtctaacctcaaatcccaacaaaccccgcgaccacgtcctctaactacctcgcgccaacaaaacccaaactacgaatcccgattaactccgcgcgacgcgtcacgctatcaactccaaccaatcgacttcgaacaaatcgaaaaaaaaaaaaacgcaaaaacgaacaaaataacgacgacaactatacaaaacgaaaaaaacgataataacgaaaactataataaaactaataatacttccaactacgaaacaacaacgtaaccgtaacgacttattaaataaaataaaaaaccgattcttaaaaacaattaaatcctaaaaaaacctaaaaaacgacgaacccaccttcccatccc

SEQ ID NO: 14405 - DNA, 1303 bp, Artificial Sequence
  chemically treated genomic DNA (Homo sapiens) CpG-island No: 14405
cgtcgcgtttttgtttttacgaggggtcgtcgcgtttttgttttcgtcgaggggtcgtcgcgtttttgttttcgtcgaggggtcgtcgcgtttttgttttcgtcgagggggcgtcgcgtttttgtttttacgaggggtcgtcgcgtttttgtttttacgaggggtcgtcgcgtttttgttttcgtcgaggggtcgtcgcgtttttgttttcgtcgagggggcgtcgcgtttttgtttttacgaggggtcgtcgcgtttttgtttttacgaggggtcgtcgcgtttttgttttcgtcgaggggtcgtcgcgtttttgttttcgtcgaggggtcgtcgcgtttttgttttcgtcgagggggcgtcgcgtttttgttttcgtcgagggggcgtcgcgtttttgtttttacgaggggtcgtcgcgtttttgtttttacgaggggtcgtcgcgtttttgtttttacgaggggtcgtcgcgtttttgtttttacgaggggtcgtcgcgtttttgttttcgtcggggggcgtcgcgtttttgtttttacgaggggtcgtcgcgtttttgtttttacgaggggtcgtcgcgtttttgtttttacgagggggcgtcgcgtttttgttttcgtcgaggggtcgtcgcgtttttgtttttacgaggggtcgtcgcgtttttgtttttacgaggggtcgtcgcgtttttgtttttacgaggggtcgtcgcgtttttgtttttacgaggggtcgtcgcgtttttgttttcgtcgagggggcgtcgcgtttttgtttttacgaggggtcgtcgcgtttttgttttcgtcgaggggtcgtcgcgtttttgtttttacgaggggtcgtcgcgtttttgttttcgtcgaggggtcgtcgcgtttttgtttttacgaggggtcgtcgcgtttttgttttcgtcgaggggtcgtcgcgtttttgttttcgtcgaggggggtcgcgtttttgtttttacgaggggtcgtcgcgtttttgttttcgtcgaggggggttcgcgtttttgtttttacgaggggtcgtcgcgtttttgttttcgtcgaggggtcgtcgcgtttttgtttttacgaggggtcgtcgcgtttttgttttcgtcgaggggtcgtcgcgtttttgtttttacgagggggcgtcgcgtttttgtttttacgaggggtcgtcgcgtttttgtttttacgaggggtcgtcgcgtttttgttttcgtcgaggggtcgttacgtttttgtttttattgaggtgttgagattgttatggtttatttatggtgttttttgtttatttt

SEQ ID NO: 14406 - DNA, 1303 bp, Artificial Sequence
  chemically treated genomic DNA (Homo sapiens) CpG-island No: 14406
aaaataaacaaaaaacaccataaataaaccataacaatctcaacacctcaataaaaacaaaaacgtaacgacccctcgacgaaaacaaaaacgcgacgacccctcgtaaaaacaaaaacgcgacgacccctcgtaaaaacaaaaacgcgacgccccctcgtaaaaacaaaaacgcgacgacccctcgacgaaaacaaaaacgcgacgacccctcgtaaaaacaaaaacgcgacgacccctcgacgaaaacaaaaacgcgacgacccctcgtaaaaacaaaaacgcgaacccccctcgacgaaaacaaaaacgcgacgacccctcgtaaaaacaaaaacgcgacccccctcgacgaaaacaaaaacgcgacgacccctcgacgaaaacaaaaacgcgacgacccctcgtaaaaacaaaaacgcgacgacccctcgacgaaaacaaaaacgcgacgacccctcgtaaaaacaaaaacgcgacgacccctcgacgaaaacaaaaacgcgacgacccctcgtaaaaacaaaaacgcgacgccccctcgacgaaaacaaaaacgcgacgacccctcgtaaaaacaaaaacgcgacgacccctcgtaaaaacaaaaacgcgacgacccctcgtaaaaacaaaaacgcgacgacccctcgtaaaaacaaaaacgcgacgacccctcgacgaaaacaaaaacgcgacgccccctcgtaaaaacaaaaacgcgacgacccctcgtaaaaacaaaaacgcgacgacccctcgtaaaaacaaaaacgcgacgccccccgacgaaaacaaaaacgcgacgacccctcgtaaaaacaaaaacgcgacgacccctcgtaaaaacaaaaacgcgacgacccctcgtaaaaacaaaaacgcgacgacccctcgtaaaaacaaaaacgcgacgccccctcgacgaaaacaaaaacgcgacgccccctcgacgaaaacaaaaacgcgacgacccctcgacgaaaacaaaaacgcgacgacccctcgacgaaaacaaaaacgcgacgacccctcgtaaaaacaaaaacgcgacgacccctcgtaaaaacaaaaacgcgacgccccctcgacgaaaacaaaaacgcgacgacccctcgacgaaaacaaaaacgcgacgacccctcgtaaaaacaaaaacgcgacgacccctcgtaaaaacaaaaacgcgacgccccctcgacgaaaacaaaaacgcgacgacccctcgacgaaaacaaaaacgcgacgacccctcgacgaaaacaaaaacgcgacgacccctcgtaaaaacaaaaacgcgacg

SEQ ID NO: 14407 - DNA, 1303 bp, Artificial Sequence
  chemically treated genomic DNA (Homo sapiens) CpG-island No: 14407
agggtgggtaggaagtattatggataaattatggtagttttaatattttagtgaggatagagacgtggcggtttttcggcgaggatagagacgcggcggtttttcgtgaggatagagacgcggcggtttttcgtgaggatagagacgcggcgttttttcgtgaggatagagacgcggcggtttttcggcgaggatagagacgcggcggtttttcgtgaggatagagacgcggcggtttttcggcgaggatagagacgcggcggtttttcgtgaggatagagacgcgggtttttttcggcgaggatagagacgcggcggtttttcgtgaggatagagacgcggtttttttcggcgaggatagagacgcggcggtttttcggcgaggatagagacgcggcggtttttcgtgaggatagagacgcggcggtttttcggcgaggatagagacgcggcggtttttcgtgaggatagagacgcggcggtttttcggcgaggatagagacgcggcggtttttcgtgaggatagagacgcggcgttttttcggcgaggatagagacgcggcggtttttcgtgaggatagagacgcggcggtttttcgtgaggatagaggcgcggcggtttttcgtgaggatagagacgcggcggtttttcgtgaggatagagacgcggcggtttttcggcgaggatagagacgcggcgttttttcgtgaggatagaggcgcggcggtttttcgtgaggatagaggcgcggcggtttttcgtgaggatagagacgcggcgtttttcggcgaggatagagacgcggcggtttttcgtgaggatagagacgcggcggtttttcgtgaggatagagacgcggcggtttttcgtgaggatagagacgcggcggtttttcgtgaggatagagacgcggcgttttttcggcgaggatagagacgcggcgttttttcggcgaggatagagacgcggcggtttttcggcgaggatagagacgcggcggtttttcggcgaggatagaggcgcggcggtttttcgtgaggatagagacgcggcggtttttcgtgaggatagagacgcggcgttttttcggcgaggatagagacgcggcggtttttcggcgaggatagagacgcggcggtttttcgtgaggatagagacgcggcggtttttcgtgaggatagagacgcggcgttttttcggcgaggatagagacgcggcggtttttcggcgaggatagagacgcggcggtttttcggcgaggatagagacgcggcggtttttcgtgaggatagaggcgcggcg

SEQ ID NO: 14408 - DNA, 1303 bp, Artificial Sequence
  chemically treated genomic DNA (Homo sapiens) CpG-island No: 14408
cgccgcgcctctatcctcacgaaaaaccgccgcgtctctatcctcgccgaaaaaccgccgcgtctctatcctcgccgaaaaaccgccgcgtctctatcctcgccgaaaaaacgccgcgtctctatcctcacgaaaaaccgccgcgtctctatcctcacgaaaaaccgccgcgtctctatcctcgccgaaaaaccgccgcgtctctatcctcgccgaaaaaacgccgcgtctctatcctcacgaaaaaccgccgcgtctctatcctcacgaaaaaccgccgcgcctctatcctcgccgaaaaaccgccgcgtctctatcctcgccgaaaaaccgccgcgtctctatcctcgccgaaaaaacgccgcgtctctatcctcgccgaaaaaacgccgcgtctctatcctcacgaaaaaccgccgcgtctctatcctcacgaaaaaccgccgcgtctctatcctcacgaaaaaccgccgcgtctctatcctcacgaaaaaccgccgcgtctctatcctcgccgaaaaacgccgcgtctctatcctcacgaaaaaccgccgcgcctctatcctcacgaaaaaccgccgcgcctctatcctcacgaaaaaacgccgcgtctctatcctcgccgaaaaaccgccgcgtctctatcctcacgaaaaaccgccgcgtctctatcctcacgaaaaaccgccgcgcctctatcctcacgaaaaaccgccgcgtctctatcctcacgaaaaaccgccgcgtctctatcctcgccgaaaaaacgccgcgtctctatcctcacgaaaaaccgccgcgtctctatcctcgccgaaaaaccgccgcgtctctatcctcacgaaaaaccgccgcgtctctatcctcgccgaaaaaccgccgcgtctctatcctcacgaaaaaccgccgcgtctctatcctcgccgaaaaaccgccgcgtctctatcctcgccgaaaaaaaccgcgtctctatcctcacgaaaaaccgccgcgtctctatcctcgccgaaaaaaacccgcgtctctatcctcacgaaaaaccgccgcgtctctatcctcgccgaaaaaccgccgcgtctctatcctcacgaaaaaccgccgcgtctctatcctcgccgaaaaaccgccgcgtctctatcctcacgaaaaaacgccgcgtctctatcctcacgaaaaaccgccgcgtctctatcctcacgaaaaaccgccgcgtctctatcctcgccgaaaaaccgccacgtctctatcctcactaaaatattaaaactaccataatttatccataatacttcctacccaccct

SEQ ID NO: 14409 - DNA, 568 bp, Artificial Sequence
  chemically treated genomic DNA (Homo sapiens) CpG-island No: 14409
ttcgcgcgtttttttcgtttttttagggtttcggcgggagttggggttgcggtcggggttcgggattcgggtaggtttttacgcgttttttcgtcgtcgggatgtttttggagttttagattttgttcgggaaatttgggtgtcgtttcggttggaagtttcggaggtttgcgtcggtttcgcgcgtttcgttttcggggcgggatcgttgtattcggggttttttcgcgtttcgttttcgattttttcgtggttgtttcgtattttatttattacggtttcggttagggtttcgcgggtttggcgcgttttttcgggcgcggcgggtattggtcgtagttttgtcgattttagttttgggttcggttagcgttgcgttttgtttcgtttgggtcgttcgggttttttcgcgcgttgttttttttttgttgcgttttatagggattcgtttttttttagttttgttttttgcgtcgttgtttttttttacgggttttcgttttttttttgcgtttttttagcgcgtggtgttagcgggttttttttttgtttatggggtgatagtttg

SEQ ID NO: 14410 - DNA, 568 bp, Artificial Sequence
  chemically treated genomic DNA (Homo sapiens) CpG-island No: 14410
caaactatcaccccataaacaaaaaaaaaacccgctaacaccacgcgctaaaaaaacgcaaaaaaaaaacgaaaacccgtaaaaaaaaacaacgacgcaaaaaacaaaactaaaaaaaaacgaatccctataaaacgcaacaaaaaaaaaacaacgcgcgaaaaaacccgaacgacccaaacgaaacaaaacgcaacgctaaccgaacccaaaactaaaatcgacaaaactacgaccaatacccgccgcgcccgaaaaaacgcgccaaacccgcgaaaccctaaccgaaaccgtaataaataaaatacgaaacaaccacgaaaaaatcgaaaacgaaacgcgaaaaaaccccgaatacaacgatcccgccccgaaaacgaaacgcgcgaaaccgacgcaaacctccgaaacttccaaccgaaacgacacccaaatttcccgaacaaaatctaaaactccaaaaacatcccgacgacgaaaaaacgcgtaaaaacctacccgaatcccgaaccccgaccgcaaccccaactcccgccgaaaccctaaaaaaacgaaaaaaacgcgcgaa

SEQ ID NO: 14411 - DNA, 568 bp, Artificial Sequence
  chemically treated genomic DNA (Homo sapiens) CpG-island No: 14411
tagattgttattttatgggtagagaaggggttcgttaatattacgcgttgagggggcgtaggggagaggcgggaattcgtggagggaggtagcggcgtagggagtaggattggagggaggcgggtttttgtggagcgtagtaggaggaaggtagcgcgcggggaggttcgggcggtttaggcgaggtaggacgtagcgttgatcggatttagggttgaagtcggtagaattgcggttagtgttcgtcgcgttcgggggagcgcgttaggttcgcggggttttagtcgaggtcgtagtaggtggaatacggggtagttacggaggaatcgggggcgaggcgcggagaggtttcggatgtagcggtttcgtttcgagaacggagcgcgcggaatcggcgtaggttttcgaggtttttagtcgagacggtatttaggtttttcgagtagggtttgaggttttaaggatatttcggcggcgagaaggcgcgtagagatttgttcgggtttcgagtttcgatcgtagttttagttttcgtcgaggttttggaaaggcgggggagacgcgcggg

SEQ ID NO: 14412 - DNA, 568 bp, Artificial Sequence
  chemically treated genomic DNA (Homo sapiens) CpG-island No: 14412
cccgcgcgtctcccccgcctttccaaaacctcgacgaaaactaaaactacgatcgaaactcgaaacccgaacaaatctctacgcgccttctcgccgccgaaatatccttaaaacctcaaaccctactcgaaaaacctaaataccgtctcgactaaaaacctcgaaaacctacgccgattccgcgcgctccgttctcgaaacgaaaccgctacatccgaaacctctccgcgcctcgcccccgattcctccgtaactaccccgtattccacctactacgacctcgactaaaaccccgcgaacctaacgcgctcccccgaacgcgacgaacactaaccgcaattctaccgacttcaaccctaaatccgatcaacgctacgtcctacctcgcctaaaccgcccgaacctccccgcgcgctaccttcctcctactacgctccacaaaaacccgcctccctccaatcctactccctacgccgctacctccctccacgaattcccgcctctcccctacgccccctcaacgcgtaatattaacgaaccccttctctacccataaaataacaatcta

SEQ ID NO: 14413 - DNA, 592 bp, Artificial Sequence
  chemically treated genomic DNA (Homo sapiens) CpG-island No: 14413
gtagtgcgtatgcgcgtcgttggcgtttaggtcgcggtaaggttgaggggaaggtggagggggtatagttcgcggagcgcgtttgtattttagcgttttagggtatttttcggggtttgggcgcgggtattcgggatttatttttttcggcgttcgaggtcgcgggatagtgggggcgtcgggaggaagtttcgtttagttttggtgggcggtggggtcgttggggtttggggcgtcgcgggttcggttcggattgacggcggtggggggcggggatggggtcgtggtgtcgggtcgcgtagaatttttgggattttcgcggcgtttaggttggggtttagggttcggagaacgttttttcgcgtggttatggttttgttagaattaggagcgggagaggcgtttatagatttttgagggtagaatcgtttggtttttaggtcgaaaggagtcggcgaggcgattttcgatttcgggacggagtcgcgggaacgggggattttaggcgttcgttttcgtttagtaggttaatttttttcgcgacgcgtttcgtatcgttttttatattaaatatgtatttatgtgtttagtt

SEQ ID NO: 14414 - DNA, 592 bp, Artificial Sequence
  chemically treated genomic DNA (Homo sapiens) CpG-island No: 14414
aactaaacacataaatacatatttaatataaaaaacgatacgaaacgcgtcgcgaaaaaaattaacctactaaacgaaaacgaacgcctaaaatcccccgttcccgcgactccgtcccgaaatcgaaaatcgcctcgccgactcctttcgacctaaaaaccaaacgattctaccctcaaaaatctataaacgcctctcccgctcctaattctaacaaaaccataaccacgcgaaaaaacgttctccgaaccctaaaccccaacctaaacgccgcgaaaatcccaaaaattctacgcgacccgacaccacgaccccatccccgccccccaccgccgtcaatccgaaccgaacccgcgacgccccaaaccccaacgaccccaccgcccaccaaaactaaacgaaacttcctcccgacgcccccactatcccgcgacctcgaacgccgaaaaaaataaatcccgaatacccgcgcccaaaccccgaaaaataccctaaaacgctaaaatacaaacgcgctccgcgaactataccccctccaccttcccctcaaccttaccgcgacctaaacgccaacgacgcgcatacgcactac

SEQ ID NO: 14415 - DNA, 592 bp, Artificial Sequence
  chemically treated genomic DNA (Homo sapiens) CpG-island No: 14415
gattgaatatatgaatatatatttggtgtaagaagcgatacgaagcgcgtcgcgggaaaaattaatttgttgggcgggagcggacgtttagaatttttcgttttcgcggtttcgtttcgggatcgggggtcgtttcgtcggtttttttcggtttgggaattaggcggttttgtttttaggaatttgtgggcgtttttttcgtttttgattttgataaagttatagttacgcgggaaaacgtttttcgggttttgagttttaatttgggcgtcgcgggggttttaagggttttgcgcggttcggtattacggttttattttcgttttttatcgtcgttagttcgggtcgagttcgcggcgttttaggttttagcggttttatcgtttattagggttgggcgaggttttttttcggcgtttttattatttcgcgatttcgggcgtcggaggggatgagtttcggatgttcgcgtttaggtttcgagggatgttttgaagcgttggggtataggcgcgtttcgcggattgtgttttttttattttttttttagttttgtcgcggtttgagcgttagcggcgcgtatgcgtattgt

SEQ ID NO: 14416 - DNA, 592 bp, Artificial Sequence
  chemically treated genomic DNA (Homo sapiens) CpG-island No: 14416
acaatacgcatacgcgccgctaacgctcaaaccgcgacaaaactaaaaaaaaaataaaaaaaacacaatccgcgaaacgcgcctataccccaacgcttcaaaacatccctcgaaacctaaacgcgaacatccgaaactcatcccctccgacgcccgaaatcgcgaaataataaaaacgccgaaaaaaaacctcgcccaaccctaataaacgataaaaccgctaaaacctaaaacgccgcgaactcgacccgaactaacgacgataaaaaacgaaaataaaaccgtaataccgaaccgcgcaaaacccttaaaacccccgcgacgcccaaattaaaactcaaaacccgaaaaacgttttcccgcgtaactataactttatcaaaatcaaaaacgaaaaaaacgcccacaaattcctaaaaacaaaaccgcctaattcccaaaccgaaaaaaaccgacgaaacgacccccgatcccgaaacgaaaccgcgaaaacgaaaaattctaaacgtccgctcccgcccaacaaattaatttttcccgcgacgcgcttcgtatcgcttcttacaccaaatatatattcatatattcaatc

SEQ ID NO: 14417 - DNA, 505 bp, Artificial Sequence
  chemically treated genomic DNA (Homo sapiens) CpG-island No: 14417
tttcggtttttggaggcggtacgtttggttacgcgttgcgaggcgtttttgtttttttcgtttggtggttttcggtaggggcgggtagggtacgtgagggcgtttgcgtttttttttggtattcggtgttgttggtcgcgcgggttgttcgggaagggaaatttcggaggaagttattgttgttatgttttttgttgtcgttatcggttgagtcgtgttaagaattttttttttcgtataggatttcgtagtttttttttattttcgagtttattcgttagggttattacgggttaggttgtcgtattcgagtcgcggagtgcgcggtggtcgttgcgtattttagttttagggtttttagaattggggagagttttaggatgggtgcgacgtttagaaaatcgacggcgtcgggttcgacgtatttagagttttggtatagttaagtagggatttgggttttattttggttttgataagtagttcgaaaaggtgaatttggtcg

SEQ ID NO: 14418 - DNA, 505 bp, Artificial Sequence
  chemically treated genomic DNA (Homo sapiens) CpG-island No: 14418
cgaccaaattcaccttttcgaactacttatcaaaaccaaaataaaacccaaatccctacttaactataccaaaactctaaatacgtcgaacccgacgccgtcgattttctaaacgtcgcacccatcctaaaactctccccaattctaaaaaccctaaaactaaaatacgcaacgaccaccgcgcactccgcgactcgaatacgacaacctaacccgtaataaccctaacgaataaactcgaaaataaaaaaaaactacgaaatcctatacgaaaaaaaaaattcttaacacgactcaaccgataacgacaacaaaaaacataacaacaataacttcctccgaaatttcccttcccgaacaacccgcgcgaccaacaacaccgaataccaaaaaaaaacgcaaacgccctcacgtaccctacccgcccctaccgaaaaccaccaaacgaaaaaaacaaaaacgcctcgcaacgcgtaaccaaacgtaccgcctccaaaaaccgaaa

SEQ ID NO: 14419 - DNA, 505 bp, Artificial Sequence
  chemically treated genomic DNA (Homo sapiens) CpG-island No: 14419
cggttaagtttattttttcgggttatttattagagttaaggtggaatttaagtttttgtttagttatgttagggttttgggtacgtcgggttcggcgtcgtcggttttttaagcgtcgtatttattttagggttttttttaattttgagaattttggagttgggatgcgtagcggttatcgcgtatttcgcggttcggatgcggtagtttggttcgtagtgattttggcgggtgagttcgagaatggggagaaattgcggggttttatgcggggaaagggatttttggtacggtttagtcgatgacgataataggggatataataataatggtttttttcgggattttttttttcgggtagttcgcgcggttagtagtatcgagtgttaggagggggcgtagacgtttttacgtgttttgttcgtttttgtcgggagttattaggcggggaaggtagaggcgtttcgtagcgcgtggttaaacgtgtcgtttttagaaatcgagg

SEQ ID NO: 14420 - DNA, 505 bp, Artificial Sequence
  chemically treated genomic DNA (Homo sapiens) CpG-island No: 14420
cctcgatttctaaaaacgacacgtttaaccacgcgctacgaaacgcctctaccttccccgcctaataactcccgacaaaaacgaacaaaacacgtaaaaacgtctacgccccctcctaacactcgatactactaaccgcgcgaactacccgaaaaaaaaaatcccgaaaaaaaccattattattatatcccctattatcgtcatcgactaaaccgtaccaaaaatccctttccccgcataaaaccccgcaatttctccccattctcgaactcacccgccaaaatcactacgaaccaaactaccgcatccgaaccgcgaaatacgcgataaccgctacgcatcccaactccaaaattctcaaaattaaaaaaaaccctaaaataaatacgacgcttaaaaaaccgacgacgccgaacccgacgtacccaaaaccctaacataactaaacaaaaacttaaattccaccttaactctaataaataacccgaaaaaataaacttaaccg

SEQ ID NO: 14421 - DNA, 862 bp, Artificial Sequence
  chemically treated genomic DNA (Homo sapiens) CpG-island No: 14421
aacggacggttagtcgatagataagatggtttacgggggtggaggggaggtcggacggtcgtttagaggggtaggtggacggtggcggtaggcgcgggggtcggcggggcgcgttggcggtttttttgttattttcggttcgttgtttcggtcgtttcgcgcgttttattttatatttcgtcgttttcggtttcgtttgtgcggacgcgggaatattttcgttgtttagatcgtatttgtttttttttcgtcgttttttcgtttttcggcggtcgtcgttttttaggggttcgtaagattcgcgcggagttcgtttattttcgggtttcggcgtttatagttggtcgcggttggagggggcgcgcggaggggagtttcggggtttatagagggagttttgaagtttgggtagcgaggcgtttcgttttgggttcggggtaatgcggattttggcgtatcgggcgagcgtttcggttcgatcgagcggtagttgtttttagggaaggtaggcgtcgcgggggtggcggaggggttcggcggtttgggacgtcggtcggaggggagtgagaggtcgttttattcgaggaagttagcgcggtcgggaggaggcgtagtcggttgtgtagggttgggcgtttcgtgtggttagaggggatgaagcggggtgtagcggagcgagggatatcgcggtgcgttggggcggtcgtcggggttcgcgtcgagagagataacgaaatggacggagggtagtagggtggcgttttcggtcgagggttagtttaggtttgttttatttttttaaacgtagatcgttcggtttatcgcggtttcgggggtttattaggcgagtggtttttaagtt

SEQ ID NO: 14422 - DNA, 862 bp, Artificial Sequence
  chemically treated genomic DNA (Homo sapiens) CpG-island No: 14422
aacttaaaaaccactcgcctaataaacccccgaaaccgcgataaaccgaacgatctacgtttaaaaaaataaaacaaacctaaactaaccctcgaccgaaaacgccaccctactaccctccgtccatttcgttatctctctcgacgcgaaccccgacgaccgccccaacgcaccgcgatatccctcgctccgctacaccccgcttcatcccctctaaccacacgaaacgcccaaccctacacaaccgactacgcctcctcccgaccgcgctaacttcctcgaataaaacgacctctcactcccctccgaccgacgtcccaaaccgccgaacccctccgccacccccgcgacgcctaccttccctaaaaacaactaccgctcgatcgaaccgaaacgctcgcccgatacgccaaaatccgcattaccccgaacccaaaacgaaacgcctcgctacccaaacttcaaaactccctctataaaccccgaaactcccctccgcgcgccccctccaaccgcgaccaactataaacgccgaaacccgaaaataaacgaactccgcgcgaatcttacgaacccctaaaaaacgacgaccgccgaaaaacgaaaaaacgacgaaaaaaaaacaaatacgatctaaacaacgaaaatattcccgcgtccgcacaaacgaaaccgaaaacgacgaaatataaaataaaacgcgcgaaacgaccgaaacaacgaaccgaaaataacaaaaaaaccgccaacgcgccccgccgacccccgcgcctaccgccaccgtccacctacccctctaaacgaccgtccgacctcccctccacccccgtaaaccatcttatctatcgactaaccgtccgtt

SEQ ID NO: 14423 - DNA, 862 bp, Artificial Sequence
  chemically treated genomic DNA (Homo sapiens) CpG-island No: 14423
ggtttggagattattcgtttggtgagttttcgggatcgcggtgggtcggacggtttgcgtttgaagaggtaggatagatttgggttggttttcggtcgggggcgttattttattatttttcgtttatttcgttgtttttttcggcgcgggtttcggcggtcgttttagcgtatcgcggtgtttttcgtttcgttgtatttcgttttattttttttggttatacggagcgtttagttttatatagtcggttacgttttttttcggtcgcgttgattttttcgggtgaagcggttttttattttttttcggtcggcgttttaggtcgtcggattttttcgttattttcgcggcgtttgttttttttgggagtagttgtcgttcggtcgggtcggagcgttcgttcggtgcgttaaggttcgtattgtttcgggtttagggcgggacgtttcgttgtttaggttttagagttttttttgtaggtttcggggttttttttcgcgcgttttttttagtcgcggttagttgtgggcgtcggggttcgaggatgggcgggtttcgcgcgggttttgcgggtttttggggagcggcggtcgtcgggaagcgagggggcggcgaggaaggagtaggtgcggtttgggtagcgggggtattttcgcgttcgtatagacggggtcgggggcggcgaggtgtgaaatgaggcgcgcggagcggtcgggatagcgggtcgggggtggtaggagaatcgttaacgcgtttcgtcggttttcgcgtttgtcgttatcgtttatttgtttttttgagcggtcgttcgattttttttttattttcgtgggttattttgtttgtcggttgatcgttcgtt

SEQ ID NO: 14424 - DNA, 862 bp, Artificial Sequence
  chemically treated genomic DNA (Homo sapiens) CpG-island No: 14424
aacgaacgatcaaccgacaaacaaaataacccacgaaaataaaaaaaaaatcgaacgaccgctcaaaaaaacaaataaacgataacgacaaacgcgaaaaccgacgaaacgcgttaacgattctcctaccacccccgacccgctatcccgaccgctccgcgcgcctcatttcacacctcgccgcccccgaccccgtctatacgaacgcgaaaatacccccgctacccaaaccgcacctactccttcctcgccgccccctcgcttcccgacgaccgccgctccccaaaaacccgcaaaacccgcgcgaaacccgcccatcctcgaaccccgacgcccacaactaaccgcgactaaaaaaaacgcgcgaaaaaaaaccccgaaacctacaaaaaaaactctaaaacctaaacaacgaaacgtcccgccctaaacccgaaacaatacgaaccttaacgcaccgaacgaacgctccgacccgaccgaacgacaactactcccaaaaaaaacaaacgccgcgaaaataacgaaaaaatccgacgacctaaaacgccgaccgaaaaaaaataaaaaaccgcttcacccgaaaaaatcaacgcgaccgaaaaaaaacgtaaccgactatataaaactaaacgctccgtataaccaaaaaaaataaaacgaaatacaacgaaacgaaaaacaccgcgatacgctaaaacgaccgccgaaacccgcgccgaaaaaaacaacgaaataaacgaaaaataataaaataacgcccccgaccgaaaaccaacccaaatctatcctacctcttcaaacgcaaaccgtccgacccaccgcgatcccgaaaactcaccaaacgaataatctccaaacc

SEQ ID NO: 14425 - DNA, 1024 bp, Artificial Sequence
  chemically treated genomic DNA (Homo sapiens) CpG-island No: 14425
  misc_feature (295)..(295): n is either a, c, g or t
atttgggcggtcgggcgggggagagacgttttttaaagtttaggaattggagggttcgtttaaagagtcggcgtcggtcgcgttgttggggaggatttagagggagattcgttatttattttcgggtcgtatcggttagtttagcgcgattagtattttttcgttacgaatttgagagataagaagcgaaaatagggtgtgtgggggatggagagagttttcgggaggtagttgcgttttcgtacgttttaatttaaagaagagagggaacgaggaagcgaatttattgtttatntacgggcggagcggtttaatttagagcgggtagttgcggacgagttggagaggaaggtgattataattagtgaattagtaatttttgtcgagttttaagtttcgatttagcggtataatgcgttgtgtcggcgtttcggggaaaggaaagaattttaaaggtattgagagcgtagggttaaaagaacgtttttaggttatttggagtttacggcggtgtattcgataagttagttgcggttgttttggtgtgggttgtttatcgtgcgtacgtttcgggcgcgcggtttttttaggcgcggtgttttatttcgggttcgggaagcgagtcgtttggttagtacgtgggttggggaaaagtttgtcgagatcggttgggagcgtttggtagttttggaattttagcggtcgtcgcggggttgcgacgttaggtaggagcgcggagcggcgggtgtagttattgggatgtttcgttttcgttcgagcgcggtttttaggtaaggggtgcgttcgtttatattttttgtttttttaattaattgtgtcgttttttgcgttttttttacggttattttatagttaagattttttttttttcgagttgtagaaggtagaacgttttcgggaggacgaagtgattcgaagggatgtggtaagcgtatttttcgatggagatgtagatcggttgaggtttgggatgtttttataagtaggtggtgttgtggtttaa

SEQ ID NO: 14426 - DNA, 1024 bp, Artificial Sequence
  chemically treated genomic DNA (Homo sapiens) CpG-island No: 14426
  misc_feature (730)..(730): n is either a, c, g or t
ttaaaccacaacaccacctacttataaaaacatcccaaacctcaaccgatctacatctccatcgaaaaatacgcttaccacatcccttcgaatcacttcgtcctcccgaaaacgttctaccttctacaactcgaaaaaaaaaaaatcttaactataaaataaccgtaaaaaaaacgcaaaaaacgacacaattaattaaaaaaacaaaaaatataaacgaacgcaccccttacctaaaaaccgcgctcgaacgaaaacgaaacatcccaataactacacccgccgctccgcgctcctacctaacgtcgcaaccccgcgacgaccgctaaaattccaaaactaccaaacgctcccaaccgatctcgacaaacttttccccaacccacgtactaaccaaacgactcgcttcccgaacccgaaataaaacaccgcgcctaaaaaaaccgcgcgcccgaaacgtacgcacgataaacaacccacaccaaaacaaccgcaactaacttatcgaatacaccgccgtaaactccaaataacctaaaaacgttcttttaaccctacgctctcaatacctttaaaattctttcctttccccgaaacgccgacacaacgcattataccgctaaatcgaaacttaaaactcgacaaaaattactaattcactaattataatcaccttcctctccaactcgtccgcaactacccgctctaaattaaaccgctccgcccgtanataaacaataaattcgcttcctcgttccctctcttctttaaattaaaacgtacgaaaacgcaactacctcccgaaaactctctccatcccccacacaccctattttcgcttcttatctctcaaattcgtaacgaaaaaatactaatcgcgctaaactaaccgatacgacccgaaaataaataacgaatctccctctaaatcctccccaacaacgcgaccgacgccgactctttaaacgaaccctccaattcctaaactttaaaaaacgtctctcccccgcccgaccgcccaaat

SEQ ID NO: 14427 - DNA, 1024 bp, Artificial Sequence
  chemically treated genomic DNA (Homo sapiens) CpG-island No: 14427
  misc_feature (730)..(730): n is either a, c, g or t
ttggattatagtattatttatttatagaagtattttaagttttagtcggtttgtatttttatcggaaagtgcgtttgttatattttttcggattatttcgttttttcgagagcgttttgttttttatagttcggaaagaaagaaattttagttgtgaagtgatcgtggagaaagcgtaggaagcgatataattggttagggaggtagagagtgtgagcgggcgtattttttgtttggggatcgcgttcgggcggggacggagtattttagtggttgtattcgtcgtttcgcgtttttgtttggcgtcgtaatttcgcggcggtcgttggaattttagagttgttaggcgtttttagtcggtttcggtaaatttttttttagtttacgtgttaattaagcggttcgtttttcgagttcgggatggagtatcgcgtttagggaggtcgcgcgttcgagacgtgcgtacggtaggtaatttatattaaggtagtcgtagttggtttatcgggtatatcgtcgtggattttaaatggtttaagagcgtttttttagttttgcgtttttagtgtttttagagttttttttttttttcggagcgtcggtataacgtattatgtcgttgggtcggagtttagggttcggtagaggttgttaatttattgattataattatttttttttttaattcgttcgtagttgttcgttttggattaagtcgtttcgttcgtgngtaggtagtgggttcgttttttcgtttttttttttttttagattgggacgtgcgaaggcgtagttgtttttcgggggttttttttattttttatatattttgttttcgttttttgttttttaggttcgtggcggagagatgttgatcgcgttgaattgatcggtgcggttcgggggtgagtggcgagtttttttttgagttttttttagtagcgcggtcggcgtcggttttttgggcgaattttttagtttttagattttgagaggcgtttttttttcgttcgatcgtttagat

SEQ ID NO: 14428 - DNA, 1024 bp, Artificial Sequence
  chemically treated genomic DNA (Homo sapiens) CpG-island No: 14428
  misc_feature (295)..(295): n is either a, c, g or t
atctaaacgatcgaacgaaaaaaaaacgcctctcaaaatctaaaaactaaaaaattcgcccaaaaaaccgacgccgaccgcgctactaaaaaaaactcaaaaaaaaactcgccactcacccccgaaccgcaccgatcaattcaacgcgatcaacatctctccgccacgaacctaaaaaacaaaaaacgaaaacaaaatatataaaaaataaaaaaaacccccgaaaaacaactacgccttcgcacgtcccaatctaaaaaaaaaaaaaaacgaaaaaacgaacccactacctacncacgaacgaaacgacttaatccaaaacgaacaactacgaacgaattaaaaaaaaaaataattataatcaataaattaacaacctctaccgaaccctaaactccgacccaacgacataatacgttataccgacgctccgaaaaaaaaaaaaaactctaaaaacactaaaaacgcaaaactaaaaaaacgctcttaaaccatttaaaatccacgacgatatacccgataaaccaactacgactaccttaatataaattacctaccgtacgcacgtctcgaacgcgcgacctccctaaacgcgatactccatcccgaactcgaaaaacgaaccgcttaattaacacgtaaactaaaaaaaaatttaccgaaaccgactaaaaacgcctaacaactctaaaattccaacgaccgccgcgaaattacgacgccaaacaaaaacgcgaaacgacgaatacaaccactaaaatactccgtccccgcccgaacgcgatccccaaacaaaaaatacgcccgctcacactctctacctccctaaccaattatatcgcttcctacgctttctccacgatcacttcacaactaaaatttctttctttccgaactataaaaaacaaaacgctctcgaaaaaacgaaataatccgaaaaaatataacaaacgcactttccgataaaaatacaaaccgactaaaacttaaaatacttctataaataaataatactataatccaa

SEQ ID NO: 14429 - DNA, 759 bp, Artificial Sequence
  chemically treated genomic DNA (Homo sapiens) CpG-island No: 14429
cgtcgcggaaaaaatcgtagcggttaattgggcgcggattcgtttttaggcgaaattcgtaaacggtgtgacgtgtgcgcgttgtggttttaaaggcggttttatagcgatttgggcgttcgaggtcgtgttttcgagagttatagggagtttgtcgaggttatttgacggcggtgtcgcgtttatattgtcggttggatttttaggtattcgttatttagcgttttgtttttcggcgtcgggaattacgagttcgttagtatcgcgggatttgtagcgtttttcgtttttcgtaggcggtttagatagtttcgtttcgttttagcgttaggagacgcgtagaattttcggcggttttagttttttttcgttcgcgcgttttcgcgttttcgcgttttcgcgttttcgcgcgtattcgttttttagatttcggttgggtttttaggcgcgtcgcgtagggcgggcggggcgggggcggggttttttggtagtttttgggagttgcgaacgttcgtttcgggttcggcggttaaacgttggtttcgagtttagcgtcgggtttttttgttttcgttagttacgtcgtatgttaagtgggtaagggaatttattgaatcgtgagagcggagacgggatatttgaatattggcgtgcgggttgcggcgttttttttaggaattggaagtcggcggggatcgggttttttgggtttttcggtcgcggaaagggttagggtcgttatttatttttgagtagttt

SEQ ID NO: 14430 - DNA, 759 bp, Artificial Sequence
  chemically treated genomic DNA (Homo sapiens) CpG-island No: 14430
aaactactcaaaaataaataacgaccctaaccctttccgcgaccgaaaaacccaaaaaacccgatccccgccgacttccaattcctaaaaaaaacgccgcaacccgcacgccaatattcaaatatcccgtctccgctctcacgattcaataaattcccttacccacttaacatacgacgtaactaacgaaaacaaaaaaacccgacgctaaactcgaaaccaacgtttaaccgccgaacccgaaacgaacgttcgcaactcccaaaaactaccaaaaaaccccgcccccgccccgcccgccctacgcgacgcgcctaaaaacccaaccgaaatctaaaaaacgaatacgcgcgaaaacgcgaaaacgcgaaaacgcgaaaacgcgcgaacgaaaaaaaactaaaaccgccgaaaattctacgcgtctcctaacgctaaaacgaaacgaaactatctaaaccgcctacgaaaaacgaaaaacgctacaaatcccgcgatactaacgaactcgtaattcccgacgccgaaaaacaaaacgctaaataacgaatacctaaaaatccaaccgacaatataaacgcgacaccgccgtcaaataacctcgacaaactccctataactctcgaaaacacgacctcgaacgcccaaatcgctataaaaccgcctttaaaaccacaacgcgcacacgtcacaccgtttacgaatttcgcctaaaaacgaatccgcgcccaattaaccgctacgattttttccgcgacg

SEQ ID NO: 14431 - DNA, 759 bp, Artificial Sequence
  chemically treated genomic DNA (Homo sapiens) CpG-island No: 14431
aaattgtttaaaagtaagtagcgattttaatttttttcgcggtcgaaagatttagggagttcggttttcgtcggtttttaatttttgaaggaggcgtcgtagttcgtacgttagtgtttaggtgtttcgttttcgtttttacgatttagtgggtttttttgtttatttggtatgcggcgtgattggcgaaaataagaaagttcggcgttaagttcgaagttagcgtttggtcgtcgagttcggggcgggcgttcgtagtttttagaaattgttagaaggtttcgttttcgtttcgttcgttttgcgcgacgcgtttgggagtttagtcgggatttgggaggcgggtacgcgcggggacgcggggacgcggggacgcggggacgcgcgggcggggaggagttggggtcgtcgggggttttgcgcgttttttaacgttagggcgggacggggttgtttgggtcgtttgcgaagggcggagggcgttgtaagtttcgcggtgttggcgggttcgtgattttcggcgtcgggaagtagggcgttgagtagcgggtgtttgagagtttaatcggtagtgtagacgcgatatcgtcgttaggtggtttcggtaggttttttatagttttcgaggatacgatttcgaacgtttaggtcgttgtaagatcgtttttggggttatagcgcgtatacgttatatcgtttgcggatttcgtttaagagcgagttcgcgtttagttggtcgttgcggtttttttcgcgacg

SEQ ID NO: 14432 - DNA, 759 bp, Artificial Sequence
  chemically treated genomic DNA (Homo sapiens) CpG-island No: 14432
cgtcgcgaaaaaaaccgcaacgaccaactaaacgcgaactcgctcttaaacgaaatccgcaaacgatataacgtatacgcgctataaccccaaaaacgatcttacaacgacctaaacgttcgaaatcgtatcctcgaaaactataaaaaacctaccgaaaccacctaacgacgatatcgcgtctacactaccgattaaactctcaaacacccgctactcaacgccctacttcccgacgccgaaaatcacgaacccgccaacaccgcgaaacttacaacgccctccgcccttcgcaaacgacccaaacaaccccgtcccgccctaacgttaaaaaacgcgcaaaacccccgacgaccccaactcctccccgcccgcgcgtccccgcgtccccgcgtccccgcgtccccgcgcgtacccgcctcccaaatcccgactaaactcccaaacgcgtcgcgcaaaacgaacgaaacgaaaacgaaaccttctaacaatttctaaaaactacgaacgcccgccccgaactcgacgaccaaacgctaacttcgaacttaacgccgaactttcttattttcgccaatcacgccgcataccaaataaacaaaaaaacccactaaatcgtaaaaacgaaaacgaaacacctaaacactaacgtacgaactacgacgcctccttcaaaaattaaaaaccgacgaaaaccgaactccctaaatctttcgaccgcgaaaaaaattaaaatcgctacttacttttaaacaattt

SEQ ID NO: 14433 - DNA, 579 bp, Artificial Sequence
  chemically treated genomic DNA (Homo sapiens) CpG-island No: 14433
gatttgtagtttttttacggttattaagtgtatttagggtaggttttttattacgagtttcgtgatgattcgaggtcgggtagcgtttgcgtattgaagtcgagggagcgtgcgggcggtattattggcgggaggagtaaagatggcggcgcgaggttttcgttttttgtttcgggttgaagcgttttgagagaggcggtagcggtaattcgagttttaatagtaatttagtgttggtagttttggtagtagttgtcgaggtcggagtaatggcggaattggagtatttaggagggaagcgggtagagtcggcgcgaatgcggcgggtagagtagtttcggcgttggcggggttcgttgatagagtaggagtttgcggagcgacgaggcgcggggcggtagtcgttgattaggcgcgggagttttagggttcgtttcgaggacggtgttgtttttttggtcgtttgttttagcggggatatcgacgaggtgagaaagtttttggtaagaggtgttgatattaatacggttaacgtggacggtttgatagttttgtattaggtaattttttttttggttt

SEQ ID NO: 14434 - DNA, 579 bp, Artificial Sequence
  chemically treated genomic DNA (Homo sapiens) CpG-island No: 14434
aaaccaaaaaaaaaattacctaatacaaaactatcaaaccgtccacgttaaccgtattaatatcaacacctcttaccaaaaactttctcacctcgtcgatatccccgctaaaacaaacgaccaaaaaaacaacaccgtcctcgaaacgaaccctaaaactcccgcgcctaatcaacgactaccgccccgcgcctcgtcgctccgcaaactcctactctatcaacgaaccccgccaacgccgaaactactctacccgccgcattcgcgccgactctacccgcttccctcctaaatactccaattccgccattactccgacctcgacaactactaccaaaactaccaacactaaattactattaaaactcgaattaccgctaccgcctctctcaaaacgcttcaacccgaaacaaaaaacgaaaacctcgcgccgccatctttactcctcccgccaataataccgcccgcacgctccctcgacttcaatacgcaaacgctacccgacctcgaatcatcacgaaactcgtaataaaaaacctaccctaaatacacttaataaccgtaaaaaaactacaaatc

SEQ ID NO: 14435 - DNA, 579 bp, Artificial Sequence
  chemically treated genomic DNA (Homo sapiens) CpG-island No: 14435
agattaagaaaggagttatttggtgtagggttgttaagtcgtttacgttgatcgtgttgatattagtattttttgttagaagtttttttatttcgtcggtgttttcgttagagtaggcggttagaaagatagtatcgttttcgaagcggattttggggttttcgcgtttggttagcggttgtcgtttcgcgtttcgtcgtttcgtaggtttttgttttgttagcgagtttcgttagcgtcgaagttgttttgttcgtcgtattcgcgtcgattttgttcgttttttttttaggtgttttagtttcgttattgtttcggtttcggtagttgttgttaaaattattaatattaaattattgttggggttcgagttgtcgttgtcgttttttttagagcgttttagttcggagtagagggcggagatttcgcgtcgttatttttatttttttcgttagtagtatcgttcgtacgttttttcggttttaatacgtaggcgttgttcggtttcgggttattacgggattcgtagtaagaggtttgttttaagtgtatttggtggtcgtaagggaattataaatt

SEQ ID NO: 14436 - DNA, 579 bp, Artificial Sequence
  chemically treated genomic DNA (Homo sapiens) CpG-island No: 14436
aatttataattcccttacgaccaccaaatacacttaaaacaaacctcttactacgaatcccgtaataacccgaaaccgaacaacgcctacgtattaaaaccgaaaaaacgtacgaacgatactactaacgaaaaaaataaaaataacgacgcgaaatctccgccctctactccgaactaaaacgctctaaaaaaaacgacaacgacaactcgaaccccaacaataatttaatattaataattttaacaacaactaccgaaaccgaaacaataacgaaactaaaacacctaaaaaaaaaacgaacaaaatcgacgcgaatacgacgaacaaaacaacttcgacgctaacgaaactcgctaacaaaacaaaaacctacgaaacgacgaaacgcgaaacgacaaccgctaaccaaacgcgaaaaccccaaaatccgcttcgaaaacgatactatctttctaaccgcctactctaacgaaaacaccgacgaaataaaaaaacttctaacaaaaaatactaatatcaacacgatcaacgtaaacgacttaacaaccctacaccaaataactcctttcttaatct

SEQ ID NO: 14437 - DNA, 620 bp, Artificial Sequence
  chemically treated genomic DNA (Homo sapiens) CpG-island No: 14437
  misc_feature (492)..(492): n is either a, c, g or t
aaacgttcgttgtaggcggttggtggtttagggaagcggcgtcgattgcgtgtaaaataatcgtcgttaacgtaattttatattttttagatttatacgttaaagaacgcgaatttcgcggttttaatttttggttttttcgtttcggcgtttgtagtttcgcggggaaggggcgacgcgagggggcgtagggatagtttcgtatttgggaggttcgagggggcgttcgggagggaggggttgtaaacggcggcgagcgcgcgcggtaatcgttaaacgttcgtttttgtagtttcggtttcgcgtttttattttgtcgacggttgttcggtttcggttcgcggcggcggttttagagtcgaggatcggggtgggttcgcgtttttcgttattggagaaagttcggggtttttttgttgttggtgtcggcggggagcggcggtcggttgcgagtcgtgaggtgttgtaggtagagttggacgtatacgtttntgcgttgtttttcggtcggtagcgttatattgttggcgattaatttattttttaatttgttttttgttaggatcgaggggttttttaggaatttcggtatttcggggatttgcgaagtttttttttta

SEQ ID NO: 14438 - DNA, 620 bp, Artificial Sequence
  chemically treated genomic DNA (Homo sapiens) CpG-island No: 14438
  misc_feature (129)..(129): n is either a, c, g or t
taaaaaaaaaacttcgcaaatccccgaaataccgaaattcctaaaaaacccctcgatcctaacaaaaaacaaattaaaaaataaattaatcgccaacaatataacgctaccgaccgaaaaacaacgcanaaacgtatacgtccaactctacctacaacacctcacgactcgcaaccgaccgccgctccccgccgacaccaacaacaaaaaaaccccgaactttctccaataacgaaaaacgcgaacccaccccgatcctcgactctaaaaccgccgccgcgaaccgaaaccgaacaaccgtcgacaaaataaaaacgcgaaaccgaaactacaaaaacgaacgtttaacgattaccgcgcgcgctcgccgccgtttacaacccctccctcccgaacgccccctcgaacctcccaaatacgaaactatccctacgccccctcgcgtcgccccttccccgcgaaactacaaacgccgaaacgaaaaaaccaaaaattaaaaccgcgaaattcgcgttctttaacgtataaatctaaaaaatataaaattacgttaacgacgattattttacacgcaatcgacgccgcttccctaaaccaccaaccgcctacaacgaacgttt

SEQ ID NO: 14439 - DNA, 620 bp, Artificial Sequence
  chemically treated genomic DNA (Homo sapiens) CpG-island No: 14439
  misc_feature (129)..(129): n is either a, c, g or t
tggggagggggtttcgtagattttcgagatgtcggagtttttggaagatttttcggttttgataaaagataagttgaagagtgagttggtcgttaataatgtgacgttgtcggtcggggagtagcgtanagacgtgtacgtttagttttatttgtagtattttacggttcgtaatcggtcgtcgtttttcgtcggtattaatagtaagggggtttcggattttttttagtgacgaagagcgcgagtttatttcggttttcggttttggggtcgtcgtcgcgggtcggagtcgagtagtcgtcggtagggtaaggacgcggggtcggggttataaaggcgggcgtttggcggttgtcgcgcgcgttcgtcgtcgtttgtagtttttttttttcgggcgttttttcgggttttttaggtgcggggttgtttttgcgttttttcgcgtcgtttttttttcgcggggttgtaggcgtcggagcggagaggttagaagttggggtcgcggggttcgcgttttttgacgtgtgggtttgggaggtgtggagttgcgttggcggcggttgttttgtacgtagtcgacgtcgtttttttggattattagtcgtttgtagcgggcgttt

SEQ ID NO: 14440 - DNA, 620 bp, Artificial Sequence
  chemically treated genomic DNA (Homo sapiens) CpG-island No: 14440
  misc_feature (492)..(492): n is either a, c, g or t
aaacgcccgctacaaacgactaataatccaaaaaaacgacgtcgactacgtacaaaacaaccgccgccaacgcaactccacacctcccaaacccacacgtcaaaaaacgcgaaccccgcgaccccaacttctaacctctccgctccgacgcctacaaccccgcgaaaaaaaaacgacgcgaaaaaacgcaaaaacaaccccgcacctaaaaaacccgaaaaaacgcccgaaaaaaaaaaactacaaacgacgacgaacgcgcgcgacaaccgccaaacgcccgcctttataaccccgaccccgcgtccttaccctaccgacgactactcgactccgacccgcgacgacgaccccaaaaccgaaaaccgaaataaactcgcgctcttcgtcactaaaaaaaatccgaaacccccttactattaataccgacgaaaaacgacgaccgattacgaaccgtaaaatactacaaataaaactaaacgtacacgtctntacgctactccccgaccgacaacgtcacattattaacgaccaactcactcttcaacttatcttttatcaaaaccgaaaaatcttccaaaaactccgacatctcgaaaatctacgaaaccccctcccca

SEQ ID NO: 14441 - DNA, 757 bp, Artificial Sequence
  chemically treated genomic DNA (Homo sapiens) CpG-island No: 14441
tttttttacgtcggtaatgcgtgcgggggtttatcggcggcgttcgagtacgcggtcggttacggcggggggtatttggcgtcgggttattgcgcgtagacgggcgtcgcgttgttttcgtcgttttcggtcgcgtttttgtagtttttatcgttttcggggtacgggtttttagcgtcgttgtataattatttcgtagggggttacgtagcgtagttcggttatggcgcgttttcgtcgtttttaggtttattttcggttttttatttgatttcgggtttgttcgcgtttacgtttttgttcgcgtcggtatcgtttatcgtttatggtttttttacggtcgcgtcgggtgtcgaattcgggttgtcgttgaagcgtaaggtcgtcgacgaggggttcgagggtcgttatcgtaagtacgcgtacgagttcgttaaggttttcgtggttgacggagttttttatttcgtcgcggataacggcgaatgtcggggtaacgggtttcgggttaagtcgttaggagtcgcggaggaggcgtcgggtaagtacggtggcggcgttttttttaaggttttgggttttttcgtttacggttcgtaattggagttttttgaaaagttttcggagcgggtttcggtttttcgtggggggttcgtcgtgtcgtcgggggagatttttaaaggcgtggattttggggttttggagttggtgacgagtaagatggtggattgcgggttttcggtgtagtgggcggatg

SEQ ID NO: 14442 - DNA, 757 bp, Artificial Sequence
  chemically treated genomic DNA (Homo sapiens) CpG-island No: 14442
catccgcccactacaccgaaaacccgcaatccaccatcttactcgtcaccaactccaaaaccccaaaatccacgcctttaaaaatctcccccgacgacacgacgaaccccccacgaaaaaccgaaacccgctccgaaaacttttcaaaaaactccaattacgaaccgtaaacgaaaaaacccaaaaccttaaaaaaaacgccgccaccgtacttacccgacgcctcctccgcgactcctaacgacttaacccgaaacccgttaccccgacattcgccgttatccgcgacgaaataaaaaactccgtcaaccacgaaaaccttaacgaactcgtacgcgtacttacgataacgaccctcgaacccctcgtcgacgaccttacgcttcaacgacaacccgaattcgacacccgacgcgaccgtaaaaaaaccataaacgataaacgataccgacgcgaacaaaaacgtaaacgcgaacaaacccgaaatcaaataaaaaaccgaaaataaacctaaaaacgacgaaaacgcgccataaccgaactacgctacgtaaccccctacgaaataattatacaacgacgctaaaaacccgtaccccgaaaacgataaaaactacaaaaacgcgaccgaaaacgacgaaaacaacgcgacgcccgtctacgcgcaataacccgacgccaaataccccccgccgtaaccgaccgcgtactcgaacgccgccgataaacccccgcacgcattaccgacgtaaaaaaa

SEQ ID NO: 14443 - DNA, 757 bp, Artificial Sequence
  chemically treated genomic DNA (Homo sapiens) CpG-island No: 14443
tattcgtttattgtatcgggggttcgtagtttattattttgttcgttattagttttagggttttagggtttacgtttttgggagtttttttcgacggtacggcgaattttttacgaggagtcggggttcgtttcgggaattttttaaagggttttagttgcgggtcgtagacgggggagtttaggattttgagggggacgtcgttatcgtatttgttcgacgtttttttcgcggtttttggcggtttggttcggaattcgttgtttcgatattcgtcgttgttcgcggcggggtaggaggtttcgttagttacgggggttttggcgggttcgtacgcgtatttgcggtagcggttttcgggtttttcgtcggcggttttgcgttttagcgatagttcggattcggtattcggcgcggtcgtggggaagttataggcggtgggcggtgtcggcgcgggtaggggcgtgggcgcgggtaggttcggggttaggtagggggtcgggggtgggtttgggggcggcgggagcgcgttatagtcgggttgcgttgcgtagttttttgcgggatagttgtatagcggcgttgagggttcgtatttcggaggcggtgggggttgtaggagcgcggtcgggggcggcgggggtagcgcggcgttcgtttgcgcgtagtaattcggcgttaggtatttttcgtcgtagtcggtcgcgtattcgggcgtcgtcgatgggttttcgtacgtattgtcggcgtagagggg

SEQ ID NO: 14444 - DNA, 757 bp, Artificial Sequence
  chemically treated genomic DNA (Homo sapiens) CpG-island No: 14444
cccctctacgccgacaatacgtacgaaaacccatcgacgacgcccgaatacgcgaccgactacgacgaaaaatacctaacgccgaattactacgcgcaaacgaacgccgcgctacccccgccgcccccgaccgcgctcctacaacccccaccgcctccgaaatacgaaccctcaacgccgctatacaactatcccgcaaaaaactacgcaacgcaacccgactataacgcgctcccgccgcccccaaacccacccccgaccccctacctaaccccgaacctacccgcgcccacgcccctacccgcgccgacaccgcccaccgcctataacttccccacgaccgcgccgaataccgaatccgaactatcgctaaaacgcaaaaccgccgacgaaaaacccgaaaaccgctaccgcaaatacgcgtacgaacccgccaaaacccccgtaactaacgaaacctcctaccccgccgcgaacaacgacgaatatcgaaacaacgaattccgaaccaaaccgccaaaaaccgcgaaaaaaacgtcgaacaaatacgataacgacgtccccctcaaaatcctaaactcccccgtctacgacccgcaactaaaaccctttaaaaaattcccgaaacgaaccccgactcctcgtaaaaaattcgccgtaccgtcgaaaaaaactcccaaaaacgtaaaccctaaaaccctaaaactaataacgaacaaaataataaactacgaacccccgatacaataaacgaata

SEQ ID NO: 14445 - DNA, 611 bp, Artificial Sequence
  chemically treated genomic DNA (Homo sapiens) CpG-island No: 14445
gcgcgtttaaggcggcgttggaggaggagttggtgtggtttttgtttaggtcgttcgtttattcgggtagtttgcgttcgtcgcggatcgttttgttttttgggtcgcggggcgcgggtaaagcgttgttgggtcgttgtttcgttacgtagttgggcgttacgttgttgcgtttgcgcggcgcgattttggttgcgttcggcgtcgtcgagggcgcgcgttttttttaggtcgttttcgcggtcgcgcgttgtcgtttatttttcgtattttttattagcgagttagaggcgttgtttttcgttcgggacgacggcgcggcggtagggggcgcgttgtaggtgtcgtttttggtttgtttggacgggggttgcggcgcgggggttgacggcgtgttggttgtgggtattatttcgcggttcgcggttttggacgaggcgattcgtcggcgttttttttttcgtttttacgtggcgttgttcgatagttcggttcgcgggtagattttgtagcgggcgttggtttagtagggttgcgcgtttagtgagcgggaattggcggcgttggtgtagggtacgtagggtttttttgggggcgagttggggtagttg

SEQ ID NO: 14446 - DNA, 611 bp, Artificial Sequence
  chemically treated genomic DNA (Homo sapiens) CpG-island No: 14446
caactaccccaactcgcccccaaaaaaaccctacgtaccctacaccaacgccgccaattcccgctcactaaacgcgcaaccctactaaaccaacgcccgctacaaaatctacccgcgaaccgaactatcgaacaacgccacgtaaaaacgaaaaaaaaaacgccgacgaatcgcctcgtccaaaaccgcgaaccgcgaaataatacccacaaccaacacgccgtcaacccccgcgccgcaacccccgtccaaacaaaccaaaaacgacacctacaacgcgccccctaccgccgcgccgtcgtcccgaacgaaaaacaacgcctctaactcgctaataaaaaatacgaaaaataaacgacaacgcgcgaccgcgaaaacgacctaaaaaaaacgcgcgccctcgacgacgccgaacgcaaccaaaatcgcgccgcgcaaacgcaacaacgtaacgcccaactacgtaacgaaacaacgacccaacaacgctttacccgcgccccgcgacccaaaaaacaaaacgatccgcgacgaacgcaaactacccgaataaacgaacgacctaaacaaaaaccacaccaactcctcctccaacgccgccttaaacgcgc

SEQ ID NO: 14447 - DNA, 611 bp, Artificial Sequence
  chemically treated genomic DNA (Homo sapiens) CpG-island No: 14447
tagttgttttagttcgtttttagagaagttttgcgtgttttgtattagcgtcgttagttttcgtttattgagcgcgtagttttgttgggttagcgttcgttgtaggatttgttcgcgggtcgggttgtcgggtagcgttacgtagaagcggagagagaagcgtcggcgggtcgtttcgtttagagtcgcgggtcgcgaggtggtgtttataattagtacgtcgttagttttcgcgtcgtagttttcgtttaggtaggttaggagcggtatttgtagcgcgttttttgtcgtcgcgtcgtcgtttcgggcggggagtagcgtttttagttcgttgatgaggagtacggagggtgggcggtagcgcgcggtcgcgaaggcggtttggaggaggcgcgcgttttcggcggcgtcgggcgtagttagggtcgcgtcgcgtaggcgtaatagcgtggcgtttagttgcgtggcgaggtagcggtttagtagcgttttgttcgcgtttcgcggtttaaagagtaggacggttcgcggcgggcgtaggttgttcgggtaggcgggcggtttgagtaggggttatattagttttttttttagcgtcgttttgagcgcgt

SEQ ID NO: 14448 - DNA, 611 bp, Artificial Sequence
  chemically treated genomic DNA (Homo sapiens) CpG-island No: 14448
acgcgctcaaaacgacgctaaaaaaaaaactaatataacccctactcaaaccgcccgcctacccgaacaacctacgcccgccgcgaaccgtcctactctttaaaccgcgaaacgcgaacaaaacgctactaaaccgctacctcgccacgcaactaaacgccacgctattacgcctacgcgacgcgaccctaactacgcccgacgccgccgaaaacgcgcgcctcctccaaaccgccttcgcgaccgcgcgctaccgcccaccctccgtactcctcatcaacgaactaaaaacgctactccccgcccgaaacgacgacgcgacgacaaaaaacgcgctacaaataccgctcctaacctacctaaacgaaaactacgacgcgaaaactaacgacgtactaattataaacaccacctcgcgacccgcgactctaaacgaaacgacccgccgacgcttctctctccgcttctacgtaacgctacccgacaacccgacccgcgaacaaatcctacaacgaacgctaacccaacaaaactacgcgctcaataaacgaaaactaacgacgctaatacaaaacacgcaaaacttctctaaaaacgaactaaaacaacta

SEQ ID NO: 14449 - DNA, 966 bp, Artificial Sequence
  chemically treated genomic DNA (Homo sapiens) CpG-island No: 14449
taattcgcgggcgttcggaattttttttttattatcggcgcggagttcgtttacgttttcgttttcgtatagttttcggtttttggttttcgttagggatggcggcgcggattttggcgagcgttttggtttttacgttttgggtttgggcgttggtttcggcgggggtcgtggacgttatgggtttttacgtagtcgttcgtttggtcgagttgttgatttcggaggagtgcggttattttcggtcgtttttagaggcgttcgagttcgacgtggaggtcgagttgtttcggttttttgaagatcggttggcgcggtttgagtcgtttaatattacgtcgttgttttcgagtcggcggcggcggcgagaggcggcggaggattcggcgggtagggtagtcgggtttggagaggtgttcgacggttgtcgggaggcgttggcggtttggttggttttttaggtcgcgtttttgttttgggatcgtttggttcgggttttgcggcgtagcggtcgttcggacgtggttagggagttgggtaagaatttttattagtaggcgacgttgtagttgcgtaagttcgggtagcgttttttgtcgcggttcggcgtcgtcgttcgcgtgttttttgtttcggtttcgcgttttcggcgcgtcgcggttttcgcgtcggattgggacgttttgtagttgatcgtggagcgtttgtcgtagtttttgtacgagcggagttttatgggttgggcggggtcgttggcgttcggtttttttatcggtttcgtgggggcgttgggtatcggggcgttggtcgttttgtttacgttatggattattggcggcgacggcgatcgggcgtcgttcggtagtttcggttcgttcgttatagtgtagggttggtgggaaataaagttgtttttttttaaagagcggcgcgcgttttcgggggtttgggttgtagatgggttag

SEQ ID NO: 14450 - DNA, 966 bp, Artificial Sequence
  chemically treated genomic DNA (Homo sapiens) CpG-island No: 14450
ctaacccatctacaacccaaacccccgaaaacgcgcgccgctctttaaaaaaaaacaactttatttcccaccaaccctacactataacgaacgaaccgaaactaccgaacgacgcccgatcgccgtcgccgccaataatccataacgtaaacaaaacgaccaacgccccgatacccaacgcccccacgaaaccgataaaaaaaccgaacgccaacgaccccgcccaacccataaaactccgctcgtacaaaaactacgacaaacgctccacgatcaactacaaaacgtcccaatccgacgcgaaaaccgcgacgcgccgaaaacgcgaaaccgaaacaaaaaacacgcgaacgacgacgccgaaccgcgacaaaaaacgctacccgaacttacgcaactacaacgtcgcctactaataaaaattcttacccaactccctaaccacgtccgaacgaccgctacgccgcaaaacccgaaccaaacgatcccaaaacaaaaacgcgacctaaaaaaccaaccaaaccgccaacgcctcccgacaaccgtcgaacacctctccaaacccgactaccctacccgccgaatcctccgccgcctctcgccgccgccgccgactcgaaaacaacgacgtaatattaaacgactcaaaccgcgccaaccgatcttcaaaaaaccgaaacaactcgacctccacgtcgaactcgaacgcctctaaaaacgaccgaaaataaccgcactcctccgaaatcaacaactcgaccaaacgaacgactacgtaaaaacccataacgtccacgacccccgccgaaaccaacgcccaaacccaaaacgtaaaaaccaaaacgctcgccaaaatccgcgccgccatccctaacgaaaaccaaaaaccgaaaactatacgaaaacgaaaacgtaaacgaactccgcgccgataataaaaaaaaaattccgaacgcccgcgaatta

SEQ ID NO: 14451 - DNA, 966 bp, Artificial Sequence
  chemically treated genomic DNA (Homo sapiens) CpG-island No: 14451
ttggtttatttgtagtttaggttttcgggggcgcgcgtcgttttttaggaaggagtagttttgttttttattagttttgtattgtggcgagcgggtcggggttgtcgggcgacgttcggtcgtcgtcgtcgttagtgatttatagcgtgagtaggacgattagcgtttcggtgtttagcgtttttacgaagtcggtgaggaggtcgagcgttagcggtttcgtttaatttatggggtttcgttcgtataggggttgcggtaggcgttttacgattagttgtagggcgttttagttcggcgcggggatcgcggcgcgtcgggggcgcggggtcggggtaaagggtacgcgggcggcggcgtcgggtcgcggtaggaagcgttgttcgaatttgcgtagttgtagcgtcgtttgttggtggaggtttttgtttagttttttggttacgttcgggcggtcgttgcgtcgtagggttcgagttaggcggttttaggatagggacgcggtttggggggttagttaggtcgttagcgtttttcggtagtcgtcggatatttttttaggttcggttattttgttcgtcgggtttttcgtcgtttttcgtcgtcgtcgtcggttcggagataacgacgtggtgttgagcggtttaggtcgcgttagtcggtttttagaaagtcgggataattcggtttttacgtcgggttcgggcgtttttaggagcgatcggaaatggtcgtattttttcggggttagtagttcggttagacggacggttgcgtgagggtttatagcgtttacggttttcgtcggagttagcgtttaaatttagagcgtgaggattaaggcgttcgttagagttcgcgtcgttatttttggcgggaattagggatcgaggattgtgcggggacggggacgtggacgggtttcgcgtcggtgatgggggaggggtttcgaacgttcgcggattg

SEQ ID NO: 14452 - DNA, 966 bp, Artificial Sequence
  chemically treated genomic DNA (Homo sapiens) CpG-island No: 14452
caatccgcgaacgttcgaaacccctcccccatcaccgacgcgaaacccgtccacgtccccgtccccgcacaatcctcgatccctaattcccgccaaaaataacgacgcgaactctaacgaacgccttaatcctcacgctctaaatttaaacgctaactccgacgaaaaccgtaaacgctataaaccctcacgcaaccgtccgtctaaccgaactactaaccccgaaaaaatacgaccatttccgatcgctcctaaaaacgcccgaacccgacgtaaaaaccgaattatcccgactttctaaaaaccgactaacgcgacctaaaccgctcaacaccacgtcgttatctccgaaccgacgacgacgacgaaaaacgacgaaaaacccgacgaacaaaataaccgaacctaaaaaaatatccgacgactaccgaaaaacgctaacgacctaactaaccccccaaaccgcgtccctatcctaaaaccgcctaactcgaaccctacgacgcaacgaccgcccgaacgtaaccaaaaaactaaacaaaaacctccaccaacaaacgacgctacaactacgcaaattcgaacaacgcttcctaccgcgacccgacgccgccgcccgcgtaccctttaccccgaccccgcgcccccgacgcgccgcgatccccgcgccgaactaaaacgccctacaactaatcgtaaaacgcctaccgcaacccctatacgaacgaaaccccataaattaaacgaaaccgctaacgctcgacctcctcaccgacttcgtaaaaacgctaaacaccgaaacgctaatcgtcctactcacgctataaatcactaacgacgacgacgaccgaacgtcgcccgacaaccccgacccgctcgccacaatacaaaactaataaaaaacaaaactactccttcctaaaaaacgacgcgcgcccccgaaaacctaaactacaaataaaccaa

SEQ ID NO: 14453 - DNA, 569 bp, Artificial Sequence
  chemically treated genomic DNA (Homo sapiens) CpG-island No: 14453
ggcggtcgtagtagtcgtagtagtagcggttttaggatggtgagcgttattgttttttagtttaggtttgtcgttttcggttcgcgtcgtcgtttcggttttcgggtcggacgcgtttttaggtcgcgtatatttatttaggattcggtcgtgatgtcgaggtacggggtcgcgggcgggtcgggatggggcggggggaggtgatcgttcggttagggtgttcggagttttgttcgtcggttcggggtcggagagggtcgagagggcgggggttgttagtcgcggggtttagttcggcgggggtcggagggtagggtcggcgagagattttagcgggtacgtgggagtcgagggttatttttcggggggagggggcgggtagagtaggggatagtcgttcggtcgtcgacgggtattcgtttcgtagttttttttggtgcgggggttgtagcgaaagcgagtagtcggttcgggggcgtttgttggtttgggggtggggagttaaggtttgcgggttcgggttttagaaggatttagcgttcggagttcgagggtcggttcgtaggttt

SEQ ID NO: 14454 - DNA, 569 bp, Artificial Sequence
  chemically treated genomic DNA (Homo sapiens) CpG-island No: 14454
aaacctacgaaccgaccctcgaactccgaacgctaaatccttctaaaacccgaacccgcaaaccttaactccccacccccaaaccaacaaacgcccccgaaccgactactcgctttcgctacaacccccgcaccaaaaaaaactacgaaacgaatacccgtcgacgaccgaacgactatcccctactctacccgccccctccccccgaaaaataaccctcgactcccacgtacccgctaaaatctctcgccgaccctaccctccgacccccgccgaactaaaccccgcgactaacaacccccgccctctcgaccctctccgaccccgaaccgacgaacaaaactccgaacaccctaaccgaacgatcacctccccccgccccatcccgacccgcccgcgaccccgtacctcgacatcacgaccgaatcctaaataaatatacgcgacctaaaaacgcgtccgacccgaaaaccgaaacgacgacgcgaaccgaaaacgacaaacctaaactaaaaaacaataacgctcaccatcctaaaaccgctactactacgactactacgaccgcc

SEQ ID NO: 14455 - DNA, 569 bp, Artificial Sequence
  chemically treated genomic DNA (Homo sapiens) CpG-island No: 14455
gggtttgcgggtcggttttcgggtttcggacgttggatttttttgggattcgaattcgtaaattttggttttttatttttaggttagtagacgttttcgagtcggttgttcgttttcgttgtagttttcgtattagagggggttgcgagacgggtgttcgtcggcggtcgggcggttattttttgttttgttcgtttttttttttcgagaagtgattttcggtttttacgtattcgttagggtttttcgtcggttttgtttttcgattttcgtcgagttgaatttcgcgattagtagttttcgttttttcggtttttttcggtttcgggtcggcggataaagtttcggatattttgatcgaacggttattttttttcgttttatttcggttcgttcgcggtttcgtatttcggtattacggtcgggttttaggtgagtgtgcgcggtttgggggcgcgttcggttcggggatcggggcggcggcgcgggtcgggggcgataggtttgggttggggggtagtggcgtttattattttggagtcgttgttgttgcggttgttgcggtcgtt

SEQ ID NO: 14456 - DNA, 569 bp, Artificial Sequence
  chemically treated genomic DNA (Homo sapiens) CpG-island No: 14456
aacgaccgcaacaaccgcaacaacaacgactccaaaataataaacgccactaccccccaacccaaacctatcgcccccgacccgcgccgccgccccgatccccgaaccgaacgcgcccccaaaccgcgcacactcacctaaaacccgaccgtaataccgaaatacgaaaccgcgaacgaaccgaaataaaacgaaaaaaaataaccgttcgatcaaaatatccgaaactttatccgccgacccgaaaccgaaaaaaaccgaaaaaacgaaaactactaatcgcgaaattcaactcgacgaaaatcgaaaaacaaaaccgacgaaaaaccctaacgaatacgtaaaaaccgaaaatcacttctcgaaaaaaaaaaacgaacaaaacaaaaaataaccgcccgaccgccgacgaacacccgtctcgcaaccccctctaatacgaaaactacaacgaaaacgaacaaccgactcgaaaacgtctactaacctaaaaataaaaaaccaaaatttacgaattcgaatcccaaaaaaatccaacgtccgaaacccgaaaaccgacccgcaaaccc

SEQ ID NO: 14457 - DNA, 830 bp, Artificial Sequence
  chemically treated genomic DNA (Homo sapiens) CpG-island No: 14457
  misc_feature (247)..(247): n is either a, c, g or t
ttatattatatcgtttatatcgttttattttgtttatcgggggtgtatatcggtttttttatattttcgtattcgtattttgggaagcggtttgtatttcgttcgttatagacgtcgcgtttttttatttcggttatatattttttttttttttattagttagtcgtatttttacggcggtttcgtttacggtttttttattttaaaattgtgtgttttaattcgttcgttttttacggtcgtgtgnaatatatatatttttcgtttaatattttttcgatattttatcgtcggtacgttttaatatttagtttatttcgcgcgtttatttgagtattttatatatatagttttttattacgttttcgaatttttttatttcgtacgttttttaattagggttttttattgttttttttttttgttttcgttttcgttttattttatttttttattatataagattttcgatacgttttataaatttttttttattacgtttttattcgaaaatttcgtttttcgatcgttcgaatttcgttttaacgtttttattatattattttaatttttttattttttagcgttttttttatttttatattatttttttttttagcgtttttatatttttcgagttatattttttatttttcgttacgtattatcgttttatatcgtacgtttttattaaacgcgtgttatataattttcgttatatattttcgatcgtttttataatcgtataatagaattttcgtcgtttttatgttttattagtttttgatatttgtacgaacgtaagggtttttattacgtgttcgtttttt

SEQ ID NO: 14458 - DNA, 830 bp, Artificial Sequence
  chemically treated genomic DNA (Homo sapiens) CpG-island No: 14458
  misc_feature (584)..(584): n is either a, c, g or t
aaaaaacgaacacgtaataaaaacccttacgttcgtacaaatatcaaaaactaataaaacataaaaacgacgaaaattctattatacgattataaaaacgatcgaaaatatataacgaaaattatataacacgcgtttaataaaaacgtacgatataaaacgataatacgtaacgaaaaataaaaaatataactcgaaaaatataaaaacgctaaaaaaaaaaataatataaaaataaaaaaaacgctaaaaaataaaaaaattaaaataatataataaaaacgttaaaacgaaattcgaacgatcgaaaaacgaaattttcgaataaaaacgtaataaaaaaaaatttataaaacgtatcgaaaatcttatataataaaaaaataaaataaaacgaaaacgaaaacaaaaaaaaaaaacaataaaaaaccctaattaaaaaacgtacgaaataaaaaaattcgaaaacgtaataaaaaactatatatataaaatactcaaataaacgcgcgaaataaactaaatattaaaacgtaccgacgataaaatatcgaaaaaatattaaacgaaaaatatatatattncacacgaccgtaaaaaacgaacgaattaaaacacacaattttaaaataaaaaaaccgtaaacgaaaccgccgtaaaaatacgactaactaataaaaaaaaaaaaaatatataaccgaaataaaaaaacgcgacgtctataacgaacgaaatacaaaccgcttcccaaaatacgaatacgaaaatataaaaaaaccgatatacacccccgataaacaaaataaaacgatataaacgatataatataa

SEQ ID NO: 14459 - DNA, 830 bp, Artificial Sequence
  chemically treated genomic DNA (Homo sapiens) CpG-island No: 14459
  misc_feature (584)..(584): n is either a, c, g or t
ggagggcgagtacgtggtagaggtttttgcgttcgtgtagatgttagaggttagtgagatatgagggcggcggggattttgttatgcggttatggggacggtcggagatgtgtggcggaggttgtgtagtacgcgtttggtgaggacgtacgatgtgggacggtggtgcgtggcggggggtgggaggtatggttcgagggatgtggggacgttagagaggagggtagtgtagggatggagagggcgttgggaagtaggagggttggggtggtgtggtgaaagcgttgggacggggttcggacggtcgaggggcggggttttcgggtaggagcgtgatgagagggggtttgtggggcgtatcgggagttttgtatggtgggggagtggggtggggcgggggcgagggtaaggagagggagtagtgggggattttggttggagagcgtacgggatgaggaagttcgaggacgtggtgaggggttgtatatgtggggtgtttaggtaaacgcgcggggtgaattgagtgttgaggcgtgtcgacgatagaatgtcgagagggtgttgggcgaggggtgtgtgtgttntatacggtcgtgagggacgggcgggttagagtatatagttttggagtagagaggtcgtaggcgaagtcgtcgtgggggtgcgattggttgatgggaggagagggggtgtgtggtcgaggtaagaggacgcggcgtttatggcgagcggagtgtaggtcgttttttagggtgcgaatgcgggggtgtggaggggtcgatgtgtattttcgatggataaagtggggcggtgtaaacggtgtgatgtgg

SEQ ID NO: 14460 - DNA, 830 bp, Artificial Sequence
  chemically treated genomic DNA (Homo sapiens) CpG-island No: 14460
  misc_feature (247)..(247): n is either a, c, g or t
ccacatcacaccgtttacaccgccccactttatccatcgaaaatacacatcgacccctccacacccccgcattcgcaccctaaaaaacgacctacactccgctcgccataaacgccgcgtcctcttacctcgaccacacaccccctctcctcccatcaaccaatcgcacccccacgacgacttcgcctacgacctctctactccaaaactatatactctaacccgcccgtccctcacgaccgtatanaacacacacacccctcgcccaacaccctctcgacattctatcgtcgacacgcctcaacactcaattcaccccgcgcgtttacctaaacaccccacatatacaacccctcaccacgtcctcgaacttcctcatcccgtacgctctccaaccaaaatcccccactactccctctccttaccctcgcccccgccccaccccactcccccaccatacaaaactcccgatacgccccacaaaccccctctcatcacgctcctacccgaaaaccccgcccctcgaccgtccgaaccccgtcccaacgctttcaccacaccaccccaaccctcctacttcccaacgccctctccatccctacactaccctcctctctaacgtccccacatccctcgaaccatacctcccaccccccgccacgcaccaccgtcccacatcgtacgtcctcaccaaacgcgtactacacaacctccgccacacatctccgaccgtccccataaccgcataacaaaatccccgccgccctcatatctcactaacctctaacatctacacgaacgcaaaaacctctaccacgtactcgccctcc

SEQ ID NO: 14461 - DNA, 734 bp, Artificial Sequence
  chemically treated genomic DNA (Homo sapiens) CpG-island No: 14461
attttttcgttaattttttgttttattcgtttataacgttttataacgggttttattatttcgcgtttttatgaatcgtttttttatttacgttttatatgaacgtttttattataatcgttttttttaatatttttcgtttttacgtattttttattaatatttcggtttatacgtagtttttatatatattcgttcgttttatattcgtaataattgtatacggtatattttacgttcgtttatttacgtatttattaattgtcgcgtataaaagttttttagttattttttttattatacgattttatatatatttttttaattcgtttataaattttttttattatcgtcgaaattttgcgcgaatagttcggttatggtttttatttagttttttaaatttttttttcgtttttttaattttcgttttttttttaaaatcgtttattttttttatttgttttatttttttaaaaaagttaatttttgtttaacgttcggtttcgttttgttattgttttatatcgttttaatcgtttaaatatacgtttaatatcgttttttattttttttttttttttataatttttttttaattttttttacgttcgttttaatgcgtattaattcgttttattttcgttttttatcgtttttaaacgttttttaaatcgttttaattacgtttttttatacgtttaaatttttttttatattttttttttaggttt

SEQ ID NO: 14462 - DNA, 734 bp, Artificial Sequence
  chemically treated genomic DNA (Homo sapiens) CpG-island No: 14462
aaacctaaaaaaaaaatataaaaaaaaatttaaacgtataaaaaaacgtaattaaaacgatttaaaaaacgtttaaaaacgataaaaaacgaaaataaaacgaattaatacgcattaaaacgaacgtaaaaaaaattaaaaaaaaattataaaaaaaaaaaaaaaataaaaaacgatattaaacgtatatttaaacgattaaaacgatataaaacaataacaaaacgaaaccgaacgttaaacaaaaattaacttttttaaaaaaataaaacaaataaaaaaaataaacgattttaaaaaaaaaacgaaaattaaaaaaacgaaaaaaaaatttaaaaaactaaataaaaaccataaccgaactattcgcgcaaaatttcgacgataataaaaaaaatttataaacgaattaaaaaaatatatataaaatcgtataataaaaaaaataactaaaaaacttttatacgcgacaattaataaatacgtaaataaacgaacgtaaaatataccgtatacaattattacgaatataaaacgaacgaatatatataaaaactacgtataaaccgaaatattaataaaaaatacgtaaaaacgaaaaatattaaaaaaaacgattataataaaaacgttcatataaaacgtaaataaaaaaacgattcataaaaacgcgaaataataaaacccgttataaaacgttataaacgaataaaacaaaaaattaacgaaaaaat

SEQ ID NO: 14463 - DNA, 734 bp, Artificial Sequence
  chemically treated genomic DNA (Homo sapiens) CpG-island No: 14463
gggtttgggagggggatgtaagggggagtttgggcgtgtgaggaggcgtagttaaggcggtttgaagggcgtttaagggcggtggagggcggagatggagcgagttagtgcgtattaaggcgggcgtgggggggattgggggagggttatagggaggaggggaggatgggaagcggtgttgagcgtgtgtttgggcggttaaagcggtgtgaggtagtggtagggcgggatcgggcgttgagtaaagattggtttttttggaggggtaaagtagatagggggggtaggcggttttggggggaaggcgggagttaggagggcgaggagggggtttgaggggttgaataggggttatgatcgggttattcgcgtagggtttcggcgatggtgaggggaatttgtaggcgggttggaggggtatgtataaggtcgtgtagtagggagggtgattaggaagtttttatgcgcggtagttggtaggtgcgtgggtaagcggacgtgggatgtgtcgtgtgtagttgttgcgagtatggaacgagcgggtatgtatgagggttgcgtgtggatcggggtgttggtgagggatgcgtgggaacggggggtattggagggggcgattatggtgggagcgtttatgtgaggcgtggataagagagcggtttatagaggcgcgaaatggtggagttcgttatgggacgttgtaagcgggtgggataggggattgacggggaggt

SEQ ID NO: 14464 - DNA, 734 bp, Artificial Sequence
  chemically treated genomic DNA (Homo sapiens) CpG-island No: 14464
acctccccgtcaatcccctatcccacccgcttacaacgtcccataacgaactccaccatttcgcgcctctataaaccgctctcttatccacgcctcacataaacgctcccaccataatcgccccctccaataccccccgttcccacgcatccctcaccaacaccccgatccacacgcaaccctcatacatacccgctcgttccatactcgcaacaactacacacgacacatcccacgtccgcttacccacgcacctaccaactaccgcgcataaaaacttcctaatcaccctccctactacacgaccttatacatacccctccaacccgcctacaaattcccctcaccatcgccgaaaccctacgcgaataacccgatcataacccctattcaacccctcaaaccccctcctcgccctcctaactcccgccttccccccaaaaccgcctaccccccctatctactttacccctccaaaaaaaccaatctttactcaacgcccgatcccgccctaccactacctcacaccgctttaaccgcccaaacacacgctcaacaccgcttcccatcctcccctcctccctataaccctcccccaatcccccccacgcccgccttaatacgcactaactcgctccatctccgccctccaccgcccttaaacgcccttcaaaccgccttaactacgcctcctcacacgcccaaactcccccttacatccccctcccaaaccc

SEQ ID NO: 14465 - DNA, 1084 bp, Artificial Sequence
  chemically treated genomic DNA (Homo sapiens) CpG-island No: 14465
  misc_feature (662)..(662): n is either a, c, g or t
  misc_feature (964)..(964): n is either a, c, g or t
cgaaagcgtagagggcggcgaggcgaagtagcgttagcgcgaaagggtcgaggcgaggttagcgtcgacgtagagcggcgacggagtagattagggagagaagggcgagacgagcgatagcgcgttaggggtagggtaggaagtatcgggtcgaagaggcgcgacgtcgggagtaagggggggggaggcgttaggaggggcggggttcggcggaacggaatttaaggtacggttaggtagtttaggtcgggaaggttcgaaaagtcgtttcgtattcggagatagtagcgcgttagcgtcggttcggtcgatagcgagatcggaaatcgacggacggaaggcgtaggacggagagcggagtaggcgagtcggaggcgaaggagcggcggaaatcggatcggcgcgtaagcgggagcgacgtagtaacgggaggcgtacgtacgcgggatgacgcgggagttaagcggagaggaaagcggtcgcgcgacggggtaggtattattcggtatagaatatgaagcgtatcgcgaacgcggtcgataatttacgacgacggttacgcgagacgtagagacggcgcgagcgaacggatttcgatcggagcgcggaaattttacgagttcgttagtacgtattaacgtcgaggatcgaggatcgaagtnttagtttatacgttagtatcgagcgacggggacggcggtcggtcgaataacggagcgagtcgtcgaggtcggacgacggcgatcgaggaaacggtcgcgattagtaagttataaacgtcgtcgcgagtaaagagtcgcgtatcgtcgaaatatatattacggacgcggtagattcgaagcgcgttaagaagcggcgtcggtaagagaggttaagatattatagtcggcggaggtcggtagcgtcgcgttaggtttaaggcgttaagggcgttttaggttaagtcgattagagtaagtttttnagagtcgtaaggtttagatcgcgtaattcgtatttacgagttcggagtcggaggtagcgtagatcgttagttagtatttcggttagtagcgttaatcgttaacgacggtatcgcgtatat

SEQ ID NO: 14466 - DNA, 1084 bp, Artificial Sequence
  chemically treated genomic DNA (Homo sapiens) CpG-island No: 14466
  misc_feature (121)..(121): n is either a, c, g or t
  misc_feature (423)..(423): n is either a, c, g or t
atatacgcgataccgtcgttaacgattaacgctactaaccgaaatactaactaacgatctacgctacctccgactccgaactcgtaaatacgaattacgcgatctaaaccttacgactctnaaaaacttactctaatcgacttaacctaaaacgcccttaacgccttaaacctaacgcgacgctaccgacctccgccgactataatatcttaacctctcttaccgacgccgcttcttaacgcgcttcgaatctaccgcgtccgtaatatatatttcgacgatacgcgactctttactcgcgacgacgtttataacttactaatcgcgaccgtttcctcgatcgccgtcgtccgacctcgacgactcgctccgttattcgaccgaccgccgtccccgtcgctcgatactaacgtataaactaanacttcgatcctcgatcctcgacgttaatacgtactaacgaactcgtaaaatttccgcgctccgatcgaaatccgttcgctcgcgccgtctctacgtctcgcgtaaccgtcgtcgtaaattatcgaccgcgttcgcgatacgcttcatattctataccgaataatacctaccccgtcgcgcgaccgctttcctctccgcttaactcccgcgtcatcccgcgtacgtacgcctcccgttactacgtcgctcccgcttacgcgccgatccgatttccgccgctccttcgcctccgactcgcctactccgctctccgtcctacgccttccgtccgtcgatttccgatctcgctatcgaccgaaccgacgctaacgcgctactatctccgaatacgaaacgacttttcgaaccttcccgacctaaactacctaaccgtaccttaaattccgttccgccgaaccccgcccctcctaacgcctcccccccccttactcccgacgtcgcgcctcttcgacccgatacttcctaccctacccctaacgcgctatcgctcgtctcgcccttctctccctaatctactccgtcgccgctctacgtcgacgctaacctcgcctcgaccctttcgcgctaacgctacttcgcctcgccgccctctacgctttcg

SEQ ID NO: 14467 - DNA, 1084 bp, Artificial Sequence
  chemically treated genomic DNA (Homo sapiens) CpG-island No: 14467
  misc_feature (121)..(121): n is either a, c, g or t
  misc_feature (423)..(423): n is either a, c, g or t
gtgtgcgcggtgtcgtcgttggcggttagcgttgttggtcggagtgttggttggcggtttgcgttgttttcggtttcgggttcgtgggtgcgggttgcgcggtttgggttttgcggttttngggagtttgttttggtcggtttgatttggggcgtttttggcgttttgggtttggcgcggcgttgtcggttttcgtcggttgtggtgttttggttttttttgtcggcgtcgttttttggcgcgtttcgggtttgtcgcgttcgtggtgtgtgtttcggcggtgcgcggttttttgttcgcggcggcgtttgtggtttgttggtcgcggtcgttttttcggtcgtcgtcgttcggtttcgacggttcgtttcgttgttcggtcggtcgtcgttttcgtcgttcggtgttggcgtgtgggttggngtttcggttttcggttttcggcgttggtgcgtgttggcgggttcgtagggttttcgcgtttcggtcggggttcgttcgttcgcgtcgtttttgcgtttcgcgtggtcgtcgtcgtgggttgtcgatcgcgttcgcgatgcgttttatgttttgtgtcgggtggtgtttgtttcgtcgcgcggtcgttttttttttcgtttggttttcgcgttatttcgcgtgcgtgcgtttttcgttgttgcgtcgttttcgtttgcgcgtcggttcggttttcgtcgttttttcgttttcggttcgtttgtttcgtttttcgttttgcgtttttcgttcgtcggttttcggtttcgttgtcgatcgggtcggcgttggcgcgttgttgttttcgggtgcggggcggtttttcgggttttttcggtttgggttgtttggtcgtgttttgggtttcgtttcgtcgagtttcgttttttttggcgttttttttttttttgttttcggcgtcgcgttttttcggttcggtgttttttgttttgtttttggcgcgttgtcgttcgtttcgtttttttttttttggtttgtttcgtcgtcgttttgcgtcggcgttggtttcgtttcggttttttcgcgttggcgttgtttcgtttcgtcgttttttgcgttttcg

SEQ ID NO: 14468 - DNA, 1084 bp, Artificial Sequence
  chemically treated genomic DNA (Homo sapiens) CpG-island No: 14468
  misc_feature (662)..(662): n is either a, c, g or t
  misc_feature (964)..(964): n is either a, c, g or t
cgaaaacgcaaaaaacgacgaaacgaaacaacgccaacgcgaaaaaaccgaaacgaaaccaacgccgacgcaaaacgacgacgaaacaaaccaaaaaaaaaaaaacgaaacgaacgacaacgcgccaaaaacaaaacaaaaaacaccgaaccgaaaaaacgcgacgccgaaaacaaaaaaaaaaaaaacgccaaaaaaaacgaaactcgacgaaacgaaacccaaaacacgaccaaacaacccaaaccgaaaaaacccgaaaaaccgccccgcacccgaaaacaacaacgcgccaacgccgacccgatcgacaacgaaaccgaaaaccgacgaacgaaaaacgcaaaacgaaaaacgaaacaaacgaaccgaaaacgaaaaaacgacgaaaaccgaaccgacgcgcaaacgaaaacgacgcaacaacgaaaaacgcacgcacgcgaaataacgcgaaaaccaaacgaaaaaaaaaacgaccgcgcgacgaaacaaacaccacccgacacaaaacataaaacgcatcgcgaacgcgatcgacaacccacgacgacgaccacgcgaaacgcaaaaacgacgcgaacgaacgaaccccgaccgaaacgcgaaaaccctacgaacccgccaacacgcaccaacgccgaaaaccgaaaaccgaaacnccaacccacacgccaacaccgaacgacgaaaacgacgaccgaccgaacaacgaaacgaaccgtcgaaaccgaacgacgacgaccgaaaaaacgaccgcgaccaacaaaccacaaacgccgccgcgaacaaaaaaccgcgcaccgccgaaacacacaccacgaacgcgacaaacccgaaacgcgccaaaaaacgacgccgacaaaaaaaaccaaaacaccacaaccgacgaaaaccgacaacgccgcgccaaacccaaaacgccaaaaacgccccaaatcaaaccgaccaaaacaaactcccnaaaaccgcaaaacccaaaccgcgcaacccgcacccacgaacccgaaaccgaaaacaacgcaaaccgccaaccaacactccgaccaacaacgctaaccgccaacgacgacaccgcgcacac

SEQ ID NO: 14469 - DNA, 1433 bp, Artificial Sequence
  chemically treated genomic DNA (Homo sapiens) CpG-island No: 14469
  misc_feature (1429)..(1429): n is either a, c, g or t
tattagtcggtgttgattgtcgtaatggtatcggtgggtgcgtttattattcgtgcggataatttttttcgggatgaggtcggttttttttgttagtttgtcgtgacggttatatcggtaaagatagtgcgcgttacgggcgatacggttattcggttatatgttgagggcgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttttttattatatttgtaatgtatcgttattcggtgtttttcgttgatatggttgatgtttgttagttagttacgttcgttatattgttatcgttttgcggttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttcggtagtatcgtattttatattgcgcgttagttcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttagggttgtcgtatgcgcggtattgatttagttttttttcgcggtgtatcgtcgttatttgttcgaagcggttatggttataacgggttatataatcggaatagtttgttaagtttagtaattgatcgtaacggttttacgttatggtttttcggttgtcggtggtattttttcgtgcgtagggtaagttaattgtgtgattattataacggtagcgggtgatatcgtcgttaagngtag

SEQ ID NO: 14470 - DNA, 1433 bp, Artificial Sequence
  chemically treated genomic DNA (Homo sapiens) CpG-island No: 14470
  misc_feature (5)..(5): n is either a, c, g or t
ctacncttaacgacgatatcacccgctaccgttataataatcacacaattaacttaccctacgcacgaaaaaataccaccgacaaccgaaaaaccataacgtaaaaccgttacgatcaattactaaacttaacaaactattccgattatataacccgttataaccataaccgcttcgaacaaataacgacgatacaccgcgaaaaaaaactaaatcaataccgcgcatacgacaaccctaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgaactaacgcgcaatataaaatacgatactaccgaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaaccgcaaaacgataacaatataacgaacgtaactaactaacaaacatcaaccatatcaacgaaaaacaccgaataacgatacattacaaatataataaaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacgccctcaacatataaccgaataaccgtatcgcccgtaacgcgcactatctttaccgatataaccgtcacgacaaactaacaaaaaaaaccgacctcatcccgaaaaaaattatccgcacgaataataaacgcacccaccgataccattacgacaatcaacaccgactaata

SEQ ID NO: 14471 - DNA, 1433 bp, Artificial Sequence
  chemically treated genomic DNA (Homo sapiens) CpG-island No: 14471
  misc_feature (5)..(5): n is either a, c, g or t
ttgtntttgacggcgatattattcgttatcgttatgataattatatagttgatttattttgcgtacgggaagatgttatcggtagtcggaaaattatgacgtggagtcgttacggttagttgttgagtttaatagattgtttcggttatgtaattcgttatgattatgatcgtttcgggtagatgacggcggtgtatcgcgaggaagggttgagttagtatcgcgtatacgatagttttggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcgggttgacgcgtagtatggaatacgatgttgtcggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaatcgtagagcggtggtagtatgacgaacgtggttggttgatagatattagttatattagcgaagggtatcgggtggcggtgtattataggtatgatgagaaaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatattatagattcggtaggtaatcgtttgttcgattcggagttgtattcggatagcgtttttagtatgtggtcggataatcgtatcgttcgtgacgcgtattatttttatcggtatgatcgttacggtaggttgatagagaaaatcgattttatttcggaaggggttattcgtacggatgatgagcgtatttatcggtattattacgatagttagtatcggttggtg

SEQ ID NO: 14472 - DNA, 1433 bp, Artificial Sequence
  chemically treated genomic DNA (Homo sapiens) CpG-island No: 14472
  misc_feature (1429)..(1429): n is either a, c, g or t
caccaaccgatactaactatcgtaataataccgataaatacgctcatcatccgtacgaataaccccttccgaaataaaatcgattttctctatcaacctaccgtaacgatcataccgataaaaataatacgcgtcacgaacgatacgattatccgaccacatactaaaaacgctatccgaatacaactccgaatcgaacaaacgattacctaccgaatctataatatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctttctcatcatacctataatacaccgccacccgatacccttcgctaatataactaatatctatcaaccaaccacgttcgtcatactaccaccgctctacgatttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtccgacaacatcgtattccatactacgcgtcaacccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccaaaactatcgtatacgcgatactaactcaacccttcctcgcgatacaccgccgtcatctacccgaaacgatcataatcataacgaattacataaccgaaacaatctattaaactcaacaactaaccgtaacgactccacgtcataattttccgactaccgataacatcttcccgtacgcaaaataaatcaactatataattatcataacgataacgaataatatcgccgtcaaanacaa

SEQ ID NO: 14473 - DNA, 675 bp, Artificial Sequence
  chemically treated genomic DNA (Homo sapiens) CpG-island No: 14473
  misc_feature (615)..(615): n is either a, c, g or t
tcgttaacgttgcgggttggtagggcgaaattagtcgtgaataatttaatgaattgatcgcgttattggtaaaacgaattttattggtttgtcgtcgcgttttgaaagacgcgggtgtagaagttgatgaagtgttggaagtggtgatggtgggcggttttattcgcgtgtcgttggtgcgtgaacgggtaggcgaatttttcggtcgtttatcgttgatttttatcgattcggataaagtcgtcgttattggcgcggcgatttaggcggatattttggtgggtaataagttagatagcgaaatgttgttgtttgatgtgattttattgtcgttgggtttcgaaacgatgggcggtttggtggagaaagtgatttcgcgtaatattattatttcggtggttcgcgtttaggattttattatttttaaagatggttagacggcgatgtttatttatgtaatgtagggtgagcgcgaattggtgtaggattgtcgtttattggcgcgttttgtttgcgtggtatttcggcgttatcggttggcggtgcgtatattcgcgtgacgttttaggtcgatgtcgacggttttttgagcgtgacgcgaatgagaatttattngcgtgagcgtttatttaggttaaatcgtttacgtttgacgatagcgaatcgttcgatgat

SEQ ID NO: 14474 - DNA, 675 bp, Artificial Sequence
  chemically treated genomic DNA (Homo sapiens) CpG-island No: 14474
  misc_feature (61)..(61): n is either a, c, g or t
atcatcgaacgattcgctatcgtcaaacgtaaacgatttaacctaaataaacgctcacgcnaataaattctcattcgcgtcacgctcaaaaaaccgtcgacatcgacctaaaacgtcacgcgaatatacgcaccgccaaccgataacgccgaaataccacgcaaacaaaacgcgccaataaacgacaatcctacaccaattcgcgctcaccctacattacataaataaacatcgccgtctaaccatctttaaaaataataaaatcctaaacgcgaaccaccgaaataataatattacgcgaaatcactttctccaccaaaccgcccatcgtttcgaaacccaacgacaataaaatcacatcaaacaacaacatttcgctatctaacttattacccaccaaaatatccgcctaaatcgccgcgccaataacgacgactttatccgaatcgataaaaatcaacgataaacgaccgaaaaattcgcctacccgttcacgcaccaacgacacgcgaataaaaccgcccaccatcaccacttccaacacttcatcaacttctacacccgcgtctttcaaaacgcgacgacaaaccaataaaattcgttttaccaataacgcgatcaattcattaaattattcacgactaatttcgccctaccaacccgcaacgttaacga

SEQ ID NO: 14475 - DNA, 675 bp, Artificial Sequence
  chemically treated genomic DNA (Homo sapiens) CpG-island No: 14475
  misc_feature (61)..(61): n is either a, c, g or t
attatcgagcgattcgttatcgttagacgtagacggtttgatttgaatagacgtttacgtnagtggatttttattcgcgttacgtttaaaagatcgtcggtatcgatttggaacgttacgcgaatatgcgtatcgttagtcggtagcgtcggaatattacgtaggtaaaacgcgttagtgagcggtagttttgtattagttcgcgtttattttgtattatatggatagatatcgtcgtttgattatttttaaaggtggtgaaattttgagcgcgggttatcggaatagtggtattacgcggaattattttttttattaggtcgtttatcgtttcgaggtttagcgatagtgggattatattaagtaatagtatttcgttgtttggtttgttatttattagaatattcgtttgaatcgtcgcgttaatagcgacgattttattcgggtcgatggaagttagcggtggacgatcgaaaaattcgtttattcgtttacgtattagcggtacgcgagtagaatcgtttattattattatttttagtattttattagtttttatattcgcgttttttagagcgcgacgataagttagtaaggttcgttttattagtggcgcgattagtttattgaattgtttacggttgatttcgttttgttagttcgtaacgttaacgg

SEQ ID NO: 14476 - DNA, 675 bp, Artificial Sequence
  chemically treated genomic DNA (Homo sapiens) CpG-island No: 14476
  misc_feature (615)..(615): n is either a, c, g or t
ccgttaacgttacgaactaacaaaacgaaatcaaccgtaaacaattcaataaactaatcgcgccactaataaaacgaaccttactaacttatcgtcgcgctctaaaaaacgcgaatataaaaactaataaaatactaaaaataataataataaacgattctactcgcgtaccgctaatacgtaaacgaataaacgaatttttcgatcgtccaccgctaacttccatcgacccgaataaaatcgtcgctattaacgcgacgattcaaacgaatattctaataaataacaaaccaaacaacgaaatactattacttaatataatcccactatcgctaaacctcgaaacgataaacgacctaataaaaaaaataattccgcgtaataccactattccgataacccgcgctcaaaatttcaccacctttaaaaataatcaaacgacgatatctatccatataatacaaaataaacgcgaactaatacaaaactaccgctcactaacgcgttttacctacgtaatattccgacgctaccgactaacgatacgcatattcgcgtaacgttccaaatcgataccgacgatcttttaaacgtaacgcgaataaaaatccactnacgtaaacgtctattcaaatcaaaccgtctacgtctaacgataacgaatcgctcgataat

SEQ ID NO: 14477 - DNA, 713 bp, Artificial Sequence
  chemically treated genomic DNA (Homo sapiens) CpG-island No: 14477
gttttcgcgagcgaggtcggagaaggcgcggcggtttttggtttggttatttcgtttttgtcgtagttgaatcgtcgattacgagtttttgtatcgcgtatatatttcgcgcgtttcgttttcggtttcgttcggttatcgtcgttttttagaacgtcgcgttcgtgattcggaagagtattttttttagtaattgcgggattgcggcggcgtcggtttcggggagaaacggtgaggtttttattcgtttgttttttgtatcgtttagtgttgtacgatttttcgggatcgattcggggtttggtttttggggggtttcgcggcgtttcgttcggtatttgtggtggcggttcgggacgagcgtttttcgtttttggcgttgtttttcggtttacgcgttttttttgtttcgtattttttttaatgtttttagttttttatttttcgtttttgatcgattcggttttttaggtacgtttatagcgtcggggtttttgtagtttaggatggcgtgaggggagcgagattagaattagagtttgttgttgtagagaggacgtttttcgaggttcgggttatttgtggacgcgttttttagggttttgatcgagatgtttaggattggtagggatggggagtttcgggaattttgaagggtagtcgtttaattataatatgtttttgacgtttgcgttttttatagtgatatattt

SEQ ID NO: 14478 - DNA, 713 bp, Artificial Sequence
  chemically treated genomic DNA (Homo sapiens) CpG-island No: 14478
aaatatatcactataaaaaacgcaaacgtcaaaaacatattataattaaacgactacccttcaaaattcccgaaactccccatccctaccaatcctaaacatctcgatcaaaaccctaaaaaacgcgtccacaaataacccgaacctcgaaaaacgtcctctctacaacaacaaactctaattctaatctcgctcccctcacgccatcctaaactacaaaaaccccgacgctataaacgtacctaaaaaaccgaatcgatcaaaaacgaaaaataaaaaactaaaaacattaaaaaaaatacgaaacaaaaaaaacgcgtaaaccgaaaaacaacgccaaaaacgaaaaacgctcgtcccgaaccgccaccacaaataccgaacgaaacgccgcgaaaccccccaaaaaccaaaccccgaatcgatcccgaaaaatcgtacaacactaaacgatacaaaaaacaaacgaataaaaacctcaccgtttctccccgaaaccgacgccgccgcaatcccgcaattactaaaaaaaatactcttccgaatcacgaacgcgacgttctaaaaaacgacgataaccgaacgaaaccgaaaacgaaacgcgcgaaatatatacgcgatacaaaaactcgtaatcgacgattcaactacgacaaaaacgaaataaccaaaccaaaaaccgccgcgccttctccgacctcgctcgcgaaaac

SEQ ID NO: 14479 - DNA, 713 bp, Artificial Sequence
  chemically treated genomic DNA (Homo sapiens) CpG-island No: 14479
aagtgtattattgtggaaagcgtaaacgttaaggatatgttataattaagcggttgttttttaagattttcgaggttttttatttttgttagttttgaatatttcgattaagattttagagaacgcgtttataggtgattcgagtttcgggaggcgttttttttatagtaataggttttaattttggtttcgttttttttacgttattttaggttataagggtttcggcgttataagcgtgtttgggaggtcgggtcggttaggagcggagagtggggagttggggatattgagggagatgcgggatagggaagacgcgtgggtcggggagtaacgttagaggcggaagacgttcgtttcgggtcgttattataggtgtcgggcgaagcgtcgcggagttttttagaggttagatttcgggtcggtttcgaggggtcgtgtagtattaggcggtgtagggggtaggcgagtgagggttttatcgttttttttcggagtcggcgtcgtcgtagtttcgtagttgttaaggagaatgttttttcgggttacgggcgcggcgttttagagagcgacggtggtcgggcgaggtcgagagcgaagcgcgcggggtgtgtgcgcggtgtaggagttcgtagtcggcggtttagttgcgataagggcgaaatggttaggttaggggtcgtcgcgtttttttcggtttcgttcgcggggat

SEQ ID NO: 14480 - DNA, 713 bp, Artificial Sequence
  chemically treated genomic DNA (Homo sapiens) CpG-island No: 14480
atccccgcgaacgaaaccgaaaaaaacgcgacgacccctaacctaaccatttcgcccttatcgcaactaaaccgccgactacgaactcctacaccgcgcacacaccccgcgcgcttcgctctcgacctcgcccgaccaccgtcgctctctaaaacgccgcgcccgtaacccgaaaaaacattctccttaacaactacgaaactacgacgacgccgactccgaaaaaaaacgataaaaccctcactcgcctaccccctacaccgcctaatactacacgacccctcgaaaccgacccgaaatctaacctctaaaaaactccgcgacgcttcgcccgacacctataataacgacccgaaacgaacgtcttccgcctctaacgttactccccgacccacgcgtcttccctatcccgcatctccctcaatatccccaactccccactctccgctcctaaccgacccgacctcccaaacacgcttataacgccgaaacccttataacctaaaataacgtaaaaaaaacgaaaccaaaattaaaacctattactataaaaaaaacgcctcccgaaactcgaatcacctataaacgcgttctctaaaatcttaatcgaaatattcaaaactaacaaaaataaaaaacctcgaaaatcttaaaaaacaaccgcttaattataacatatccttaacgtttacgctttccacaataatacactt

SEQ ID NO: 14481 - DNA, 1103 bp, Artificial Sequence
  chemically treated genomic DNA (Homo sapiens) CpG-island No: 14481
ggacgcgacgtggtgtttgtacgcgcggaatgcgatagtaaggttgtttttaggtttcggggacgcgttatttttattttcgttcggagggtagggttcgagcgcgggattttagtcgattttgattggcggcgcgattttgaggtttgcgttcgttttagttgttttttttgtgtaatggggagacgcgttttatcgtttgataacggtcgaagagcgtcgcgttttcgtttttcgcgtgcgcgtttatgttgtttattttcgtttcgtattgattttttttcgtgtttcgcgtttcgtattgtcgtttcgtttcgagttttatgtcgtagttatcgcgacggagttcgtagcgggaatttgttttcgcgcgttagtacgcgcgttttatgtgtcgtttttattagcgtcggttttcgtttataggttagatgtattgttattttggcgaagtcgtagattcgattggtcgggacgaggcgcgagatcgggttgcgggcggggtcgaacgtggtataaaaggggcgggaggtaggttcgtgtcgttttgtagacgttatcgtcgaggaaaatcgtgtattattagttatggttaattttatcgtgtttttcgatattgtcgtcgacggcgagtttttgggtcgcgttttttttgaggtcgggcgggcggcggcgtgcgggaatgggtttagaaagtgggtcggggtcggggtgggtggtagcgttttaaaggttcgggtcggggcgattttgtttgaggggcgagcgcgggcgggttcggcgttattttttgacgaggggttattttgggaggttcgagtcgcgggaggaggcggacgcgggcggataaaggtaggcgggtcgttgcgaggcgtttggggagggggttcgcgttcgttcgttcgttttatgtgtcgcgttttgttttgttcgacgtacgtgttcggcggtcgcgtttaggttcgcgttttgagagtcgttcgtcgttttagtttggtttgggcgtcgtagatcggagttagaagtacgttcgcgggggtttgcgatcgtttttttgggaagttgttttttggtaggtatgggtgttttatattttgagttgg

SEQ ID NO: 14482 - DNA, 1103 bp, Artificial Sequence
  chemically treated genomic DNA (Homo sapiens) CpG-island No: 14482
ccaactcaaaatataaaacacccatacctaccaaaaaacaacttcccaaaaaaacgatcgcaaacccccgcgaacgtacttctaactccgatctacgacgcccaaaccaaactaaaacgacgaacgactctcaaaacgcgaacctaaacgcgaccgccgaacacgtacgtcgaacaaaacaaaacgcgacacataaaacgaacgaacgaacgcgaaccccctccccaaacgcctcgcaacgacccgcctacctttatccgcccgcgtccgcctcctcccgcgactcgaacctcccaaaataacccctcgtcaaaaaataacgccgaacccgcccgcgctcgcccctcaaacaaaatcgccccgacccgaacctttaaaacgctaccacccaccccgaccccgacccactttctaaacccattcccgcacgccgccgcccgcccgacctcaaaaaaaacgcgacccaaaaactcgccgtcgacgacaatatcgaaaaacacgataaaattaaccataactaataatacacgattttcctcgacgataacgtctacaaaacgacacgaacctacctcccgccccttttataccacgttcgaccccgcccgcaacccgatctcgcgcctcgtcccgaccaatcgaatctacgacttcgccaaaataacaatacatctaacctataaacgaaaaccgacgctaataaaaacgacacataaaacgcgcgtactaacgcgcgaaaacaaattcccgctacgaactccgtcgcgataactacgacataaaactcgaaacgaaacgacaatacgaaacgcgaaacacgaaaaaaaatcaatacgaaacgaaaataaacaacataaacgcgcacgcgaaaaacgaaaacgcgacgctcttcgaccgttatcaaacgataaaacgcgtctccccattacacaaaaaaaacaactaaaacgaacgcaaacctcaaaatcgcgccgccaatcaaaatcgactaaaatcccgcgctcgaaccctaccctccgaacgaaaataaaaataacgcgtccccgaaacctaaaaacaaccttactatcgcattccgcgcgtacaaacaccacgtcgcgtcc

SEQ ID NO: 14483 - DNA, 1103 bp, Artificial Sequence
  chemically treated genomic DNA (Homo sapiens) CpG-island No: 14483
ttagtttaggatgtaaagtatttatgtttgttaggggatagttttttaggaaggcggtcgtaagttttcgcgagcgtgtttttggtttcggtttgcggcgtttaggttaagttagggcgacgaacgatttttaaggcgcggatttgagcgcggtcgtcgagtacgtgcgtcggataggatagggcgcggtatatgaggcgggcgggcggacgcgggttttttttttaaacgtttcgtagcggttcgtttgtttttgttcgttcgcgttcgttttttttcgcgattcggattttttaaaatggtttttcgttaggaaatggcgtcgagttcgttcgcgttcgttttttaagtagggtcgtttcggttcgggtttttggggcgttattatttatttcgatttcggtttattttttgggtttattttcgtacgtcgtcgttcgttcgattttaaaggagacgcggtttaagggttcgtcgtcgacggtaatgtcgaagaatacggtggggttgattatggttaatagtatacggtttttttcggcggtggcgtttgtaaaacggtacgagtttgtttttcgttttttttatattacgttcggtttcgttcgtaattcggtttcgcgtttcgtttcggttaatcgggtttgcgatttcgttagagtgatagtgtatttggtttatagacggaagtcggcgttgatggggacgatatatgaggcgcgcgtgttaacgcgcggaggtaggttttcgttgcgggtttcgtcgcggtggttgcggtatgggattcggggcggggcggtagtacgggacgcggggtacgggggagggttagtgcggaacgggggtgggtagtatgggcgcgtacgcgggagacggaagcgcggcgtttttcggtcgttgttaagcgatgaggcgcgtttttttattgtatagagggggtaattgaggcgaacgtaggttttaaggtcgcgtcgttagttaaggtcgattggggtttcgcgttcggattttatttttcgagcggaaatggggatggcgcgttttcgagatttaggagtagttttgttgtcgtatttcgcgcgtgtaaatattacgtcgcgttt

SEQ ID NO: 14484 - DNA, 1103 bp, Artificial Sequence
  chemically treated genomic DNA (Homo sapiens) CpG-island No: 14484
aaacgcgacgtaatatttacacgcgcgaaatacgacaacaaaactactcctaaatctcgaaaacgcgccatccccatttccgctcgaaaaataaaatccgaacgcgaaaccccaatcgaccttaactaacgacgcgaccttaaaacctacgttcgcctcaattaccccctctatacaataaaaaaacgcgcctcatcgcttaacaacgaccgaaaaacgccgcgcttccgtctcccgcgtacgcgcccatactacccacccccgttccgcactaaccctcccccgtaccccgcgtcccgtactaccgccccgccccgaatcccataccgcaaccaccgcgacgaaacccgcaacgaaaacctacctccgcgcgttaacacgcgcgcctcatatatcgtccccatcaacgccgacttccgtctataaaccaaatacactatcactctaacgaaatcgcaaacccgattaaccgaaacgaaacgcgaaaccgaattacgaacgaaaccgaacgtaatataaaaaaaacgaaaaacaaactcgtaccgttttacaaacgccaccgccgaaaaaaaccgtatactattaaccataatcaaccccaccgtattcttcgacattaccgtcgacgacgaacccttaaaccgcgtctcctttaaaatcgaacgaacgacgacgtacgaaaataaacccaaaaaataaaccgaaatcgaaataaataataacgccccaaaaacccgaaccgaaacgaccctacttaaaaaacgaacgcgaacgaactcgacgccatttcctaacgaaaaaccattttaaaaaatccgaatcgcgaaaaaaaacgaacgcgaacgaacaaaaacaaacgaaccgctacgaaacgtttaaaaaaaaaacccgcgtccgcccgcccgcctcatataccgcgccctatcctatccgacgcacgtactcgacgaccgcgctcaaatccgcgccttaaaaatcgttcgtcgccctaacttaacctaaacgccgcaaaccgaaaccaaaaacacgctcgcgaaaacttacgaccgccttcctaaaaaactatcccctaacaaacataaatactttacatcctaaactaa

SEQ ID NO: 14485 - DNA, 678 bp, Artificial Sequence
  chemically treated genomic DNA (Homo sapiens) CpG-island No: 14485
agttttttttagacgtagagcgggcgggcggttagtgcgcgtcgagggtttaggggtcggcgtcgcgaggggttgtaggtcgcgttcggtcgttgttcgggtcgtaggtgggagtcgttgtttgggttttagggttggatggtagtcggcggcggggattgaacgcgggagggttgtagggtgcgcgtcggcgaggggtttttcgttggaagttgagggatagacgtggggattcgtggttgttcggttttatcgtttagtcgtagggcgagtgttgtttcgtggaggtgatacggcgttaagagcggcgcgaggttttttgttggaggagggtaacggggaattcgaaggcgattgttttatgttggaggataaggggtattgttttttcggggtttcgcgtcggcgtcgaggaggggttcgttcgttgtttttgcgttttgagttcggtttttggtttttggggtcggggacgtagagaggggttggagtcggtcgatttacggtttagggcgttttttcgcggtttaagtagcggtcgtcgtttggagcgtagagtttgcggggtttagggggcgtcgacgttcgttttgaggcgtttttgttgttgcggcggcggggatggggacgatttaggggattttttgtagttattattggtagttttattaagaattg

SEQ ID NO: 14486 - DNA, 678 bp, Artificial Sequence
  chemically treated genomic DNA (Homo sapiens) CpG-island No: 14486
caattcttaataaaactaccaataataactacaaaaaatcccctaaatcgtccccatccccgccgccgcaacaacaaaaacgcctcaaaacgaacgtcgacgccccctaaaccccgcaaactctacgctccaaacgacgaccgctacttaaaccgcgaaaaaacgccctaaaccgtaaatcgaccgactccaacccctctctacgtccccgaccccaaaaaccaaaaaccgaactcaaaacgcaaaaacaacgaacgaacccctcctcgacgccgacgcgaaaccccgaaaaaacaataccccttatcctccaacataaaacaatcgccttcgaattccccgttaccctcctccaacaaaaaacctcgcgccgctcttaacgccgtatcacctccacgaaacaacactcgccctacgactaaacgataaaaccgaacaaccacgaatccccacgtctatccctcaacttccaacgaaaaacccctcgccgacgcgcaccctacaaccctcccgcgttcaatccccgccgccgactaccatccaaccctaaaacccaaacaacgactcccacctacgacccgaacaacgaccgaacgcgacctacaacccctcgcgacgccgacccctaaaccctcgacgcgcactaaccgcccgcccgctctacgtctaaaaaaaact

SEQ ID NO: 14487 - DNA, 678 bp, Artificial Sequence
  chemically treated genomic DNA (Homo sapiens) CpG-island No: 14487
taatttttgatggggttgttagtgatggttgtagggggttttttgggtcgtttttattttcgtcgtcgtagtagtagagacgttttagagcgggcgtcggcgttttttgggtttcgtaaattttgcgttttaggcggcggtcgttgtttaggtcgcgagggggcgttttgggtcgtgggtcgatcggttttagtttttttttgcgttttcggttttaggagttagaggtcgagtttaggacgtagaggtagcgagcgaattttttttcggcgtcgacgcgaagtttcgagagaatagtgttttttgttttttagtatagaatagtcgttttcgaatttttcgttatttttttttagtagaaagtttcgcgtcgtttttggcgtcgtgttatttttacggagtagtattcgttttgcggttggacggtggggtcgagtagttacgggtttttacgtttgttttttagtttttaacgagaagtttttcgtcggcgcgtattttgtagttttttcgcgtttagttttcgtcgtcggttgttatttagttttgggatttagatagcggtttttatttgcggttcggatagcggtcgagcgcggtttgtagtttttcgcggcgtcggtttttgagttttcggcgcgtattagtcgttcgttcgttttgcgtttgaaggaggtt

SEQ ID NO: 14488 - DNA, 678 bp, Artificial Sequence
  chemically treated genomic DNA (Homo sapiens) CpG-island No: 14488
aacctccttcaaacgcaaaacgaacgaacgactaatacgcgccgaaaactcaaaaaccgacgccgcgaaaaactacaaaccgcgctcgaccgctatccgaaccgcaaataaaaaccgctatctaaatcccaaaactaaataacaaccgacgacgaaaactaaacgcgaaaaaactacaaaatacgcgccgacgaaaaacttctcgttaaaaactaaaaaacaaacgtaaaaacccgtaactactcgaccccaccgtccaaccgcaaaacgaatactactccgtaaaaataacacgacgccaaaaacgacgcgaaactttctactaaaaaaaaataacgaaaaattcgaaaacgactattctatactaaaaaacaaaaaacactattctctcgaaacttcgcgtcgacgccgaaaaaaaattcgctcgctacctctacgtcctaaactcgacctctaactcctaaaaccgaaaacgcaaaaaaaaactaaaaccgatcgacccacgacccaaaacgccccctcgcgacctaaacaacgaccgccgcctaaaacgcaaaatttacgaaacccaaaaaacgccgacgcccgctctaaaacgtctctactactacgacgacgaaaataaaaacgacccaaaaaaccccctacaaccatcactaacaaccccatcaaaaatta

SEQ ID NO: 14489 - DNA, 687 bp, Artificial Sequence
  chemically treated genomic DNA (Homo sapiens) CpG-island No: 14489
ttcgatttcggtcgagtagaagaggttttttggtcggcgtggtattgttagtgtaggtggttgtagaggtcgagcgtttcggggtgtagcggtagtattttggcgtatacgatggtttcggttagttcgcgcggtagttttcgtttaggggtttttattcggagtgtagttggtaggcgcgtcgggcgttggggattcgttaggtagagcgcggcgagtagtacgtggcgtagtatgtcgggttttcggggcgtacggggcggcggcggggagttcggggagttcgtcggttcgggaagggtagttttgggcgttcggttgttcgggtcgttttcgggagttgagcgtatcgttgttttcgttacggggttcggtatgttcgttttggcgcgttacgttttaaaagggtttcggggattggatcgtcgggcgttcgtttttcgttttgtttttgcggttggggcgtgggcgggggaggggcggggagtcgggcgggtttcggcgtcggttggggcggggattagggattcggagaacgcggggacgtcgggatttagttttgaattggggatagtggtttagtaattttttggcgttttacgatggacgtggttcgagtttgttaggcgtaaagtttgtttgtaaacgtaaggtatttattaaagaatgatttttaatttgtacgat

SEQ ID NO: 14490 - DNA, 687 bp, Artificial Sequence
  chemically treated genomic DNA (Homo sapiens) CpG-island No: 14490
atcgtacaaattaaaaatcattctttaataaataccttacgtttacaaacaaactttacgcctaacaaactcgaaccacgtccatcgtaaaacgccaaaaaattactaaaccactatccccaattcaaaactaaatcccgacgtccccgcgttctccgaatccctaatccccgccccaaccgacgccgaaacccgcccgactccccgcccctcccccgcccacgccccaaccgcaaaaacaaaacgaaaaacgaacgcccgacgatccaatccccgaaacccttttaaaacgtaacgcgccaaaacgaacataccgaaccccgtaacgaaaacaacgatacgctcaactcccgaaaacgacccgaacaaccgaacgcccaaaactacccttcccgaaccgacgaactccccgaactccccgccgccgccccgtacgccccgaaaacccgacatactacgccacgtactactcgccgcgctctacctaacgaatccccaacgcccgacgcgcctaccaactacactccgaataaaaacccctaaacgaaaactaccgcgcgaactaaccgaaaccatcgtatacgccaaaatactaccgctacaccccgaaacgctcgacctctacaaccacctacactaacaataccacgccgaccaaaaaacctcttctactcgaccgaaatcgaa

SEQ ID NO: 14491 - DNA, 687 bp, Artificial Sequence
  chemically treated genomic DNA (Homo sapiens) CpG-island No: 14491
atcgtgtaaattaagagttattttttaatgaatgttttgcgtttgtaaataggttttacgtttggtaagttcggattacgtttatcgtggggcgttaggagattgttgggttattgtttttaatttagggttgggtttcggcgttttcgcgtttttcgagtttttggttttcgttttagtcggcgtcgggattcgttcgatttttcgtttttttttcgtttacgttttagtcgtaggggtagggcgggaggcgggcgttcggcggtttagttttcgggatttttttaaagcgtggcgcgttagggcgggtatgtcgagtttcgtggcggagatagcggtgcgtttagttttcgggagcggttcgagtagtcgagcgtttagggttgtttttttcgggtcggcgggtttttcgggtttttcgtcgtcgtttcgtgcgtttcgggagttcggtatgttgcgttacgtgttgttcgtcgcgttttgtttggcgggtttttagcgttcggcgcgtttgttagttgtatttcgagtggaggtttttgagcgagggttgtcgcgcgagttggtcgagattatcgtgtacgttagggtgttgtcgttgtatttcgaggcgttcggtttttataattatttgtattggtagtattacgtcggttagggggttttttttattcggtcgaggtcgag

SEQ ID NO: 14492 - DNA, 687 bp, Artificial Sequence
  chemically treated genomic DNA (Homo sapiens) CpG-island No: 14492
ctcgacctcgaccgaataaaaaaaaccccctaaccgacgtaatactaccaatacaaataattataaaaaccgaacgcctcgaaatacaacgacaacaccctaacgtacacgataatctcgaccaactcgcgcgacaaccctcgctcaaaaacctccactcgaaatacaactaacaaacgcgccgaacgctaaaaacccgccaaacaaaacgcgacgaacaacacgtaacgcaacataccgaactcccgaaacgcacgaaacgacgacgaaaaacccgaaaaacccgccgacccgaaaaaaacaaccctaaacgctcgactactcgaaccgctcccgaaaactaaacgcaccgctatctccgccacgaaactcgacatacccgccctaacgcgccacgctttaaaaaaatcccgaaaactaaaccgccgaacgcccgcctcccgccctacccctacgactaaaacgtaaacgaaaaaaaaacgaaaaatcgaacgaatcccgacgccgactaaaacgaaaaccaaaaactcgaaaaacgcgaaaacgccgaaacccaaccctaaattaaaaacaataacccaacaatctcctaacgccccacgataaacgtaatccgaacttaccaaacgtaaaacctatttacaaacgcaaaacattcattaaaaaataactcttaatttacacgat

SEQ ID NO: 14493 - DNA, 608 bp, Artificial Sequence
  chemically treated genomic DNA (Homo sapiens) CpG-island No: 14493
tttcgcgaatttttttcggcggtatttttaaatatatagcggcggatatataaagacgttcgcgagttagtattagtgtaggtattcgggtatatatagatatacgacgtaaggtttcggggattcggatggagtcgtagtgttttcggttcgggcggagagggttcgcgcgtaggggtagttgttttcgggtcgtttttatatcgggcgcgcggtttttaagtcgggagttggcgagttgaaagttcgggataattagcgttaattatatgtgtgtaaatagtcgcggtagagggcgcggtttaggtcgcgggcgttttttttttcggtttgattttggtagttttatcgtagtggaggggttttgttggcgtagttcgagtcgatcgttaggggagagcgcgtaggagtatttacgagattcgggaatcggggtgcgtcgttagtgtttagagttatcgagtttcgattatatacgcgggcgcgcgttgcggttcggtaatttcgggatggcgggttatagtcgggttagaggttgagtttagaattgggggtcgaatattcgttgtttttcgttgttttttagcggggatcgggcggggtggggt

SEQ ID NO: 14494 - DNA, 608 bp, Artificial Sequence
  chemically treated genomic DNA (Homo sapiens) CpG-island No: 14494
accccaccccgcccgatccccgctaaaaaacaacgaaaaacaacgaatattcgacccccaattctaaactcaacctctaacccgactataacccgccatcccgaaattaccgaaccgcaacgcgcgcccgcgtatataatcgaaactcgataactctaaacactaacgacgcaccccgattcccgaatctcgtaaatactcctacgcgctctcccctaacgatcgactcgaactacgccaacaaaacccctccactacgataaaactaccaaaatcaaaccgaaaaaaaaaacgcccgcgacctaaaccgcgccctctaccgcgactatttacacacatataattaacgctaattatcccgaactttcaactcgccaactcccgacttaaaaaccgcgcgcccgatataaaaacgacccgaaaacaactacccctacgcgcgaaccctctccgcccgaaccgaaaacactacgactccatccgaatccccgaaaccttacgtcgtatatctatatatacccgaatacctacactaatactaactcgcgaacgtctttatatatccgccgctatatatttaaaaataccgccgaaaaaaattcgcgaaa

SEQ ID NO: 14495 - DNA, 608 bp, Artificial Sequence
  chemically treated genomic DNA (Homo sapiens) CpG-island No: 14495
gttttatttcgttcggttttcgttgaagggtagcgaagggtagcgggtgttcggtttttagttttgggtttagtttttggttcgattgtaattcgttatttcgagattgtcgggtcgtaacgcgcgttcgcgtgtgtggtcggggttcggtggttttgggtattgacggcgtatttcgattttcgggtttcgtgggtgtttttgcgcgtttttttttagcggtcggttcgagttgcgttagtagagtttttttattgcggtgggattgttagggttaggtcgggggaggggacgttcgcggtttagatcgcgttttttgtcgcggttgtttgtatatatgtaattagcgttaattatttcgggtttttagttcgttagttttcggtttgagagtcgcgcgttcggtgtgagagcggttcgggagtagttgtttttacgcgcgagtttttttcgttcgggtcggggatattgcggttttattcgagttttcgggattttgcgtcgtgtatttgtgtgtgttcgagtgtttatattagtgttggttcgcgagcgtttttgtgtgttcgtcgttgtgtgtttgaagatgtcgtcggggaaggttcgcggga

SEQ ID NO: 14496 - DNA, 608 bp, Artificial Sequence
  chemically treated genomic DNA (Homo sapiens) CpG-island No: 14496
tcccgcgaaccttccccgacgacatcttcaaacacacaacgacgaacacacaaaaacgctcgcgaaccaacactaatataaacactcgaacacacacaaatacacgacgcaaaatcccgaaaactcgaataaaaccgcaatatccccgacccgaacgaaaaaaactcgcgcgtaaaaacaactactcccgaaccgctctcacaccgaacgcgcgactctcaaaccgaaaactaacgaactaaaaacccgaaataattaacgctaattacatatatacaaacaaccgcgacaaaaaacgcgatctaaaccgcgaacgtcccctcccccgacctaaccctaacaatcccaccgcaataaaaaaactctactaacgcaactcgaaccgaccgctaaaaaaaaacgcgcaaaaacacccacgaaacccgaaaatcgaaatacgccgtcaatacccaaaaccaccgaaccccgaccacacacgcgaacgcgcgttacgacccgacaatctcgaaataacgaattacaatcgaaccaaaaactaaacccaaaactaaaaaccgaacacccgctacccttcgctacccttcaacgaaaaccgaacgaaataaaac

SEQ ID NO: 14497 - DNA, 568 bp, Artificial Sequence
  chemically treated genomic DNA (Homo sapiens) CpG-island No: 14497
agaatatcgttcgttacgacgacgagggcggcggcgaggaggatatcgaggttttcgatatcgcggttatgtggaattttcgggaggcgtaggcgggggtcgtttttaagacgcggtaggatatgttgttcgagatcgagagtttttttcgttacgtgttttagacgtgcgtagtgaatagtattgtttatagttacgtgttggttaagttttacgaggtcgatatggatttgtgggtatcgtttttcgattttttttagacgtatatgttcgagggggacggttttgtggcggggtcgttgagttttttgtagtcggttacgtcggattcggaatagagtttcgattttttgacggattgggggtttcgttttcggaagttggtcgagttttacggggcgtcggagggattcgcgtcgttgtggtgacggaagttaggaggtaggcgcgcgtttaaatttagacgtttttcgcgggtgtttcgcggataaggtgtagttaattatacgagtaatattgtgttggagagtgagaatgggggtgagtaggcgaatagagttttttttgg

SEQ ID NO: 14498 - DNA, 568 bp, Artificial Sequence
  chemically treated genomic DNA (Homo sapiens) CpG-island No: 14498
ccaaaaaaaactctattcgcctactcacccccattctcactctccaacacaatattactcgtataattaactacaccttatccgcgaaacacccgcgaaaaacgtctaaatttaaacgcgcgcctacctcctaacttccgtcaccacaacgacgcgaatccctccgacgccccgtaaaactcgaccaacttccgaaaacgaaacccccaatccgtcaaaaaatcgaaactctattccgaatccgacgtaaccgactacaaaaaactcaacgaccccgccacaaaaccgtccccctcgaacatatacgtctaaaaaaaatcgaaaaacgatacccacaaatccatatcgacctcgtaaaacttaaccaacacgtaactataaacaatactattcactacgcacgtctaaaacacgtaacgaaaaaaactctcgatctcgaacaacatatcctaccgcgtcttaaaaacgacccccgcctacgcctcccgaaaattccacataaccgcgatatcgaaaacctcgatatcctcctcgccgccgccctcgtcgtcgtaacgaacgatattct

SEQ ID NO: 14499 - DNA, 568 bp, Artificial Sequence
  chemically treated genomic DNA (Homo sapiens) CpG-island No: 14499
ttagagagagttttgttcgtttgtttatttttatttttattttttagtatagtattgttcgtgtggttggttgtattttgttcgcgaagtattcgcggagaacgtttggatttggacgcgcgtttgttttttggttttcgttattatagcggcgcgggttttttcgacgtttcgtagagttcggttagttttcggaagcggggtttttagttcgttaggaagtcgaagttttgtttcgagttcgacgtggtcgattgtagggagtttagcgatttcgttatagagtcgtttttttcgaatatatacgtttggagggagtcgaagggcggtgtttataggtttatgtcggtttcgtagagtttggttagtacgtagttgtggatagtgttgtttattgcgtacgtttgaggtacgtagcgggagaggttttcgatttcgggtagtatgttttgtcgcgttttgggggcggttttcgtttgcgtttttcgggggttttatatggtcgcgatgtcgaaggtttcggtgtttttttcgtcgtcgttttcgtcgtcgtagcggacgatgtttt

SEQ ID NO: 14500 - DNA, 568 bp, Artificial Sequence
  chemically treated genomic DNA (Homo sapiens) CpG-island No: 14500
aaaacatcgtccgctacgacgacgaaaacgacgacgaaaaaaacaccgaaaccttcgacatcgcgaccatataaaacccccgaaaaacgcaaacgaaaaccgcccccaaaacgcgacaaaacatactacccgaaatcgaaaacctctcccgctacgtacctcaaacgtacgcaataaacaacactatccacaactacgtactaaccaaactctacgaaaccgacataaacctataaacaccgcccttcgactccctccaaacgtatatattcgaaaaaaacgactctataacgaaatcgctaaactccctacaatcgaccacgtcgaactcgaaacaaaacttcgacttcctaacgaactaaaaaccccgcttccgaaaactaaccgaactctacgaaacgtcgaaaaaacccgcgccgctataataacgaaaaccaaaaaacaaacgcgcgtccaaatccaaacgttctccgcgaatacttcgcgaacaaaatacaaccaaccacacgaacaatactatactaaaaaataaaaataaaaataaacaaacgaacaaaactctctctaa

SEQ ID NO: 14501 - DNA, 697 bp, Artificial Sequence
  chemically treated genomic DNA (Homo sapiens) CpG-island No: 14501
cgcgtgcgtagaggcggatcgtaaggttagggcgtgagggaagggcgggcgtacgtttttgcgtgcgttttaggtagcgcgtacgtcggcgtgagagggtacggggaaaaggtggttttggtcggggtggttcggttttttggggttatgtaattgagttcgtcgatttaggggttttttttcgttgttttcgtcgcgtgttagtagggagttttcgttcgggagagagattgtttttacgttcgttgcgttttttcgacggtagagtaggtttgttcgttcgtgggagcgtttcggtcgagaagttttgaggggggaggggaggttattttgtttcgatcgatttttcggaatcgggcggacgggttgggagaggttgcggagcgcggtcgtcgttttcggaggtattggacgtcgttattgtcggggtttttttaaagttgttcgtaggtcgttcgcgtcgtttcgagttttttttttacgttttttcggtttttcggtttgagaacgttcgagtgaggagttggtcgtagtgagagggatcgattttttggggtcgtcgcgcgagagttcgagtcgttttttttaatggcgaagaagacgtacgatttgttttttaagttgtttttgatcggggatttcggagtggggaagatttgcgttttttttcgtttttcggatgatgtttttaatatta

SEQ ID NO: 14502 - DNA, 697 bp, Artificial Sequence
  chemically treated genomic DNA (Homo sapiens) CpG-island No: 14502
taatattaaaaacatcatccgaaaaacgaaaaaaaacgcaaatcttccccactccgaaatccccgatcaaaaacaacttaaaaaacaaatcgtacgtcttcttcgccattaaaaaaaacgactcgaactctcgcgcgacgaccccaaaaaatcgatccctctcactacgaccaactcctcactcgaacgttctcaaaccgaaaaaccgaaaaaacgtaaaaaaaaaactcgaaacgacgcgaacgacctacgaacaactttaaaaaaaccccgacaataacgacgtccaatacctccgaaaacgacgaccgcgctccgcaacctctcccaacccgtccgcccgattccgaaaaatcgatcgaaacaaaataacctcccctcccccctcaaaacttctcgaccgaaacgctcccacgaacgaacaaacctactctaccgtcgaaaaaacgcaacgaacgtaaaaacaatctctctcccgaacgaaaactccctactaacacgcgacgaaaacaacgaaaaaaaacccctaaatcgacgaactcaattacataaccccaaaaaaccgaaccaccccgaccaaaaccaccttttccccgtaccctctcacgccgacgtacgcgctacctaaaacgcacgcaaaaacgtacgcccgcccttccctcacgccctaaccttacgatccgcctctacgcacgcg

SEQ ID NO: 14503 - DNA, 697 bp, Artificial Sequence
  chemically treated genomic DNA (Homo sapiens) CpG-island No: 14503
tagtattgaaggtattattcgaaaaacgaaaaaggacgtaggttttttttatttcggaattttcgattaggagtagtttgaaaagtaggtcgtacgtttttttcgttattgggaggagcggttcgggttttcgcgcggcggttttaagggatcggttttttttattacggttaattttttattcgggcgtttttaggtcggaggatcggggaagcgtgggaaaaaggttcgagacggcgcgggcgatttacgaatagttttgaggaagtttcgatagtggcggcgtttagtgttttcgagggcggcgatcgcgtttcgtagttttttttagttcgttcgttcggtttcggggagtcggtcgggataaaatggttttttttttttttttagggtttttcggtcgggacgtttttacgggcgagtaagtttgttttgtcgtcgaggaggcgtagcgggcgtgaggatagtttttttttcgagcggaaattttttgttagtacgcggcgagggtagcgaagaaggatttttaagtcgacgagtttagttatatagttttaggaaatcgagttatttcggttagagttatttttttttcgtgtttttttacgtcggcgtgcgcgttgtttgagacgtacgtaagggcgtacgttcgttttttttttacgttttagttttgcggttcgtttttgcgtacgcg

SEQ ID NO: 14504 - DNA, 697 bp, Artificial Sequence
  chemically treated genomic DNA (Homo sapiens) CpG-island No: 14504
cgcgtacgcaaaaacgaaccgcaaaactaaaacgtaaaaaaaaaacgaacgtacgcccttacgtacgtctcaaacaacgcgcacgccgacgtaaaaaaacacgaaaaaaaaataactctaaccgaaataactcgatttcctaaaactatataactaaactcgtcgacttaaaaatccttcttcgctaccctcgccgcgtactaacaaaaaatttccgctcgaaaaaaaaactatcctcacgcccgctacgcctcctcgacgacaaaacaaacttactcgcccgtaaaaacgtcccgaccgaaaaaccctaaaaaaaaaaaaaaaaccattttatcccgaccgactccccgaaaccgaacgaacgaactaaaaaaaactacgaaacgcgatcgccgccctcgaaaacactaaacgccgccactatcgaaacttcctcaaaactattcgtaaatcgcccgcgccgtctcgaacctttttcccacgcttccccgatcctccgacctaaaaacgcccgaataaaaaattaaccgtaataaaaaaaaccgatcccttaaaaccgccgcgcgaaaacccgaaccgctcctcccaataacgaaaaaaacgtacgacctacttttcaaactactcctaatcgaaaattccgaaataaaaaaaacctacgtcctttttcgtttttcgaataataccttcaatacta

SEQ ID NO: 14505 - DNA, 702 bp, Artificial Sequence
  chemically treated genomic DNA (Homo sapiens) CpG-island No: 14505
tttttcgtttttacgtagtttgttttttcgtgtcggtggttgggtcgcggtcgggtcgtttgtttttttcgatatacgcgttagcgttatgtgtttcgtcgtcgttgttttttttcggttttttattgttcgtcgttagtttgcgtcgtcggcgttcgtgttttttcggttttttgggtggtcgtggttagcgcgtgcgttgatttttgtttacgtcgggtagttgtttttttcgggagggatagtaatcgatacgaaggtagagcgacgggcggtagggttagataggagtagaggagtagcgggagacgcggcggcggacgtagggtagacgtagaaagcgcgacgtgaggacgcgcgataggaagatcgacgagggtagaaggagcgcggcgcggaagagagtacgcggggcgcgaggaggagtaggaaggaggggggagagtcgcggagagagtagagagagagagaggagtagaagcgaaaacgttaggggatgaaataaaacgatcggtaagaattataagaaatacgagatttaagacgagaggattttagggagatgcgaatagcgggttattagatgtagatggtcgcggtaacgtgagtaggtaaggcggttataaaagagtttaatcgtataaaggttgataaagagagagttgtttttaaagggatcgttgttgtacgaggaattaagga

SEQ ID NO: 14506 - DNA, 702 bp, Artificial Sequence
  chemically treated genomic DNA (Homo sapiens) CpG-island No: 14506
tccttaattcctcgtacaacaacgatccctttaaaaacaactctctctttatcaacctttatacgattaaactcttttataaccgccttacctactcacgttaccgcgaccatctacatctaataacccgctattcgcatctccctaaaatcctctcgtcttaaatctcgtatttcttataattcttaccgatcgttttatttcatcccctaacgttttcgcttctactcctctctctctctctactctctccgcgactctcccccctccttcctactcctcctcgcgccccgcgtactctcttccgcgccgcgctccttctaccctcgtcgatcttcctatcgcgcgtcctcacgtcgcgctttctacgtctaccctacgtccgccgccgcgtctcccgctactcctctactcctatctaaccctaccgcccgtcgctctaccttcgtatcgattactatccctcccgaaaaaaacaactacccgacgtaaacaaaaatcaacgcacgcgctaaccacgaccacccaaaaaaccgaaaaaacacgaacgccgacgacgcaaactaacgacgaacaataaaaaaccgaaaaaaaacaacgacgacgaaacacataacgctaacgcgtatatcgaaaaaaacaaacgacccgaccgcgacccaaccaccgacacgaaaaaacaaactacgtaaaaacgaaaaa

SEQ ID NO: 14507 - DNA, 702 bp, Artificial Sequence
  chemically treated genomic DNA (Homo sapiens) CpG-island No: 14507
tttttagtttttcgtgtaataacggtttttttagggataattttttttttgttagtttttatgcggttgagtttttttatggtcgttttgtttgtttacgttatcgcggttatttgtatttaataattcgttattcgtatttttttgggattttttcgttttgggtttcgtgttttttgtggtttttgtcggtcgttttgttttattttttgacgttttcgtttttatttttttttttttttttgtttttttcgcggttttttttttttttttttgttttttttcgcgtttcgcgtgttttttttcgcgtcgcgttttttttgttttcgtcggtttttttatcgcgcgtttttacgtcgcgttttttgcgtttgttttgcgttcgtcgtcgcgtttttcgttgtttttttgtttttgtttggttttgtcgttcgtcgttttgttttcgtgtcggttgttgtttttttcgagggaggtagttgttcgacgtaagtaaggattagcgtacgcgttggttacgattatttaggggatcgggaagatacgggcgtcgacggcgtaggttggcggcgggtagtgagaggtcggaagaagatagcggcgacggggtatatgacgttggcgcgtgtatcggaaagggtaggcggttcgatcgcgatttagttatcggtacgggaaggtagattgcgtgagagcgaaaga

SEQ ID NO: 14508 - DNA, 702 bp, Artificial Sequence
  chemically treated genomic DNA (Homo sapiens) CpG-island No: 14508
tctttcgctctcacgcaatctaccttcccgtaccgataactaaatcgcgatcgaaccgcctaccctttccgatacacgcgccaacgtcatataccccgtcgccgctatcttcttccgacctctcactacccgccgccaacctacgccgtcgacgcccgtatcttcccgatcccctaaataatcgtaaccaacgcgtacgctaatccttacttacgtcgaacaactacctccctcgaaaaaaacaacaaccgacacgaaaacaaaacgacgaacgacaaaaccaaacaaaaacaaaaaaacaacgaaaaacgcgacgacgaacgcaaaacaaacgcaaaaaacgcgacgtaaaaacgcgcgataaaaaaaccgacgaaaacaaaaaaaacgcgacgcgaaaaaaaacacgcgaaacgcgaaaaaaaacaaaaaaaaaaaaaaaaaaccgcgaaaaaaacaaaaaaaaaaaaaaaaataaaaacgaaaacgtcaaaaaataaaacaaaacgaccgacaaaaaccacaaaaaacacgaaacccaaaacgaaaaaatcccaaaaaaatacgaataacgaattattaaatacaaataaccgcgataacgtaaacaaacaaaacgaccataaaaaaactcaaccgcataaaaactaacaaaaaaaaaattatccctaaaaaaaccgttattacacgaaaaactaaaaa

SEQ ID NO: 14509 - DNA, 721 bp, Artificial Sequence
  chemically treated genomic DNA (Homo sapiens) CpG-island No: 14509
tttcgtattttattttatttcgttacgatcgttggttcgtatttatttatcgtttcgtttatattatgtttttttttatgtattgttttttggacggttgtatttgatttacgttagcgttttttttttttttacgtcgattcgcgttcgttaaattttcggcgttcggtttgtcgtttatgtgtcgtgtttgttgttttttattttagcggtttttcgttttcgttttgtcgcgggtcgttcgttttttattttttatacgttgtttttttcgttcgtcgtatattcgtttttttttcgttattttttgtcgttcgttttttttttcgtcgcgcgtgggcgcgtttcggttttttattgtgtgcgggggggtatttgcgcgttttcgttcgcgttattcgtgtttgtttttttttgttgcgttgcgttcgtttcgttttcgttagtcgtttcggtgttttgtgcggatcgtttttttgtatatatttttgcggttttttttttcgggtggttgttttgtagcgtgtcgtttttgttttcgcgttttgtgttttgttgtttttgttgtacgtcggtcgcgtagtgagtatttgttgcgtttttacgttttttttcgtgtcggttttgcgcgagacggtaataaggattagcgtgaataatagaacgaaaaagtaggtgtcgatagataagtaagtaacgtttgcgattagttttttaagta

SEQ ID NO: 14510 - DNA, 721 bp, Artificial Sequence
  chemically treated genomic DNA (Homo sapiens) CpG-island No: 14510
tacttaaaaaactaatcgcaaacgttacttacttatctatcgacacctactttttcgttctattattcacgctaatccttattaccgtctcgcgcaaaaccgacacgaaaaaaaacgtaaaaacgcaacaaatactcactacgcgaccgacgtacaacaaaaacaacaaaacacaaaacgcgaaaacaaaaacgacacgctacaaaacaaccacccgaaaaaaaaaaccgcaaaaatatatacaaaaaaacgatccgcacaaaacaccgaaacgactaacgaaaacgaaacgaacgcaacgcaacaaaaaaaaacaaacacgaataacgcgaacgaaaacgcgcaaatacccccccgcacacaataaaaaaccgaaacgcgcccacgcgcgacgaaaaaaaaaacgaacgacaaaaaataacgaaaaaaaaacgaatatacgacgaacgaaaaaaacaacgtataaaaaataaaaaacgaacgacccgcgacaaaacgaaaacgaaaaaccgctaaaataaaaaacaacaaacacgacacataaacgacaaaccgaacgccgaaaatttaacgaacgcgaatcgacgtaaaaaaaaaaaaaacgctaacgtaaatcaaatacaaccgtccaaaaaacaatacataaaaaaaaacataatataaacgaaacgataaataaatacgaaccaacgatcgtaacgaaataaaataaaatacgaaa

SEQ ID NO: 14511 - DNA, 721 bp, Artificial Sequence
  chemically treated genomic DNA (Homo sapiens) CpG-island No: 14511
tatttaggggattgatcgtaaacgttgtttgtttgtttgtcgatatttgttttttcgttttattgtttacgttagtttttgttgtcgtttcgcgtagagtcgatacggagaggagcgtagaggcgtagtagatgtttattgcgcggtcggcgtgtaataggagtagtagggtatagagcgcgagagtaggggcggtacgttgtagagtagttattcggaggggagaatcgtaagagtgtgtgtaagagggcgattcgtatagaatatcgaggcgattagcgaaagcgaggcgagcgtagcgtagtaggggagagtaagtacgaatagcgcgggcggggacgcgtagatgttttttcgtatatagtgaggaatcgagacgcgtttacgcgcggcggaggggggggcgggcgatagaggatgacgagagggaagcgggtatacgacgagcgggggagatagcgtgtgaaaggtgggaggcgggcggttcgcgatagggcgagagcggggggtcgttggggtggggggtagtaggtacggtatatgggcgataggtcgagcgtcgagagtttgacgggcgcggatcggcgtgaggagaggagagacgttggcgtagattaggtatagtcgtttagaagataatgtatgagaggggatatggtgtgggcgaaacgatgggtaggtgcgaattagcggtcgtggcgaagtgaggtagggtgcggga

SEQ ID NO: 14512 - DNA, 721 bp, Artificial Sequence
  chemically treated genomic DNA (Homo sapiens) CpG-island No: 14512
tcccgcaccctacctcacttcgccacgaccgctaattcgcacctacccatcgtttcgcccacaccatatcccctctcatacattatcttctaaacgactatacctaatctacgccaacgtctctcctctcctcacgccgatccgcgcccgtcaaactctcgacgctcgacctatcgcccatataccgtacctactaccccccaccccaacgaccccccgctctcgccctatcgcgaaccgcccgcctcccacctttcacacgctatctcccccgctcgtcgtatacccgcttccctctcgtcatcctctatcgcccgcccccccctccgccgcgcgtaaacgcgtctcgattcctcactatatacgaaaaaacatctacgcgtccccgcccgcgctattcgtacttactctcccctactacgctacgctcgcctcgctttcgctaatcgcctcgatattctatacgaatcgccctcttacacacactcttacgattctcccctccgaataactactctacaacgtaccgcccctactctcgcgctctataccctactactcctattacacgccgaccgcgcaataaacatctactacgcctctacgctcctctccgtatcgactctacgcgaaacgacaacaaaaactaacgtaaacaataaaacgaaaaaacaaatatcgacaaacaaacaaacaacgtttacgatcaatcccctaaata

SEQ ID NO: 14513 - DNA, 741 bp, Artificial Sequence
  chemically treated genomic DNA (Homo sapiens) CpG-island No: 14513
gtttgcgtaggtggttggatacgtcgcgattgttgcgcgcgggacggttttttggttttcgtttcggtgggttttttggggtttttttagttcggttgggttcgttttacgggttgtaagttcgcgataggcgcgttttgttttcggaatagattgtatattttggttgtagtcgttgtcgggtagttgtttttagggcgtcgtagtcgattcgcgtttttattagtcggttcgtatttttttacggggtttttttgggtatgattcgcgtttacgaagagagttagggtgagcggtaggaagtttttttaggggtttcgtagggcgcgtttcgggttgcgggttttggttcgcggttttatggcgcggggcggttggagagtggtgcgcgcgggtatcgcgaagagttttgtggtcggtacgttggacgttcgcgggttgttttttcggtttcgttcggcggttagtttttttgagtttagggggttttgaagcggtcgattgggggttcggttttcggcggaacgagggttgcgcgtttcgagtttcgagttcgcgtttttattttagttgggttcgtacggttgttgtattttcgcgttttttttttgtgtttgtagtcgtttgaaggggattcggacggttttatttttggaaatttttttcggttttttcgttttttttatttatattaggtttttttttcggagggatagtttagtttttttattatcggagagg

SEQ ID NO: 14514 - DNA, 741 bp, Artificial Sequence
  chemically treated genomic DNA (Homo sapiens) CpG-island No: 14514
cctctccgataataaaaaaactaaactatccctccgaaaaaaaaacctaatataaataaaaaaaacgaaaaaaccgaaaaaaatttccaaaaataaaaccgtccgaatccccttcaaacgactacaaacacaaaaaaaaaacgcgaaaatacaacaaccgtacgaacccaactaaaataaaaacgcgaactcgaaactcgaaacgcgcaaccctcgttccgccgaaaaccgaacccccaatcgaccgcttcaaaaccccctaaactcaaaaaaactaaccgccgaacgaaaccgaaaaaacaacccgcgaacgtccaacgtaccgaccacaaaactcttcgcgatacccgcgcgcaccactctccaaccgccccgcgccataaaaccgcgaaccaaaacccgcaacccgaaacgcgccctacgaaacccctaaaaaaacttcctaccgctcaccctaactctcttcgtaaacgcgaatcatacccaaaaaaaccccgtaaaaaaatacgaaccgactaataaaaacgcgaatcgactacgacgccctaaaaacaactacccgacaacgactacaaccaaaatatacaatctattccgaaaacaaaacgcgcctatcgcgaacttacaacccgtaaaacgaacccaaccgaactaaaaaaaccccaaaaaacccaccgaaacgaaaaccaaaaaaccgtcccgcgcgcaacaatcgcgacgtatccaaccacctacgcaaac

SEQ ID NO: 14515 - DNA, 741 bp, Artificial Sequence
  chemically treated genomic DNA (Homo sapiens) CpG-island No: 14515
ttttttcggtaatgagggggttgagttgttttttcgaggagggggtttggtgtggataaaagagacgaaaaagtcgggggaggtttttaaaaataaaatcgttcgggttttttttagacggttgtaggtatagggaggaggcgcgaaggtgtagtagtcgtgcgagtttagttggagtaggagcgcggattcgaggttcggggcgcgtagttttcgtttcgtcgagagtcgggtttttagtcggtcgttttagggttttttagatttagagaagttggtcgtcgggcggggtcgggagaatagttcgcgggcgtttagcgtgtcgattataaagtttttcgcggtgttcgcgcgtattattttttagtcgtttcgcgttatgaggtcgcggattaaagttcgtagttcggggcgcgttttgcggaatttttggagaggttttttgtcgtttattttggtttttttcgtgggcgcgggttatgtttaaagggatttcgtagggagatacgagtcggttggtggagacgcgaatcgattgcggcgttttgggggtagttattcggtagcggttgtagttaaggtgtatagtttgtttcgggagtaggacgcgtttgtcgcgggtttgtagttcgtggagcgggtttagtcgggttgggggagttttaggaggtttatcgaggcggaggttaggaggtcgtttcgcgcgtagtagtcgcggcgtgtttagttatttgcgtagat

SEQ ID NO: 14516 - DNA, 741 bp, Artificial Sequence
  chemically treated genomic DNA (Homo sapiens) CpG-island No: 14516
atctacgcaaataactaaacacgccgcgactactacgcgcgaaacgacctcctaacctccgcctcgataaacctcctaaaactcccccaacccgactaaacccgctccacgaactacaaacccgcgacaaacgcgtcctactcccgaaacaaactatacaccttaactacaaccgctaccgaataactacccccaaaacgccgcaatcgattcgcgtctccaccaaccgactcgtatctccctacgaaatccctttaaacataacccgcgcccacgaaaaaaaccaaaataaacgacaaaaaacctctccaaaaattccgcaaaacgcgccccgaactacgaactttaatccgcgacctcataacgcgaaacgactaaaaaataatacgcgcgaacaccgcgaaaaactttataatcgacacgctaaacgcccgcgaactattctcccgaccccgcccgacgaccaacttctctaaatctaaaaaaccctaaaacgaccgactaaaaacccgactctcgacgaaacgaaaactacgcgccccgaacctcgaatccgcgctcctactccaactaaactcgcacgactactacaccttcgcgcctcctccctatacctacaaccgtctaaaaaaaacccgaacgattttatttttaaaaacctcccccgactttttcgtctcttttatccacaccaaaccccctcctcgaaaaaacaactcaaccccctcattaccgaaaaaa

SEQ ID NO: 14517 - DNA, 564 bp, Artificial Sequence
  chemically treated genomic DNA (Homo sapiens) CpG-island No: 14517
ggcgagcgggcggcgagggggattaattcgtgcggagtagggggcggcgcggggttgatttaggcgttggtcgggtagatggcgtttgttacgatcgggatattgggtcgttttttttttgttttgggtaagttcgaattgtagatttgtttcgaatcgttttttcgtttttcgttttagggatcgtttttggatcgggggatttaggttgtagttttgtaggtttgaaggaagtcgggaggggcgttgaggttcgcgtaagggaatagggtcgtcgtttttttcgtttgcgttttggtcgttgggggcgtttttcgtagggtcggtcggagcgggggtggcgcggggcggggcgcggcgcgcggagcgtagggaggtttcgggcgcgttttttggcggagttggcggttttggcgtttcgtggttgtaatgttttggcgtcgtcgttttcgttttggattttaatttttttttattggcgtgagggttacgtttgagtttggcgcggtgatggttgtcggtagaagaggggtttttttttttttttttttttttttttttttt

SEQ ID NO: 14518 - DNA, 564 bp, Artificial Sequence
  chemically treated genomic DNA (Homo sapiens) CpG-island No: 14518
aaaaaaaaaaaaaaaaaaaaaaaaaaaaaaaacccctcttctaccgacaaccatcaccgcgccaaactcaaacgtaaccctcacgccaataaaaaaaaattaaaatccaaaacgaaaacgacgacgccaaaacattacaaccacgaaacgccaaaaccgccaactccgccaaaaaacgcgcccgaaacctccctacgctccgcgcgccgcgccccgccccgcgccacccccgctccgaccgaccctacgaaaaacgcccccaacgaccaaaacgcaaacgaaaaaaacgacgaccctattcccttacgcgaacctcaacgcccctcccgacttccttcaaacctacaaaactacaacctaaatcccccgatccaaaaacgatccctaaaacgaaaaacgaaaaaacgattcgaaacaaatctacaattcgaacttacccaaaacaaaaaaaaaacgacccaatatcccgatcgtaacaaacgccatctacccgaccaacgcctaaatcaaccccgcgccgccccctactccgcacgaattaatccccctcgccgcccgctcgcc

SEQ ID NO: 14519 - DNA, 564 bp, Artificial Sequence
  chemically treated genomic DNA (Homo sapiens) CpG-island No: 14519
gaaagaaaagaaaaagaaaaagaaaaagaggattttttttttatcggtagttattatcgcgttaggtttaggcgtgatttttacgttagtggaaggggattgagatttagagcgaaggcggcggcgttagggtattgtagttacggagcgttagggtcgttagtttcgttagggggcgcgttcgggatttttttgcgtttcgcgcgtcgcgtttcgtttcgcgttattttcgtttcggtcggttttgcggagggcgtttttagcggttagggcgtaagcggagggggcggcggttttgtttttttacgcgggttttagcgtttttttcggttttttttagatttgtaaggttgtagtttgggtttttcgatttaaagacggtttttgaggcgaggggcgggagaacgattcggggtaggtttgtagttcgaatttgtttagagtaggagaaaggcggtttagtgtttcggtcgtggtaggcgttatttgttcgattagcgtttgggttagtttcgcgtcgttttttgtttcgtacgggttaatttttttcgtcgttcgttcgtt

SEQ ID NO: 14520 - DNA, 564 bp, Artificial Sequence
  chemically treated genomic DNA (Homo sapiens) CpG-island No: 14520
aacgaacgaacgacgaaaaaaattaacccgtacgaaacaaaaaacgacgcgaaactaacccaaacgctaatcgaacaaataacgcctaccacgaccgaaacactaaaccgcctttctcctactctaaacaaattcgaactacaaacctaccccgaatcgttctcccgcccctcgcctcaaaaaccgtctttaaatcgaaaaacccaaactacaaccttacaaatctaaaaaaaaccgaaaaaaacgctaaaacccgcgtaaaaaaacaaaaccgccgccccctccgcttacgccctaaccgctaaaaacgccctccgcaaaaccgaccgaaacgaaaataacgcgaaacgaaacgcgacgcgcgaaacgcaaaaaaatcccgaacgcgccccctaacgaaactaacgaccctaacgctccgtaactacaataccctaacgccgccgccttcgctctaaatctcaatccccttccactaacgtaaaaatcacgcctaaacctaacgcgataataactaccgataaaaaaaaaatcctctttttctttttctttttcttttctttc

SEQ ID NO: 14521 - DNA, 767 bp, Artificial Sequence
  chemically treated genomic DNA (Homo sapiens) CpG-island No: 14521
atttttcgtagttaggttttcggatcgaagattatatttattttcgttttcgatgttttagtattttttttttcgttcgagtgttttatttcgaggattattttgcgtatgcgtttagtttttggaggtaagcggttgtgtgcgggtggtcgcggtgagtgtgtaaggtcgcggtggtcgcgtgataagtttgcgttattagtgcgttcgtcggttaggagaacggagtttgtgatagattttttcgtaatattaagtattgtattaggatttgcggtttcgttttagaggtcgttatttttttgattattcgaaaggtcggatttatttttcggtgtattttgggattagggcggggttttgagcgtcgttatgtttttgtacggtaggatcgtaaagtacgtcgggatcggttggtttggttttgaagacgtggatggcgggaattttcgtttttggtttgggtgagttagaagggagaaggtaggggaaagatttattgtcggatcggatcgtggttagggtggcgggttgaacggtttttttaaaatttttttcgtggtcgggaagttcgttggattagagtagtcgtggtttcgggagcgcgtcggggtcgcgggatgggcgcgggggtgggtatggattttgttggttcggacgatgggagagggcgggcggtttaggaaaggggattttagtcgtgatatttgtgttattcgcggtttaggggttgtgtttgagtggtgtgtgttttgtcgtttgggttt

SEQ ID NO: 14522 - DNA, 767 bp, Artificial Sequence
  chemically treated genomic DNA (Homo sapiens) CpG-island No: 14522
aaacccaaacgacaaaacacacaccactcaaacacaacccctaaaccgcgaataacacaaatatcacgactaaaatcccctttcctaaaccgcccgccctctcccatcgtccgaaccaacaaaatccatacccacccccgcgcccatcccgcgaccccgacgcgctcccgaaaccacgactactctaatccaacgaacttcccgaccacgaaaaaaattttaaaaaaaccgttcaacccgccaccctaaccacgatccgatccgacaataaatctttcccctaccttctcccttctaactcacccaaaccaaaaacgaaaattcccgccatccacgtcttcaaaaccaaaccaaccgatcccgacgtactttacgatcctaccgtacaaaaacataacgacgctcaaaaccccgccctaatcccaaaatacaccgaaaaataaatccgacctttcgaataatcaaaaaaataacgacctctaaaacgaaaccgcaaatcctaatacaatacttaatattacgaaaaaatctatcacaaactccgttctcctaaccgacgaacgcactaataacgcaaacttatcacgcgaccaccgcgaccttacacactcaccgcgaccacccgcacacaaccgcttacctccaaaaactaaacgcatacgcaaaataatcctcgaaataaaacactcgaacgaaaaaaaaaatactaaaacatcgaaaacgaaaataaatataatcttcgatccgaaaacctaactacgaaaaat

SEQ ID NO: 14523 - DNA, 767 bp, Artificial Sequence
  chemically treated genomic DNA (Homo sapiens) CpG-island No: 14523
aaatttagacggtagggtatatattatttaggtataatttttgggtcgcggatgatataaatgttacggttaggatttttttttttgagtcgttcgtttttttttatcgttcgagttagtagagtttatgtttattttcgcgtttatttcgcggtttcggcgcgttttcgaggttacggttattttggtttagcgggtttttcggttacggaaggagttttaagaaggtcgtttagttcgttattttggttacggttcggttcgataatgggttttttttttatttttttttttttagtttatttaggttagaagcgagaattttcgttatttacgtttttaaaattaaattaatcggtttcggcgtgttttgcgattttgtcgtataaaagtatggcggcgtttagggtttcgttttgattttaagatgtatcggggagtaggttcggtttttcgggtggttaggaagatggcggtttttggggcggagtcgtaggttttggtataatatttggtgttacgaaaggatttattataagtttcgtttttttggtcggcgggcgtattggtagcgtaggtttgttacgcggttatcgcggttttgtatatttatcgcgattattcgtatatagtcgtttatttttaagagttgggcgtatgcgtaaagtggttttcgaggtgaggtattcgggcggagggggaggtgttgagatatcgagggcggaagtgggtgtggttttcggttcgaaggtttggttgcggggagt

SEQ ID NO: 14524 - DNA, 767 bp, Artificial Sequence
  chemically treated genomic DNA (Homo sapiens) CpG-island No: 14524
actccccgcaaccaaaccttcgaaccgaaaaccacacccacttccgccctcgatatctcaacacctccccctccgcccgaatacctcacctcgaaaaccactttacgcatacgcccaactcttaaaaataaacgactatatacgaataatcgcgataaatatacaaaaccgcgataaccgcgtaacaaacctacgctaccaatacgcccgccgaccaaaaaaacgaaacttataataaatcctttcgtaacaccaaatattataccaaaacctacgactccgccccaaaaaccgccatcttcctaaccacccgaaaaaccgaacctactccccgatacatcttaaaatcaaaacgaaaccctaaacgccgccatacttttatacgacaaaatcgcaaaacacgccgaaaccgattaatttaattttaaaaacgtaaataacgaaaattctcgcttctaacctaaataaactaaaaaaaaaaaaataaaaaaaaaacccattatcgaaccgaaccgtaaccaaaataacgaactaaacgaccttcttaaaactccttccgtaaccgaaaaacccgctaaaccaaaataaccgtaacctcgaaaacgcgccgaaaccgcgaaataaacgcgaaaataaacataaactctactaactcgaacgataaaaaaaaacgaacgactcaaaaaaaaaaatcctaaccgtaacatttatatcatccgcgacccaaaaattatacctaaataatatataccctaccgtctaaattt

SEQ ID NO: 14525 - DNA, 648 bp, Artificial Sequence
  chemically treated genomic DNA (Homo sapiens) CpG-island No: 14525
tcgttatgttttttgtagagtaatgggtggttatggtcgatggcgtttatgtcgttgttttttttgtagagcgatgggtggttatggtcgatggcgtttatgtcgttgttttttttgtagagcgatgggtggtcgtggtcgatggcgttcgtgtcgttgttttttttgtagagcgatgggtggtcgtggtcgatggcgttcgtgtcgttgttttttttgtagagcgatgggtggtcgtggcgatggcgttcgtgtcgttgttttttttgtagagcgatgggtggtcgtggcgatggcgttcgtgtcgttgttttttttgtagagcgatgggtggtcgtggcgatggcgttcgtgtcgttgttttttttgtagagcgatgggtggtcgtggtcgatggcgttcgtgtcgttgttttttttgtagagcgatgggtggtcgtggcgatggcgttcgtgtcgttgttttttttgtagagcgatgggtggtcgtgtcgatggcgttcgtgtcgttgttttttttgtagagcgatgggtggtcgtgtcgatggcgttcgtgtcgttgttttttttgtagagcgatgggtggtcgtgtcgatggcgttcgtgtcgttattttttttgttttcgtgtatgtttgaatatttttata

SEQ ID NO: 14526 - DNA, 648 bp, Artificial Sequence
  chemically treated genomic DNA (Homo sapiens) CpG-island No: 14526
tataaaaatattcaaacatacacgaaaacaaaaaaaataacgacacgaacgccatcgacacgaccacccatcgctctacaaaaaaaacaacgacacgaacgccatcgacacgaccacccatcgctctacaaaaaaaacaacgacacgaacgccatcgacacgaccacccatcgctctacaaaaaaaacaacgacacgaacgccatcgccacgaccacccatcgctctacaaaaaaaacaacgacacgaacgccatcgaccacgaccacccatcgctctacaaaaaaaacaacgacacgaacgccatcgccacgaccacccatcgctctacaaaaaaaacaacgacacgaacgccatcgccacgaccacccatcgctctacaaaaaaaacaacgacacgaacgccatcgccacgaccacccatcgctctacaaaaaaaacaacgacacgaacgccatcgaccacgaccacccatcgctctacaaaaaaaacaacgacacgaacgccatcgaccacgaccacccatcgctctacaaaaaaaacaacgacataaacgccatcgaccataaccacccatcgctctacaaaaaaaacaacgacataaacgccatcgaccataaccacccattactctacaaaaaacataacga

SEQ ID NO: 14527 - DNA, 648 bp, Artificial Sequence
  chemically treated genomic DNA (Homo sapiens) CpG-island No: 14527
tatagaaatgtttaaatatatacgaaagtagagaagataacggtacggacgttatcggtacggttatttatcgttttgtagagaagataacggtacggacgttatcggtacggttatttatcgttttgtagagaagataacggtacggacgttatcggtacggttatttatcgttttgtagagaagataacggtacggacgttatcgttacggttatttatcgttttgtagagaagataacggtacggacgttatcggttacggttatttatcgttttgtagagaagataacggtacggacgttatcgttacggttatttatcgttttgtagagaagataacggtacggacgttatcgttacggttatttatcgttttgtagagaagataacggtacggacgttatcgttacggttatttatcgttttgtagagaagataacggtacggacgttatcggttacggttatttatcgttttgtagagaagataacggtacggacgttatcggttacggttatttatcgttttgtagagaagataacggtatggacgttatcggttatggttatttatcgttttgtagagaagataacggtatggacgttatcggttatggttatttattattttgtagagaatataacgg

SEQ ID NO: 14528 - DNA, 648 bp, Artificial Sequence
  chemically treated genomic DNA (Homo sapiens) CpG-island No: 14528
ccgttatattctctacaaaataataaataaccataaccgataacgtccataccgttatcttctctacaaaacgataaataaccataaccgataacgtccataccgttatcttctctacaaaacgataaataaccgtaaccgataacgtccgtaccgttatcttctctacaaaacgataaataaccgtaaccgataacgtccgtaccgttatcttctctacaaaacgataaataaccgtaacgataacgtccgtaccgttatcttctctacaaaacgataaataaccgtaacgataacgtccgtaccgttatcttctctacaaaacgataaataaccgtaacgataacgtccgtaccgttatcttctctacaaaacgataaataaccgtaaccgataacgtccgtaccgttatcttctctacaaaacgataaataaccgtaacgataacgtccgtaccgttatcttctctacaaaacgataaataaccgtaccgataacgtccgtaccgttatcttctctacaaaacgataaataaccgtaccgataacgtccgtaccgttatcttctctacaaaacgataaataaccgtaccgataacgtccgtaccgttatcttctctactttcgtatatatttaaacatttctata

SEQ ID NO: 14529 - DNA, 1898 bp, Artificial Sequence
  chemically treated genomic DNA (Homo sapiens) CpG-island No: 14529
gtcgggaaagacgcggtgttcgagtttagtttagttgaggtttgcgtatcgtcgggaaagacgcggggttcgagattagtttagttgaggtttgcgtatcgtcgggaaagatttagagttcgagattagtttagttgaggtttgcgtatcgtcgggaaagacgcggtgttcgagtttagtttagttgaggtttgcgtatcgtcgggaaagacgcggggttcgagattagtttagttgaggtttgcgtattatcgggaaagacgcggggttcgagattagtttagttgaggtttgcgtatcgtcgggaaagacgcggggttcgagattagtttagttgaggtttgcgtatcgtcgggaaagacgcggggttcgagattagtttagttgaggtttgcgtatcgtcgggaaagatttagagttcgagtttagtttagttgaggtttgcgtatcgtcgggaaagacgcggggtttaagtgtagtttagttgaggtttgcgtatcgtcgggaaagacgcggtgttcgagtttagtttagttgaggtttgcgtatcgtcgggaaagacgcggggtttaagtgtagtttagttgaggtttgcgtatcgtcgggaaagacgcggggttcgagattagtttagttgaggtttgcgtatcgtcgggaaagacgcggggttcgagtttagtttagttgaggtttgtatagcgtcgggaaagacgtagagttagtttagtttagttggggtttgcgtatcgtcgggaaagacgtagagttcgagattagtttagttgggtttgcgtatcgtcgggaaagacgtagagttcgagattagtttagttggggtttgcgtatcgtcgggaaagacgtagagttcgagattagtttagttggggtttgcgtatcgtacgggaaagacgcggggttcgagtttagtttagttgaggtttgcgtatcgcgggaaagacgcggtgttcgagattagtttagttgaggtttgcgtatcgtcgggaaagacgcggggtttaagtgtagtttagttgaggtttgcgtatcgtcgggaaagatttagagttcgagattagtttagttgaggtttgcgtatcgtcgggaaagacgcggggtttaagtgtagtttagttgaggtttgcgtatcgtcgggaaagacgtagagttcgagattagtttagttggggtttgcgtatcgtcgggaaagacgtagagttcgagattagtttagttgaggtttgcgtatcgtcgggaaagacgcggggttcgagtttagtttagttgaggtttgcgtatcgtcgggaaagacggagagttcgagtttagtttagttgaggtttgcgtatcgtcgggaaagacgcggggttcgagtttagtttagttgaggtttgcgtatcgtcgggaaagacgcggggttcgagtttagtttagttgaggtttgcgtatcgtcgggaaagatttagagttcgagtttagtttagttgaggtttgcgtatcgtcgggaaagacgcggggttcgagtttagtttagttgaggtttgcgtatcgtcgggaaagacgcggtgttcgagattagtttagttgaggtttgcgtatcgtcgggaaagacgcggggttcgagtttagtttagttgaggtttgcgtatcgtcgggaaagatttagagttcgagtttagtttagttgaggtttgcgtatcgtcgggaaagacgcggggttcgagattagtttagttgaggtttgcgtatcgtcgggaaagacgcggggttcgagattagtttagttgaggtttgtatagcgtcgggaaagacgtagagttcgagattagtttagttgagttttgtatatttaatttcgtcgaggatttatattttgattttaggggtttttttagtttgtt

SEQ ID NO: 14530 - DNA, 1898 bp, Artificial Sequence
  chemically treated genomic DNA (Homo sapiens) CpG-island No: 14530
aacaaactaaaaaaacccctaaaatcaaaatataaatcctcgacgaaattaaatatacaaaactcaactaaactaatctcgaactctacgtctttcccgacgctatacaaacctcaactaaactaatctcgaaccccgcgtctttcccgacgatacgcaaacctcaactaaactaatctcgaaccccgcgtctttcccgacgatacgcaaacctcaactaaactaaactcgaactctaaatctttcccgacgatacgcaaacctcaactaaactaaactcgaaccccgcgtctttcccgacgatacgcaaacctcaactaaactaatctcgaacaccgcgtctttcccgacgatacgcaaacctcaactaaactaaactcgaaccccgcgtctttcccgacgatacgcaaacctcaactaaactaaactcgaactctaaatctttcccgacgatacgcaaacctcaactaaactaaactcgaaccccgcgtctttcccgacgatacgcaaacctcaactaaactaaactcgaaccccgcgtctttcccgacgatacgcaaacctcaactaaactaaactcgaactctccgtctttcccgacgatacgcaaacctcaactaaactaaactcgaaccccgcgtctttcccgacgatacgcaaacctcaactaaactaatctcgaactctacgtctttcccgacgatacgcaaaccccaactaaactaatctcgaactctacgtctttcccgacgatacgcaaacctcaactaaactacacttaaaccccgcgtctttcccgacgatacgcaaacctcaactaaactaatctcgaactctaaatctttcccgacgatacgcaaacctcaactaaactacacttaaaccccgcgtctttcccgacgatacgcaaacctcaactaaactaatctcgaacaccgcgtctttcccgcgatacgcaaacctcaactaaactaaactcgaaccccgcgtctttcccgtacgatacgcaaaccccaactaaactaatctcgaactctacgtctttcccgacgatacgcaaaccccaactaaactaatctcgaactctacgtctttcccgacgatacgcaaacccaactaaactaatctcgaactctacgtctttcccgacgatacgcaaaccccaactaaactaaactaactctacgtctttcccgacgctatacaaacctcaactaaactaaactcgaaccccgcgtctttcccgacgatacgcaaacctcaactaaactaatctcgaaccccgcgtctttcccgacgatacgcaaacctcaactaaactacacttaaaccccgcgtctttcccgacgatacgcaaacctcaactaaactaaactcgaacaccgcgtctttcccgacgatacgcaaacctcaactaaactacacttaaaccccgcgtctttcccgacgatacgcaaacctcaactaaactaaactcgaactctaaatctttcccgacgatacgcaaacctcaactaaactaatctcgaaccccgcgtctttcccgacgatacgcaaacctcaactaaactaatctcgaaccccgcgtctttcccgacgatacgcaaacctcaactaaactaatctcgaaccccgcgtctttcccgataatacgcaaacctcaactaaactaatctcgaaccccgcgtctttcccgacgatacgcaaacctcaactaaactaaactcgaacaccgcgtctttcccgacgatacgcaaacctcaactaaactaatctcgaactctaaatctttcccgacgatacgcaaacctcaactaaactaatctcgaaccccgcgtctttcccgacgatacgcaaacctcaactaaactaaactcgaacaccgcgtctttcccgac

SEQ ID NO: 14531 - DNA, 1898 bp, Artificial Sequence
  chemically treated genomic DNA (Homo sapiens) CpG-island No: 14531
gataggttaagagaatttttgaaattagaatgtaagttttcggcggagttaggtatgtaggatttagttaggttggtttcggattttgcgtttttttcggcgttgtgtaggttttagttaggttggtttcggatttcgcgtttttttcggcggtgcgtaggttttagttaggttggtttcggatttcgcgtttttttcggcggtgcgtaggttttagttaggttggattcggattttgggtttttttcggcggtgcgtaggttttagttaggttggattcggatttcgcgtttttttcggcggtgcgtaggttttagttaggttggtttcggatatcgcgtttttttcggcggtgcgtaggttttagttaggttggattcggatttcgcgtttttttcggcggtgcgtaggttttagttaggttggattcggattttgggtttttttcggcggtgcgtaggttttagttaggttggattcggatttcgcgtttttttcggcggtgcgtaggttttagttaggttggattcggatttcgcgtttttttcggcggtgcgtaggttttagttaggttggattcggatttttcgtttttttcggcggtgcgtaggttttagttaggttggattcggatttcgcgtttttttcggcggtgcgtaggttttagttaggttggtttcggattttgcgtttttttcggcggtgcgtaggttttagttaggttggtttcggattttgcgtttttttcggcggtgcgtaggttttagttaggttgtatttggatttcgcgtttttttcggcggtgcgtaggttttagttaggttggtttcggattttgggtttttttcggcggtgcgtaggttttagttaggttgtatttggatttcgcgtttttttcggcggtgcgtaggttttagttaggttggtttcggatatcgcgtttttttcgcggtgcgtaggttttagttaggttggattcggatttcgcgtttttttcgtgcggtgcgtaggttttagttaggttggtttcggattttgcgtttttttcggcggtgcgtaggttttagttaggttggtttcggattttgcgtttttttcggcggtgcgtaggtttagttaggttggtttcggattttgcgtttttttcggcggtgcgtaggttttagttaggttggattgattttgcgtttttttcggcgttgtgtaggttttagttaggttggattcggatttcgcgtttttttcggcggtgcgtaggttttagttaggttggtttcggatttcgcgtttttttcggcggtgcgtaggttttagttaggttgtatttggatttcgcgtttttttcggcggtgcgtaggttttagttaggttggattcggatatcgcgtttttttcggcggtgcgtaggttttagttaggttgtatttggatttcgcgtttttttcggcggtgcgtaggttttagttaggttggattcggattttgggtttttttcggcggtgcgtaggttttagttaggttggtttcggatttcgcgtttttttcggcggtgcgtaggttttagttaggttggtttcggatttcgcgtttttttcggcggtgcgtaggttttagttaggttggtttcggatttcgcgtttttttcggtggtgcgtaggttttagttaggttggtttcggatttcgcgtttttttcggcggtgcgtaggttttagttaggttggattcggatatcgcgtttttttcggcggtgcgtaggttttagttaggttggtttcggattttgggtttttttcggcggtgcgtaggttttagttaggttggtttcggatttcgcgtttttttcggcggtgcgtaggttttagttaggttggattcggatatcgcgtttttttcggt

SEQ ID NO: 14532 - DNA, 1898 bp, Artificial Sequence
  chemically treated genomic DNA (Homo sapiens) CpG-island No: 14532
accgaaaaaaacgcgatatccgaatccaacctaactaaaacctacgcaccgccgaaaaaaacgcgaaatccgaaaccaacctaactaaaacctacgcaccgccgaaaaaaacccaaaatccgaaaccaacctaactaaaacctacgcaccgccgaaaaaaacgcgatatccgaatccaacctaactaaaacctacgcaccgccgaaaaaaacgcgaaatccgaaaccaacctaactaaaacctacgcaccaccgaaaaaaacgcgaaatccgaaaccaacctaactaaaacctacgcaccgccgaaaaaaacgcgaaatccgaaaccaacctaactaaaacctacgcaccgccgaaaaaaacgcgaaatccgaaaccaacctaactaaaacctacgcaccgccgaaaaaaacccaaaatccgaatccaacctaactaaaacctacgcaccgccgaaaaaaacgcgaaatccaaatacaacctaactaaaacctacgcaccgccgaaaaaaacgcgatatccgaatccaacctaactaaaacctacgcaccgccgaaaaaaacgcgaaatccaaatacaacctaactaaaacctacgcaccgccgaaaaaaacgcgaaatccgaaaccaacctaactaaaacctacgcaccgccgaaaaaaacgcgaaatccgaatccaacctaactaaaacctacacaacgccgaaaaaaacgcaaaatcaatccaacctaactaaaacctacgcaccgccgaaaaaaacgcaaaatccgaaaccaacctaactaaacctacgcaccgccgaaaaaaacgcaaaatccgaaaccaacctaactaaaacctacgcaccgccgaaaaaaacgcaaaatccgaaaccaacctaactaaaacctacgcaccgcacgaaaaaaacgcgaaatccgaatccaacctaactaaaacctacgcaccgcgaaaaaaacgcgatatccgaaaccaacctaactaaaacctacgcaccgccgaaaaaaacgcgaaatccaaatacaacctaactaaaacctacgcaccgccgaaaaaaacccaaaatccgaaaccaacctaactaaaacctacgcaccgccgaaaaaaacgcgaaatccaaatacaacctaactaaaacctacgcaccgccgaaaaaaacgcaaaatccgaaaccaacctaactaaaacctacgcaccgccgaaaaaaacgcaaaatccgaaaccaacctaactaaaacctacgcaccgccgaaaaaaacgcgaaatccgaatccaacctaactaaaacctacgcaccgccgaaaaaaacgaaaaatccgaatccaacctaactaaaacctacgcaccgccgaaaaaaacgcgaaatccgaatccaacctaactaaaacctacgcaccgccgaaaaaaacgcgaaatccgaatccaacctaactaaaacctacgcaccgccgaaaaaaacccaaaatccgaatccaacctaactaaaacctacgcaccgccgaaaaaaacgcgaaatccgaatccaacctaactaaaacctacgcaccgccgaaaaaaacgcgatatccgaaaccaacctaactaaaacctacgcaccgccgaaaaaaacgcgaaatccgaatccaacctaactaaaacctacgcaccgccgaaaaaaacccaaaatccgaatccaacctaactaaaacctacgcaccgccgaaaaaaacgcgaaatccgaaaccaacctaactaaaacctacgcaccgccgaaaaaaacgcgaaatccgaaaccaacctaactaaaacctacacaacgccgaaaaaaacgcaaaatccgaaaccaacctaactaaatcctacatacctaactccgccgaaaacttacattctaatttcaaaaattctcttaacctatc

SEQ ID NO: 14533 - DNA, 850 bp, Artificial Sequence
  chemically treated genomic DNA (Homo sapiens) CpG-island No: 14533
ttagagcggtaagttagtgtcgtagtttttttcggcgggcgtttcggttttcgtagttttcggggtagagttcggtttcgtcgttcgtttttcggagtgggtgtttcggattcgttttttttttcgacgttattatttgcgttcgtttcggcgtcgtttttgttcggcgttttatcgttaagcgagtttttcgggttcgatttgattcggtttttagttttagaagagaggcggcggagcgagtagggtaagattaggtcgggtcgcgagtatagggtttcgttgttatttggaggcggtttgataatttcgatttttttcgttatatttcggattcggtcgtcgtttcgtaaggttttcgtagggtttttcgcggtttatattcgtttttcgaatcggttttttttcgttttcggcgttttttttttttttagttcgatcgagtcgggtttatattatttttttttgtcgttttcgttcggcgcggtttttattttttgttttttatttagtaataatcggttagtttttagcgcgggaggcgtttttttattttgagcgggcgatttcgcggtcgttttcggcgcggttttttgtttcggggatcgcgatgggggagggggcgcggcgggggtttcgtcgttcgcgtattcggaggcgagtcgttttcgcggcgaggaaagatcggcgttttttcgtttttcgtagttcgggacgttcgcgtcgtcgtcgttcggtcgagttgttattttgcggtcgttatttatttcgttttcggtttgtaaggcgggcggttttcgggggttgttatttcgaggcgcgtcgcgtttttcgatggcgggatcgtggt

SEQ ID NO: 14534 - DNA, 850 bp, Artificial Sequence
  chemically treated genomic DNA (Homo sapiens) CpG-island No: 14534
accacgatcccgccatcgaaaaacgcgacgcgcctcgaaataacaacccccgaaaaccgcccgccttacaaaccgaaaacgaaataaataacgaccgcaaaataacaactcgaccgaacgacgacgacgcgaacgtcccgaactacgaaaaacgaaaaaacgccgatctttcctcgccgcgaaaacgactcgcctccgaatacgcgaacgacgaaacccccgccgcgccccctcccccatcgcgatccccgaaacaaaaaaccgcgccgaaaacgaccgcgaaatcgcccgctcaaaataaaaaaacgcctcccgcgctaaaaactaaccgattattactaaataaaaaacaaaaaataaaaaccgcgccgaacgaaaacgacaaaaaaaaataatataaacccgactcgatcgaactaaaaaaaaaaaaaacgccgaaaacgaaaaaaaaccgattcgaaaaacgaatataaaccgcgaaaaaccctacgaaaaccttacgaaacgacgaccgaatccgaaatataacgaaaaaaatcgaaattatcaaaccgcctccaaataacaacgaaaccctatactcgcgacccgacctaatcttaccctactcgctccgccgcctctcttctaaaactaaaaaccgaatcaaatcgaacccgaaaaactcgcttaacgataaaacgccgaacaaaaacgacgccgaaacgaacgcaaataataacgtcgaaaaaaaaaacgaatccgaaacacccactccgaaaaacgaacgacgaaaccgaactctaccccgaaaactacgaaaaccgaaacgcccgccgaaaaaaactacgacactaacttaccgctctaa

SEQ ID NO: 14535 - DNA, 850 bp, Artificial Sequence
  chemically treated genomic DNA (Homo sapiens) CpG-island No: 14535
attacggtttcgttatcggggaacgcggcgcgtttcgaggtgatagttttcgggggtcgttcgttttgtaggtcgggggcggggtgggtggcggtcgtagggtggtagttcggtcgggcggcggcggcgcgggcgtttcgagttgcggagggcgggaggacgtcggttttttttcgtcgcggagacggttcgttttcgagtgcgcgggcggcgaggttttcgtcgcgtttttttttttatcgcggttttcgaggtaaggggtcgcgtcgggggcggtcgcgggatcgttcgtttagggtgggggggcgtttttcgcgttgggagttgatcggttattgttggatggggggtaggggatgagggtcgcgtcgggcgggggcggtaggggggagtagtgtagattcgattcgatcgggttgagaggaagggaggcgtcgaagacggaaggggatcggttcgaaaagcgagtgtgggtcgcgggaggttttgcggggattttgcggggcggcggtcgagttcgaggtgtggcggggggaatcgaagttgttagatcgtttttaagtgatagcgggattttgtgttcgcggttcggtttggttttgttttgttcgtttcgtcgttttttttttggggttgggggtcgggttaggtcgggttcgaggggttcgtttggcggtgaagcgtcggataaaggcggcgtcggagcgggcgtaggtggtggcgtcggggaggggagcgggttcgaggtatttatttcgaggggcgggcgacggggtcggattttgtttcggggattgcgggggtcggggcgttcgtcgggaggagttgcggtattggtttgtcgttttag

SEQ ID NO: 14536 - DNA, 850 bp, Artificial Sequence
  chemically treated genomic DNA (Homo sapiens) CpG-island No: 14536
ctaaaacgacaaaccaataccgcaactcctcccgacgaacgccccgacccccgcaatccccgaaacaaaatccgaccccgtcgcccgcccctcgaaataaatacctcgaacccgctcccctccccgacgccaccacctacgcccgctccgacgccgcctttatccgacgcttcaccgccaaacgaacccctcgaacccgacctaacccgacccccaaccccaaaaaaaaaacgacgaaacgaacaaaacaaaaccaaaccgaaccgcgaacacaaaatcccgctatcacttaaaaacgatctaacaacttcgattccccccgccacacctcgaactcgaccgccgccccgcaaaatccccgcaaaacctcccgcgacccacactcgcttttcgaaccgatccccttccgtcttcgacgcctcccttcctctcaacccgatcgaatcgaatctacactactcccccctaccgcccccgcccgacgcgaccctcatcccctaccccccatccaacaataaccgatcaactcccaacgcgaaaaacgcccccccaccctaaacgaacgatcccgcgaccgcccccgacgcgaccccttacctcgaaaaccgcgataaaaaaaaaaacgcgacgaaaacctcgccgcccgcgcactcgaaaacgaaccgtctccgcgacgaaaaaaaaccgacgtcctcccgccctccgcaactcgaaacgcccgcgccgccgccgcccgaccgaactaccaccctacgaccgccacccaccccgcccccgacctacaaaacgaacgacccccgaaaactatcacctcgaaacgcgccgcgttccccgataacgaaaccgtaat

SEQ ID NO: 14537 - DNA, 593 bp, Artificial Sequence
  chemically treated genomic DNA (Homo sapiens) CpG-island No: 14537
ttgatttttttatttattttcgtttacgttttcgtttatagtttcgataattttttttttattatttatttatttttcgttttttaattttttaagtttttattatttttttttatcgaacgttttttaagcgttagttttttttaatatttcgtattcgttcgtttcggcgtttttttttatttacgaggcgcgttaggttttcgttcgcgttttttagtttttttttagttttgtttcgttttttttcgttttttcgttttcgtttcgtcgtagttagttacgttagtagtagttagcgttcgtgttcgttcggtcgtttcgtcgtattttagtcgcgtttagagacgttttttcgcggtcgtttttcgcgtttacgtgcgttcgcggtttaggtataggtcgcgtgttcgttttaggtcgtttgtcgtttacgagcgcgtgtttcggttcgtgcgtttacgcgttgtatcgaggtttcgtgttttacgttcgtgcgcgtatttgtgggaagttagggtttgtttattagcgttacgtaggacgttcgtatttttttattttcggtttgtgttgtaaaatattaagtgtgt

SEQ ID NO: 14538 - DNA, 593 bp, Artificial Sequence
  chemically treated genomic DNA (Homo sapiens) CpG-island No: 14538
acacacttaatattttacaacacaaaccgaaaataaaaaaatacgaacgtcctacgtaacgctaataaacaaaccctaacttcccacaaatacgcgcacgaacgtaaaacacgaaacctcgatacaacgcgtaaacgcacgaaccgaaacacgcgctcgtaaacgacaaacgacctaaaacgaacacgcgacctatacctaaaccgcgaacgcacgtaaacgcgaaaaacgaccgcgaaaaaacgtctctaaacgcgactaaaatacgacgaaacgaccgaacgaacacgaacgctaactactactaacgtaactaactacgacgaaacgaaaacgaaaaaacgaaaaaaaacgaaacaaaactaaaaaaaaactaaaaaacgcgaacgaaaacctaacgcgcctcgtaaataaaaaaaaacgccgaaacgaacgaatacgaaatattaaaaaaaactaacgcttaaaaaacgttcgataaaaaaaaataataaaaacttaaaaaattaaaaaacgaaaaataaataaataataaaaaaaaaattatcgaaactataaacgaaaacgtaaacgaaaataaataaaaaaatcaa

SEQ ID NO: 14539 - DNA, 593 bp, Artificial Sequence
  chemically treated genomic DNA (Homo sapiens) CpG-island No: 14539
gtatatttgatattttgtagtataggtcgggggtggaagggtgcgggcgttttgcgtggcgttggtggataggttttggttttttataggtgcgcgtacgagcgtggagtacggggtttcggtgtagcgcgtgggcgtacgggtcgggatacgcgttcgtgggcggtaggcggtttgggacgagtacgcggtttgtgtttgggtcgcggacgtacgtggacgcgaggaacggtcgcggagagacgtttttgagcgcggttggggtgcggcgggacggtcgagcgagtacgggcgttggttgttgttggcgtggttggttgcggcggggcggaggcggaggggcgaggagggacggggtagggttggaggaaagttgggggacgcgagcgagagtttggcgcgtttcgtaggtgggggaaggcgtcgaggcggacgggtgcggggtattggggggggttggcgtttggggggcgttcgatgagaggggatggtggggatttgaggggttggggagcggagggtggatgggtggtggaaggagggttgtcgaggttgtgggcgggagcgtgggcgggggtgggtgggggagttag

SEQ ID NO: 14540 - DNA, 593 bp, Artificial Sequence
  chemically treated genomic DNA (Homo sapiens) CpG-island No: 14540
ctaactcccccacccacccccgcccacgctcccgcccacaacctcgacaaccctccttccaccacccatccaccctccgctccccaacccctcaaatccccaccatcccctctcatcgaacgccccccaaacgccaaccccccccaataccccgcacccgtccgcctcgacgccttcccccacctacgaaacgcgccaaactctcgctcgcgtcccccaactttcctccaaccctaccccgtccctcctcgcccctccgcctccgccccgccgcaaccaaccacgccaacaacaaccaacgcccgtactcgctcgaccgtcccgccgcaccccaaccgcgctcaaaaacgtctctccgcgaccgttcctcgcgtccacgtacgtccgcgacccaaacacaaaccgcgtactcgtcccaaaccgcctaccgcccacgaacgcgtatcccgacccgtacgcccacgcgctacaccgaaaccccgtactccacgctcgtacgcgcacctataaaaaaccaaaacctatccaccaacgccacgcaaaacgcccgcacccttccacccccgacctatactacaaaatatcaaatatac

SEQ ID NO: 14541 - DNA, 554 bp, Artificial Sequence
  chemically treated genomic DNA (Homo sapiens) CpG-island No: 14541
tcgcgttttcgggttttttgagggttttatcgtgttcggtttgggcgatgatacggggttttagcggtagcgagagaaaggttttgtcggtagttggaggcggggaggaaggaggagagaacgtaggttcgtttttttcgtcgagcggtacgtacgacggcggcgatagcggcggaacgggcgggtcgggcgcgagcggtatttgcgcgtagattatggtttcgttttttttcgttttgttcgtcgcgtttcgtttattcgttaatcggtcggggaggcgggagtagggcgggaggagtttagggtgggaggacgcgcggcggtagggagttggagaggggaaggcgttggttaggtcgttttcgggagttttagtttttcgtttcggtacgtgggtttttcggttttaggttttcgttttcgtttgcgtgcgcggtttgggttatttgtttacgtttattcgacgtttatagttttaagtttttttagttggattgcggagtgttttgggttttgattttttttcgggagattcggggcgtttgaagttaggt

SEQ ID NO: 14542 - DNA, 554 bp, Artificial Sequence
  chemically treated genomic DNA (Homo sapiens) CpG-island No: 14542
acctaacttcaaacgccccgaatctcccgaaaaaaaatcaaaacccaaaacactccgcaatccaactaaaaaaacttaaaactataaacgtcgaataaacgtaaacaaataacccaaaccgcgcacgcaaacgaaaacgaaaacctaaaaccgaaaaacccacgtaccgaaacgaaaaactaaaactcccgaaaacgacctaaccaacgccttcccctctccaactccctaccgccgcgcgtcctcccaccctaaactcctcccgccctactcccgcctccccgaccgattaacgaataaacgaaacgcgacgaacaaaacgaaaaaaaacgaaaccataatctacgcgcaaataccgctcgcgcccgacccgcccgttccgccgctatcgccgccgtcgtacgtaccgctcgacgaaaaaaacgaacctacgttctctcctccttcctccccgcctccaactaccgacaaaacctttctctcgctaccgctaaaaccccgtatcatcgcccaaaccgaacacgataaaaccctcaaaaaacccgaaaacgcga

SEQ ID NO: 14543 - DNA, 554 bp, Artificial Sequence
  chemically treated genomic DNA (Homo sapiens) CpG-island No: 14543
gtttgattttagacgtttcggatttttcggagagaagttagggtttaaggtatttcgtagtttagttgggaaagtttggggttgtaggcgtcgagtgaacgtgagtaggtaatttaggtcgcgtacgtagacggaagcggagatttagaatcgagaagtttacgtgtcgaagcggaagattagagttttcgggaacggtttagttagcgtttttttttttttagttttttgtcgtcgcgcgtttttttattttgggtttttttcgttttattttcgttttttcggtcggttagcgaatgggcgggacgcggcgggtaaggcggggaggggcggggttatggtttgcgcgtaggtgtcgttcgcgttcggttcgttcgtttcgtcgttgtcgtcgtcgtcgtgcgtgtcgttcggcggaggggacgggtttgcgtttttttttttttttttttcgtttttagttgtcggtaggatttttttttcgttgtcgttgggatttcgtgttatcgtttaggtcgagtacggtgaggtttttagggagttcgggggcgcga

SEQ ID NO: 14544 - DNA, 554 bp, Artificial Sequence
  chemically treated genomic DNA (Homo sapiens) CpG-island No: 14544
tcgcgcccccgaactccctaaaaacctcaccgtactcgacctaaacgataacacgaaatcccaacgacaacgaaaaaaaaatcctaccgacaactaaaaacgaaaaaaaaaaaaaaaaaaacgcaaacccgtcccctccgccgaacgacacgcacgacgacgacgacaacgacgaaacgaacgaaccgaacgcgaacgacacctacgcgcaaaccataaccccgcccctccccgccttacccgccgcgtcccgcccattcgctaaccgaccgaaaaaacgaaaataaaacgaaaaaaacccaaaataaaaaaacgcgcgacgacaaaaaactaaaaaaaaaaaaacgctaactaaaccgttcccgaaaactctaatcttccgcttcgacacgtaaacttctcgattctaaatctccgcttccgtctacgtacgcgacctaaattacctactcacgttcactcgacgcctacaaccccaaactttcccaactaaactacgaaataccttaaaccctaacttctctccgaaaaatccgaaacgtctaaaatcaaac

SEQ ID NO: 14545 - DNA, 613 bp, Artificial Sequence
  chemically treated genomic DNA (Homo sapiens) CpG-island No: 14545
  misc_feature (101)..(102): n is either a, c, g or t
  misc_feature (309)..(309): n is either a, c, g or t
  misc_feature (321)..(321): n is either a, c, g or t
  misc_feature (323)..(323): n is either a, c, g or t
  misc_feature (345)..(345): n is either a, c, g or t
cggaacgatttcgttggttatgttggcggcgatttgtaataagatcggtaatacgagttcgttgacgacgttgttagagtcgagcgttttcgttaaagggnntttttatttttggaagcgtttttcgtttagttgtaatttcggttttagtttttcgggtttcgcggtggttatcgggggtcgtggttcgggcggtttggcgggcggttcgggcgcgtaatagcgttttttgtttggtttttacgtcgtttacgtcgttcgtttttagtagcgattacggcggttttttttttaattcggcggttgttnggcggtaggttngngttcgttttcgtaagaggcgtngagttagtcggtttttatttttaaggtgtatacgacggtagtcgacgggttgtattcgcgcgtgggtatggcgtattcgtacgagttttggtataagtcgggtttttattcgacgttggcggtcggcgaggtgattaacggcgcggcgtcgtcgtggtgggacgtgtatagtagttcgggttcgtggttggaagtgtagaaatcgttggggggttttagagttcgttgtattcgggcgttttttaggtttcgttgtattcgtagttgg

SEQ ID NO: 14546 - DNA, 613 bp, Artificial Sequence
  chemically treated genomic DNA (Homo sapiens) CpG-island No: 14546
  misc_feature (269)..(269): n is either a, c, g or t
  misc_feature (291)..(291): n is either a, c, g or t
  misc_feature (293)..(293): n is either a, c, g or t
  misc_feature (305)..(305): n is either a, c, g or t
  misc_feature (512)..(513): n is either a, c, g or t
ccaactacgaatacaacgaaacctaaaaaacgcccgaatacaacgaactctaaaaccccccaacgatttctacacttccaaccacgaacccgaactactatacacgtcccaccacgacgacgccgcgccgttaatcacctcgccgaccgccaacgtcgaataaaaacccgacttataccaaaactcgtacgaatacgccatacccacgcgcgaatacaacccgtcgactaccgtcgtatacaccttaaaaataaaaaccgactaactcnacgcctcttacgaaaacgaacncnaacctaccgccnaacaaccgccgaattaaaaaaaaaaccgccgtaatcgctactaaaaacgaacgacgtaaacgacgtaaaaaccaaacaaaaaacgctattacgcgcccgaaccgcccgccaaaccgcccgaaccacgacccccgataaccaccgcgaaacccgaaaaactaaaaccgaaattacaactaaacgaaaaacgcttccaaaaataaaaannccctttaacgaaaacgctcgactctaacaacgtcgtcaacgaactcgtattaccgatcttattacaaatcgccgccaacataaccaacgaaatcgttccg

SEQ ID NO: 14547 - DNA, 613 bp, Artificial Sequence
  chemically treated genomic DNA (Homo sapiens) CpG-island No: 14547
  misc_feature (269)..(269): n is either a, c, g or t
  misc_feature (291)..(291): n is either a, c, g or t
  misc_feature (293)..(293): n is either a, c, g or t
  misc_feature (305)..(305): n is either a, c, g or t
  misc_feature (512)..(513): n is either a, c, g or t
ttagttgcgagtgtagcgaggtttggggggcgttcgagtgtagcgagttttggagttttttagcggtttttgtatttttagttacgagttcgggttgttgtgtacgttttattacgacgacgtcgcgtcgttggttatttcgtcggtcgttagcgtcgaatggaagttcgatttgtattaggattcgtacgggtgcgttatgtttacgcgcgggtatagttcgtcggttgtcgtcgtgtgtattttggaaatgaaggtcgattggtttnacgttttttgcggggacgaatntnggtttgtcgttnggtagtcgtcgagttggagaagaggtcgtcgtagtcgttgttgaaggcggacgacgtgggcgacgtggaggttaggtagaaggcgttgttgcgcgttcgagtcgttcgttaggtcgttcgagttacggttttcggtggttatcgcgaagttcgagaggttggagtcgaggttgtagttggacgaggagcgtttttaggggtgaaagnnttttttggcgaaggcgttcgattttggtagcgtcgttagcgggttcgtgttgtcgattttgttgtaggtcgtcgttagtatggttaacggggtcgtttcg

SEQ ID NO: 14548 - DNA, 613 bp, Artificial Sequence
  chemically treated genomic DNA (Homo sapiens) CpG-island No: 14548
  misc_feature (101)..(102): n is either a, c, g or t
  misc_feature (309)..(309): n is either a, c, g or t
  misc_feature (321)..(321): n is either a, c, g or t
  misc_feature (323)..(323): n is either a, c, g or t
  misc_feature (345)..(345): n is either a, c, g or t
cgaaacgaccccgttaaccatactaacgacgacctacaacaaaatcgacaacacgaacccgctaacgacgctaccaaaatcgaacgccttcgccaaaaaannctttcacccctaaaaacgctcctcgtccaactacaacctcgactccaacctctcgaacttcgcgataaccaccgaaaaccgtaactcgaacgacctaacgaacgactcgaacgcgcaacaacgccttctacctaacctccacgtcgcccacgtcgtccgccttcaacaacgactacgacgacctcttctccaactcgacgactaccnaacgacaaaccnanattcgtccccgcaaaaaacgtnaaaccaatcgaccttcatttccaaaatacacacgacgacaaccgacgaactatacccgcgcgtaaacataacgcacccgtacgaatcctaatacaaatcgaacttccattcgacgctaacgaccgacgaaataaccaacgacgcgacgtcgtcgtaataaaacgtacacaacaacccgaactcgtaactaaaaatacaaaaaccgctaaaaaactccaaaactcgctacactcgaacgccccccaaacctcgctacactcgcaactaa

SEQ ID NO: 14549 - DNA, 1072 bp, Artificial Sequence
  chemically treated genomic DNA (Homo sapiens) CpG-island No: 14549
tttagttcgtttacgtatttcgtttttagttttacgggtttcggttttttcgtcgtcgtcgttttttatttgttttttattagttagtatttgttggtttaggacggttttaagtcggtgttgtttttttattcggattttagcgtcgtcgtggtagtcgtcgtcgttagcgttatgatatcgggcgtcgcggttgtcgtcgtcggggggagttcggtacgttttgttcgtcgttattcgggtcgcgtatttgcgattgttttaattgttaggaggcggagcggttgggttcggtcggggcgagtttgcgcgtaagggtttgtatagttgttatatttcgggttgcggtaaggtgtacgggaagacgtcgtatttgaaggcgtatttgtcgtggtatacgggcgagcggtttttcgtgtgtaattggtttttttgcggtaagcgttttacgtttcggacgagttgtagcgtatttgcggatttatacgggcgagaagcgtttcgtttgttcggtgtgtaataagcgttttatgcgtagcgattatttgagtaaatatattaagacgtataacgggggcggcgggggtaaaaagggtagcgatagtgatacggacgttagtaatttggagacgtttcgtttcgaatttttcgattttattttgtatgatttcggcgttagtgtcgttcgggcggtagcggcggcggcggtagcggcggcggcggcggcggtcgttttcgcgtgaggtaaggaagtagcgtttggttttaacgatttttagaggtcgggcgagaggcgcgagtatataagcgagtagagatatcgagaacgaacgagaggttcggagggcgagcgagcgggaggcgggagggtaggggttttagtgacgttttagggttcgggttgggcgcgaggtggagtcgtttagggttttcgggttgcggttcgttcgttgtgcgaggagtttttttttgtttttcgcgttcggataagaatcgaacgcgtggttcggaaataaaagcgaattatttttcgatataaatattttaaaaattgtatttttagacgtatata

SEQ ID NO: 14550 - DNA, 1072 bp, Artificial Sequence
  chemically treated genomic DNA (Homo sapiens) CpG-island No: 14550
tatatacgtctaaaaatacaatttttaaaatatttatatcgaaaaataattcgcttttatttccgaaccacgcgttcgattcttatccgaacgcgaaaaacaaaaaaaaactcctcgcacaacgaacgaaccgcaacccgaaaaccctaaacgactccacctcgcgcccaacccgaaccctaaaacgtcactaaaacccctaccctcccgcctcccgctcgctcgccctccgaacctctcgttcgttctcgatatctctactcgcttatatactcgcgcctctcgcccgacctctaaaaatcgttaaaaccaaacgctacttccttacctcacgcgaaaacgaccgccgccgccgccgccgctaccgccgccgccgctaccgcccgaacgacactaacgccgaaatcatacaaaataaaatcgaaaaattcgaaacgaaacgtctccaaattactaacgtccgtatcactatcgctaccctttttacccccgccgcccccgttatacgtcttaatatatttactcaaataatcgctacgcataaaacgcttattacacaccgaacaaacgaaacgcttctcgcccgtataaatccgcaaatacgctacaactcgtccgaaacgtaaaacgcttaccgcaaaaaaaccaattacacacgaaaaaccgctcgcccgtataccacgacaaatacgccttcaaatacgacgtcttcccgtacaccttaccgcaacccgaaatataacaactatacaaacccttacgcgcaaactcgccccgaccgaacccaaccgctccgcctcctaacaattaaaacaatcgcaaatacgcgacccgaataacgacgaacaaaacgtaccgaactccccccgacgacgacaaccgcgacgcccgatatcataacgctaacgacgacgactaccacgacgacgctaaaatccgaataaaaaaacaacaccgacttaaaaccgtcctaaaccaacaaatactaactaataaaaaacaaataaaaaacgacgacgacgaaaaaaccgaaacccgtaaaactaaaaacgaaatacgtaaacgaactaaa

SEQ ID NO: 14551 - DNA, 1072 bp, Artificial Sequence
  chemically treated genomic DNA (Homo sapiens) CpG-island No: 14551
tgtgtacgtttgggagtatagtttttaaagtgtttgtgtcggaggatggttcgtttttgttttcggattacgcgttcgatttttattcgggcgcggaaggtagaggggagtttttcgtatagcgggcgaatcgtagttcgggagttttgagcggttttatttcgcgtttagttcgggttttggggcgttattgaagtttttgttttttcgtttttcgttcgttcgtttttcgaatttttcgttcgttttcggtgtttttattcgtttgtgtgttcgcgtttttcgttcggtttttaagagtcgttggggttagacgttgtttttttgttttacgcggaggcggtcgtcgtcgtcgtcgtcgttgtcgtcgtcgtcgttgtcgttcgggcggtattgacgtcggagttatgtaggatgaggtcgggggattcggaacggggcgtttttaggttgttggcgttcgtgttattgtcgttgttttttttgttttcgtcgttttcgttgtgcgttttaatgtgtttgtttaggtggtcgttgcgtatgaagcgtttgttgtatatcggataggcgaagcgtttttcgttcgtgtgagttcgtagatgcgttgtagttcgttcgaggcgtgaagcgtttgtcgtagaagagttagttgtatacgaagggtcgttcgttcgtgtgttacggtaggtgcgtttttaggtgcgacgttttttcgtatattttgtcgtagttcggaatgtggtagttgtgtaggtttttgcgcgtaggttcgtttcggtcgggtttagtcgtttcgttttttggtagttggggtagtcgtaggtgcgcggttcgagtagcggcgggtagagcgtgtcgagtttttttcggcggcggtagtcgcggcgttcgatattatggcgttggcggcggcggttgttacggcggcgttggagttcgaataggagggtaatatcggtttgaagtcgttttgggttagtaggtgttggttggtggagagtaggtgggaggcggcggcggcggaggagtcgaggttcgtggagttgaaggcggagtgcgtgagcgagttgaa

SEQ ID NO: 14552 - DNA, 1072 bp, Artificial Sequence
  chemically treated genomic DNA (Homo sapiens) CpG-island No: 14552
ttcaactcgctcacgcactccgccttcaactccacgaacctcgactcctccgccgccgccgcctcccacctactctccaccaaccaacacctactaacccaaaacgacttcaaaccgatattaccctcctattcgaactccaacgccgccgtaacaaccgccgccgccaacgccataatatcgaacgccgcgactaccgccgccgaaaaaaactcgacacgctctacccgccgctactcgaaccgcgcacctacgactaccccaactaccaaaaaacgaaacgactaaacccgaccgaaacgaacctacgcgcaaaaacctacacaactaccacattccgaactacgacaaaatatacgaaaaaacgtcgcacctaaaaacgcacctaccgtaacacacgaacgaacgacccttcgtatacaactaactcttctacgacaaacgcttcacgcctcgaacgaactacaacgcatctacgaactcacacgaacgaaaaacgcttcgcctatccgatatacaacaaacgcttcatacgcaacgaccacctaaacaaacacattaaaacgcacaacgaaaacgacgaaaacaaaaaaaacaacgacaataacacgaacgccaacaacctaaaaacgccccgttccgaatcccccgacctcatcctacataactccgacgtcaataccgcccgaacgacaacgacgacgacgacaacgacgacgacgacgacgaccgcctccgcgtaaaacaaaaaaacaacgtctaaccccaacgactcttaaaaaccgaacgaaaaacgcgaacacacaaacgaataaaaacaccgaaaacgaacgaaaaattcgaaaaacgaacgaacgaaaaacgaaaaaacaaaaacttcaataacgccccaaaacccgaactaaacgcgaaataaaaccgctcaaaactcccgaactacgattcgcccgctatacgaaaaactcccctctaccttccgcgcccgaataaaaatcgaacgcgtaatccgaaaacaaaaacgaaccatcctccgacacaaacactttaaaaactatactcccaaacgtacaca

SEQ ID NO: 14553 - DNA, 600 bp, Artificial Sequence
  chemically treated genomic DNA (Homo sapiens) CpG-island No: 14553
tttttcgcggttaggttgtttcgttttttttattcgagtttttttttattttggttatttttttttttcgattaagttgtttataatcgggagttttttattttttaagcgtttttggtcgggggatggtttttcggagagtcggttggtagggacgcgtttttcggaggggtttcgggtcggggtattggaggtttagagggtgtttggcgcgtttgggggtcgcgggttggcggcgcggagtagagggtgtggtgggtttttttaggaacgcgggcgttcgggcgtcgggtttagggagttttgtttttcgttgataataaaggtagattaaagggttcggtcgtgtaggtttcgttggtcgcgcggtttttttcgtaggttagtgattaaggtttgtgtgcgttgtttttgtttcgcgggttagcggacgtttattatttaggttttcgggagcggcgggcggcggtttcggatcgagcgtttagtcgggagatagtagttcgcggaatttgagtttagaggtagcggggtttcgggtttcgtcgaattaataggcgaaaatagggtttagttttttgttcggttttttttaagttt

SEQ ID NO: 14554 - DNA, 600 bp, Artificial Sequence
  chemically treated genomic DNA (Homo sapiens) CpG-island No: 14554
aaacttaaaaaaaaccgaacaaaaaactaaaccctattttcgcctattaattcgacgaaacccgaaaccccgctacctctaaactcaaattccgcgaactactatctcccgactaaacgctcgatccgaaaccgccgcccgccgctcccgaaaacctaaataataaacgtccgctaacccgcgaaacaaaaacaacgcacacaaaccttaatcactaacctacgaaaaaaaccgcgcgaccaacgaaacctacacgaccgaaccctttaatctacctttattatcaacgaaaaacaaaactccctaaacccgacgcccgaacgcccgcgttcctaaaaaaacccaccacaccctctactccgcgccgccaacccgcgacccccaaacgcgccaaacaccctctaaacctccaataccccgacccgaaacccctccgaaaaacgcgtccctaccaaccgactctccgaaaaaccatcccccgaccaaaaacgcttaaaaaataaaaaactcccgattataaacaacttaatcgaaaaaaaaaaataaccaaaataaaaaaaaactcgaataaaaaaaacgaaacaacctaaccgcgaaaaa

SEQ ID NO: 14555 - DNA, 600 bp, Artificial Sequence
  chemically treated genomic DNA (Homo sapiens) CpG-island No: 14555
gggtttgggggaggtcgggtagggggttagattttgttttcgtttgttggttcggcggggttcggggtttcgttgtttttgggtttaggtttcgcggattgttgtttttcggttggacgttcggttcggggtcgtcgttcgtcgttttcgggagtttgggtgatggacgttcgttgattcgcggggtagaggtagcgtatataggttttgattattggtttgcggagggagtcgcgcggttagcgggatttgtacgatcgggttttttgatttgtttttattattaacgagaaataaagttttttgggttcgacgttcgggcgttcgcgtttttggggagatttattatattttttatttcgcgtcgttagttcgcggtttttaaacgcgttaggtattttttgggtttttagtgtttcggttcgaagttttttcggaaaacgcgtttttgttagtcggtttttcggaagattatttttcgattagaggcgtttagggagtggggggttttcggttatgaatagtttgatcggggagagaaaatggttaaagtgaagaaaaattcgagtaagaagagcggggtagtttggtcgcggggag

SEQ ID NO: 14556 - DNA, 600 bp, Artificial Sequence
  chemically treated genomic DNA (Homo sapiens) CpG-island No: 14556
ctccccgcgaccaaactaccccgctcttcttactcgaatttttcttcactttaaccattttctctccccgatcaaactattcataaccgaaaaccccccactccctaaacgcctctaatcgaaaaataatcttccgaaaaaccgactaacaaaaacgcgttttccgaaaaaacttcgaaccgaaacactaaaaacccaaaaaatacctaacgcgtttaaaaaccgcgaactaacgacgcgaaataaaaaatataataaatctccccaaaaacgcgaacgcccgaacgtcgaacccaaaaaactttatttctcgttaataataaaaacaaatcaaaaaacccgatcgtacaaatcccgctaaccgcgcgactccctccgcaaaccaataatcaaaacctatatacgctacctctaccccgcgaatcaacgaacgtccatcacccaaactcccgaaaacgacgaacgacgaccccgaaccgaacgtccaaccgaaaaacaacaatccgcgaaacctaaacccaaaaacaacgaaaccccgaaccccgccgaaccaacaaacgaaaacaaaatctaaccccctacccgacctcccccaaaccc

SEQ ID NO: 14557 - DNA, 594 bp, Artificial Sequence
  chemically treated genomic DNA (Homo sapiens) CpG-island No: 14557
cgtatgcgttgattaagtttaagcggtttcggatgatgttacgcgagggtttgagttagttaaggggtcggcgcgtttgggggtatgcggttgttgcgggacgtattaggtttagtcgttcgatagtcgttcgaggagtagtttagttattttagggttcggaggattaatcgtttcgatatcgtttcgggcggcggtagtgttggtcggcgaggcgaggaggtcgggtcgttacggtgggcgaaaagttttgaaagttttttttagttttttcggtgcgtttttcgttcgttttgcggaggttttgagggcggatttaaggtttcgcgagaagttatttgaggcggcgacgattgtttttagttttacgggaacgtcgcggacgtagcgtttttttttcggataagaaaatagttattttagagtaggttttttttttttttttgtttttttttttttttcgtgtttatggttgacgcgagttgtttttggacgtgggtttcgggtttgattggatagacgtgggttttgtttttgaaaggcgtaaaattttagatttgttttgtaattttttggttttcgtttttgttttta

SEQ ID NO: 14558 - DNA, 594 bp, Artificial Sequence
  chemically treated genomic DNA (Homo sapiens) CpG-island No: 14558
taaaaacaaaaacgaaaaccaaaaaattacaaaacaaatctaaaattttacgcctttcaaaaacaaaacccacgtctatccaatcaaacccgaaacccacgtccaaaaacaactcgcgtcaaccataaacacgaaaaaaaaaaaaaaacaaaaaaaaaaaaaaaacctactctaaaataactattttcttatccgaaaaaaaaacgctacgtccgcgacgttcccgtaaaactaaaaacaatcgtcgccgcctcaaataacttctcgcgaaaccttaaatccgccctcaaaacctccgcaaaacgaacgaaaaacgcaccgaaaaaactaaaaaaaactttcaaaacttttcgcccaccgtaacgacccgacctcctcgcctcgccgaccaacactaccgccgcccgaaacgatatcgaaacgattaatcctccgaaccctaaaataactaaactactcctcgaacgactatcgaacgactaaacctaatacgtcccgcaacaaccgcatacccccaaacgcgccgaccccttaactaactcaaaccctcgcgtaacatcatccgaaaccgcttaaacttaatcaacgcatacg

SEQ ID NO: 14559 - DNA, 594 bp, Artificial Sequence
  chemically treated genomic DNA (Homo sapiens) CpG-island No: 14559
tagaggtaaaaacggagattaggaggttgtaggataagtttgaggttttacgttttttagaaatagaatttacgtttgtttagttaagttcgggatttacgtttaaaagtagttcgcgttagttatgggtacgggaaaggggaaaaaataaggaaaggggaggaatttattttagaatggttgtttttttgttcgggagagggacgttgcgttcgcggcgttttcgtggggttgagaatagtcgtcgtcgttttagatggtttttcgcggggttttgaattcgtttttagggttttcgtaaggcgagcgggaggcgtatcggaagaattgagaggaatttttagggtttttcgtttatcgtggcggttcggttttttcgtttcgtcggttaatattgtcgtcgttcggggcggtgtcgaagcggttggtttttcgggttttggggtggttgggttgtttttcgggcggttgtcgggcgattaggtttggtgcgtttcgtagtagtcgtatgtttttaggcgcgtcggttttttggttggtttagattttcgcgtggtattattcgaagtcgtttaggtttagttagcgtatgcg

SEQ ID NO: 14560 - DNA, 594 bp, Artificial Sequence
  chemically treated genomic DNA (Homo sapiens) CpG-island No: 14560
cgcatacgctaactaaacctaaacgacttcgaataataccacgcgaaaatctaaaccaaccaaaaaaccgacgcgcctaaaaacatacgactactacgaaacgcaccaaacctaatcgcccgacaaccgcccgaaaaacaacccaaccaccccaaaacccgaaaaaccaaccgcttcgacaccgccccgaacgacgacaatattaaccgacgaaacgaaaaaaccgaaccgccacgataaacgaaaaaccctaaaaattcctctcaattcttccgatacgcctcccgctcgccttacgaaaaccctaaaaacgaattcaaaaccccgcgaaaaaccatctaaaacgacgacgactattctcaaccccacgaaaacgccgcgaacgcaacgtccctctcccgaacaaaaaaacaaccattctaaaataaattcctcccctttccttattttttcccctttcccgtacccataactaacgcgaactacttttaaacgtaaatcccgaacttaactaaacaaacgtaaattctatttctaaaaaacgtaaaacctcaaacttatcctacaacctcctaatctccgtttttacctcta

SEQ ID NO: 14561 - DNA, 561 bp, Artificial Sequence
  chemically treated genomic DNA (Homo sapiens) CpG-island No: 14561
ttcgtcgcggtcggtcgtcgttttttattaggtgttcggagaaatcgggatttgtttttcgcggggtagggagtttgggagtcgcgtttatcgtttattcgttcggtttttttttttcgggattcgcgtattaggacgtcgttttttcgttttttttttttcgttttttacgttcggagattttcgtcgggttcgtgttatttcgtttaggtttacgtagggttcggcgttttcggggaatatttcgtttatcgtcggttttatttcggggtcgcggcgttttaggtttattttcggttttagagtcgttttcggcgcgcgttatatggtagatttagacgtcggaggatcgcgtttttgtggtgttcgttcgttggggtgttttcggtcgtcggcgcgttcgcggttatcggcgtttgtttttgcgttggcgagggcgggcgtttgtaacgtttttgatgggcggtcgggcggttacggggagaaaaggttgttagtaatgggagtagtgtttgtagagtacgttttcgattagaggtcggatttagaataaagaaggag

SEQ ID NO: 14562 - DNA, 561 bp, Artificial Sequence
  chemically treated genomic DNA (Homo sapiens) CpG-island No: 14562
ctccttctttattctaaatccgacctctaatcgaaaacgtactctacaaacactactcccattactaacaaccttttctccccgtaaccgcccgaccgcccatcaaaaacgttacaaacgcccgccctcgccaacgcaaaaacaaacgccgataaccgcgaacgcgccgacgaccgaaaacaccccaacgaacgaacaccacaaaaacgcgatcctccgacgtctaaatctaccatataacgcgcgccgaaaacgactctaaaaccgaaaataaacctaaaacgccgcgaccccgaaataaaaccgacgataaacgaaatattccccgaaaacgccgaaccctacgtaaacctaaacgaaataacacgaacccgacgaaaatctccgaacgtaaaaaacgaaaaaaaaaaaacgaaaaaacgacgtcctaatacgcgaatcccgaaaaaaaaaaaccgaacgaataaacgataaacgcgactcccaaactccctaccccgcgaaaaacaaatcccgatttctccgaacacctaataaaaaacgacgaccgaccgcgacgaa

SEQ ID NO: 14563 - DNA, 561 bp, Artificial Sequence
  chemically treated genomic DNA (Homo sapiens) CpG-island No: 14563
ttttttttttattttggattcggtttttggtcggaggcgtgttttgtaggtattgtttttattgttggtagtttttttttttcgtggtcgttcggtcgtttattagaggcgttgtagacgttcgttttcgttagcgtaaagataaacgtcggtggtcgcggacgcgtcggcggtcgggagtattttagcgggcgggtattatagaggcgcggtttttcggcgtttagatttgttatgtggcgcgcgtcggaagcggttttgaggtcggaagtgagtttagagcgtcgcggtttcgagatgaagtcggcggtggacgagatgtttttcgagggcgtcgggttttacgtggatttggacgaggtggtacgggttcggcgggagttttcgagcgtggggagcggggaagggggagcggaagggcggcgttttggtgcgcgggtttcggggaggggaggtcgggcgggtgggcgatgggcgcggtttttaggttttttgtttcgcggagagtaaatttcggttttttcgagtatttggtgaaaggcggcgatcgatcgcggcggg

SEQ ID NO: 14564 - DNA, 561 bp, Artificial Sequence
  chemically treated genomic DNA (Homo sapiens) CpG-island No: 14564
cccgccgcgatcgatcgccgcctttcaccaaatactcgaaaaaaccgaaatttactctccgcgaaacaaaaaacctaaaaaccgcgcccatcgcccacccgcccgacctcccctccccgaaacccgcgcaccaaaacgccgcccttccgctcccccttccccgctccccacgctcgaaaactcccgccgaacccgtaccacctcgtccaaatccacgtaaaacccgacgccctcgaaaaacatctcgtccaccgccgacttcatctcgaaaccgcgacgctctaaactcacttccgacctcaaaaccgcttccgacgcgcgccacataacaaatctaaacgccgaaaaaccgcgcctctataatacccgcccgctaaaatactcccgaccgccgacgcgtccgcgaccaccgacgtttatctttacgctaacgaaaacgaacgtctacaacgcctctaataaacgaccgaacgaccacgaaaaaaaaaaactaccaacaataaaaacaatacctacaaaacacgcctccgaccaaaaaccgaatccaaaataaaaaaaaaa

SEQ ID NO: 14565 - DNA, 619 bp, Artificial Sequence
  chemically treated genomic DNA (Homo sapiens) CpG-island No: 14565
agttagttcgaatttatttgtttggtaggtgcgcgtttttcgaggcgtgataagggagcgtcggcgcggtgggtggggggtagagaatgtgaagttttagacgtatggtattcgtcgttaagtcgtcgcggtggttgtcgggatgcgtcgtagcgaatggtcgcgtcgggcgtcgttttgagtgattttttattcgcgtttagcggtttcgggcggtagtataaggcggtagttatggcggaggcggcggttgtagcgggtgggattggtttggggcgggcgcgagttacgggtttgtagcggatcgggatcgggattcggatcggatcgcgtcgggcgggaggttgcgggttttttttggttatttgttgggtcggtttcgggaggttttgagtattaatgagtgtaaagcgcggagagtcgcgtcggcgtagcggtagcgtttacgcgttattttcgtcgcgtaggagtcgggtattattttaaagaagcggtgagtagcggtatgtggaaggagttagcgtcgagggattaggtcgggttgtgttgtaggagggtataggcgaggtgggaagggaagtgatacgggtgggcggaaggtatttcggtttttgaaagt

SEQ ID NO: 14566 - DNA, 619 bp, Artificial Sequence
  chemically treated genomic DNA (Homo sapiens) CpG-island No: 14566
actttcaaaaaccgaaataccttccgcccacccgtatcacttcccttcccacctcgcctataccctcctacaacacaacccgacctaatccctcgacgctaactccttccacataccgctactcaccgcttctttaaaataatacccgactcctacgcgacgaaaataacgcgtaaacgctaccgctacgccgacgcgactctccgcgctttacactcattaatactcaaaacctcccgaaaccgacccaacaaataaccaaaaaaaacccgcaacctcccgcccgacgcgatccgatccgaatcccgatcccgatccgctacaaacccgtaactcgcgcccgccccaaaccaatcccacccgctacaaccgccgcctccgccataactaccgccttatactaccgcccgaaaccgctaaacgcgaataaaaaatcactcaaaacgacgcccgacgcgaccattcgctacgacgcatcccgacaaccaccgcgacgacttaacgacgaataccatacgtctaaaacttcacattctctaccccccacccaccgcgccgacgctcccttatcacgcctcgaaaaacgcgcacctaccaaacaaataaattcgaactaact

SEQ ID NO: 14567 - DNA, 619 bp, Artificial Sequence
  chemically treated genomic DNA (Homo sapiens) CpG-island No: 14567
atttttagggatcgggatgtttttcgtttattcgtgttatttttttttttatttcgtttgtgtttttttgtagtatagttcggtttggtttttcgacgttaattttttttatatatcgttatttatcgtttttttgggatggtgttcgatttttgcgcggcgggagtggcgcgtgggcgttgtcgttgcgtcgacgcggtttttcgcgttttgtatttattggtatttagagtttttcggggtcggtttagtagatggttagagagaattcgtagtttttcgttcggcgcggttcggttcgggtttcggtttcggttcgttgtagattcgtagttcgcgttcgttttaagttagttttattcgttgtagtcgtcgttttcgttatggttatcgttttgtgttgtcgttcggaatcgttgggcgcgggtgaaaggttatttagagcggcgttcggcgcgattattcgttgcggcgtatttcggtagttatcgcggcgatttggcggcgggtgttatgcgtttggagttttatattttttgttttttatttatcgcgtcggcgtttttttgttacgtttcgggaagcgcgtatttgttaagtaggtgagttcgagttgatt

SEQ ID NO: 14568 - DNA, 619 bp, Artificial Sequence
  chemically treated genomic DNA (Homo sapiens) CpG-island No: 14568
aatcaactcgaactcacctacttaacaaatacgcgcttcccgaaacgtaacaaaaaaacgccgacgcgataaataaaaaacaaaaaatataaaactccaaacgcataacacccgccgccaaatcgccgcgataactaccgaaatacgccgcaacgaataatcgcgccgaacgccgctctaaataacctttcacccgcgcccaacgattccgaacgacaacacaaaacgataaccataacgaaaacgacgactacaacgaataaaactaacttaaaacgaacgcgaactacgaatctacaacgaaccgaaaccgaaacccgaaccgaaccgcgccgaacgaaaaactacgaattctctctaaccatctactaaaccgaccccgaaaaactctaaataccaataaatacaaaacgcgaaaaaccgcgtcgacgcaacgacaacgcccacgcgccactcccgccgcgcaaaaatcgaacaccatcccaaaaaaacgataaataacgatatataaaaaaaattaacgtcgaaaaaccaaaccgaactatactacaaaaaaacacaaacgaaataaaaaaaaaaataacacgaataaacgaaaaacatcccgatccctaaaaat

SEQ ID NO: 14569 - DNA, 511 bp, Artificial Sequence
  chemically treated genomic DNA (Homo sapiens) CpG-island No: 14569
tagcgatcgtagttttatcgtagttattttagtagtttcgtttcgttcgcgttttttttcgtcgagtcggatcgttttttttttcgcgtatttcgtacggttcgggtttattttaagtgttcggggggggtgcgggcgggcgttcgtttagggtcgtttcgtttttcggtttgggtgtcgttagcgtttgttcgattttttgtagtttcggtcgggtcgtttgcgtcgtttatgtttttcggggcgtcgtgttgcgcgtttatcgagttttttcgttgttttttttcgtcgtcgtcgggttcgtgcgtttatttagtggtacggttttcggcggttttcgggttagtggcgttgatagaggttgatagaggcggcggcggcgggaataagggttcgtgttggtttcggcgttgggcggcggttgggagtttggtttttgttttttttttcgagcgtggtttgtttttttggtcgcggcgggattttttttttttatttttttttatttttt

SEQ ID NO: 14570 - DNA, 511 bp, Artificial Sequence
  chemically treated genomic DNA (Homo sapiens) CpG-island No: 14570
aaaaaataaaaaaaaataaaaaaaaaaaatcccgccgcgaccaaaaaaacaaaccacgctcgaaaaaaaaaacaaaaaccaaactcccaaccgccgcccaacgccgaaaccaacacgaacccttattcccgccgccgccgcctctatcaacctctatcaacgccactaacccgaaaaccgccgaaaaccgtaccactaaataaacgcacgaacccgacgacgacgaaaaaaaacaacgaaaaaactcgataaacgcgcaacacgacgccccgaaaaacataaacgacgcaaacgacccgaccgaaactacaaaaaatcgaacaaacgctaacgacacccaaaccgaaaaacgaaacgaccctaaacgaacgcccgcccgcaccccccccgaacacttaaaataaacccgaaccgtacgaaatacgcgaaaaaaaaaacgatccgactcgacgaaaaaaaacgcgaacgaaacgaaactactaaaataactacgataaaactacgatcgcta

SEQ ID NO: 14571 - DNA, 511 bp, Artificial Sequence
  chemically treated genomic DNA (Homo sapiens) CpG-island No: 14571
ggggagtgaggaggggtgagaggaggaggtttcgtcgcggttaagaaaataagttacgttcgggggaggaggtagagattaaatttttaatcgtcgtttagcgtcggggttaatacgggtttttgttttcgtcgtcgtcgtttttgttagtttttgttagcgttattggttcgggggtcgtcgaggatcgtattattgggtgaacgtacgggttcggcgacggcgaggggaggtagcgagggggttcggtgaacgcgtaatacggcgtttcgaagagtatgggcgacgtaggcggttcgatcgaggttatagagagtcgggtaagcgttaacggtatttaaatcggggagcgaggcggttttggacggacgttcgttcgtatttttttcggatatttaagatgggttcgggtcgtgcggggtgcgcggggaagggagcgattcggttcggcggggaaggacgcgggcggggcgggattgttgaggtagttgcggtggggttgcggtcgttg

SEQ ID NO: 14572 - DNA, 511 bp, Artificial Sequence
  chemically treated genomic DNA (Homo sapiens) CpG-island No: 14572
caacgaccgcaaccccaccgcaactacctcaacaatcccgccccgcccgcgtccttccccgccgaaccgaatcgctcccttccccgcgcaccccgcacgacccgaacccatcttaaatatccgaaaaaaatacgaacgaacgtccgtccaaaaccgcctcgctccccgatttaaataccgttaacgcttacccgactctctataacctcgatcgaaccgcctacgtcgcccatactcttcgaaacgccgtattacgcgttcaccgaaccccctcgctacctcccctcgccgtcgccgaacccgtacgttcacccaataatacgatcctcgacgacccccgaaccaataacgctaacaaaaactaacaaaaacgacgacgacgaaaacaaaaacccgtattaaccccgacgctaaacgacgattaaaaatttaatctctacctcctcccccgaacgtaacttattttcttaaccgcgacgaaacctcctcctctcacccctcctcactcccc

SEQ ID NO: 14573 - DNA, 513 bp, Artificial Sequence
  chemically treated genomic DNA (Homo sapiens) CpG-island No: 14573
ttttttcgggtaatgtcgtttgcgttttggtttttatcgcgtttcgtttaatttggaatttttttaaagtcggtggttttgtttcgacggtttcgcgtgtttttcgcgtttgttttttcgcgtcgcggtcgtttcgattttaatgtcggttaatcgttgttgtataaggttcgtattgttttacgtttcgtcgttttgggttttatgttcgtagttttttttttcggttattttttcggttttgtttggtcgaggtgtcgaattttgttacgtttttttcgttagggattcgcggttcgttcgggttcgtcgtaaggtagtttgggatttgtagttttttttttgggtcgggtttttttgagcgaagagtatcgggaagacggttttttcggttagtgcgttttcgtttaggcgaagaggtcgggaggagaggagatttttttttgagaacgtttattgagcgtcgatgtgaaggttacggtattgagagatttggtagaattgtttttgttt

SEQ ID NO: 14574 - DNA, 513 bp, Artificial Sequence
  chemically treated genomic DNA (Homo sapiens) CpG-island No: 14574
aaacaaaaacaattctaccaaatctctcaataccgtaaccttcacatcgacgctcaataaacgttctcaaaaaaaaatctcctctcctcccgacctcttcgcctaaacgaaaacgcactaaccgaaaaaaccgtcttcccgatactcttcgctcaaaaaaacccgacccaaaaaaaaaactacaaatcccaaactaccttacgacgaacccgaacgaaccgcgaatccctaacgaaaaaaacgtaacaaaattcgacacctcgaccaaacaaaaccgaaaaaataaccgaaaaaaaaaactacgaacataaaacccaaaacgacgaaacgtaaaacaatacgaaccttatacaacaacgattaaccgacattaaaatcgaaacgaccgcgacgcgaaaaaacaaacgcgaaaaacacgcgaaaccgtcgaaacaaaaccaccgactttaaaaaaattccaaattaaacgaaacgcgataaaaaccaaaacgcaaacgacattacccgaaaaaa

SEQ ID NO: 14575 - DNA, 513 bp, Artificial Sequence
  chemically treated genomic DNA (Homo sapiens) CpG-island No: 14575
aaatagaaatagttttattaagttttttaatgtcgtggtttttatatcgacgtttaatgaacgtttttagaagggaatttttttttttttcggttttttcgtttgggcgggggcgtattggtcgagaaagtcgttttttcgatgtttttcgtttaggagagttcggtttaggagagggattataagttttaggttgttttgcggcgggttcgggcgggtcgcggatttttgacgaggaagacgtggtagagttcggtatttcggttaggtaaagtcggagaagtggtcgagagggagggttgcgaatataggatttaagacgacgggacgtaaggtagtacgaattttgtgtagtagcggttagtcggtattgagatcgagacggtcgcgacgcgaaaggataggcgcgaggaatacgcgagatcgtcggagtagagttatcggttttggggagattttaagttagacgaggcgcggtaagagttagagcgtagacggtattgttcgagaaaa

SEQ ID NO: 14576 - DNA, 513 bp, Artificial Sequence
  chemically treated genomic DNA (Homo sapiens) CpG-island No: 14576
ttttctcgaacaataccgtctacgctctaactcttaccgcgcctcgtctaacttaaaatctccccaaaaccgataactctactccgacgatctcgcgtattcctcgcgcctatcctttcgcgtcgcgaccgtctcgatctcaataccgactaaccgctactacacaaaattcgtactaccttacgtcccgtcgtcttaaatcctatattcgcaaccctccctctcgaccacttctccgactttacctaaccgaaataccgaactctaccacgtcttcctcgtcaaaaatccgcgacccgcccgaacccgccgcaaaacaacctaaaacttataatccctctcctaaaccgaactctcctaaacgaaaaacatcgaaaaaacgactttctcgaccaatacgcccccgcccaaacgaaaaaaccgaaaaaaaaaaaaattcccttctaaaaacgttcattaaacgtcgatataaaaaccacgacattaaaaaacttaataaaactatttctattt

SEQ ID NO: 14577 - DNA, 561 bp, Artificial Sequence
  chemically treated genomic DNA (Homo sapiens) CpG-island No: 14577
ggcgtggtcgggatcgcgtaattaggtcgggagcggggtgcggggtggttttcgaggggttcgggtttaaggggttgagagaagggggcggggtcggggttggcggggtcggggttggcggggttcgtagttcgcgtagagttttttattttttttcgggtcggtgatttcgttttttttttcgttagcgaggtcgtattttgggtttcggtattcggttttttattcgggtttttaaaaatattcgagcgtcgcggtgtcgggatttcgttttgttaggaaataagaagtttttcgtttattggtcgtggttgtagttggcgattcgtttagtaaagttcgttattattggttagtttttagggtttttcgtacgttagtgggtatttgagcgagtgtcgttcggggacgatggcgggtaggagcggtcggagggttttagtagcgtttttcggaagacggttaacggtttgtttgtcgggaggcgggaaagataaagcggtagaaattgggatttaattgcgaaataaaaagatatcgtgtgaaattttttatcgttta

SEQ ID NO: 14578 - DNA, 561 bp, Artificial Sequence
  chemically treated genomic DNA (Homo sapiens) CpG-island No: 14578
taaacgataaaaaatttcacacgatatctttttatttcgcaattaaatcccaatttctaccgctttatctttcccgcctcccgacaaacaaaccgttaaccgtcttccgaaaaacgctactaaaaccctccgaccgctcctacccgccatcgtccccgaacgacactcgctcaaatacccactaacgtacgaaaaaccctaaaaactaaccaataataacgaactttactaaacgaatcgccaactacaaccacgaccaataaacgaaaaacttcttatttcctaacaaaacgaaatcccgacaccgcgacgctcgaatatttttaaaaacccgaataaaaaaccgaataccgaaacccaaaatacgacctcgctaacgaaaaaaaaaacgaaatcaccgacccgaaaaaaaataaaaaactctacgcgaactacgaaccccgccaaccccgaccccgccaaccccgaccccgcccccttctctcaaccccttaaacccgaacccctcgaaaaccaccccgcaccccgctcccgacctaattacgcgatcccgaccacgcc

SEQ ID NO: 14579 - DNA, 561 bp, Artificial Sequence
  chemically treated genomic DNA (Homo sapiens) CpG-island No: 14579
taagcgataaggagttttatacgatgtttttttatttcgtagttgagttttagtttttgtcgttttatttttttcgtttttcggtaggtaggtcgttaatcgtttttcggaagacgttgttagaatttttcggtcgtttttgttcgttatcgttttcgaacgatattcgtttaggtatttattaacgtgcgaggaattttgagagttgattaatggtagcgagttttattgggcgggtcgttagttgtagttacggttaataggcgagagattttttgttttttggtagagcggggtttcggtatcgcggcgttcgggtgtttttgggggttcgggtggagggtcgggtgtcggggtttaaggtgcggtttcgttagcgggagagggagcgggattatcggttcggagagaggtgaggggttttgcgcggattacgggtttcgttagtttcggtttcgttagtttcggtttcgttttttttttttagttttttgagttcgagtttttcgaaggttatttcgtatttcgttttcgatttggttacgcggtttcgattacgtt

SEQ ID NO: 14580 - DNA, 561 bp, Artificial Sequence
  chemically treated genomic DNA (Homo sapiens) CpG-island No: 14580
aacgtaatcgaaaccgcgtaaccaaatcgaaaacgaaatacgaaataaccttcgaaaaactcgaactcaaaaaactaaaaaaaaaaaacgaaaccgaaactaacgaaaccgaaactaacgaaacccgtaatccgcgcaaaacccctcacctctctccgaaccgataatcccgctccctctcccgctaacgaaaccgcaccttaaaccccgacacccgaccctccacccgaacccccaaaaacacccgaacgccgcgataccgaaaccccgctctaccaaaaaacaaaaaatctctcgcctattaaccgtaactacaactaacgacccgcccaataaaactcgctaccattaatcaactctcaaaattcctcgcacgttaataaatacctaaacgaatatcgttcgaaaacgataacgaacaaaaacgaccgaaaaattctaacaacgtcttccgaaaaacgattaacgacctacctaccgaaaaacgaaaaaaataaaacgacaaaaactaaaactcaactacgaaataaaaaaacatcgtataaaactccttatcgctta

SEQ ID NO: 14581 - DNA, 595 bp, Artificial Sequence
  chemically treated genomic DNA (Homo sapiens) CpG-island No: 14581
tatttcgcggtggttttttttggatcgcgaacgtcgagttcgtcgtcgttttttggagtttcggggtagcgtttgtgtcgcggtatttgtatttataggggttttgcgatcgcgacgcgtaaattttgttcgagagtcgatgggttattttggttgtttttgttttatattttttttggttttttcggacgtgtttttttgacgcgaacgatattcgttcggttaattaatttaggttttgttaggttttattcgttttgattagtgtaagagagacggcgatcgcggggtgttgtaggtttcggcgcggcgtattatcgggttgtgtcgaatttttcgggtcgttttgggatcgcgggtttggcggcgtggtcgagggttcggggagagggttacgcgttaggagagggcggcggggttgtagtataggtttttttgttttcggaagcgttcgtaagtttgggggattttttgcggtagatttgggatggtgggcggcgcgtcggtcgggtaggtttttgtagttttcgaggtttacgtgaggtcggggtcggggcggttgtatagtgtttagtatagttattggttttttttg

SEQ ID NO: 14582 - DNA, 595 bp, Artificial Sequence
  chemically treated genomic DNA (Homo sapiens) CpG-island No: 14582
caaaaaaaaccaataactatactaaacactatacaaccgccccgaccccgacctcacgtaaacctcgaaaactacaaaaacctacccgaccgacgcgccgcccaccatcccaaatctaccgcaaaaaatcccccaaacttacgaacgcttccgaaaacaaaaaaacctatactacaaccccgccgccctctcctaacgcgtaaccctctccccgaaccctcgaccacgccgccaaacccgcgatcccaaaacgacccgaaaaattcgacacaacccgataatacgccgcgccgaaacctacaacaccccgcgatcgccgtctctcttacactaatcaaaacgaataaaacctaacaaaacctaaattaattaaccgaacgaatatcgttcgcgtcaaaaaaacacgtccgaaaaaaccaaaaaaaatataaaacaaaaacaaccaaaataacccatcgactctcgaacaaaatttacgcgtcgcgatcgcaaaacccctataaatacaaataccgcgacacaaacgctaccccgaaactccaaaaaacgacgacgaactcgacgttcgcgatccaaaaaaaaccaccgcgaaata

SEQ ID NO: 14583 - DNA, 595 bp, Artificial Sequence
  chemically treated genomic DNA (Homo sapiens) CpG-island No: 14583
taagggaggttagtggttgtgttgggtattgtatagtcgtttcgatttcgattttacgtgggtttcggaggttgtagggatttattcggtcggcgcgtcgtttattattttaggtttatcgtagggaattttttaggtttgcgagcgttttcgagggtaggaaagtttgtattgtagtttcgtcgtttttttttggcgcgtagtttttttttcgagttttcggttacgtcgttaggttcgcgattttagggcggttcggggggttcggtatagttcgataatgcgtcgcgtcgaagtttgtagtatttcgcggtcgtcgttttttttgtattggttaggacgaatagagtttgataaaatttgagttaattggtcgagcgaatgtcgttcgcgttaggagagtacgttcggagaagttaagggaaatgtggagtaggagtagttaaagtggtttatcggttttcgagtagggtttgcgcgtcgcggtcgtaaagtttttgtgagtgtaggtatcgcggtataagcgttgtttcggagttttaggaggcggcggcgggttcggcgttcgcggtttaggagaaattatcgcggggtg

SEQ ID NO: 14584 - DNA, 595 bp, Artificial Sequence
  chemically treated genomic DNA (Homo sapiens) CpG-island No: 14584
caccccgcgataatttctcctaaaccgcgaacgccgaacccgccgccgcctcctaaaactccgaaacaacgcttataccgcgatacctacactcacaaaaactttacgaccgcgacgcgcaaaccctactcgaaaaccgataaaccactttaactactcctactccacatttcccttaacttctccgaacgtactctcctaacgcgaacgacattcgctcgaccaattaactcaaattttatcaaactctattcgtcctaaccaatacaaaaaaaacgacgaccgcgaaatactacaaacttcgacgcgacgcattatcgaactataccgaaccccccgaaccgccctaaaatcgcgaacctaacgacgtaaccgaaaactcgaaaaaaaaactacgcgccaaaaaaaaacgacgaaactacaatacaaactttcctaccctcgaaaacgctcgcaaacctaaaaaattccctacgataaacctaaaataataaacgacgcgccgaccgaataaatccctacaacctccgaaacccacgtaaaatcgaaatcgaaacgactatacaatacccaacacaaccactaacctccctta

SEQ ID NO: 14585 - DNA, 530 bp, Artificial Sequence
  chemically treated genomic DNA (Homo sapiens) CpG-island No: 14585
tacgttttgggagggcggtttggcggtttttttagttcggagcgcgtggaggttgcgcgtaggggttcgggacgcgggatagggatttcgcgtagtttaggcgtcggggaatcgggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcgaggttgagaggttacgtcgtgttgttggggtttttcgtcgattatatttttgggcgttagttcgggtagagatcgcggggattggttaggtcgggttaggtcgggtcgggggagggtcgcgttttcgggtttttgattttcggcggcgagaggaagcggtatttgggttatatttttttcgcgcgggtcgaggggaggggttttggttcggagataggtagattttatttattttttttttgtagatttggtt

SEQ ID NO: 14586 - DNA, 530 bp, Artificial Sequence
  chemically treated genomic DNA (Homo sapiens) CpG-island No: 14586
aaccaaatctacaaaaaaaaaataaataaaatctacctatctccgaaccaaaacccctcccctcgacccgcgcgaaaaaaatataacccaaataccgcttcctctcgccgccgaaaatcaaaaacccgaaaacgcgaccctcccccgacccgacctaacccgacctaaccaatccccgcgatctctacccgaactaacgcccaaaaatataatcgacgaaaaaccccaacaacacgacgtaacctctcaacctcgataaatacccgccgtaaaaaaaaatcctaaaaacccactaaaaaccgcgacccgcaacaaccaaaaaccgaaccacgaccacgaacgccctaatatcccgatccgtaccgaacctccaaacgaaaaaaacgtccgctaaactcaaatccccgactccaacccgattccccgacgcctaaactacgcgaaatccctatcccgcgtcccgaacccctacgcgcaacctccacgcgctccgaactaaaaaaaccgccaaaccgccctcccaaaacgta

SEQ ID NO: 14587 - DNA, 530 bp, Artificial Sequence
  chemically treated genomic DNA (Homo sapiens) CpG-island No: 14587
agttaagtttgtagaaaaaaaataaatgaagtttgtttattttcgggttagagttttttttttcggttcgcgcgggaggagtgtgatttaggtgtcgttttttttcgtcgtcgagggttaggagttcgggagcgcgattttttttcggttcggtttggttcggtttggttagttttcgcggtttttgttcgggttgacgtttaggaatgtggtcgacgagaagttttaatagtacggcgtggttttttagtttcggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagttcggtttttcggcgtttgggttgcgcggagtttttgtttcgcgtttcggatttttacgcgtagtttttacgcgtttcgagttggagaagtcgttagatcgtttttttagggcgtg

SEQ ID NO: 14588 - DNA, 530 bp, Artificial Sequence
  chemically treated genomic DNA (Homo sapiens) CpG-island No: 14588
cacgccctaaaaaaacgatctaacgacttctccaactcgaaacgcgtaaaaactacgcgtaaaaatccgaaacgcgaaacaaaaactccgcgcaacccaaacgccgaaaaaccgaactaaaatcgaaaatctaaacccaacgaacgcctcctccgcctaaaaacccgacacgaaccgaaacaccaaaacgtccgtaaccgtaactcgacccctaactactacgaaccgcgacctccaataaatccccaaaacccttccccacgacgaatactcaccgaaactaaaaaaccacgccgtactattaaaacttctcgtcgaccacattcctaaacgtcaacccgaacaaaaaccgcgaaaactaaccaaaccgaaccaaaccgaaccgaaaaaaaatcgcgctcccgaactcctaaccctcgacgacgaaaaaaaacgacacctaaatcacactcctcccgcgcgaaccgaaaaaaaaaactctaacccgaaaataaacaaacttcatttattttttttctacaaacttaact

SEQ ID NO: 14589 - DNA, 649 bp, Artificial Sequence
  chemically treated genomic DNA (Homo sapiens) CpG-island No: 14589
acgttttttatagtttcggttttaggttcgcgttttttttttcgtcggcggttcggatgggtcgttaggggtcgttgcgcgtcgcgcgggcgaggatcggttttttttttttatttttatcgtttcgttgtttcgttttcgcggcgtagtcggcgttaaaattaaacgcgttttggtttgtttcgtttttttttttaagcgcgggttcggttagcggaagttttgcgttcgcgttatggtaaggattgaggttacggtttcgcgttttttttttttttagtgtgtgggtttcgcgtttttcggttgtatgtggatttcggttatgcgttgatcgttatttcgggcgcgggagcggtcgtacggttttcggttttatcgtgtaggggtttagttcgtttttcgtagttattcgatatttcgcgtttttcgtcgtttttgttcggagtttcgaggtcggggtatttcgttttttttcgtttatttcgcgtttgtttttagagtcgttcgggcgggttaggttagaacgcgggaagcgttcgcgaacgtgattcgagaattttattaatttggatttatttaaaagattacggggtttttgagaatttgggttttttacgtttttagtttcggtttcgcgtggtgtagtttt

SEQ ID NO: 14590 - DNA, 649 bp, Artificial Sequence
  chemically treated genomic DNA (Homo sapiens) CpG-island No: 14590
aaaactacaccacgcgaaaccgaaactaaaaacgtaaaaaacccaaattctcaaaaaccccgtaatcttttaaataaatccaaattaataaaattctcgaatcacgttcgcgaacgcttcccgcgttctaacctaacccgcccgaacgactctaaaaacaaacgcgaaataaacgaaaaaaaacgaaataccccgacctcgaaactccgaacaaaaacgacgaaaaacgcgaaatatcgaataactacgaaaaacgaactaaacccctacacgataaaaccgaaaaccgtacgaccgctcccgcgcccgaaataacgatcaacgcataaccgaaatccacatacaaccgaaaaacgcgaaacccacacactaaaaaaaaaaaaaacgcgaaaccgtaacctcaatccttaccataacgcgaacgcaaaacttccgctaaccgaacccgcgcttaaaaaaaaaaacgaaacaaaccaaaacgcgtttaattttaacgccgactacgccgcgaaaacgaaacaacgaaacgataaaaataaaaaaaaaaaaccgatcctcgcccgcgcgacgcgcaacgacccctaacgacccatccgaaccgccgacgaaaaaaaaaacgcgaacctaaaaccgaaactataaaaaacgt

SEQ ID NO: 14591 - DNA, 649 bp, Artificial Sequence
  chemically treated genomic DNA (Homo sapiens) CpG-island No: 14591
ggggttatattacgcggggtcgaagttggaggcgtagggagtttaggtttttaagggtttcgtggttttttagataaatttaggttggtgaagttttcgggttacgttcgcgaacgtttttcgcgttttaatttaattcgttcgaacggttttggggatagacgcggggtgagcggggggaggcgggatgtttcggtttcgggatttcggataggagcggcggggaacgcgaagtgtcgagtggttgcggggggcgggttgggtttttatacggtgaggtcgagagtcgtgcgatcgttttcgcgttcggaatggcggttaacgtatggtcgggatttatatgtagtcgaggggcgcgaagtttatatattagggaggaagaagacgcgggatcgtagttttagtttttattatggcgcgggcgtagggttttcgttggtcgggttcgcgtttggggagaggggcgggataggttaggacgcgtttgattttggcgtcgattacgtcgcgggggcggagtagcgagacggtggaggtgggggaaagaggtcggttttcgttcgcgcggcgcgtagcgatttttagcgatttattcgagtcgtcggcgggggaaggggcgcgggtttggggtcggggttgtggggagcgt

SEQ ID NO: 14592 - DNA, 649 bp, Artificial Sequence
  chemically treated genomic DNA (Homo sapiens) CpG-island No: 14592
acgctccccacaaccccgaccccaaacccgcgccccttcccccgccgacgactcgaataaatcgctaaaaatcgctacgcgccgcgcgaacgaaaaccgacctctttcccccacctccaccgtctcgctactccgcccccgcgacgtaatcgacgccaaaatcaaacgcgtcctaacctatcccgcccctctccccaaacgcgaacccgaccaacgaaaaccctacgcccgcgccataataaaaactaaaactacgatcccgcgtcttcttcctccctaatatataaacttcgcgcccctcgactacatataaatcccgaccatacgttaaccgccattccgaacgcgaaaacgatcgcacgactctcgacctcaccgtataaaaacccaacccgccccccgcaaccactcgacacttcgcgttccccgccgctcctatccgaaatcccgaaaccgaaacatcccgcctccccccgctcaccccgcgtctatccccaaaaccgttcgaacgaattaaattaaaacgcgaaaaacgttcgcgaacgtaacccgaaaacttcaccaacctaaatttatctaaaaaaccacgaaacccttaaaaacctaaactccctacgcctccaacttcgaccccgcgtaatataacccc

SEQ ID NO: 14593 - DNA, 1354 bp, Artificial Sequence
  chemically treated genomic DNA (Homo sapiens) CpG-island No: 14593
tacgcgcgggtttttttttttttttcgcgttttttattcgcgtatagcgttagcgtttttaaggagttgtagcgtcgcgatcgtcgttttttcgtttattttcgcggattcgcgttttttttttttttttcgggtagcgtcgttggtttttagttttattttcgtcgaggggatttttgtgtttcgggggattttttgttttttttttttttttcgtttcgcgaggagatcggtttttttcgtagattaaagcggtagcgagtatcggaggcggcggcgtttatatttgtcggcgttttttgggaagtagttcgtagatatttatattttattcgagtttcggaaattttcgggcgatttaaggttttcgttggatcggagaggtgataggcgtacgttagtttttcgcgtcgcgttttttcgtttaatttttcgatcgggtttgagttattcgcgtttttagtagttttcgttttcgtttttgttttacgtacgttgtcggtttcgcggtcgattcgatattaggggaaagcgcggcgcggacgttagtcgttaatttattagtaagagcgatgatcgcgggtttcgaggcgaggcgaagagaggcgcggggggaagttgttcgcgtgagttcgcggcgatcggatgtaagttcgggttttagcggtcggtagacgtgagcgttttcgagcgtagttttcgtcgttatatgtcgttttgttttcgtcgcgggttcggagtttcgggaggggtcgcgggtgttttacgcgttgttaagtttttcggttaatatggtttcgcgtcgacgagtcgcgcggacggtttattaattttttcggagtagtcggtacgagcgcgcgggtcgacggcgggttgagattgtttggtcgggcgttggtttttttttcgcggttttgcggcggttcgcggggagtttaggagattgcgggcgagattgttcgttttttgcgtgggcgtcgtttttatattcggcggttgcggattgacgttttcgtttgtttttcggaggagagcgagtgtaagagaaaaaatatttttattgaaacgatttaattagcggcggcggagaaaagcgatcggtcgcgggagtttattttattttcgtttgagcggttcgtcgggggtagcgcgatttttgtcggcggcggcggaggcgggggcggggtcggcggtcggggcggggtttgtagggcggggcgggtgttttcgggaaattgttcgtttcgaaatgcgggcgtcgggggagcggcggagggggttaggggattttatcggaatgagtgtttgttcgtagcgattgggggagaaattatgtgaataatttagttttttt

SEQ ID NO: 14594 - DNA, 1354 bp, Artificial Sequence
  chemically treated genomic DNA (Homo sapiens) CpG-island No: 14594
aaaaaaactaaattattcacataatttctcccccaatcgctacgaacaaacactcattccgataaaatcccctaaccccctccgccgctcccccgacgcccgcatttcgaaacgaacaatttcccgaaaacacccgccccgccctacaaaccccgccccgaccgccgaccccgcccccgcctccgccgccgccgacaaaaatcgcgctacccccgacgaaccgctcaaacgaaaataaaataaactcccgcgaccgatcgcttttctccgccgccgctaattaaatcgtttcaataaaaatattttttctcttacactcgctctcctccgaaaaacaaacgaaaacgtcaatccgcaaccgccgaatataaaaacgacgcccacgcaaaaaacgaacaatctcgcccgcaatctcctaaactccccgcgaaccgccgcaaaaccgcgaaaaaaaaaccaacgcccgaccaaacaatctcaacccgccgtcgacccgcgcgctcgtaccgactactccgaaaaaattaataaaccgtccgcgcgactcgtcgacgcgaaaccatattaaccgaaaaacttaacaacgcgtaaaacacccgcgacccctcccgaaactccgaacccgcgacgaaaacaaaacgacatataacgacgaaaactacgctcgaaaacgctcacgtctaccgaccgctaaaacccgaacttacatccgatcgccgcgaactcacgcgaacaacttccccccgcgcctctcttcgcctcgcctcgaaacccgcgatcatcgctcttactaataaattaacgactaacgtccgcgccgcgctttcccctaatatcgaatcgaccgcgaaaccgacaacgtacgtaaaacaaaaacgaaaacgaaaactactaaaaacgcgaataactcaaacccgatcgaaaaattaaacgaaaaaacgcgacgcgaaaaactaacgtacgcctatcacctctccgatccaacgaaaaccttaaatcgcccgaaaatttccgaaactcgaataaaatataaatatctacgaactacttcccaaaaaacgccgacaaatataaacgccgccgcctccgatactcgctaccgctttaatctacgaaaaaaaccgatctcctcgcgaaacgaaaaaaaaaaaaaaaacaaaaaatcccccgaaacacaaaaatcccctcgacgaaaataaaactaaaaaccaacgacgctacccgaaaaaaaaaaaaaaaacgcgaatccgcgaaaataaacgaaaaaacgacgatcgcgacgctacaactccttaaaaacgctaacgctatacgcgaataaaaaacgcgaaaaaaaaaaaaaaacccgcgcgta

SEQ ID NO: 14595 - DNA, 1354 bp, Artificial Sequence
  chemically treated genomic DNA (Homo sapiens) CpG-island No: 14595
ggaggggttgaattatttatataattttttttttagtcgttgcggataggtatttatttcggtggggttttttggtttttttcgtcgttttttcgacgttcgtatttcggagcgggtagtttttcggggatattcgtttcgttttgtaggtttcgtttcggtcgtcggtttcgttttcgttttcgtcgtcgtcggtaggggtcgcgttgttttcggcgagtcgtttaggcgggggtggggtaagttttcgcggtcggtcgttttttttcgtcgtcgttggttggatcgttttaataaaagtgtttttttttttgtattcgttttttttcggggaataggcggaggcgttaattcgtagtcgtcgagtgtgaaagcgacgtttacgtaaggagcgaatagtttcgttcgtagttttttgagtttttcgcgggtcgtcgtagagtcgcggagaaggagttagcgttcggttagatagttttagttcgtcgtcggttcgcgcgttcgtgtcggttgtttcgaggggattagtgggtcgttcgcgcggttcgtcggcgcgaagttatgttgatcgagggatttggtaacgcgtgagatattcgcggtttttttcgaggtttcggattcgcggcgagagtaaggcggtatgtggcggcggaggttgcgttcggaagcgtttacgtttgtcggtcgttgagattcggatttgtattcggtcgtcgcgggtttacgcgagtagttttttttcgcgttttttttcgtttcgtttcgggattcgcggttatcgtttttgttggtgagttggcggttggcgttcgcgtcgcgtttttttttggtgtcgggtcggtcgcggggtcggtagcgtgcgtgggatagaggcgggggcgggggttattgggggcgcgggtggtttaggttcggtcgggaagttgagcgaggaggcgcggcgcggggggttagcgtgcgtttgttattttttcggtttagcgaggattttgggtcgttcggggattttcggggttcgggtggggtgtgagtgtttgcgagttgttttttaggaggcgtcgatagatatagacgtcgtcgttttcggtgttcgttgtcgttttggtttgcgggggaggtcggttttttcgcgaggcggaggaggggaaagaggtagaaagtttttcgagatataaaggttttttcggcgggggtggagttggaggttagcgacgttgttcgggagggaaggaaggggcgcgggttcgcggaggtgggcgaggaggcggcggtcgcggcgttgtagttttttggagacgttggcgttgtgcgcgggtggggagcgcggaggaggaggaggagttcgcgcgtg

SEQ ID NO: 14596 - DNA, 1354 bp, Artificial Sequence
  chemically treated genomic DNA (Homo sapiens) CpG-island No: 14596
cacgcgcgaactcctcctcctcctccgcgctccccacccgcgcacaacgccaacgtctccaaaaaactacaacgccgcgaccgccgcctcctcgcccacctccgcgaacccgcgccccttccttccctcccgaacaacgtcgctaacctccaactccacccccgccgaaaaaacctttatatctcgaaaaactttctacctctttcccctcctccgcctcgcgaaaaaaccgacctcccccgcaaaccaaaacgacaacgaacaccgaaaacgacgacgtctatatctatcgacgcctcctaaaaaacaactcgcaaacactcacaccccacccgaaccccgaaaatccccgaacgacccaaaatcctcgctaaaccgaaaaaataacaaacgcacgctaaccccccgcgccgcgcctcctcgctcaacttcccgaccgaacctaaaccacccgcgcccccaataacccccgcccccgcctctatcccacgcacgctaccgaccccgcgaccgacccgacaccaaaaaaaaacgcgacgcgaacgccaaccgccaactcaccaacaaaaacgataaccgcgaatcccgaaacgaaacgaaaaaaaacgcgaaaaaaaactactcgcgtaaacccgcgacgaccgaatacaaatccgaatctcaacgaccgacaaacgtaaacgcttccgaacgcaacctccgccgccacataccgccttactctcgccgcgaatccgaaacctcgaaaaaaaccgcgaatatctcacgcgttaccaaatccctcgatcaacataacttcgcgccgacgaaccgcgcgaacgacccactaatcccctcgaaacaaccgacacgaacgcgcgaaccgacgacgaactaaaactatctaaccgaacgctaactccttctccgcgactctacgacgacccgcgaaaaactcaaaaaactacgaacgaaactattcgctccttacgtaaacgtcgctttcacactcgacgactacgaattaacgcctccgcctattccccgaaaaaaaacgaatacaaaaaaaaaaacacttttattaaaacgatccaaccaacgacgacgaaaaaaaacgaccgaccgcgaaaacttaccccacccccgcctaaacgactcgccgaaaacaacgcgacccctaccgacgacgacgaaaacgaaaacgaaaccgacgaccgaaacgaaacctacaaaacgaaacgaatatccccgaaaaactacccgctccgaaatacgaacgtcgaaaaaacgacgaaaaaaaccaaaaaaccccaccgaaataaatacctatccgcaacgactaaaaaaaaaattatataaataattcaacccctcc

SEQ ID NO: 14597 - DNA, 643 bp, Artificial Sequence
  chemically treated genomic DNA (Homo sapiens) CpG-island No: 14597
ttaagcgttcgaaagaaagttttacgaatttataaaggttttttttcgtttttttttcgaagttttttttttattttgtatttcggttgtggatttattttttttttgttgattcggttatcggtttgtcgggtttggcgttttttagaaggtttagcgtcgggaaggggtttgtagttgtttcgttatcgtgcggttcgacgttatttcgcgttcgtgtgtaggttcggttcggtttttggttttcggtgcgagggttaacgcgaggtttcggtttcggttttcggattaggtcgtgatttcgggtgttatgaagtaggagggttcggcgcggcgtcgcggcgcggataaggcggagtcgtcgttcggcggaggagaataagaatttttatcgtcgtcggttttttaggatgtggagatgaaagaggaggtagcgacgggtggcgggtcgacgggggaggtagacggtaagacggcggcggtagcggttgagtatttttagcgagagttggatatagttattttggagggtacggtagtttaggtcgggaacgtgatcgatcgcgggtgatagcgatttttgtgatttggttttttgttgggaagttatagtagtttttattatttttagttttttgggatt

SEQ ID NO: 14598 - DNA, 643 bp, Artificial Sequence
  chemically treated genomic DNA (Homo sapiens) CpG-island No: 14598
aatcccaaaaaactaaaaataataaaaactactataacttcccaacaaaaaaccaaatcacaaaaatcgctatcacccgcgatcgatcacgttcccgacctaaactaccgtaccctccaaaataactatatccaactctcgctaaaaatactcaaccgctaccgccgccgtcttaccgtctacctcccccgtcgacccgccacccgtcgctacctcctctttcatctccacatcctaaaaaaccgacgacgataaaaattcttattctcctccgccgaacgacgactccgccttatccgcgccgcgacgccgcgccgaaccctcctacttcataacacccgaaatcacgacctaatccgaaaaccgaaaccgaaacctcgcgttaaccctcgcaccgaaaaccaaaaaccgaaccgaacctacacacgaacgcgaaataacgtcgaaccgcacgataacgaaacaactacaaaccccttcccgacgctaaaccttctaaaaaacgccaaacccgacaaaccgataaccgaatcaacaaaaaaaaaataaatccacaaccgaaatacaaaataaaaaaaaaacttcgaaaaaaaaacgaaaaaaaacctttataaattcgtaaaactttctttcgaacgcttaa

SEQ ID NO: 14599 - DNA, 643 bp, Artificial Sequence
  chemically treated genomic DNA (Homo sapiens) CpG-island No: 14599
gattttaaagaattgagggtggtggaggttgttgtggttttttagtaagaagttaaattataggggtcgttgttattcgcgatcggttacgttttcggtttgggttgtcgtattttttaaggtgattgtgtttagttttcgttgggagtgtttagtcgttgtcgtcgtcgttttgtcgtttgtttttttcgtcgattcgttattcgtcgttgtttttttttttatttttatattttggggggtcggcggcggtgggggtttttgttttttttcgtcgggcggcggtttcgttttgttcgcgtcgcggcgtcgcgtcgagtttttttgttttatggtattcggggttacggtttagttcggggatcgaggtcggggtttcgcgttaattttcgtatcggggattaggagtcgagtcgggtttgtatacgagcgcgagatagcgtcgggtcgtacgatgacggagtagttgtaaattttttttcggcgttgggttttttgggaaacgttaggttcggtaggtcgatggtcgagttaataaaggggaaataaatttatagtcgaggtgtaggatgaaggaggagtttcgaggaaggagcggggaggagtttttatgggttcgtggggttttttttcgagcgtttaa

SEQ ID NO: 14600 - DNA, 643 bp, Artificial Sequence
  chemically treated genomic DNA (Homo sapiens) CpG-island No: 14600
ttaaacgctcgaaaaaaaaccccacgaacccataaaaactcctccccgctccttcctcgaaactcctccttcatcctacacctcgactataaatttatttcccctttattaactcgaccatcgacctaccgaacctaacgtttcccaaaaaacccaacgccgaaaaaaaatttacaactactccgtcatcgtacgacccgacgctatctcgcgctcgtatacaaacccgactcgactcctaatccccgatacgaaaattaacgcgaaaccccgacctcgatccccgaactaaaccgtaaccccgaataccataaaacaaaaaaactcgacgcgacgccgcgacgcgaacaaaacgaaaccgccgcccgacgaaaaaaaacaaaaacccccaccgccgccgaccccccaaaatataaaaataaaaaaaaaaacaacgacgaataacgaatcgacgaaaaaaacaaacgacaaaacgacgacgacaacgactaaacactcccaacgaaaactaaacacaatcaccttaaaaaatacgacaacccaaaccgaaaacgtaaccgatcgcgaataacaacgacccctataatttaacttcttactaaaaaaccacaacaacctccaccaccctcaattctttaaaatc

SEQ ID NO: 14601 - DNA, 621 bp, Artificial Sequence
  chemically treated genomic DNA (Homo sapiens) CpG-island No: 14601
  misc_feature (367)..(367): n is either a, c, g or t
  misc_feature (528)..(528): n is either a, c, g or t
cgtcgtttttcgcgtttacgtcgtcgttcgcgggtcggtagtatacgaaattttggtcgtaggttcgcgacgcggggtcgtagttttcgtattggttgacgaagggcgtttgcgggtaggggaattgttgcgggtaggagggttgttggcggtaggtgttggcgaaggtcgaagtcgcgatcgaggaggcggagttttcgtgtcgttgttgggagacggaggtgcgggttcgggttatgttcgtgttgttttcgacggttatttcgcgttagttgtcgggtatttggttaaagtcgaatgggtgtcgcgtttggtcgcgtacggtgttcgagtttacgcgtttcggtaggggtagggacggcgtttngtcgacgtcgggggttttcgtggttgcgtcgttgttgggtttggggcgcgtcggttagtagtattcgggagttattttcggagcgttgaggttcggtcggtacgtattttgagttcgagttgagtaagttgtatatttgttcgttgtttttttattggatntagttgtcgttagcgggcggggttcgagttttgttcgggttgcgtttgttgttcgtgtattagtacgtataggtaggcgttttatattagggt

SEQ ID NO: 14602 - DNA, 621 bp, Artificial Sequence
  chemically treated genomic DNA (Homo sapiens) CpG-island No: 14602
  misc_feature (94)..(94): n is either a, c, g or t
  misc_feature (255)..(255): n is either a, c, g or t
accctaatataaaacgcctacctatacgtactaatacacgaacaacaaacgcaacccgaacaaaactcgaaccccgcccgctaacgacaactanatccaataaaaaaacaacgaacaaatatacaacttactcaactcgaactcaaaatacgtaccgaccgaacctcaacgctccgaaaataactcccgaatactactaaccgacgcgccccaaacccaacaacgacgcaaccacgaaaacccccgacgtcgacnaaacgccgtccctacccctaccgaaacgcgtaaactcgaacaccgtacgcgaccaaacgcgacacccattcgactttaaccaaatacccgacaactaacgcgaaataaccgtcgaaaacaacacgaacataacccgaacccgcacctccgtctcccaacaacgacacgaaaactccgcctcctcgatcgcgacttcgaccttcgccaacacctaccgccaacaaccctcctacccgcaacaattcccctacccgcaaacgcccttcgtcaaccaatacgaaaactacgaccccgcgtcgcgaacctacgaccaaaatttcgtatactaccgacccgcgaacgacgacgtaaacgcgaaaaacgacg

SEQ ID NO: 14603 - DNA, 621 bp, Artificial Sequence
  chemically treated genomic DNA (Homo sapiens) CpG-island No: 14603
  misc_feature (94)..(94): n is either a, c, g or t
  misc_feature (255)..(255): n is either a, c, g or t
gttttggtgtggggcgtttgtttgtgcgtgttggtgtacgggtagtaggcgtagttcgggtagggttcggatttcgttcgttggcggtagttgnatttagtgggagaataacgggtaggtgtatagtttgtttaattcgggtttagagtacgtgtcggtcggattttagcgtttcgagagtagttttcgggtgttgttggtcggcgcgttttaggtttagtagcggcgtagttacgggagttttcggcgtcggtnaggcgtcgtttttgtttttgtcggggcgcgtgggttcggatatcgtgcgcggttaggcgcggtatttattcggttttggttaggtgttcgataattggcgcgaggtggtcgtcggggatagtacgggtatggttcgggttcgtattttcgttttttagtaacggtacgggggtttcgttttttcggtcgcggtttcggttttcgttagtatttatcgttagtagtttttttattcgtagtagtttttttattcgtaggcgtttttcgttagttagtacgagaattacgatttcgcgtcgcggatttacgattagggtttcgtgtattatcggttcgcgggcggcggcgtgggcgcggggggcggcg

SEQ ID NO: 14604 - DNA, 621 bp, Artificial Sequence
  chemically treated genomic DNA (Homo sapiens) CpG-island No: 14604
  misc_feature (367)..(367): n is either a, c, g or t
  misc_feature (528)..(528): n is either a, c, g or t
cgccgccccccgcgcccacgccgccgcccgcgaaccgataatacacgaaaccctaatcgtaaatccgcgacgcgaaatcgtaattctcgtactaactaacgaaaaacgcctacgaataaaaaaactactacgaataaaaaaactactaacgataaatactaacgaaaaccgaaaccgcgaccgaaaaaacgaaacccccgtaccgttactaaaaaacgaaaatacgaacccgaaccatacccgtactatccccgacgaccacctcgcgccaattatcgaacacctaaccaaaaccgaataaataccgcgcctaaccgcgcacgatatccgaacccacgcgccccgacaaaaacaaaaacgacgcctnaccgacgccgaaaactcccgtaactacgccgctactaaacctaaaacgcgccgaccaacaacacccgaaaactactctcgaaacgctaaaatccgaccgacacgtactctaaacccgaattaaacaaactatacacctacccgttattctcccactaaatncaactaccgccaacgaacgaaatccgaaccctacccgaactacgcctactacccgtacaccaacacgcacaaacaaacgccccacaccaaaac

SEQ ID NO: 14605 - DNA, 546 bp, Artificial Sequence
  chemically treated genomic DNA (Homo sapiens) CpG-island No: 14605
  misc_feature (8)..(8): n is either a, c, g or t
cgaagttnatcggtgcgtacggtagtttgtaggttttggggttttttttggcgtaggcggtagagcgtttggcgtaggaaatcgtgtatgtttagtattttttggttcgaggcgtagtattttattttttgtattagcgcgttgttcgtgcggatgcgttgtagtatagtatttaggcggtttagtcgattggttattttttcgtagtcgcgttggtatcgcgcgtttatagtttttagtagttcgcgtttttgagttcgtacgtgagttattatttggcgtacgcgttcgcggattagtttttcggtttcggtacgcgcgcggtttagttggtcgacggtcgcgtgtatttgcgcgtgaatcgcgttaaaggtattattttgtttttgtagcgtttgcgttatggcgtttagttttttttgtcgttgttggatttttgcgttgatgtcgtatttgagtttattgtggttgttgttaaggagcgcgtacgagtagtatagcggtttggaatattttcggtagtagatgttgtggatatataaggtt

SEQ ID NO: 14606 - DNA, 546 bp, Artificial Sequence
  chemically treated genomic DNA (Homo sapiens) CpG-island No: 14606
  misc_feature (539)..(539): n is either a, c, g or t
aaccttatatatccacaacatctactaccgaaaatattccaaaccgctatactactcgtacgcgctccttaacaacaaccacaataaactcaaatacgacatcaacgcaaaaatccaacaacgacaaaaaaaactaaacgccataacgcaaacgctacaaaaacaaaataatacctttaacgcgattcacgcgcaaatacacgcgaccgtcgaccaactaaaccgcgcgcgtaccgaaaccgaaaaactaatccgcgaacgcgtacgccaaataataactcacgtacgaactcaaaaacgcgaactactaaaaactataaacgcgcgataccaacgcgactacgaaaaaataaccaatcgactaaaccgcctaaatactatactacaacgcatccgcacgaacaacgcgctaatacaaaaaataaaatactacgcctcgaaccaaaaaatactaaacatacacgatttcctacgccaaacgctctaccgcctacgccaaaaaaaaccccaaaacctacaaactaccgtacgcaccgatnaacttcg

SEQ ID NO: 14607 - DNA, 546 bp, Artificial Sequence
  chemically treated genomic DNA (Homo sapiens) CpG-island No: 14607
  misc_feature (539)..(539): n is either a, c, g or t
aattttgtgtgtttatagtatttattgtcgaggatgttttaagtcgttgtgttgttcgtgcgcgttttttgatagtagttatagtgagtttaagtgcgatattagcgtagagatttagtagcgataggaggagttggacgttatgacgtaggcgttgtaggagtaggatagtgtttttggcgcggtttacgcgtagatgtacgcggtcgtcggttagttgggtcgcgcgcgtgtcgagatcgaggagttgattcgcgagcgcgtgcgttaggtggtagtttacgtgcgggtttaggagcgcgagttgttggaggttgtggacgcgcggtattagcgcgattacgaggagatggttagtcggttgggtcgtttggatgttgtgttgtagcgtattcgtacgggtagcgcgttggtgtagaggatgaagtgttacgtttcggattaggaggtgttggatatgtacggttttttgcgttaggcgttttgtcgtttgcgttaggaggagttttagagtttgtaagttgtcgtgcgtatcgatnggtttcg

SEQ ID NO: 14608 - DNA, 546 bp, Artificial Sequence
  chemically treated genomic DNA (Homo sapiens) CpG-island No: 14608
  misc_feature (8)..(8): n is either a, c, g or t
cgaaaccnatcgatacgcacgacaacttacaaactctaaaactcctcctaacgcaaacgacaaaacgcctaacgcaaaaaaccgtacatatccaacacctcctaatccgaaacgtaacacttcatcctctacaccaacgcgctacccgtacgaatacgctacaacacaacatccaaacgacccaaccgactaaccatctcctcgtaatcgcgctaataccgcgcgtccacaacctccaacaactcgcgctcctaaacccgcacgtaaactaccacctaacgcacgcgctcgcgaatcaactcctcgatctcgacacgcgcgcgacccaactaaccgacgaccgcgtacatctacgcgtaaaccgcgccaaaaacactatcctactcctacaacgcctacgtcataacgtccaactcctcctatcgctactaaatctctacgctaatatcgcacttaaactcactataactactatcaaaaaacgcgcacgaacaacacaacgacttaaaacatcctcgacaataaatactataaacacacaaaatt

SEQ ID NO: 14609 - DNA, 528 bp, Artificial Sequence
  chemically treated genomic DNA (Homo sapiens) CpG-island No: 14609
  misc_feature (183)..(183): n is either a, c, g or t
ttttatcgtaaggggagttatgcgacggcggaagcgggtttcggtcggtattttttttttgcgttcgcgtcgtcgcgggtggtcgcgcgggtgaagtcggaagtagtagttaggagggcggggtcgcgtagggtttattggttagggagggcgtcgcgcggaggcgcggggcgtgttttttgnttaaaagttatgttcggtaggtttgggtatcgggcgttgtttttgggtgattttgatcgtttttagtagtcgagtttcggttttttgggttcgtagaagggttgtttgttttcggagcggggcggcgtggggataggggtcggtgagtggtcgtttggtacggcggagtcgggggggatcggtcggtaatttttaggttcgaatttttgttttcgaggagtcggtcggttcggtgtcgtcgtattttacgaggggggattgagaaagggatacgatgtggagagggggttggattcggcgtttggtgttagcgtcgattcgttttttttagggttatggggtttt

SEQ ID NO: 14610 - DNA, 528 bp, Artificial Sequence
  chemically treated genomic DNA (Homo sapiens) CpG-island No: 14610
  misc_feature (346)..(346): n is either a, c, g or t
aaaaccccataaccctaaaaaaaacgaatcgacgctaacaccaaacgccgaatccaaccccctctccacatcgtatccctttctcaatcccccctcgtaaaatacgacgacaccgaaccgaccgactcctcgaaaacaaaaattcgaacctaaaaattaccgaccgatcccccccgactccgccgtaccaaacgaccactcaccgacccctatccccacgccgccccgctccgaaaacaaacaacccttctacgaacccaaaaaaccgaaactcgactactaaaaacgatcaaaatcacccaaaaacaacgcccgatacccaaacctaccgaacataacttttaancaaaaaacacgccccgcgcctccgcgcgacgccctccctaaccaataaaccctacgcgaccccgccctcctaactactacttccgacttcacccgcgcgaccacccgcgacgacgcgaacgcaaaaaaaaaataccgaccgaaacccgcttccgccgtcgcataactccccttacgataaaa

SEQ ID NO: 14611 - DNA, 528 bp, Artificial Sequence
  chemically treated genomic DNA (Homo sapiens) CpG-island No: 14611
  misc_feature (346)..(346): n is either a, c, g or t
aaagttttatgattttagggagggcggatcggcgttagtattaggcgtcgggtttagttttttttttatatcgtattttttttttagttttttttcgtagggtgcgacggtatcgggtcggtcgatttttcggaggtagagattcgggtttgggggttgtcggtcggtttttttcggtttcgtcgtgttaggcggttatttatcggtttttgtttttacgtcgtttcgtttcggggataagtagtttttttgcgagtttagaaagtcgaagttcgattgttggaagcggttaaaattatttaggggtagcgttcggtatttagatttgtcgagtatggtttttgantaggagatacgtttcgcgttttcgcgcggcgttttttttggttagtgggttttacgcggtttcgtttttttggttgttgttttcggttttattcgcgcggttattcgcggcggcgcgggcgtaggaagaggatgtcggtcggggttcgttttcgtcgtcgtatggttttttttgcggtggga

SEQ ID NO: 14612 - DNA, 528 bp, Artificial Sequence
  chemically treated genomic DNA (Homo sapiens) CpG-island No: 14612
  misc_feature (183)..(183): n is either a, c, g or t
tcccaccgcaaaaaaaaccatacgacgacgaaaacgaaccccgaccgacatcctcttcctacgcccgcgccgccgcgaataaccgcgcgaataaaaccgaaaacaacaaccaaaaaaacgaaaccgcgtaaaacccactaaccaaaaaaaacgccgcgcgaaaacgcgaaacgtatctcctantcaaaaaccatactcgacaaatctaaataccgaacgctacccctaaataattttaaccgcttccaacaatcgaacttcgactttctaaactcgcaaaaaaactacttatccccgaaacgaaacgacgtaaaaacaaaaaccgataaataaccgcctaacacgacgaaaccgaaaaaaaccgaccgacaacccccaaacccgaatctctacctccgaaaaatcgaccgacccgataccgtcgcaccctacgaaaaaaaactaaaaaaaaaatacgatataaaaaaaaaactaaacccgacgcctaatactaacgccgatccgccctccctaaaatcataaaacttt

SEQ ID NO: 14613 - DNA, 764 bp, Artificial Sequence
  chemically treated genomic DNA (Homo sapiens) CpG-island No: 14613
attcgttttttatcgagtttcgtgtcgtttttaaatcgtacgataagttttatagggagtgcgttataggtcggggcgcgttacggggtcggggcggggcggagttcggacgtcgggagtaggatggcggcggagtaggatttcgaggcgcgcgcggggcggtcgttgtttattgatttttattaggttattatggcgttgggttattggcgcgcgggtcgggcgcgggacgtcgtcgagttcgagtttttttttcgtcgttgttcgttcggcggcgttttcgttttggtagtcggtttgcgcgattgtgtgcgttttttgcgcgtttttcgtttgcgggacgtcggtagtatttcgttcgcgcgacgagttttttacgttcggtagaaatttttatttatggtcggtggaagtttttgttttttcgtggaattttttatgttttacgatcggtttgttttcgcgttggttttagcgtagttatttcgtttttagacgtgtagtttttggtttcggtgttgtttttagatacggattttgcgtttttcgagtattttcgggttttcgattgtttcgaggtgacggtgcgagttttgttcgaggttttttcgtttttttcggagtgagtaggggtaagcgggcggcgcggcggttacggggtgttgggtcgagcgcggagttgattttttttttcgtaggtgtcgtttttgtaggtgttcgggtcgtttttggtggtgtagttgttggagatatcgttgttttgt

SEQ ID NO: 14614 - DNA, 764 bp, Artificial Sequence
  chemically treated genomic DNA (Homo sapiens) CpG-island No: 14614
acaaaacaacgatatctccaacaactacaccaccaaaaacgacccgaacacctacaaaaacgacacctacgaaaaaaaaaatcaactccgcgctcgacccaacaccccgtaaccgccgcgccgcccgcttacccctactcactccgaaaaaaacgaaaaaacctcgaacaaaactcgcaccgtcacctcgaaacaatcgaaaacccgaaaatactcgaaaaacgcaaaatccgtatctaaaaacaacaccgaaaccaaaaactacacgtctaaaaacgaaataactacgctaaaaccaacgcgaaaacaaaccgatcgtaaaacataaaaaattccacgaaaaaacaaaaacttccaccgaccataaataaaaatttctaccgaacgtaaaaaactcgtcgcgcgaacgaaatactaccgacgtcccgcaaacgaaaaacgcgcaaaaaacgcacacaatcgcgcaaaccgactaccaaaacgaaaacgccgccgaacgaacaacgacgaaaaaaaaactcgaactcgacgacgtcccgcgcccgacccgcgcgccaataacccaacgccataataacctaataaaaatcaataaacaacgaccgccccgcgcgcgcctcgaaatcctactccgccgccatcctactcccgacgtccgaactccgccccgccccgaccccgtaacgcgccccgacctataacgcactccctataaaacttatcgtacgatttaaaaacgacacgaaactcgataaaaaacgaat

SEQ ID NO: 14615 - DNA, 764 bp, Artificial Sequence
  chemically treated genomic DNA (Homo sapiens) CpG-island No: 14615
gtagagtagcggtgtttttagtagttgtattattaggagcggttcggatatttgtaggagcggtatttgcggggagagaagttagtttcgcgttcggtttagtatttcgtggtcgtcgcgtcgttcgtttatttttatttatttcggggaaggcgagggagtttcgggtagggttcgtatcgttatttcggagtagtcgagggttcgaaggtgttcgaagaacgtaggattcgtgtttgggggtagtatcgaggttaggaattgtacgtttggaaacgaggtaattgcgttgagattagcgcggggatagatcggtcgtgggatatggggggttttacgggggggtaaggatttttatcggttataggtgggggtttttgtcgggcgtggggggttcgtcgcgcggacggggtattatcggcgtttcgtaggcggaaggcgcgtaggaagcgtatatagtcgcgtaagtcggttattaaggcgaaggcgtcgtcgaacgggtagcggcggaagaagagttcgaattcggcggcgtttcgcgttcggttcgcgcgttaatagtttaacgttatggtggtttggtagaggttagtgagtagcggtcgtttcgcgcgcgtttcggggttttgtttcgtcgttattttgttttcgacgttcggatttcgtttcgtttcggtttcgtgacgcgtttcggtttatggcgtattttttgtggggtttatcgtgcggtttgggagcggtacgggattcgatggaggacgggt

SEQ ID NO: 14616 - DNA, 764 bp, Artificial Sequence
  chemically treated genomic DNA (Homo sapiens) CpG-island No: 14616
acccgtcctccatcgaatcccgtaccgctcccaaaccgcacgataaaccccacaaaaaatacgccataaaccgaaacgcgtcacgaaaccgaaacgaaacgaaatccgaacgtcgaaaacaaaataacgacgaaacaaaaccccgaaacgcgcgcgaaacgaccgctactcactaacctctaccaaaccaccataacgttaaactattaacgcgcgaaccgaacgcgaaacgccgccgaattcgaactcttcttccgccgctacccgttcgacgacgccttcgccttaataaccgacttacgcgactatatacgcttcctacgcgccttccgcctacgaaacgccgataataccccgtccgcgcgacgaaccccccacgcccgacaaaaacccccacctataaccgataaaaatccttacccccccgtaaaaccccccatatcccacgaccgatctatccccgcgctaatctcaacgcaattacctcgtttccaaacgtacaattcctaacctcgatactacccccaaacacgaatcctacgttcttcgaacaccttcgaaccctcgactactccgaaataacgatacgaaccctacccgaaactccctcgccttccccgaaataaataaaaataaacgaacgacgcgacgaccacgaaatactaaaccgaacgcgaaactaacttctctccccgcaaataccgctcctacaaatatccgaaccgctcctaataatacaactactaaaaacaccgctactctac

SEQ ID NO: 14617 - DNA, 757 bp, Artificial Sequence
  chemically treated genomic DNA (Homo sapiens) CpG-island No: 14617
ttagttcggttcggtttcgtttcgtttttgcgttgcgtcgtttcgtgcgttattcggcgtttgtcgttgtcggattcgtttttatcggcgatattattggtcgcgaagtaggggggcggcgcgcgtttgtcgttcgtttttagtatttgtgtaaattttttcggggaagagcggttttcgggtgtatttttaacggaattttgtttttgaagcgtcggggtacggcgcgtcgagggttttggcggttaggcggggcgtgtgtaagggtcgcgtttttttttcgggttttcggttcgtgtttttggtagagtttagtgttttatttttcgtgcgcggttcgggcggtttttttttttattagttttttcgcgttcgtcgattttttttttttggtcgtcgcgtttttggttggcgtgtgagtatcgcggttttcgtcggaaggagtcgggcgcgatagagacgttcgaggggtcgggagggcgggcggttcgcgtgcgttagaagttcgcgtcgttagggattgaggtataagtgcgttagcgcgggtttaggggtcgtgggttaagtgcggtatttggggcgagcgtagagaggcggggcgacggaggttacgtggtcggtttggagggcgttcgcgggacgggggcgtcgggagtattgttttacggcgtatttcggtcgtggaagtttttcggttaggttgttggggtttaaggtttgtgtttgttgtcgttttcgtgggagattagatatttgt

SEQ ID NO: 14618 - DNA, 757 bp, Artificial Sequence
  chemically treated genomic DNA (Homo sapiens) CpG-island No: 14618
acaaatatctaatctcccacgaaaacgacaacaaacacaaaccttaaaccccaacaacctaaccgaaaaacttccacgaccgaaatacgccgtaaaacaatactcccgacgcccccgtcccgcgaacgccctccaaaccgaccacgtaacctccgtcgccccgcctctctacgctcgccccaaataccgcacttaacccacgacccctaaacccgcgctaacgcacttatacctcaatccctaacgacgcgaacttctaacgcacgcgaaccgcccgccctcccgacccctcgaacgtctctatcgcgcccgactccttccgacgaaaaccgcgatactcacacgccaaccaaaaacgcgacgaccaaaaaaaaaaaatcgacgaacgcgaaaaaactaataaaaaaaaaaaccgcccgaaccgcgcacgaaaaataaaacactaaactctaccaaaaacacgaaccgaaaacccgaaaaaaaaacgcgacccttacacacgccccgcctaaccgccaaaaccctcgacgcgccgtaccccgacgcttcaaaaacaaaattccgttaaaaatacacccgaaaaccgctcttccccgaaaaaatttacacaaatactaaaaacgaacgacaaacgcgcgccgcccccctacttcgcgaccaataatatcgccgataaaaacgaatccgacaacgacaaacgccgaataacgcacgaaacgacgcaacgcaaaaacgaaacgaaaccgaaccgaactaa

SEQ ID NO: 14619 - DNA, 757 bp, Artificial Sequence
  chemically treated genomic DNA (Homo sapiens) CpG-island No: 14619
gtagatgtttggttttttacggagacggtagtaaatataggttttaggttttagtagtttggtcgaggggtttttacgatcgggatgcgtcgtgagatagtgttttcggcgttttcgtttcgcggacgttttttaagtcggttacgtggttttcgtcgtttcgtttttttgcgttcgttttaagtgtcgtatttggtttacggtttttaagttcgcgttggcgtatttgtgttttagtttttaacggcgcgagtttttggcgtacgcgggtcgttcgttttttcggtttttcgggcgtttttgtcgcgttcgatttttttcggcgggggtcgcggtatttatacgttagttaaggacgcggcgattaaggaggaggaatcggcggacgcgggaagattgatgaaagggagggtcgttcgggtcgcgtacgggaaatgaagtattgggttttattaagagtacgggtcgggggttcgggggggggacgcgatttttgtatacgtttcgtttggtcgttaggattttcgacgcgtcgtgtttcgacgttttaaagatagaatttcgttggagatgtattcggaggtcgttttttttcggaggagtttgtataagtgttgggaacgggcggtaggcgcgcgtcgtttttttgtttcgcggttagtggtgtcgtcggtgggggcgggttcggtagcggtaagcgtcgagtgacgtacgaggcggcgtagcgtaggagcggggcggggtcgggtcgggttag

SEQ ID NO: 14620 - DNA, 757 bp, Artificial Sequence
  chemically treated genomic DNA (Homo sapiens) CpG-island No: 14620
ctaacccgacccgaccccgccccgctcctacgctacgccgcctcgtacgtcactcgacgcttaccgctaccgaacccgcccccaccgacgacaccactaaccgcgaaacaaaaaaacgacgcgcgcctaccgcccgttcccaacacttatacaaactcctccgaaaaaaaacgacctccgaatacatctccaacgaaattctatctttaaaacgtcgaaacacgacgcgtcgaaaatcctaacgaccaaacgaaacgtatacaaaaatcgcgtcccccccccgaacccccgacccgtactcttaataaaacccaatacttcatttcccgtacgcgacccgaacgaccctccctttcatcaatcttcccgcgtccgccgattcctcctccttaatcgccgcgtccttaactaacgtataaataccgcgacccccgccgaaaaaaatcgaacgcgacaaaaacgcccgaaaaaccgaaaaaacgaacgacccgcgtacgccaaaaactcgcgccgttaaaaactaaaacacaaatacgccaacgcgaacttaaaaaccgtaaaccaaatacgacacttaaaacgaacgcaaaaaaacgaaacgacgaaaaccacgtaaccgacttaaaaaacgtccgcgaaacgaaaacgccgaaaacactatctcacgacgcatcccgatcgtaaaaacccctcgaccaaactactaaaacctaaaacctatatttactaccgtctccgtaaaaaaccaaacatctac

SEQ ID NO: 14621 - DNA, 769 bp, Artificial Sequence
  chemically treated genomic DNA (Homo sapiens) CpG-island No: 14621
gtcgcgattttttttgattcgtcgtgatttatcgtgattcgatgtgattttttttaattcgtcgtgattcgttgttatttatagttatttaacgtgattcgtcgtaattttggtgttgtttgttgtttgttgttcgagtttgggcgtatttatgggcgcgggtgatagtgtaagtgtttgggacgataattcgggttttttatcgcggtcggaatttaagaggttgcggcgcgaggtttgggtattcgggggcggaattttgggagggaaggggagtaaagggagacgtcgtagttaacgtcgtttggttttagcgtcggcgaggtttttttcgacgtcgcgggtatttcgcggatttgcggttggtttttttttcgtgttttttcgtcgttttaagtagggtttgggttagcgtttcgggtttaaagaggttgcggttcgggatttcgtcggggattcgttcgcgcgcggtcggcggacgagattgcgttttttaagcggttttgcggtcgcggattttaagttttagttgtgttcgggacgttgcgcgttttcgggattttattttttagagtgtttcgttttagtttttcggtttcgttttttatttggtttcgcgggtagtcggagcgtattcggtcggaagtcgttgtcggggagtcggcggtggggttggacgtaggtgaggtggtatcggatttagtcgcgttttgggttttggatgtttcgtgagagttagggagcgttgtgggggtttgggatcgagggg

SEQ ID NO: 14622 - DNA, 769 bp, Artificial Sequence
  chemically treated genomic DNA (Homo sapiens) CpG-island No: 14622
cccctcgatcccaaacccccacaacgctccctaactctcacgaaacatccaaaacccaaaacgcgactaaatccgataccacctcacctacgtccaaccccaccgccgactccccgacaacgacttccgaccgaatacgctccgactacccgcgaaaccaaataaaaaacgaaaccgaaaaactaaaacgaaacactctaaaaaataaaatcccgaaaacgcgcaacgtcccgaacacaactaaaacttaaaatccgcgaccgcaaaaccgcttaaaaaacgcaatctcgtccgccgaccgcgcgcgaacgaatccccgacgaaatcccgaaccgcaacctctttaaacccgaaacgctaacccaaaccctacttaaaacgacgaaaaaacacgaaaaaaaaaccaaccgcaaatccgcgaaatacccgcgacgtcgaaaaaaacctcgccgacgctaaaaccaaacgacgttaactacgacgtctccctttactccccttccctcccaaaattccgcccccgaatacccaaacctcgcgccgcaacctcttaaattccgaccgcgataaaaaacccgaattatcgtcccaaacacttacactatcacccgcgcccataaatacgcccaaactcgaacaacaaacaacaaacaacaccaaaattacgacgaatcacgttaaataactataaataacaacgaatcacgacgaattaaaaaaaatcacatcgaatcacgataaatcacgacgaatcaaaaaaaatcgcgac

SEQ ID NO: 14623 - DNA, 769 bp, Artificial Sequence
  chemically treated genomic DNA (Homo sapiens) CpG-island No: 14623
tttttcgattttagatttttatagcgttttttgatttttacggagtatttagggtttagggcgcggttgagttcggtgttattttatttgcgtttagttttatcgtcggtttttcgatagcggttttcggtcgggtgcgtttcggttgttcgcggagttaggtggggggcggggtcgggaggttggggcggggtattttgggaaatggagtttcgggggcgcgtagcgtttcgggtatagttgggatttggagttcgcggtcgtaaagtcgtttgggaagcgtagtttcgttcgtcggtcgcgcgcgggcgggttttcgacgaagtttcgggtcgtaatttttttaggttcggggcgttggtttaggttttgtttgggacggcggaaggatacgagaggagggttagtcgtaggttcgcgggatgttcgcggcgtcggaaggagtttcgtcggcgttggggttaggcggcgttagttgcggcgtttttttttgtttttttttttttttagggtttcgttttcgaatatttagatttcgcgtcgtagttttttggatttcggtcgcgatgaggagttcgggttgtcgttttaagtatttgtattgttattcgcgtttatgggtacgtttaggttcgggtagtaagtagtaaataatattagagttacggcgaattacgttgggtgattgtgggtgatagcgggttacggcgggttaagaaggattatatcggattacgatgggttacggcgagttaaggagggtcgcggt

SEQ ID NO: 14624 - DNA, 769 bp, Artificial Sequence
  chemically treated genomic DNA (Homo sapiens) CpG-island No: 14624
accgcgaccctccttaactcgccgtaacccatcgtaatccgatataatccttcttaacccgccgtaacccgctatcacccacaatcacccaacgtaattcgccgtaactctaatattatttactacttactacccgaacctaaacgtacccataaacgcgaataacaatacaaatacttaaaacgacaacccgaactcctcatcgcgaccgaaatccaaaaaactacgacgcgaaatctaaatattcgaaaacgaaaccctaaaaaaaaaaaaaaacaaaaaaaaacgccgcaactaacgccgcctaaccccaacgccgacgaaactccttccgacgccgcgaacatcccgcgaacctacgactaaccctcctctcgtatccttccgccgtcccaaacaaaacctaaaccaacgccccgaacctaaaaaaattacgacccgaaacttcgtcgaaaacccgcccgcgcgcgaccgacgaacgaaactacgcttcccaaacgactttacgaccgcgaactccaaatcccaactatacccgaaacgctacgcgcccccgaaactccatttcccaaaataccccgccccaacctcccgaccccgccccccacctaactccgcgaacaaccgaaacgcacccgaccgaaaaccgctatcgaaaaaccgacgataaaactaaacgcaaataaaataacaccgaactcaaccgcgccctaaaccctaaatactccgtaaaaatcaaaaaacgctataaaaatctaaaatcgaaaaa

SEQ ID NO: 14625 - DNA, 794 bp, Artificial Sequence
  chemically treated genomic DNA (Homo sapiens) CpG-island No: 14625
gtacgttttggattagtttcgtaattcgtttcgttatttttttttttcggaaaattaatatgtgtttttcgtacgcgcgatcgggattttttttcgttttttcggttttttcgagcgcgagtatttcgtcggtttcgttttttacggtttcgtttttagttttttttagttaatgggtagtgaggggcggtatagtttttcgggttaataagtagcgagaggcggggttttcgtttttgcgaatttgtagagtgcggataaaaagtcggtcggagtgtgtcgttttagtaattaatcggcgagggtggggacggggaggcgagttttattggagggcgggggtggggtttagatttgtgggcggggcgcggtttgtggatgggcggtgacgtagcggcgttcgaggtaataagatggtagttgcggatcgttttcgcggcgcgtgggtttcgtgggcgcgggcgtatggcggggttatcgcgtagggttttattagagtaggtggggcggcgcggggttaggtttgcggtttggagtgggagtagtttcgtgggaggtgttttgtcgcgagagtggggtcggggcgcgggttagttaatcgggttttcgtttcgttgggcgtagtcgggttacgtttgtttgtttttatttttttgacgtggttgcgggaagatttgagttatacgtggttaggtgtcgttttcgtggtcggttttttggtcgcgtggtttggttaggtttattttttttagtttttgattttttttttgcgcgttagttttttttatggggag

SEQ ID NO: 14626 - DNA, 794 bp, Artificial Sequence
  chemically treated genomic DNA (Homo sapiens) CpG-island No: 14626
ctccccataaaaaaaactaacgcgcaaaaaaaaaatcaaaaactaaaaaaaataaacctaaccaaaccacgcgaccaaaaaaccgaccacgaaaacgacacctaaccacgtataactcaaatcttcccgcaaccacgtcaaaaaaataaaaacaaacaaacgtaacccgactacgcccaacgaaacgaaaacccgattaactaacccgcgccccgaccccactctcgcgacaaaacacctcccacgaaactactcccactccaaaccgcaaacctaaccccgcgccgccccacctactctaataaaaccctacgcgataaccccgccatacgcccgcgcccacgaaacccacgcgccgcgaaaacgatccgcaactaccatcttattacctcgaacgccgctacgtcaccgcccatccacaaaccgcgccccgcccacaaatctaaaccccacccccgccctccaataaaactcgcctccccgtccccaccctcgccgattaattactaaaacgacacactccgaccgactttttatccgcactctacaaattcgcaaaaacgaaaaccccgcctctcgctacttattaacccgaaaaactataccgcccctcactacccattaactaaaaaaaactaaaaacgaaaccgtaaaaaacgaaaccgacgaaatactcgcgctcgaaaaaaccgaaaaaacgaaaaaaaatcccgatcgcgcgtacgaaaaacacatattaattttccgaaaaaaaaaaataacgaaacgaattacgaaactaatccaaaacgtac

SEQ ID NO: 14627 - DNA, 794 bp, Artificial Sequence
  chemically treated genomic DNA (Homo sapiens) CpG-island No: 14627
ttttttatgagaggggttggcgcgtaaagagaaaattagaggttggaagaggtgagtttggttaagttacgcggttaggaagtcggttacggaagcggtatttagttacgtgtgatttaaattttttcgtagttacgttaaaaaagtaagagtaaataggcgtggttcggttgcgtttagcggagcggagattcggttggttggttcgcgtttcggttttattttcgcggtaggatattttttacggggttgtttttattttagatcgtaggtttagtttcgcgtcgttttatttgttttgatgaggttttgcgcgatggtttcgttatgcgttcgcgtttacgaagtttacgcgtcgcggagacggttcgtagttgttattttgttgtttcggacgtcgttgcgttatcgtttatttataggtcgcgtttcgtttatagatttaggttttattttcgttttttaataggattcgttttttcgtttttattttcgtcgattggttattgggacggtatatttcggtcggttttttgttcgtattttataagttcgtaagggcgggaatttcgtttttcgttgtttattggttcgaaaggttatgtcgttttttattgtttattggttgagagaaattgggggcggggtcgtaaggggcggggtcggcggggtattcgcgttcggagaggtcggaggagcggggaggggtttcggtcgcgcgtgcgaggagtatatgttggtttttcggaggggaggggtagcgaagcgggttgcggggttggtttagagcgtgt

SEQ ID NO: 14628 - DNA, 794 bp, Artificial Sequence
  chemically treated genomic DNA (Homo sapiens) CpG-island No: 14628
acacgctctaaaccaaccccgcaacccgcttcgctacccctcccctccgaaaaaccaacatatactcctcgcacgcgcgaccgaaacccctccccgctcctccgacctctccgaacgcgaataccccgccgaccccgccccttacgaccccgcccccaatttctctcaaccaataaacaataaaaaacgacataacctttcgaaccaataaacaacgaaaaacgaaattcccgcccttacgaacttataaaatacgaacaaaaaaccgaccgaaatataccgtcccaataaccaatcgacgaaaataaaaacgaaaaaacgaatcctattaaaaaacgaaaataaaacctaaatctataaacgaaacgcgacctataaataaacgataacgcaacgacgtccgaaacaacaaaataacaactacgaaccgtctccgcgacgcgtaaacttcgtaaacgcgaacgcataacgaaaccatcgcgcaaaacctcatcaaaacaaataaaacgacgcgaaactaaacctacgatctaaaataaaaacaaccccgtaaaaaatatcctaccgcgaaaataaaaccgaaacgcgaaccaaccaaccgaatctccgctccgctaaacgcaaccgaaccacgcctatttactcttacttttttaacgtaactacgaaaaaatttaaatcacacgtaactaaataccgcttccgtaaccgacttcctaaccgcgtaacttaaccaaactcacctcttccaacctctaattttctctttacgcgccaacccctctcataaaaaa

SEQ ID NO: 14629 - DNA, 512 bp, Artificial Sequence
  chemically treated genomic DNA (Homo sapiens) CpG-island No: 14629
gttcgcgcggttttttagagtttaagtagtttttttttagtcgttattaggttatttttcggcgtttattagtgacgttttcgtttcgttttgcgcgtgcgggttttgttttttcgttgtcgttgttagggcgacggcgggttttcggcggtcggtagatattcgggtttgtttttggtagtttcgttttggttcgtttcgtttcgttcgcggaaaaaaggtcgcgtagcgatgacgtcgtgggggtttggcggtcgtcgcggattcgggagatggaggaaaaggagatattacggcggtagattcgtttattgtagggtaggttcggtcggggtcggacgcgagttttttttttttttttttatttcgcggcggttttttgtttttttgtcgaaggggtcgtttatcgttcgcgtgttttgggtggcggttggggtgggggacggtagggttcgttaggatttgtgggtcggtttagggttcgggttagttttcggttttagttttgtcga

SEQ ID NO: 14630 - DNA, 512 bp, Artificial Sequence
  chemically treated genomic DNA (Homo sapiens) CpG-island No: 14630
tcgacaaaactaaaaccgaaaactaacccgaaccctaaaccgacccacaaatcctaacgaaccctaccgtcccccaccccaaccgccacccaaaacacgcgaacgataaacgaccccttcgacaaaaaaacaaaaaaccgccgcgaaataaaaaaaaaaaaaaaaaactcgcgtccgaccccgaccgaacctaccctacaataaacgaatctaccgccgtaatatctccttttcctccatctcccgaatccgcgacgaccgccaaacccccacgacgtcatcgctacgcgaccttttttccgcgaacgaaacgaaacgaaccaaaacgaaactaccaaaaacaaacccgaatatctaccgaccgccgaaaacccgccgtcgccctaacaacgacaacgaaaaaacaaaacccgcacgcgcaaaacgaaacgaaaacgtcactaataaacgccgaaaaataacctaataacgactaaaaaaaaactacttaaactctaaaaaaccgcgcgaac

SEQ ID NO: 14631 - DNA, 512 bp, Artificial Sequence
  chemically treated genomic DNA (Homo sapiens) CpG-island No: 14631
tcgataaagttggagtcggggattgattcgggttttgagtcggtttataagttttggcggattttatcgttttttattttagtcgttatttagaatacgcgggcggtgagcgattttttcgataagggggtaggggatcgtcgcgaggtgagggggaaagaaggggattcgcgttcggtttcggtcggatttattttgtagtaggcggatttgtcgtcgtaatattttttttttttttatttttcgagttcgcgacggtcgttaggtttttacgacgttatcgttacgcgatttttttttcgcgggcggggcggagcgggttagggcggagttgttaggagtaggttcggatgtttgtcgatcgtcgaggattcgtcgtcgttttgataacggtagcggagaggtagagttcgtacgcgtagaacgaggcggggacgttattagtgagcgtcgggaagtggtttggtaacggttgggaagggattgtttgggttttgggaggtcgcgcgggt

SEQ ID NO: 14632 - DNA, 512 bp, Artificial Sequence
  chemically treated genomic DNA (Homo sapiens) CpG-island No: 14632
acccgcgcgacctcccaaaacccaaacaatcccttcccaaccgttaccaaaccacttcccgacgctcactaataacgtccccgcctcgttctacgcgtacgaactctacctctccgctaccgttatcaaaacgacgacgaatcctcgacgatcgacaaacatccgaacctactcctaacaactccgccctaacccgctccgccccgcccgcgaaaaaaaaatcgcgtaacgataacgtcgtaaaaacctaacgaccgtcgcgaactcgaaaaataaaaaaaaaaaaaatattacgacgacaaatccgcctactacaaaataaatccgaccgaaaccgaacgcgaatccccttctttccccctcacctcgcgacgatcccctacccccttatcgaaaaaatcgctcaccgcccgcgtattctaaataacgactaaaataaaaaacgataaaatccgccaaaacttataaaccgactcaaaacccgaatcaatccccgactccaactttatcga

SEQ ID NO: 14633 - DNA, 638 bp, Artificial Sequence
  chemically treated genomic DNA (Homo sapiens) CpG-island No: 14633
gagacgtcgtagtttcgcgggggcggtcgtggttgcgttcgggagattgattagttaaggtttcgtttttggacgttttagcggggggatagcggtttgcggatttcgttcggttttttcggcggattgtgttttggtaaggcggtcgggtttcggagttagtcggggttgcggttaaggcgttgttcgttttcgttcggaacgcgttatttattcggcgcgggcggggtagaggacggcgcgatcgtattttgtagtcgttgattggatttcgtcggcgcggttttatagattagtcgataaagtttgtatcgtcgttagttcgtcgcgatcggaagtcgtagaggtttcgtttgggaaattttttgcgtcgttttaggagcgttagggatcggttttttttttagtggtgcggattttcgggttcggggattaagattttcggaggtaggggtgttcggtagagcggcgttgttacgcggttgggagggttgcgggtcgggaagcgcgggttcggaaattcgggtttggagttcgcggcgaggttcgatcgtagtttaagattagttttttaggaggcgaggatttaggggaagtaaatatcgtgaggttaaattttatttttttgcgttttagag

SEQ ID NO: 14634 - DNA, 638 bp, Artificial Sequence
  chemically treated genomic DNA (Homo sapiens) CpG-island No: 14634
ctctaaaacgcaaaaaaataaaatttaacctcacgatatttacttcccctaaatcctcgcctcctaaaaaactaatcttaaactacgatcgaacctcgccgcgaactccaaacccgaatttccgaacccgcgcttcccgacccgcaaccctcccaaccgcgtaacaacgccgctctaccgaacacccctacctccgaaaatcttaatccccgaacccgaaaatccgcaccactaaaaaaaaaaccgatccctaacgctcctaaaacgacgcaaaaaatttcccaaacgaaacctctacgacttccgatcgcgacgaactaacgacgatacaaactttatcgactaatctataaaaccgcgccgacgaaatccaatcaacgactacaaaatacgatcgcgccgtcctctaccccgcccgcgccgaataaataacgcgttccgaacgaaaacgaacaacgccttaaccgcaaccccgactaactccgaaacccgaccgccttaccaaaacacaatccgccgaaaaaaccgaacgaaatccgcaaaccgctatccccccgctaaaacgtccaaaaacgaaaccttaactaatcaatctcccgaacgcaaccacgaccgcccccgcgaaactacgacgtctc

SEQ ID NO: 14635 - DNA, 638 bp, Artificial Sequence
  chemically treated genomic DNA (Homo sapiens) CpG-island No: 14635
ttttggggcgtagagaggtgaagtttggttttacggtatttattttttttggattttcgttttttgagaagttggttttgggttgcggtcggatttcgtcgcgagttttagattcgagttttcgagttcgcgtttttcggttcgtaatttttttaatcgcgtagtaacgtcgttttgtcggatatttttgttttcgggggttttagttttcgggttcggaagttcgtattattgagaggggagtcgatttttggcgtttttagaacggcgtaggaagttttttaggcggggtttttgcgattttcggtcgcggcgggttggcggcggtgtaggttttgtcggttgatttgtggggtcgcgtcggcggggtttagttagcggttgtagggtgcggtcgcgtcgttttttatttcgttcgcgtcgggtgagtggcgcgtttcggacgggggcgggtaacgttttagtcgtagtttcggttggtttcggagttcggtcgttttgttagggtatagttcgtcgagagggtcgggcggggttcgtaggtcgttgttttttcgttagggcgtttaggagcggggttttggttagttagtttttcggacgtagttacggtcgttttcgcgaggttgcggcgtttt

SEQ ID NO: 14636 - DNA, 638 bp, Artificial Sequence
  chemically treated genomic DNA (Homo sapiens) CpG-island No: 14636
aaaacgccgcaacctcgcgaaaacgaccgtaactacgtccgaaaaactaactaaccaaaaccccgctcctaaacgccctaacgaaaaaacaacgacctacgaaccccgcccgaccctctcgacgaactataccctaacaaaacgaccgaactccgaaaccaaccgaaactacgactaaaacgttacccgcccccgtccgaaacgcgccactcacccgacgcgaacgaaataaaaaacgacgcgaccgcaccctacaaccgctaactaaaccccgccgacgcgaccccacaaatcaaccgacaaaacctacaccgccgccaacccgccgcgaccgaaaatcgcaaaaaccccgcctaaaaaacttcctacgccgttctaaaaacgccaaaaatcgactcccctctcaataatacgaacttccgaacccgaaaactaaaacccccgaaaacaaaaatatccgacaaaacgacgttactacgcgattaaaaaaattacgaaccgaaaaacgcgaactcgaaaactcgaatctaaaactcgcgacgaaatccgaccgcaacccaaaaccaacttctcaaaaaacgaaaatccaaaaaaaataaataccgtaaaaccaaacttcacctctctacgccccaaaa

SEQ ID NO: 14637 - DNA, 1555 bp, Artificial Sequence
  chemically treated genomic DNA (Homo sapiens) CpG-island No: 14637
cgttatacgattttattattacgaagtttatatatagaatagtattcgttatacgattttattattacgaagtttagatatagaatagtattcgttatacggttttattattacgaagtttagatatagaatagtattcgttatacggttttattattacgaagtttagatatagaatagtattcgttatacgattttattattacgaagtttatatatagaatagtattcgttatacgattttattattacgaagtttatatatagaatagtattcgttatacgattttattattacgaagtttagatatagaatagtattcgttatacggttttattattacgaagtttatatatagaatagtattcgttatacggttttattattacgaagtttatatatagaatagtattcgttatacggttttattattacgaagtttagatatagaatagtattcgttatacggttttattattacgaagtttagatatataatagtattcgttatacggttttattattacgaagtttatatatagaatagtattcgttatacggttttattattacgaagtttagatatagaatagtattcgttatacggttttattattacgaagtttatatatagaatagtattcgttatacggttttattattacgaagtttatatatagaatagtattcgttatacggttttattattacgaagtttagatatagaatagtattcgttatacggttttattattacgaagtttatatatagaatagtattcgttatacggttttattattacgaagtttatatatagaatagtattcgttatacggttttattattacgaagtttagatatagaatagtattcgttatacggttttattattacgaagtttatatatagaatagtattcgttatacggttttattattacgaagtttatatatagaatagtattcgttatattgttttattattacgaagtttatatatagaatagtattcgttatacggttttattattacgaagtttagatatagaatagtattcgttatacggttttattattacgaagtttagatatagaatagtattcgttatacgattttattattacgaagtttatatatagaatagtattcgttttacgattttattattacgaagtttatatatagaatagtattcgttatacggttttattattatgaagtttatatatagaatagtattcgttatacggttttattattacgaagtttatatatagaatagtattcgttatacggttttattattacgaagtttatatatagaatagtattcgttatacggttttattattacgaagtttatatatagaatagtattcgttatacggttttattattacgaagtttatatatagaatagtattcgttatacggttttattattacgaagtttatatatagaatagtattcgttttacgattttattattacgaagtttagatatagaatagtattcgttatacggttttattattacgaagtttagatatag

SEQ ID NO: 14638 - DNA, 1555 bp, Artificial Sequence
  chemically treated genomic DNA (Homo sapiens) CpG-island No: 14638
ctatatctaaacttcgtaataataaaaccgtataacgaatactattctatatctaaacttcgtaataataaaatcgtaaaacgaatactattctatatataaacttcgtaataataaaaccgtataacgaatactattctatatataaacttcgtaataataaaaccgtataacgaatactattctatatataaacttcgtaataataaaaccgtataacgaatactattctatatataaacttcgtaataataaaaccgtataacgaatactattctatatataaacttcgtaataataaaaccgtataacgaatactattctatatataaacttcataataataaaaccgtataacgaatactattctatatataaacttcgtaataataaaatcgtaaaacgaatactattctatatataaacttcgtaataataaaatcgtataacgaatactattctatatctaaacttcgtaataataaaaccgtataacgaatactattctatatctaaacttcgtaataataaaaccgtataacgaatactattctatatataaacttcgtaataataaaacaatataacgaatactattctatatataaacttcgtaataataaaaccgtataacgaatactattctatatataaacttcgtaataataaaaccgtataacgaatactattctatatctaaacttcgtaataataaaaccgtataacgaatactattctatatataaacttcgtaataataaaaccgtataacgaatactattctatatataaacttcgtaataataaaaccgtataacgaatactattctatatctaaacttcgtaataataaaaccgtataacgaatactattctatatataaacttcgtaataataaaaccgtataacgaatactattctatatataaacttcgtaataataaaaccgtataacgaatactattctatatctaaacttcgtaataataaaaccgtataacgaatactattctatatataaacttcgtaataataaaaccgtataacgaatactattatatatctaaacttcgtaataataaaaccgtataacgaatactattctatatctaaacttcgtaataataaaaccgtataacgaatactattctatatataaacttcgtaataataaaaccgtataacgaatactattctatatataaacttcgtaataataaaaccgtataacgaatactattctatatctaaacttcgtaataataaaatcgtataacgaatactattctatatataaacttcgtaataataaaatcgtataacgaatactattctatatataaacttcgtaataataaaatcgtataacgaatactattctatatctaaacttcgtaataataaaaccgtataacgaatactattctatatctaaacttcgtaataataaaaccgtataacgaatactattctatatctaaacttcgtaataataaaatcgtataacgaatactattctatatataaacttcgtaataataaaatcgtataacg

SEQ ID NO: 14639 - DNA, 1555 bp, Artificial Sequence
  chemically treated genomic DNA (Homo sapiens) CpG-island No: 14639
ttgtgtttgagtttcgtggtgatggggtcgtgtagcgggtgttgttttgtgtttgagtttcgtggtgatggggtcgtggagcgggtgttgttttgtgtgtgagtttcgtggtgatggggtcgtgtagcgggtgttgttttgtgtgtgagtttcgtggtgatggggtcgtgtagcgggtgttgttttgtgtgtgagtttcgtggtgatggggtcgtgtagcgggtgttgttttgtgtgtgagtttcgtggtgatggggtcgtgtagcgggtgttgttttgtgtgtgagtttcgtggtgatggggtcgtgtagcgggtgttgttttgtgtgtgagttttatggtgatggggtcgtgtagcgggtgttgttttgtgtgtgagtttcgtggtgatggggtcgtggagcgggtgttgttttgtgtgtgagtttcgtggtgatggggtcgtgtagcgggtgttgttttgtgtttgagtttcgtggtgatggggtcgtgtagcgggtgttgttttgtgtttgagtttcgtggtgatggggtcgtgtagcgggtgttgttttgtgtgtgagtttcgtggtgatggggtagtgtagcgggtgttgttttgtgtgtgagtttcgtggtgatggggtcgtgtagcgggtgttgttttgtgtgtgagtttcgtggtggtggggtcgtgtagcgggtgttgttttgtgtttgagtttcgtggtggtggggtcgtgtagcgggtgttgttttgtgtgtgagtttcgtggtgatggggtcgtgtagcgggtgttgttttgtgtgtgagtttcgtggtggtggggtcgtgtagcgggtgttgttttgtgtttgagtttcgtggtggtggggtcgtgtagcgggtgttgttttgtgtgtgagtttcgtggtgatggggtcgtgtagcgggtgttgttttgtgtgtgagtttcgtggtgatggggtcgtgtagcgggtgttgttttgtgtttgagtttcgtggtgatggggtcgtgtagcgggtgttgttttgtgtgtgagtttcgtggtgatggggtcgtgtagcgggtgttgttgtgtgtttgagtttcgtggtggtggggtcgtgtagcgggtgttgttttgtgtttgagtttcgtggtggtggggtcgtgtagcgggtgttgttttgtgtgtgagtttcgtggtggtggggtcgtgtagcgggtgttgttttgtgtgtgagtttcgtggtgatggggtcgtgtagcgggtgttgttttgtgtttgagtttcgtggtgatggggtcgtgtagcgggtgttgttttgtgtgtgagtttcgtggtggtggggtcgtgtagcgggtgttgttttgtatgtgagtttcgtggtggtggggtcgtgtagcgggtgttgttttgtgtttgagtttcgtgatgatggggtcgtgtagcgggtgttgttttgtgtttgagtttcgtggtgatggggtcgtgtagcgggtgttgttttgtgtttgagtttcgtggtgatggggtcgtgtagcgggtgttgttttgtgtgtgagtttcgtggtgatggggtcgtgtagcg

SEQ ID NO: 14640 - DNA, 1555 bp, Artificial Sequence
  chemically treated genomic DNA (Homo sapiens) CpG-island No: 14640
cgctacacgaccccatcaccacgaaactcacacacaaaacaacacccgctacacgaccccatcaccacgaaactcaaacacaaaacaacacccgctacacgaccccatcaccacgaaactcaaacacaaaacaacacccgctacacgaccccatcatcacgaaactcaaacacaaaacaacacccgctacacgaccccaccaccacgaaactcacatacaaaacaacacccgctacacgaccccaccaccacgaaactcacacacaaaacaacacccgctacacgaccccatcaccacgaaactcaaacacaaaacaacacccgctacacgaccccatcaccacgaaactcacacacaaaacaacacccgctacacgaccccaccaccacgaaactcacacacaaaacaacacccgctacacgaccccaccaccacgaaactcaaacacaaaacaacacccgctacacgaccccaccaccacgaaactcaaacacacaacaacacccgctacacgaccccatcaccacgaaactcacacacaaaacaacacccgctacacgaccccatcaccacgaaactcaaacacaaaacaacacccgctacacgaccccatcaccacgaaactcacacacaaaacaacacccgctacacgaccccatcaccacgaaactcacacacaaaacaacacccgctacacgaccccaccaccacgaaactcaaacacaaaacaacacccgctacacgaccccaccaccacgaaactcacacacaaaacaacacccgctacacgaccccatcaccacgaaactcacacacaaaacaacacccgctacacgaccccaccaccacgaaactcaaacacaaaacaacacccgctacacgaccccaccaccacgaaactcacacacaaaacaacacccgctacacgaccccatcaccacgaaactcacacacaaaacaacacccgctacactaccccatcaccacgaaactcacacacaaaacaacacccgctacacgaccccatcaccacgaaactcaaacacaaaacaacacccgctacacgaccccatcaccacgaaactcaaacacaaaacaacacccgctacacgaccccatcaccacgaaactcacacacaaaacaacacccgctccacgaccccatcaccacgaaactcacacacaaaacaacacccgctacacgaccccatcaccataaaactcacacacaaaacaacacccgctacacgaccccatcaccacgaaactcacacacaaaacaacacccgctacacgaccccatcaccacgaaactcacacacaaaacaacacccgctacacgaccccatcaccacgaaactcacacacaaaacaacacccgctacacgaccccatcaccacgaaactcacacacaaaacaacacccgctacacgaccccatcaccacgaaactcacacacaaaacaacacccgctccacgaccccatcaccacgaaactcaaacacaaaacaacacccgctacacgaccccatcaccacgaaactcaaacacaa

SEQ ID NO: 14641 - DNA, 983 bp, Artificial Sequence
  chemically treated genomic DNA (Homo sapiens) CpG-island No: 14641
taattatttttaaattaacgtatattatatttatatcgtttcgtatcgcgtcgttatgaaatattgtttttcgaaaagtttattatatttaaggataagttgtaggttatcgagtcgcgttaatgggcggcgagcgtaaggtttagacgtgtgtcgcgatatttagcgtgtcggcgcgggtatgcgcggttggtttaaggacgatgtttatatgcgttggtttttggagtagttgggcggtgaggtgggtatttagcgtaagaagatgcggttggttaacgaggaggagatcgatcgcgtcgtgtacgtttggtttttggcgttgcgttacgacggggtgtcgttgtttggttcgtttatttaggcgtagtcgaggttttcgcgcgttagatttacgggttcgagtgtatttttaaggttagttacggttggttttggcgttggtagaagcgttacggtatttttagttagcgtttttacggcgaggcgggtttttagtttcgagtttcgcgttcggttcgttcgttaaggaggagttcgcgttgtttttcggcgtcggttttttgttcgatcgcgtttcggtttcgcgttttcggtcgagggcggttacggggacgagtagatttatagcgttagcgttatcggtttttattggaagttgttttcggagtaggttgcgttcggttaggggatttcggggcgggggttgtggcggcgttggcggggcgatcgcgtaacggtgttgttggtcgtaaatttgatcggtagttataagttgaagtcgttggttatcgggcggttgtcggattcgtttagtttgcgttattataattaggataagttttcggttttttatcgttatagtttcgacgtttggtttagcgtacgttgttgcggggttggttttttgaggaatttgttttaggcgttaaatttatttgcgtcgaagttgtttgtagagaaggtcgtgttgttggtggttt

SEQ ID NO: 14642 - DNA, 983 bp, Artificial Sequence
  chemically treated genomic DNA (Homo sapiens) CpG-island No: 14642
aaaccaccaacaacacgaccttctctacaaacaacttcgacgcaaataaatttaacgcctaaaacaaattcctcaaaaaaccaaccccgcaacaacgtacgctaaaccaaacgtcgaaactataacgataaaaaaccgaaaacttatcctaattataataacgcaaactaaacgaatccgacaaccgcccgataaccaacgacttcaacttataactaccgatcaaatttacgaccaacaacaccgttacgcgatcgccccgccaacgccgccacaacccccgccccgaaatcccctaaccgaacgcaacctactccgaaaacaacttccaataaaaaccgataacgctaacgctataaatctactcgtccccgtaaccgccctcgaccgaaaacgcgaaaccgaaacgcgatcgaacaaaaaaccgacgccgaaaaacaacgcgaactcctccttaacgaacgaaccgaacgcgaaactcgaaactaaaaacccgcctcgccgtaaaaacgctaactaaaaataccgtaacgcttctaccaacgccaaaaccaaccgtaactaaccttaaaaatacactcgaacccgtaaatctaacgcgcgaaaacctcgactacgcctaaataaacgaaccaaacaacgacaccccgtcgtaacgcaacgccaaaaaccaaacgtacacgacgcgatcgatctcctcctcgttaaccaaccgcatcttcttacgctaaatacccacctcaccgcccaactactccaaaaaccaacgcatataaacatcgtccttaaaccaaccgcgcatacccgcgccgacacgctaaatatcgcgacacacgtctaaaccttacgctcgccgcccattaacgcgactcgataacctacaacttatccttaaatataataaacttttcgaaaaacaatatttcataacgacgcgatacgaaacgatataaatataatatacgttaatttaaaaataatta

SEQ ID NO: 14643 - DNA, 983 bp, Artificial Sequence
  chemically treated genomic DNA (Homo sapiens) CpG-island No: 14643
gggttattagtagtacggttttttttgtaggtagtttcggcgtaggtaggtttgacgtttgggataaattttttaaagaattagtttcgtagtagcgtgcgttgagttaggcgtcggggttgtagcggtaggaggtcgggaatttgttttggttgtggtggcgtaggttgggcgggttcggtagtcgttcgatgattagcggttttagtttgtggttgtcggttaggtttgcggttagtagtatcgttacgcggtcgtttcgttagcgtcgttatagttttcgtttcggggttttttggtcgggcgtagtttgtttcggaagtagtttttagtagaggtcggtgacgttggcgttgtaaatttgttcgttttcgtagtcgttttcggtcgggggcgcggggtcggggcgcggtcgggtagggggtcggcgtcggagggtagcgcgggtttttttttgacgggcgggtcgggcgcggggttcggggttgggggttcgtttcgtcgtagaagcgttggttggagatgtcgtggcgtttttgttagcgttagaattagtcgtggttggttttgaaggtgtattcgggttcgtagatttggcgcgcgaaggtttcggttgcgtttggatgagcgggttagatagcggtatttcgtcgtggcgtagcgttaggaattaggcgtatacggcgcggtcgatttttttttcgttggttagtcgtatttttttgcgttgagtgtttattttatcgtttagttgttttaggaattagcgtatgtgggtatcgtttttgagttagtcgcgtatgttcgcgtcggtacgttgaatgtcgcggtatacgtttgggttttgcgttcgtcgtttattgacgcggttcgatggtttgtaatttgtttttggatgtagtaggtttttcggaaggtaatgttttatggcgacgcggtgcggggcggtgtgggtgtgatgtgcgttggtttaagggtggtta

SEQ ID NO: 14644 - DNA, 983 bp, Artificial Sequence
  chemically treated genomic DNA (Homo sapiens) CpG-island No: 14644
taaccacccttaaaccaacgcacatcacacccacaccgccccgcaccgcgtcgccataaaacattaccttccgaaaaacctactacatccaaaaacaaattacaaaccatcgaaccgcgtcaataaacgacgaacgcaaaacccaaacgtataccgcgacattcaacgtaccgacgcgaacatacgcgactaactcaaaaacgatacccacatacgctaattcctaaaacaactaaacgataaaataaacactcaacgcaaaaaaatacgactaaccaacgaaaaaaaaatcgaccgcgccgtatacgcctaattcctaacgctacgccacgacgaaataccgctatctaacccgctcatccaaacgcaaccgaaaccttcgcgcgccaaatctacgaacccgaatacaccttcaaaaccaaccacgactaattctaacgctaacaaaaacgccacgacatctccaaccaacgcttctacgacgaaacgaacccccaaccccgaaccccgcgcccgacccgcccgtcaaaaaaaaacccgcgctaccctccgacgccgaccccctacccgaccgcgccccgaccccgcgcccccgaccgaaaacgactacgaaaacgaacaaatttacaacgccaacgtcaccgacctctactaaaaactacttccgaaacaaactacgcccgaccaaaaaaccccgaaacgaaaactataacgacgctaacgaaacgaccgcgtaacgatactactaaccgcaaacctaaccgacaaccacaaactaaaaccgctaatcatcgaacgactaccgaacccgcccaacctacgccaccacaaccaaaacaaattcccgacctcctaccgctacaaccccgacgcctaactcaacgcacgctactacgaaactaattctttaaaaaatttatcccaaacgtcaaacctacctacgccgaaactacctacaaaaaaaaccgtactactaataaccc

SEQ ID NO: 14645 - DNA, 546 bp, Artificial Sequence
  chemically treated genomic DNA (Homo sapiens) CpG-island No: 14645
ggttttttgttttttgttttgggtttgtttcggttggcgggattgttcgtattgtttttttggttttcgcgtttgcggtgggtgttcgttttttttttattatttttttttcgtttgtttttcgtcgttatttttttattcgttttgtgttttttttttttttttttcgttttcgtttgtttttgcgttggtcgtttttttgtttttcgtcggttttttgcggttgtgggtgtgtgtcgtttttttgttcgcgttttttttttttttattgtttcgaaggtttttttttttttcgtttttttcgcgttttttttttcgcgtttttttcgcgttttttatcgttttgtttcgcgttttcgtggcgcggcgtcggggggagtttttttttttttttcgttgtttcgttttcggtttcgttggttggcgcgcgcgcgtcggcgggtgtttcgtttcgttatttttcggataggtatttaatttcgtttttgtattaaatgttttgaggtgttcggttttcgggtcgcgttgcgagaaatgaaagaaaaa

SEQ ID NO: 14646 - DNA, 546 bp, Artificial Sequence
  chemically treated genomic DNA (Homo sapiens) CpG-island No: 14646
tttttctttcatttctcgcaacgcgacccgaaaaccgaacacctcaaaacatttaatacaaaaacgaaattaaatacctatccgaaaaataacgaaacgaaacacccgccgacgcgcgcgcgccaaccaacgaaaccgaaaacgaaacaacgaaaaaaaaaaaaaaactccccccgacgccgcgccacgaaaacgcgaaacaaaacgataaaaaacgcgaaaaaaacgcgaaaaaaaaaacgcgaaaaaaacgaaaaaaaaaaaaaccttcgaaacaataaaaaaaaaaaaaacgcgaacaaaaaaacgacacacacccacaaccgcaaaaaaccgacgaaaaacaaaaaaacgaccaacgcaaaaacaaacgaaaacgaaaaaaaaaaaaaaaaaacacaaaacgaataaaaaaataacgacgaaaaacaaacgaaaaaaaaataataaaaaaaaaacgaacacccaccgcaaacgcgaaaaccaaaaaaacaatacgaacaatcccgccaaccgaaacaaacccaaaacaaaaaacaaaaaacc

SEQ ID NO: 14647 - DNA, 546 bp, Artificial Sequence
  chemically treated genomic DNA (Homo sapiens) CpG-island No: 14647
ttttttttttatttttcgtaacgcggttcgagagtcgggtattttaagatatttgatataagaacgagattaaatgtttgttcgagaggtggcggggcgagatattcgtcggcgcgcgcgcgttagttagcgaagtcgaagacggaatagcggaggagggaagagagtttttttcggcgtcgcgttacgagagcgcgggataagacggtgaaggacgcgaagagagcgcgggggggagggcgcggggggggcggggaaggggaaggttttcgaggtaataaagagaaaaaaggcgcgggtaaagagacgatatatatttataatcgtaaggggtcgacgggggatagggagacgattaacgtaagaataagcggaaacggggggaggggggaggggatataaaacgaatgagagggtggcggcggagggtaagcggggaggaaataatagaagagaagcgggtatttatcgtaggcgcggaaattaggggggtagtacggatagtttcgttagtcgaaataaatttaaggtagagagtaggaaatt

SEQ ID NO: 14648 - DNA, 546 bp, Artificial Sequence
  chemically treated genomic DNA (Homo sapiens) CpG-island No: 14648
aatttcctactctctaccttaaatttatttcgactaacgaaactatccgtactacccccctaatttccgcgcctacgataaatacccgcttctcttctattatttcctccccgcttaccctccgccgccaccctctcattcgttttatatcccctcccccctccccccgtttccgcttattcttacgttaatcgtctccctatcccccgtcgaccccttacgattataaatatatatcgtctctttacccgcgccttttttctctttattacctcgaaaaccttccccttccccgccccccccgcgccctcccccccgcgctctcttcgcgtccttcaccgtcttatcccgcgctctcgtaacgcgacgccgaaaaaaactctcttccctcctccgctattccgtcttcgacttcgctaactaacgcgcgcgcgccgacgaatatctcgccccgccacctctcgaacaaacatttaatctcgttcttatatcaaatatcttaaaatacccgactctcgaaccgcgttacgaaaaataaaaaaaaaa

SEQ ID NO: 14649 - DNA, 542 bp, Artificial Sequence
  chemically treated genomic DNA (Homo sapiens) CpG-island No: 14649
tttcgtagggattcgacggacggttcggcgtttttagcgtttagattcgagtttcgtcggtgttgcggatgtggaggttcgcgacgttcgggttgttttttttttcggcgtcgttatttgttttcggtagttcgtatatttggcggttttcgtttagcgcggggaatcggttttagaacgcggaggtttagcgcggttacgcgatttcgtatagttcgttttcgttttagtttatatggtcgcggcgggtggcgttttcgttttcgcgtgagtttagcgcggttttcgaggatttagggattttaggaggtaggagggggcggtggcgacgcgggtggggggaggaggaaacgcggtcggggggaagaggaggagcgcgtttcgattcgtcgtaagggcgggaggagttagtaggggagaagcgaggaggggttcgtagcggcggtatattcgcggggtagcgggcgtttatttgcgagtagaagtacgagttttggatgtttagtttgatgtaagtgggatattggagtttggttttattg

SEQ ID NO: 14650 - DNA, 542 bp, Artificial Sequence
  chemically treated genomic DNA (Homo sapiens) CpG-island No: 14650
caataaaaccaaactccaatatcccacttacatcaaactaaacatccaaaactcgtacttctactcgcaaataaacgcccgctaccccgcgaatataccgccgctacgaacccctcctcgcttctcccctactaactcctcccgcccttacgacgaatcgaaacgcgctcctcctcttccccccgaccgcgtttcctcctccccccacccgcgtcgccaccgccccctcctacctcctaaaatccctaaatcctcgaaaaccgcgctaaactcacgcgaaaacgaaaacgccacccgccgcgaccatataaactaaaacgaaaacgaactatacgaaatcgcgtaaccgcgctaaacctccgcgttctaaaaccgattccccgcgctaaacgaaaaccgccaaatatacgaactaccgaaaacaaataacgacgccgaaaaaaaaaacaacccgaacgtcgcgaacctccacatccgcaacaccgacgaaactcgaatctaaacgctaaaaacgccgaaccgtccgtcgaatccctacgaaa

SEQ ID NO: 14651 - DNA, 542 bp, Artificial Sequence
  chemically treated genomic DNA (Homo sapiens) CpG-island No: 14651
tagtgaggttaagttttagtgttttatttgtattaagttgggtatttagggttcgtatttttgttcgtaggtaggcgttcgttgtttcgcggatatgtcgtcgttgcggattttttttcgttttttttttgttggtttttttcgtttttgcggcgagtcgggacgcgttttttttttttttttcggtcgcgtttttttttttttttattcgcgtcgttatcgtttttttttgttttttggggtttttgggttttcgggaatcgcgttgggtttacgcgggggcgggggcgttattcgtcgcggttatgtgggttggggcggaagcgggttgtgcggggtcgcgtggtcgcgttagattttcgcgttttggggtcggtttttcgcgttgggcgggggtcgttaggtgtgcgggttgtcggaggtaggtagcggcgtcgggaaggagggtagttcgagcgtcgcgagtttttatattcgtagtatcggcggggttcgggtttgggcgttggaggcgtcgggtcgttcgtcgggtttttgcgggg

SEQ ID NO: 14652 - DNA, 542 bp, Artificial Sequence
  chemically treated genomic DNA (Homo sapiens) CpG-island No: 14652
ccccgcaaaaacccgacgaacgacccgacgcctccaacgcccaaacccgaaccccgccgatactacgaatataaaaactcgcgacgctcgaactaccctccttcccgacgccgctacctacctccgacaacccgcacacctaacgacccccgcccaacgcgaaaaaccgaccccaaaacgcgaaaatctaacgcgaccacgcgaccccgcacaacccgcttccgccccaacccacataaccgcgacgaataacgcccccgcccccgcgtaaacccaacgcgattcccgaaaacccaaaaaccccaaaaaacaaaaaaaaacgataacgacgcgaataaaaaaaaaaaaaaacgcgaccgaaaaaaaaaaaaaaaacgcgtcccgactcgccgcaaaaacgaaaaaaaccaacaaaaaaaaaacgaaaaaaaatccgcaacgacgacatatccgcgaaacaacgaacgcctacctacgaacaaaaatacgaaccctaaatacccaacttaatacaaataaaacactaaaacttaacctcacta

SEQ ID NO: 14653 - DNA, 561 bp, Artificial Sequence
  chemically treated genomic DNA (Homo sapiens) CpG-island No: 14653
gtttgttcgttggaagagcgttttatcgaggaagaggcggcggcgggagggaggaattgtcgggcggaggggaggggagagagatcgagtcgggggaggagttgggttcgtcgttggtttgggcgcgggagggggaggagttagggtcggtcgggattacgtagcgttttcgttttcgttttcgttttcgtttcgcgcgcgtagtgggtgtttcgtttcgtcggtttcgttcggtttttcgtcgggggtgttgcgttttaaaattttcggggcgtatattggggttgtaagggagttcggtagggtttttttaattcggcgttttcggggttcggttagtagagaacgcgatttgtcggcgtttgacggtgaggagtcgttttttcgcgcgtatttttattgtgttatagttagataagatagtcgtttttattagtgaatatttaggacgtttgattattttcgatattacgtagaagttagagaaggcgttgttttttttgcgtttggatttttcgtcgttattttgagaaaaagtttattggttaagtgttgtttttt

SEQ ID NO: 14654 - DNA, 561 bp, Artificial Sequence
  chemically treated genomic DNA (Homo sapiens) CpG-island No: 14654
aaaaaacaacacttaaccaataaactttttctcaaaataacgacgaaaaatccaaacgcaaaaaaaacaacgccttctctaacttctacgtaatatcgaaaataatcaaacgtcctaaatattcactaataaaaacgactatcttatctaactataacacaataaaaatacgcgcgaaaaaacgactcctcaccgtcaaacgccgacaaatcgcgttctctactaaccgaaccccgaaaacgccgaattaaaaaaaccctaccgaactcccttacaaccccaatatacgccccgaaaattttaaaacgcaacacccccgacgaaaaaccgaacgaaaccgacgaaacgaaacacccactacgcgcgcgaaacgaaaacgaaaacgaaaacgaaaacgctacgtaatcccgaccgaccctaactcctccccctcccgcgcccaaaccaacgacgaacccaactcctcccccgactcgatctctctcccctcccctccgcccgacaattcctccctcccgccgccgcctcttcctcgataaaacgctcttccaacgaacaaac

SEQ ID NO: 14655 - DNA, 561 bp, Artificial Sequence
  chemically treated genomic DNA (Homo sapiens) CpG-island No: 14655
gagaaatagtatttaattaatggatttttttttaaagtagcggcggagaatttaaacgtagaggaggtagcgttttttttagtttttgcgtggtgtcgaggatgattaggcgttttgggtgtttattagtgaagacgattgttttatttgattgtagtatagtagagatgcgcgcgagagggcggttttttatcgttaggcgtcggtaggtcgcgttttttgttggtcgagtttcgaaggcgtcgaattgggggggttttgtcgagtttttttatagttttaatgtgcgtttcggagattttgaaacgtagtattttcggcggggggtcgggcgaagtcggcggggcggggtatttattgcgcgcgcggggcgggggcgggggcggggacggggacgttgcgtggtttcggtcggttttggtttttttttttttcgcgtttaggttagcggcgggtttagtttttttttcgattcggttttttttttttttttttcgttcggtagtttttttttttcgtcgtcgtttttttttcggtgaggcgtttttttagcgggtaggt

SEQ ID NO: 14656 - DNA, 561 bp, Artificial Sequence
  chemically treated genomic DNA (Homo sapiens) CpG-island No: 14656
acctacccgctaaaaaaacgcctcaccgaaaaaaaaacgacgacgaaaaaaaaaaactaccgaacgaaaaaaaaaaaaaaaaaaccgaatcgaaaaaaaaactaaacccgccgctaacctaaacgcgaaaaaaaaaaaaaccaaaaccgaccgaaaccacgcaacgtccccgtccccgcccccgcccccgccccgcgcgcgcaataaataccccgccccgccgacttcgcccgaccccccgccgaaaatactacgtttcaaaatctccgaaacgcacattaaaactataaaaaaactcgacaaaacccccccaattcgacgccttcgaaactcgaccaacaaaaaacgcgacctaccgacgcctaacgataaaaaaccgccctctcgcgcgcatctctactatactacaatcaaataaaacaatcgtcttcactaataaacacccaaaacgcctaatcatcctcgacaccacgcaaaaactaaaaaaaacgctacctcctctacgtttaaattctccgccgctactttaaaaaaaaatccattaattaaatactatttctc

SEQ ID NO: 14657 - DNA, 712 bp, Artificial Sequence
  chemically treated genomic DNA (Homo sapiens) CpG-island No: 14657
ggtgttcgggtcgtcgttttcgtcgttgttatcgttcgcgttattgttcgtatcggtttttgggtcgaattgcgttttttcgggtgggtatatagtcgcggggaagtcgtcggggggtagtatggagtcgtaggggtagcgcgtttcgttaggagtcgggtatataggttcgtggggcgttttagtcgtcgtttggtacgggaagagtgagtagggcgtagttagtttcgatttttgaggatcgggggattggaggtagtatcgttcggagtttaggttgtttatggagtagcgcgtagtggtcgtagtcgcggcggcggcggcggcggcggttgtagcggcggagggtagtttttttttttcgtagggggagtttttgcggtcgttcgggggtttcggtttggttattgtcgtagcgttggtaaatgcgttttcggcgtcggtgttattaagtatggtcgcgggggtttttgcgttggcggttgcgggtttttcgtttatcgtttcgtaggagagattgtcggaaaattttttggacgttttgtttaagtttaatttttgaggagagggggtcgcgttggggaggtggttagcgttttcgtcgttgtcgtttcgcgtattttttagcgggtagaagtgcgcgttaggtaggtttattgagtttattaagagttgtttttttaattgtatgttttgtaaagcgtagacggta

SEQ ID NO: 14658 - DNA, 712 bp, Artificial Sequence
  chemically treated genomic DNA (Homo sapiens) CpG-island No: 14658
taccgtctacgctttacaaaacatacaattaaaaaaacaactcttaataaactcaataaacctacctaacgcgcacttctacccgctaaaaaatacgcgaaacgacaacgacgaaaacgctaaccacctccccaacgcgaccccctctcctcaaaaattaaacttaaacaaaacgtccaaaaaattttccgacaatctctcctacgaaacgataaacgaaaaacccgcaaccgccaacgcaaaaacccccgcgaccatacttaataacaccgacgccgaaaacgcatttaccaacgctacgacaataaccaaaccgaaacccccgaacgaccgcaaaaactccccctacgaaaaaaaaaaactaccctccgccgctacaaccgccgccgccgccgccgccgcgactacgaccactacgcgctactccataaacaacctaaactccgaacgatactacctccaatcccccgatcctcaaaaatcgaaactaactacgccctactcactcttcccgtaccaaacgacgactaaaacgccccacgaacctatatacccgactcctaacgaaacgcgctacccctacgactccatactaccccccgacgacttccccgcgactatatacccacccgaaaaaacgcaattcgacccaaaaaccgatacgaacaataacgcgaacgataacaacgacgaaaacgacgacccgaacacc

SEQ ID NO: 14659 - DNA, 712 bp, Artificial Sequence
  chemically treated genomic DNA (Homo sapiens) CpG-island No: 14659
tgtcgtttgcgttttgtaaagtatgtagttaggggagtagtttttggtgagtttagtgaatttgtttggcgcgtatttttattcgttggagagtgcgcgaggcggtagcggcgggagcgttggttatttttttagcgcggttttttttttttagaagttggatttagataaagcgtttaagaagtttttcggtagttttttttgcgaggcggtgagcggggagttcgtagtcgttagcgtaggggttttcgcggttatgtttagtgatatcgacgtcggggacgtatttgttagcgttgcggtagtggttaagtcggggttttcggacggtcgtaagggttttttttgcggggaggaggagttgtttttcgtcgttgtagtcgtcgtcgtcgtcgtcgtcgcggttgcggttattgcgcgttattttatggatagtttgagtttcgagcggtattatttttagtttttcggtttttaggggtcggagttggttgcgttttgtttatttttttcgtattaggcggcggttggggcgttttacggatttgtgtattcggtttttaacggggcgcgttatttttacggttttatgttgtttttcggcggttttttcgcggttgtgtgtttattcgggagggcgtagttcggtttaggagtcggtgcgggtagtggcgcgggcggtagtagcggcgggggcggcggttcgggtatt

SEQ ID NO: 14660 - DNA, 712 bp, Artificial Sequence
  chemically treated genomic DNA (Homo sapiens) CpG-island No: 14660
aatacccgaaccgccgcccccgccgctactaccgcccgcgccactacccgcaccgactcctaaaccgaactacgccctcccgaataaacacacaaccgcgaaaaaaccgccgaaaaacaacataaaaccgtaaaaataacgcgccccgttaaaaaccgaatacacaaatccgtaaaacgccccaaccgccgcctaatacgaaaaaaataaacaaaacgcaaccaactccgacccctaaaaaccgaaaaactaaaaataataccgctcgaaactcaaactatccataaaataacgcgcaataaccgcaaccgcgacgacgacgacgacgacgactacaacgacgaaaaacaactcctcctccccgcaaaaaaaacccttacgaccgtccgaaaaccccgacttaaccactaccgcaacgctaacaaatacgtccccgacgtcgatatcactaaacataaccgcgaaaacccctacgctaacgactacgaactccccgctcaccgcctcgcaaaaaaaactaccgaaaaacttcttaaacgctttatctaaatccaacttctaaaaaaaaaaaaccgcgctaaaaaaataaccaacgctcccgccgctaccgcctcgcgcactctccaacgaataaaaatacgcgccaaacaaattcactaaactcaccaaaaactactcccctaactacatactttacaaaacgcaaacgaca

SEQ ID NO: 14661 - DNA, 522 bp, Artificial Sequence
  chemically treated genomic DNA (Homo sapiens) CpG-island No: 14661
ggttacgtttagtacgaattttattttgttgttttagtggtcgcgttcgtggatcgttttgtcgcgtttgacgcgcgggtggcgcgcgggcgtcgcgttttcgttgttgtagtcgttattcggcgtttcggattttcgcgtttttttagtagtttttttattgtttaggggtagcgtttttttcgtcgttatggtcgcgttggttgtttcgtgcgtcggttcggttttgcgtcgtcgtttcgggcgagttggttttttaggaggcgcgagcgggcgggagggggaggtagggggtggagttgagggatcgggttagattagcgcggagattgggattgggacgcgtcgcggaggttcggttcgtagggcgtttacgttattttagttcggttgggttcgggagttcgcgagtattttgagcgcgcggagtttttgtagcgttcgtttttttcgcggttttgtttattggtttgttgggttaagagtggaagcgtttatttcggtttaggtcggttttattta

SEQ ID NO: 14662 - DNA, 522 bp, Artificial Sequence
  chemically treated genomic DNA (Homo sapiens) CpG-island No: 14662
taaataaaaccgacctaaaccgaaataaacgcttccactcttaacccaacaaaccaataaacaaaaccgcgaaaaaaacgaacgctacaaaaactccgcgcgctcaaaatactcgcgaactcccgaacccaaccgaactaaaataacgtaaacgccctacgaaccgaacctccgcgacgcgtcccaatcccaatctccgcgctaatctaacccgatccctcaactccaccccctacctccccctcccgcccgctcgcgcctcctaaaaaaccaactcgcccgaaacgacgacgcaaaaccgaaccgacgcacgaaacaaccaacgcgaccataacgacgaaaaaaacgctacccctaaacaataaaaaaactactaaaaaaacgcgaaaatccgaaacgccgaataacgactacaacaacgaaaacgcgacgcccgcgcgccacccgcgcgtcaaacgcgacaaaacgatccacgaacgcgaccactaaaacaacaaaataaaattcgtactaaacgtaacc

SEQ ID NO: 14663 - DNA, 522 bp, Artificial Sequence
  chemically treated genomic DNA (Homo sapiens) CpG-island No: 14663
tgagtggagtcggtttaggtcggaatgggcgtttttatttttggtttagtaggttagtgggtagggtcgcgggaaggacgggcgttgtaggggtttcgcgcgtttaaggtgttcgcgggttttcgggtttagtcgggttgaggtggcgtgggcgttttgcgggtcgggttttcgcggcgcgttttagttttagttttcgcgttggtttggttcggttttttagttttattttttgtttttttttttcgttcgttcgcgttttttgaaaagttagttcgttcggggcggcggcgtagagtcgggtcggcgtacgaggtagttagcgcggttatgacggcggagaaggcgttgtttttgggtaatgggaaggttgttgaggaggcgcgggagttcgaggcgtcgggtggcggttgtagtagcgggggcgcggcgttcgcgcgttattcgcgcgttaagcgcgataaggcggtttacgagcgcggttattggaataataaggtggagttcgtgttgagcgtggtt

SEQ ID NO: 14664 - DNA, 522 bp, Artificial Sequence
  chemically treated genomic DNA (Homo sapiens) CpG-island No: 14664
aaccacgctcaacacgaactccaccttattattccaataaccgcgctcgtaaaccgccttatcgcgcttaacgcgcgaataacgcgcgaacgccgcgcccccgctactacaaccgccacccgacgcctcgaactcccgcgcctcctcaacaaccttcccattacccaaaaacaacgccttctccgccgtcataaccgcgctaactacctcgtacgccgacccgactctacgccgccgccccgaacgaactaacttttcaaaaaacgcgaacgaacgaaaaaaaaaaacaaaaaataaaactaaaaaaccgaaccaaaccaacgcgaaaactaaaactaaaacgcgccgcgaaaacccgacccgcaaaacgcccacgccacctcaacccgactaaacccgaaaacccgcgaacaccttaaacgcgcgaaacccctacaacgcccgtccttcccgcgaccctacccactaacctactaaaccaaaaataaaaacgcccattccgacctaaaccgactccactca

SEQ ID NO: 14665 - DNA, 909 bp, Artificial Sequence
  chemically treated genomic DNA (Homo sapiens) CpG-island No: 14665
cgttttcggtcggtttttgtcgttcgcgtttttttttttcgggtttcggaagtgacgtaagcgtttttttatcgtcgttagattcgttgttgttgtcgcggcgggtagatttgtaggaggcggcggcggcggcggcggcgtaggttgaaggaagatggcggacggcgtggattatatagatatttacgcggatgtcggcgaagagtttaattaggtacgtgagagtttaggttttcgtcgtcgacgcggcgttatgcggtcgggaagttgattcggggttcgttgcggcgcgagtcgaagcgattgtagagtgtgcgtttttgtcgtttttgggtcgcgtcgtcgatttttggcgtggcgttttttcgtttttcgttttatcgcgtcgttttacgggtcgcgggcgcgtaagtcgcggagattcggatgcgcggacgcggtcgttgtgtagttgtcgtcggttttttttcgtcggcgttgtttcgttttttattgttggcggtattcggttggcgtttttcgtcgcgttaggttcgggcggtggggcgcgtgtaagcggcggagagaattggtcgtcgtcgcgttttttttttcgtcgttggtcggaggaggaagttttggcggggcgcgtgttcgtcgtcgtcgtttttttttcgtcgttgtcgttcgggtttcgattttttttatcgttttattttgtttttttgttcgcgtattgtcgttttatggaaggtcgcgtttacggttttttgtatttcgcgcgtttagttttcggggttttttttttcgggtttgcgataggtttcggcgtggcgttttttttttttttttatattttttgaaggcgattgaggtgcgggtttatttgtaataagttttttgatttttggagttatagataaaagtcgg

SEQ ID NO: 14666 - DNA, 909 bp, Artificial Sequence
  chemically treated genomic DNA (Homo sapiens) CpG-island No: 14666
ccgacttttatctataactccaaaaatcaaaaaacttattacaaataaacccgcacctcaatcgccttcaaaaaatataaaaaaaaaaaaaaaacgccacgccgaaacctatcgcaaacccgaaaaaaaaaaccccgaaaactaaacgcgcgaaatacaaaaaaccgtaaacgcgaccttccataaaacgacaatacgcgaacaaaaaaacaaaataaaacgataaaaaaaatcgaaacccgaacgacaacgacgaaaaaaaaacgacgacgacgaacacgcgccccgccaaaacttcctcctccgaccaacgacgaaaaaaaaaacgcgacgacgaccaattctctccgccgcttacacgcgccccaccgcccgaacctaacgcgacgaaaaacgccaaccgaataccgccaacaataaaaaacgaaacaacgccgacgaaaaaaaaccgacgacaactacacaacgaccgcgtccgcgcatccgaatctccgcgacttacgcgcccgcgacccgtaaaacgacgcgataaaacgaaaaacgaaaaaacgccacgccaaaaatcgacgacgcgacccaaaaacgacaaaaacgcacactctacaatcgcttcgactcgcgccgcaacgaaccccgaatcaacttcccgaccgcataacgccgcgtcgacgacgaaaacctaaactctcacgtacctaattaaactcttcgccgacatccgcgtaaatatctatataatccacgccgtccgccatcttccttcaacctacgccgccgccgccgccgccgcctcctacaaatctacccgccgcgacaacaacaacgaatctaacgacgataaaaaaacgcttacgtcacttccgaaacccgaaaaaaaaaaacgcgaacgacaaaaaccgaccgaaaacg

SEQ ID NO: 14667 - DNA, 909 bp, Artificial Sequence
  chemically treated genomic DNA (Homo sapiens) CpG-island No: 14667
tcgatttttatttgtggttttaaaagttaaaggatttgttgtaaatgagttcgtattttagtcgtttttagaaagtgtgaggggaggaggaaggcgttacgtcgaaatttgtcgtaaattcgagaaggagagtttcggggattgggcgcgcgggatataaagggtcgtgaacgcggttttttatgaggcgatagtgcgcgggtagggagataaaatggagcgatgggaggaatcggagttcgagcggtagcggcggggaaggggcggcggcggcgggtacgcgtttcgttagggttttttttttcgattagcgacgggggagggggcgcggcggcggttagtttttttcgtcgtttatacgcgttttatcgttcgggtttagcgcggcgggaagcgttagtcgggtgtcgttaataatagggagcgaggtagcgtcggcgagggaggatcggcggtagttgtatagcggtcgcgttcgcgtattcgggttttcgcgatttacgcgttcgcggttcgtgaaacgacgcggtagaacgaggggcgggggggcgttacgttaggggtcggcggcgcggtttagaggcggtaagggcgtatattttgtagtcgtttcggttcgcgtcgtagcgggtttcgggttagtttttcggtcgtatggcgtcgcgtcggcggcggggatttgggtttttacgtatttggttgaatttttcgtcgatattcgcgtaaatgtttatgtggtttacgtcgttcgttatttttttttagtttgcgtcgtcgtcgtcgtcgtcgttttttgtaggtttgttcgtcgcggtagtagtagcggatttagcggcggtgggggggcgtttgcgttattttcgaggttcgagggagggaggcgcgggcgataggggtcggtcgggggcg

SEQ ID NO: 14668 - DNA, 909 bp, Artificial Sequence
  chemically treated genomic DNA (Homo sapiens) CpG-island No: 14668
cgcccccgaccgacccctatcgcccgcgcctccctccctcgaacctcgaaaataacgcaaacgcccccccaccgccgctaaatccgctactactaccgcgacgaacaaacctacaaaaaacgacgacgacgacgacgacgcaaactaaaaaaaaataacgaacgacgtaaaccacataaacatttacgcgaatatcgacgaaaaattcaaccaaatacgtaaaaacccaaatccccgccgccgacgcgacgccatacgaccgaaaaactaacccgaaacccgctacgacgcgaaccgaaacgactacaaaatatacgcccttaccgcctctaaaccgcgccgccgacccctaacgtaacgcccccccgcccctcgttctaccgcgtcgtttcacgaaccgcgaacgcgtaaatcgcgaaaacccgaatacgcgaacgcgaccgctatacaactaccgccgatcctccctcgccgacgctacctcgctccctattattaacgacacccgactaacgcttcccgccgcgctaaacccgaacgataaaacgcgtataaacgacgaaaaaaactaaccgccgccgcgccccctcccccgtcgctaatcgaaaaaaaaaaccctaacgaaacgcgtacccgccgccgccgccccttccccgccgctaccgctcgaactccgattcctcccatcgctccattttatctccctacccgcgcactatcgcctcataaaaaaccgcgttcacgaccctttatatcccgcgcgcccaatccccgaaactctccttctcgaatttacgacaaatttcgacgtaacgccttcctcctcccctcacactttctaaaaacgactaaaatacgaactcatttacaacaaatcctttaacttttaaaaccacaaataaaaatcga

SEQ ID NO: 14669 - DNA, 526 bp, Artificial Sequence
  chemically treated genomic DNA (Homo sapiens) CpG-island No: 14669
ttttgtatcgtcggttcggttttatttatagtatgattcgcgagacgtgtagtcgtatcgggacgtttttgtttttgaaggcggtggtgatgaagtagtcgaaggtgagcgtcgttattacgtttagcgagaaggcgaatagtgagttcgttcgcgatagtatcgtgtttatcgcgatcgttttttacgagttcggattttatacgtatatttaggttttcgtttcggcggcggatcggttttttgcgattcgcgtcgtttgcggtgcgcgcgtttcgggagcgcgcgtcgtcgtagtttcgtttttttttcggtttttcgacgcgagcgcgcgcgcgttcgtttttcgaaatatatttatagcgcgtacggggcggcgcggaaagggagagatttagtcgcgggttcgttttttcgtcgcggtttaacgtcgttattaattagcgacgagtgagggaggggcggggtttgttgtggaagatttattttttttttttttaaattgttttttcgatttttgggttta

SEQ ID NO: 14670 - DNA, 526 bp, Artificial Sequence
  chemically treated genomic DNA (Homo sapiens) CpG-island No: 14670
taaacccaaaaatcgaaaaaacaatttaaaaaaaaaaaaaataaatcttccacaacaaaccccgcccctccctcactcgtcgctaattaataacgacgttaaaccgcgacgaaaaaacgaacccgcgactaaatctctccctttccgcgccgccccgtacgcgctataaatatatttcgaaaaacgaacgcgcgcgcgctcgcgtcgaaaaaccgaaaaaaaaacgaaactacgacgacgcgcgctcccgaaacgcgcgcaccgcaaacgacgcgaatcgcaaaaaaccgatccgccgccgaaacgaaaacctaaatatacgtataaaatccgaactcgtaaaaaacgatcgcgataaacacgatactatcgcgaacgaactcactattcgccttctcgctaaacgtaataacgacgctcaccttcgactacttcatcaccaccgccttcaaaaacaaaaacgtcccgatacgactacacgtctcgcgaatcatactataaataaaaccgaaccgacgatacaaaa

SEQ ID NO: 14671 - DNA, 526 bp, Artificial Sequence
  chemically treated genomic DNA (Homo sapiens) CpG-island No: 14671
tgaatttaaaggtcggagaagtaatttagaagaggagggggtgggttttttataataaatttcgttttttttttattcgtcgttgattggtggcggcgttaggtcgcgacggaggggcgggttcgcggttgagttttttttttttcgcgtcgtttcgtgcgcgttgtgggtgtgtttcgggaagcgggcgcgcgcgcgttcgcgtcggaggatcggaaaggaggcggggttgcggcggcgcgcgttttcggaacgcgcgtatcgtagacggcgcggatcgtagggagtcggttcgtcgtcggaacgggagtttgggtgtgcgtgtggagttcggattcgtgggagacgatcgcgatgaatacggtgttgtcgcgggcgaatttattgttcgttttttcgttgagcgtgatggcggcgtttattttcggttgttttattattatcgtttttaaagataggagcgtttcggtgcggttgtacgtttcgcggattatgttgtgagtgaggtcgggtcggcggtgtagga

SEQ ID NO: 14672 - DNA, 526 bp, Artificial Sequence
  chemically treated genomic DNA (Homo sapiens) CpG-island No: 14672
tcctacaccgccgacccgacctcactcacaacataatccgcgaaacgtacaaccgcaccgaaacgctcctatctttaaaaacgataataataaaacaaccgaaaataaacgccgccatcacgctcaacgaaaaaacgaacaataaattcgcccgcgacaacaccgtattcatcgcgatcgtctcccacgaatccgaactccacacgcacacccaaactcccgttccgacgacgaaccgactccctacgatccgcgccgtctacgatacgcgcgttccgaaaacgcgcgccgccgcaaccccgcctcctttccgatcctccgacgcgaacgcgcgcgcgcccgcttcccgaaacacacccacaacgcgcacgaaacgacgcgaaaaaaaaaaaactcaaccgcgaacccgcccctccgtcgcgacctaacgccgccaccaatcaacgacgaataaaaaaaaaacgaaatttattataaaaaacccaccccctcctcttctaaattacttctccgacctttaaattca

SEQ ID NO: 14673 - DNA, 678 bp, Artificial Sequence
  chemically treated genomic DNA (Homo sapiens) CpG-island No: 14673
gaggtggggttacgcgtggagggtggagaaggggagcgaggtgggtttacgcgcggagggtggaggagaaggggagcgaggtgggtttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgcgcggagggtggaggagaaggggagcgaggtggggttacgtgcggagcgtggaggagaaggggagcgaggtggggttacgcgtggagcgtggaggagaaggggagcgaggttggattttttgggtgttttttttaggatgagggtgg

SEQ ID NO: 14674 - DNA, 678 bp, Artificial Sequence
  chemically treated genomic DNA (Homo sapiens) CpG-island No: 14674
ccaccctcatcctaaaaaaaacacccaaaaaatccaacctcgctccccttctcctccacgctccacgcgtaaccccacctcgctccccttctcctccacgctccgcacgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaccccacctcgctccccttctcctccaccctccgcgcgtaaacccacctcgctccccttctcctccaccctccgcgcgtaaacccacctcgctccccttctccaccctccacgcgtaaccccacctc

SEQ ID NO: 14675 - DNA, 678 bp, Artificial Sequence
  chemically treated genomic DNA (Homo sapiens) CpG-island No: 14675
ttatttttattttagagggagtatttagagggtttagtttcgtttttttttttttttacgttttacgcgtgattttatttcgtttttttttttttttacgtttcgtacgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgattttatttcgtttttttttttttttatttttcgcgcgtgaatttatttcgtttttttttttttttatttttcgcgcgtgaatttatttcgttttttttttttattttttacgcgtgattttatttt

SEQ ID NO: 14676 - DNA, 678 bp, Artificial Sequence
  chemically treated genomic DNA (Homo sapiens) CpG-island No: 14676
aaaataaaatcacgcgtaaaaaataaaaaaaaaaaacgaaataaattcacgcgcgaaaaataaaaaaaaaaaaaaacgaaataaattcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgcgcgaaaaataaaaaaaaaaaaaaacgaaataaaatcacgtacgaaacgtaaaaaaaaaaaaaaacgaaataaaatcacgcgtaaaacgtaaaaaaaaaaaaaaacgaaactaaaccctctaaatactccctctaaaataaaaataa

SEQ ID NO: 14677 - DNA, 874 bp, Artificial Sequence
  chemically treated genomic DNA (Homo sapiens) CpG-island No: 14677
cggttaattttttgttcgcgttttattgttcgcgcggtttttgtttttcgttcggtttcgcgttttcgggttttttcgcgaagtcgtagtcggcggcgtcggattttttttagtttttttcgcgtttcgtttatataggtagtttgggttaacggttgtagtcgttcggttagtttcgcgcgtagcggcgcggtttgggagtatagtaggatttaggtcgcgtcgtcggtttcggtttcgcgtagggtttggtttaggtcgcgtagtcgtcgtattaggcgtagagttcggagtaatcgcgcgcgtatttcgttaaggttgggttcggtatgcgtgcgttggggtatcggatagtttgttcgtcgcggggtttcgaatatcgtttttagttattgtcggtcgcgtaggcgttggagggtcgtattttcgagtacgtcggtcggcggcggcggcgttttaggttatcgcgggttttagggcggtttcgggtcgggaggcggtggtcgcggtcgttcgtcggcgtcggttttcgggaagggtcgatattggggcggcggaggaggtagcggcggtggtggtatcgggtagaaggcgttagcgtcgttttcgtcgcgggaggtttgcgcggaggttcggggttgtagagttagcggaggttgaaggaagggggcggaggttttcggaaaagggtcgggtcgttgggggagaggcggcgggaaagtcggggagggtagcggcggtggcggatagtcgaaaagagtaagaggcggcggttgcgggggcggtgggtttgggcgattttggtcgaagaatggtggtagggttatgtttacgacggagatgttttgagaagtgataggaatttgagtggttt

SEQ ID NO: 14678 - DNA, 874 bp, Artificial Sequence
  chemically treated genomic DNA (Homo sapiens) CpG-island No: 14678
aaaccactcaaattcctatcacttctcaaaacatctccgtcgtaaacataaccctaccaccattcttcgaccaaaatcgcccaaacccaccgcccccgcaaccgccgcctcttactcttttcgactatccgccaccgccgctaccctccccgactttcccgccgcctctcccccaacgacccgacccttttccgaaaacctccgcccccttccttcaacctccgctaactctacaaccccgaacctccgcgcaaacctcccgcgacgaaaacgacgctaacgccttctacccgataccaccaccgccgctacctcctccgccgccccaatatcgacccttcccgaaaaccgacgccgacgaacgaccgcgaccaccgcctcccgacccgaaaccgccctaaaacccgcgataacctaaaacgccgccgccgccgaccgacgtactcgaaaatacgaccctccaacgcctacgcgaccgacaataactaaaaacgatattcgaaaccccgcgacgaacaaactatccgataccccaacgcacgcataccgaacccaaccttaacgaaatacgcgcgcgattactccgaactctacgcctaatacgacgactacgcgacctaaaccaaaccctacgcgaaaccgaaaccgacgacgcgacctaaatcctactatactcccaaaccgcgccgctacgcgcgaaactaaccgaacgactacaaccgttaacccaaactacctatataaacgaaacgcgaaaaaaactaaaaaaaatccgacgccgccgactacgacttcgcgaaaaaacccgaaaacgcgaaaccgaacgaaaaacaaaaaccgcgcgaacaataaaacgcgaacaaaaaattaaccg

SEQ ID NO: 14679 - DNA, 874 bp, Artificial Sequence
  chemically treated genomic DNA (Homo sapiens) CpG-island No: 14679
gagttatttagatttttgttattttttaaagtattttcgtcgtgaatatggttttgttattatttttcggttagggtcgtttaggtttatcgttttcgtagtcgtcgttttttgtttttttcggttgttcgttatcgtcgttgtttttttcggttttttcgtcgttttttttttagcggttcggttttttttcgggggttttcgttttttttttttagttttcgttggttttgtagtttcgagttttcgcgtaggtttttcgcggcggaggcggcgttggcgttttttattcggtgttattatcgtcgttgtttttttcgtcgttttagtgtcggtttttttcggggatcgacgtcggcgagcggtcgcggttatcgtttttcggttcggggtcgttttggagttcgcggtggtttgaggcgtcgtcgtcgtcggtcgacgtgttcggggatgcggttttttaacgtttgcgcgatcggtagtggttggaggcggtgttcgggatttcgcggcgggtaggttgttcggtgttttagcgtacgtatgtcgggtttagttttggcgaagtgcgcgcgcgattgtttcgggttttgcgtttggtgcggcggttgcgcggtttgagttaggttttgcgcgaggtcgaagtcgacggcgcggtttgggttttgttgtatttttagatcgcgtcgttgcgcgcggaattggtcgagcggttatagtcgttgatttaggttgtttatgtgggcgaggcgcggaggaggttggagagggttcggcgtcgtcggttgcggtttcgcgagagggttcgggaacgcgaggtcgagcgggaggtagaggtcgcgcgggtagtggaacgcgagtaggagattgatcg

SEQ ID NO: 14680 - DNA, 874 bp, Artificial Sequence
  chemically treated genomic DNA (Homo sapiens) CpG-island No: 14680
cgatcaatctcctactcgcgttccactacccgcgcgacctctacctcccgctcgacctcgcgttcccgaaccctctcgcgaaaccgcaaccgacgacgccgaaccctctccaacctcctccgcgcctcgcccacataaacaacctaaatcaacgactataaccgctcgaccaattccgcgcgcaacgacgcgatctaaaaatacaacaaaacccaaaccgcgccgtcgacttcgacctcgcgcaaaacctaactcaaaccgcgcaaccgccgcaccaaacgcaaaacccgaaacaatcgcgcgcgcacttcgccaaaactaaacccgacatacgtacgctaaaacaccgaacaacctacccgccgcgaaatcccgaacaccgcctccaaccactaccgatcgcgcaaacgttaaaaaaccgcatccccgaacacgtcgaccgacgacgacgacgcctcaaaccaccgcgaactccaaaacgaccccgaaccgaaaaacgataaccgcgaccgctcgccgacgtcgatccccgaaaaaaaccgacactaaaacgacgaaaaaaacaacgacgataataacaccgaataaaaaacgccaacgccgcctccgccgcgaaaaacctacgcgaaaactcgaaactacaaaaccaacgaaaactaaaaaaaaaaaacgaaaacccccgaaaaaaaaccgaaccgctaaaaaaaaaacgacgaaaaaaccgaaaaaaacaacgacgataacgaacaaccgaaaaaaacaaaaaacgacgactacgaaaacgataaacctaaacgaccctaaccgaaaaataataacaaaaccatattcacgacgaaaatactttaaaaaataacaaaaatctaaataactc

SEQ ID NO: 14681 - DNA, 1231 bp, Artificial Sequence
  chemically treated genomic DNA (Homo sapiens) CpG-island No: 14681
gttttcgatggcgtagagtagcgtgaatatgcggttgatcgtatagacggtgttatcgcgtattacggtcgtgaagagcgtttttttgttgttgacgaattggtcgggtagcgtcgtttattggttcgtggttaggttgagatagtcgatggcgtagtgtaggaagtcgtcggaaggttcgttgcgtattatatagaggttgtcgcggtgggttattatgtagtggttatagttttgcggacgtcgtagttcggttattggtagttacgcgtcggttcgtattgcgtattttattacggcggtggtgtcggtcggtcgttataggtatacgaagagacggttataagtttgggcgtagggtacgtcggcggtcggttgcggtaggtcggttacgaaattttagtagttcgcggttgggtcgtagcgttttacggagttgatgggcgttttttggaattcgtcgtcgatggcgtagaggcggtcgtcgaagtcggttagcgttgtgttatagcgcggttggtgcgggttggggaattcgtgttacgtgtcgtcgtcggggtcgtagtagaagtttagttttattatttttttgttggcgtcgcgtacgttttttacgatgtaaagtttgttgtttagcgtggttatttcggttagtaacgtgttggtttttaggggtagcgtagttagcgtgcgttacgcgttttttttttcgtttaggtaatatagcgtgcgcgaggcgttttttaggaagtcgggcgcgggcgtgtgcgtgtttacggtcgcgtagttgttgggtcgtagggtcgttacgtaggcgcgggttttaggtagcgttagttcggtcgttagttcgcgttcgtcgtcgtagatgaagagcgcggtattgtggaatacgtcgcgtaggtcgaaggcggcggtcgcgtcgtatagtaatgcgtagttgttcgacgtgaggttgtgttttagaaagcgagttagcgtcggcgtttggaggaaggcggcgtattttacggtttgtagtagttcgtttttcgtcgttagcgtcggtcggtcgtcgcgtagtatttgtagcgtggcgcggaaatttttcgcgtttagaacgtttaggcgtatttttgttgcgcgggtttttcgtatgtcggagcggaagaggtttcggaagaagttatagtgttttattagtagggcgcggtcggtttggaagagttggtcgtttatttatatttgtatt

SEQ ID NO: 14682 - DNA, 1231 bp, Artificial Sequence
  chemically treated genomic DNA (Homo sapiens) CpG-island No: 14682
aatacaaatataaataaacgaccaactcttccaaaccgaccgcgccctactaataaaacactataacttcttccgaaacctcttccgctccgacatacgaaaaacccgcgcaacaaaaatacgcctaaacgttctaaacgcgaaaaatttccgcgccacgctacaaatactacgcgacgaccgaccgacgctaacgacgaaaaacgaactactacaaaccgtaaaatacgccgccttcctccaaacgccgacgctaactcgctttctaaaacacaacctcacgtcgaacaactacgcattactatacgacgcgaccgccgccttcgacctacgcgacgtattccacaataccgcgctcttcatctacgacgacgaacgcgaactaacgaccgaactaacgctacctaaaacccgcgcctacgtaacgaccctacgacccaacaactacgcgaccgtaaacacgcacacgcccgcgcccgacttcctaaaaaacgcctcgcgcacgctatattacctaaacgaaaaaaaaaacgcgtaacgcacgctaactacgctacccctaaaaaccaacacgttactaaccgaaataaccacgctaaacaacaaactttacatcgtaaaaaacgtacgcgacgccaacaaaaaaataataaaactaaacttctactacgaccccgacgacgacacgtaacacgaattccccaacccgcaccaaccgcgctataacacaacgctaaccgacttcgacgaccgcctctacgccatcgacgacgaattccaaaaaacgcccatcaactccgtaaaacgctacgacccaaccgcgaactactaaaatttcgtaaccgacctaccgcaaccgaccgccgacgtaccctacgcccaaacttataaccgtctcttcgtatacctataacgaccgaccgacaccaccgccgtaataaaatacgcaatacgaaccgacgcgtaactaccaataaccgaactacgacgtccgcaaaactataaccactacataataacccaccgcgacaacctctatataatacgcaacgaaccttccgacgacttcctacactacgccatcgactatctcaacctaaccacgaaccaataaacgacgctacccgaccaattcgtcaacaacaaaaaaacgctcttcacgaccgtaatacgcgataacaccgtctatacgatcaaccgcatattcacgctactctacgccatcgaaaac

SEQ ID NO: 14683 - DNA, 1231 bp, Artificial Sequence
  chemically treated genomic DNA (Homo sapiens) CpG-island No: 14683
ggtgtaggtgtgggtgggcggttagtttttttaagtcgatcgcgttttgttggtggagtattgtggtttttttcgaggtttttttcgtttcggtatgcgggagattcgcgtagtagaggtgcgtttgggcgttttgagcgcgggaggttttcgcgttacgttgtaggtgttgcgcggcgatcggtcggcgttggcggcggaggacgagttgttgtaggtcgtggagtgcgtcgtttttttttaggcgtcggcgttggttcgttttttggagtataattttacgtcggataattgcgtattgttgtgcgacgcggtcgtcgttttcggtttgcgcgacgtgttttatagtgtcgcgttttttatttgcgacggcgagcgcgagttggcggtcgaattggcgttgtttgaggttcgcgtttacgtggcggttttgcggtttagtagttacgcggtcgtgagtacgtatacgttcgcgttcggttttttggaggacgtttcgcgtacgttgtgttatttggacgaggaagaggacgcgtggcgtacgttggttgcgttgtttttggaggttagtacgttgttggtcggggtggttacgttgggtaataagttttatatcgtggggggcgtgcgcggcgttagtaaggaggtggtagagttgggtttttgttacgatttcgacggcggtacgtggtacgagttttttagttcgtattagtcgcgttatgatatagcgttggtcggtttcgacggtcgtttttacgttatcggcggcgaattttagaggacgtttattagtttcgtggagcgttacgatttagtcgcgggttgttggagtttcgtggtcgatttgtcgtagtcggtcgtcggcgtgttttgcgtttaggtttgtggtcgttttttcgtgtgtttgtggcggtcggtcgatattatcgtcgtggtggagtacgtagtgcggatcgacgcgtggttgttagtggtcgagttgcggcgttcgtagagttatggttattgtatggtggtttatcgcgatagtttttatgtggtgcgtaacggatttttcgacgattttttgtattgcgttatcgattgttttaatttggttacgggttagtggacggcgttgttcggttagttcgttaatagtaagggagcgttttttacggtcgtggtgcgcggtgatatcgtttatacggttaatcgtatgtttacgttgttttacgttatcgagggt

SEQ ID NO: 14684 - DNA, 1231 bp, Artificial Sequence
  chemically treated genomic DNA (Homo sapiens) CpG-island No: 14684
accctcgataacgtaaaacaacgtaaacatacgattaaccgtataaacgatatcaccgcgcaccacgaccgtaaaaaacgctcccttactattaacgaactaaccgaacaacgccgtccactaacccgtaaccaaattaaaacaatcgataacgcaatacaaaaaatcgtcgaaaaatccgttacgcaccacataaaaactatcgcgataaaccaccatacaataaccataactctacgaacgccgcaactcgaccactaacaaccacgcgtcgatccgcactacgtactccaccacgacgataatatcgaccgaccgccacaaacacacgaaaaaacgaccacaaacctaaacgcaaaacacgccgacgaccgactacgacaaatcgaccacgaaactccaacaacccgcgactaaatcgtaacgctccacgaaactaataaacgtcctctaaaattcgccgccgataacgtaaaaacgaccgtcgaaaccgaccaacgctatatcataacgcgactaatacgaactaaaaaactcgtaccacgtaccgccgtcgaaatcgtaacaaaaacccaactctaccacctccttactaacgccgcgcacgccccccacgatataaaacttattacccaacgtaaccaccccgaccaacaacgtactaacctccaaaaacaacgcaaccaacgtacgccacgcgtcctcttcctcgtccaaataacacaacgtacgcgaaacgtcctccaaaaaaccgaacgcgaacgtatacgtactcacgaccgcgtaactactaaaccgcaaaaccgccacgtaaacgcgaacctcaaacaacgccaattcgaccgccaactcgcgctcgccgtcgcaaataaaaaacgcgacactataaaacacgtcgcgcaaaccgaaaacgacgaccgcgtcgcacaacaatacgcaattatccgacgtaaaattatactccaaaaaacgaaccaacgccgacgcctaaaaaaaaacgacgcactccacgacctacaacaactcgtcctccgccgccaacgccgaccgatcgccgcgcaacacctacaacgtaacgcgaaaacctcccgcgctcaaaacgcccaaacgcacctctactacgcgaatctcccgcataccgaaacgaaaaaaacctcgaaaaaaaccacaatactccaccaacaaaacgcgatcgacttaaaaaaactaaccgcccacccacacctacacc

SEQ ID NO: 14685 - DNA, 683 bp, Artificial Sequence
  chemically treated genomic DNA (Homo sapiens) CpG-island No: 14685
tcgtagcgcgtttcgcggtgatttgtttaaggttattatcgtttcgggttcgtggcgttcggttcgggaggatacgggttaggcgggcgcggggttttggggtgggggtcggcgcggggcgttcggggcgttgcgcgttgacgtcggggttcgatgcggcggggattgggcgcggggggaggcgcgtcgtaggcgagcgttttttttttgtgcgagcgtcggcgttcggtttttcgaaggtaaatagcgtttttttttttttttcgtcgcgttttttttttttatagttatttttcgtttggtattcgttcgggttgttgttgttgttgttgttgtcgtcgcgcgggagtagttcgtaaatttgtggcggtgacgtgagtttcgttaattcggaaacggcggcggcggcggtatcggtagtttcgaggtttttgcgttttcgcgcgcgtttttttcgttcgttcgcgcgttagtacgtgtcggggttttgaaggcgtcgtatcggtcggtcgcgcgcggtttttggattcgatttgttttcggagagggcggggtttcgggttttggaattggggtgtcggggagaggcggaggtattattcgggtcgtcggcgacgttttgcgcgggttggatagggggcgttttttggttggggttttcgggtcggttcgggcgtttttta

SEQ ID NO: 14686 - DNA, 683 bp, Artificial Sequence
  chemically treated genomic DNA (Homo sapiens) CpG-island No: 14686
taaaaaacgcccgaaccgacccgaaaaccccaaccaaaaaacgccccctatccaacccgcgcaaaacgtcgccgacgacccgaataatacctccgcctctccccgacaccccaattccaaaacccgaaaccccgccctctccgaaaacaaatcgaatccaaaaaccgcgcgcgaccgaccgatacgacgccttcaaaaccccgacacgtactaacgcgcgaacgaacgaaaaaaacgcgcgcgaaaacgcaaaaacctcgaaactaccgataccgccgccgccgccgtttccgaattaacgaaactcacgtcaccgccacaaatttacgaactactcccgcgcgacgacaacaacaacaacaacaacaacccgaacgaataccaaacgaaaaataactataaaaaaaaaaaacgcgacgaaaaaaaaaaaaaaacgctatttaccttcgaaaaaccgaacgccgacgctcgcacaaaaaaaaaacgctcgcctacgacgcgcctccccccgcgcccaatccccgccgcatcgaaccccgacgtcaacgcgcaacgccccgaacgccccgcgccgacccccaccccaaaaccccgcgcccgcctaacccgtatcctcccgaaccgaacgccacgaacccgaaacgataataaccttaaacaaatcaccgcgaaacgcgctacga

SEQ ID NO: 14687 - DNA, 683 bp, Artificial Sequence
  chemically treated genomic DNA (Homo sapiens) CpG-island No: 14687
tgggggacgttcgggtcggttcgaaggttttaattaaggggcgttttttgtttaattcgcgtaaggcgtcgtcggcggttcggatggtattttcgttttttttcggtattttaattttagggttcggaatttcgtttttttcgggggtaaatcggatttaggggtcgcgcgcggtcggtcggtgcggcgtttttagagtttcggtacgtattggcgcgcgggcgggcgaggggagcgcgcgcgggagcgtaggagtttcggagttatcggtgtcgtcgtcgtcgtcgttttcgggttggcggggtttacgttatcgttataggtttgcgagttgttttcgcgcggcggtagtagtagtagtagtagtagttcgggcgagtgttaggcgagaaataattataaaaggaagaggcgcggcgaggaggaagaggaagcgttgtttattttcgagaagtcgagcgtcggcgttcgtataaaaggaggacgttcgtttgcgacgcgttttttttcgcgtttagttttcgtcgtatcgggtttcggcgttagcgcgtagcgtttcggacgtttcgcgtcggtttttattttagaatttcgcgttcgtttggttcgtgttttttcgagtcgggcgttacgggttcgggacggtggtgattttgggtaagttatcgcggggcgcgttgcga

SEQ ID NO: 14688 - DNA, 683 bp, Artificial Sequence
  chemically treated genomic DNA (Homo sapiens) CpG-island No: 14688
tcgcaacgcgccccgcgataacttacccaaaatcaccaccgtcccgaacccgtaacgcccgactcgaaaaaacacgaaccaaacgaacgcgaaattctaaaataaaaaccgacgcgaaacgtccgaaacgctacgcgctaacgccgaaacccgatacgacgaaaactaaacgcgaaaaaaaacgcgtcgcaaacgaacgtcctccttttatacgaacgccgacgctcgacttctcgaaaataaacaacgcttcctcttcctcctcgccgcgcctcttccttttataattatttctcgcctaacactcgcccgaactactactactactactactaccgccgcgcgaaaacaactcgcaaacctataacgataacgtaaaccccgccaacccgaaaacgacgacgacgacgacaccgataactccgaaactcctacgctcccgcgcgcgctcccctcgcccgcccgcgcgccaatacgtaccgaaactctaaaaacgccgcaccgaccgaccgcgcgcgacccctaaatccgatttacccccgaaaaaaacgaaattccgaaccctaaaattaaaataccgaaaaaaaacgaaaataccatccgaaccgccgacgacgccttacgcgaattaaacaaaaaacgccccttaattaaaaccttcgaaccgacccgaacgtccccca

SEQ ID NO: 14689 - DNA, 506 bp, Artificial Sequence
  chemically treated genomic DNA (Homo sapiens) CpG-island No: 14689
  misc_feature (178)..(178): n is either a, c, g or t
tcgtatcggaggtttcgtgtataggcgggatatatttcgtatcggaggtttcgtgtataggcgggatatatttcgtatcggaggtttcgtgtataggcgggatatattcgatcggaggtttcgtgtataggcgggatatattcgattcggaggtttcgtgtataggcgggatatattncgtatcggaggtttcgtgtataggcgggatatattcgatcggaggtttcgtgtataggcgggatatattcgtatcggaggtttcgtgtataggcgggatatattcgtatcggaggtttcgtgtataggcgggatatattcgtatcggaggtttcgtgtataggcgggatatacgtatatcggaggtttcgtgtataggcgggatatatttgtacgagaggtttattgtacgtggagggcgggggcgggaaatatttatattagaggtttcgtgtataggcgggatatatttatacgagaggttttgtgtataagcgggatatatttgt

SEQ ID NO: 14690 - DNA, 506 bp, Artificial Sequence
  chemically treated genomic DNA (Homo sapiens) CpG-island No: 14690
  misc_feature (329)..(329): n is either a, c, g or t
acaaatatatcccgcttatacacaaaacctctcgtataaatatatcccgcctatacacgaaacctctaatataaatatttcccgcccccgccctccacgtacaataaacctctcgtacaaatatatcccgcctatacacgaaacctccgatatacgtatatcccgcctatacacgaaacctccgatacgaatatatcccgcctatacacgaaacctccgatacgaatatatcccgcctatacacgaaacctccgatacgaatatatcccgcctatacacgaaacctccgatcgaatatatcccgcctatacacgaaacctccgatacgnaatatatcccgcctatacacgaaacctccgaatcgaatatatcccgcctatacacgaaacctccgatcgaatatatcccgcctatacacgaaacctccgatacgaaatatatcccgcctatacacgaaacctccgatacgaaatatatcccgcctatacacgaaacctccgatacga

SEQ ID NO: 14691 - DNA, 506 bp, Artificial Sequence
  chemically treated genomic DNA (Homo sapiens) CpG-island No: 14691
  misc_feature (329)..(329): n is either a, c, g or t
gtagatgtgtttcgtttgtgtatagggtttttcgtgtgggtgtgtttcgtttgtgtacggaatttttgatgtggatgtttttcgttttcgttttttacgtgtagtgaatttttcgtgtagatgtgtttcgtttgtgtacggagttttcggtgtgcgtgtgtttcgtttgtgtacggagttttcggtgcgggtgtgtttcgtttgtgtacggagttttcggtgcgggtgtgtttcgtttgtgtacggagttttcggtgcgggtgtgtttcgtttgtgtacggagttttcggtcgggtgtgtttcgtttgtgtacggagttttcggtgcgnggtgtgtttcgtttgtgtacggagttttcggatcgggtgtgtttcgtttgtgtacggagttttcggtcgggtgtgtttcgtttgtgtacggagttttcggtgcggggtgtgtttcgtttgtgtacggagttttcggtgcggggtgtgtttcgtttgtgtacggagttttcggtgcgg

SEQ ID NO: 14692 - DNA, 506 bp, Artificial Sequence
  chemically treated genomic DNA (Homo sapiens) CpG-island No: 14692
  misc_feature (178)..(178): n is either a, c, g or t
ccgcaccgaaaactccgtacacaaacgaaacacaccccgcaccgaaaactccgtacacaaacgaaacacaccccgcaccgaaaactccgtacacaaacgaaacacacccgaccgaaaactccgtacacaaacgaaacacacccgatccgaaaactccgtacacaaacgaaacacaccncgcaccgaaaactccgtacacaaacgaaacacacccgaccgaaaactccgtacacaaacgaaacacacccgcaccgaaaactccgtacacaaacgaaacacacccgcaccgaaaactccgtacacaaacgaaacacacccgcaccgaaaactccgtacacaaacgaaacacacgcacaccgaaaactccgtacacaaacgaaacacatctacacgaaaaattcactacacgtaaaaaacgaaaacgaaaaacatccacatcaaaaattccgtacacaaacgaaacacacccacacgaaaaaccctatacacaaacgaaacacatctac

SEQ ID NO: 14693 - DNA, 745 bp, Artificial Sequence
  chemically treated genomic DNA (Homo sapiens) CpG-island No: 14693
aagttgcgattcgcgtattaaaaatattcgtcgcgatttttaaatagcgaggagagagggggagagaaagttgcgttcggcgattttcggttcgcggaagaaggcgtaggggagcgttcggagcggcgcgtcgggaggagcgttcgtttagtagtagcgcggcggcggggaggcggtagtatggagcgcgggtcgcgggtcggttcgtcgagcgttcgttgttgcgttcgcggttcgcgtcggggatgatttcgggttcggcgtttaggtttcgcgcgtttcgttcgtagttcggcggtcgggacgcggttcgcgtcggtcgtcgtcgtcgttttttggagcggtttcgggcgcggcggtttatgcgagcggtttttcgcggttcgcggcgcgttcggagttcggagttcgcggggacgaggttaaagttgggcgcgtcgcggagttgcgttcgcgttcggggtttcgcgttttcgcgtttcgcgaatttcggcggcggttgaggcgacggttgcggcggtcgagtagtatgtcgaggaggaagtagtaggtttttcggcgttcggtaggtaacgggcgcgcggttcgcgtcgcggggagtgggcgtcgggaggagtaggaggagggggtttcgcgggtcgaggtgcgggacgtgggtcgcgggtcgttttaagttggggaggggaggtttagtttgcgttggttatagtcgtttggaggttgcggtcgtcgtttttttttatat

SEQ ID NO: 14694 - DNA, 745 bp, Artificial Sequence
  chemically treated genomic DNA (Homo sapiens) CpG-island No: 14694
atataaaaaaaaacgacgaccgcaacctccaaacgactataaccaacgcaaactaaacctcccctccccaacttaaaacgacccgcgacccacgtcccgcacctcgacccgcgaaaccccctcctcctactcctcccgacgcccactccccgcgacgcgaaccgcgcgcccgttacctaccgaacgccgaaaaacctactacttcctcctcgacatactactcgaccgccgcaaccgtcgcctcaaccgccgccgaaattcgcgaaacgcgaaaacgcgaaaccccgaacgcgaacgcaactccgcgacgcgcccaactttaacctcgtccccgcgaactccgaactccgaacgcgccgcgaaccgcgaaaaaccgctcgcataaaccgccgcgcccgaaaccgctccaaaaaacgacgacgacgaccgacgcgaaccgcgtcccgaccgccgaactacgaacgaaacgcgcgaaacctaaacgccgaacccgaaatcatccccgacgcgaaccgcgaacgcaacaacgaacgctcgacgaaccgacccgcgacccgcgctccatactaccgcctccccgccgccgcgctactactaaacgaacgctcctcccgacgcgccgctccgaacgctcccctacgccttcttccgcgaaccgaaaatcgccgaacgcaactttctctccccctctctcctcgctatttaaaaatcgcgacgaatatttttaatacgcgaatcgcaactt

SEQ ID NO: 14695 - DNA, 745 bp, Artificial Sequence
  chemically treated genomic DNA (Homo sapiens) CpG-island No: 14695
gtgtgggggaggacggcgatcgtagtttttagacgattgtggttagcgtaggttgggttttttttttttagtttggggcggttcgcggtttacgtttcgtatttcggttcgcgaagttttttttttttgtttttttcggcgtttatttttcgcggcgcgggtcgcgcgttcgttatttgtcgagcgtcggggggtttgttgtttttttttcggtatgttgttcggtcgtcgtagtcgtcgttttagtcgtcgtcggagttcgcggggcgcggggacgcggggtttcgggcgcgggcgtaatttcgcggcgcgtttaattttggtttcgttttcgcgggtttcgggtttcgggcgcgtcgcggatcgcggggagtcgttcgtatggatcgtcgcgttcggggtcgttttaggaggcggcggcggcggtcggcgcgggtcgcgtttcggtcgtcgggttgcgggcggagcgcgcggggtttgggcgtcgagttcggagttattttcggcgcgggtcgcgggcgtagtagcgggcgttcggcgggtcggttcgcggttcgcgttttatgttgtcgttttttcgtcgtcgcgttgttgttgggcgggcgtttttttcggcgcgtcgtttcgggcgtttttttgcgttttttttcgcgagtcgagagtcgtcgagcgtaatttttttttttttttttttttcgttgtttgggggtcgcggcgagtgtttttagtgcgcgggtcgtagttt

SEQ ID NO: 14696 - DNA, 745 bp, Artificial Sequence
  chemically treated genomic DNA (Homo sapiens) CpG-island No: 14696
aaactacgacccgcgcactaaaaacactcgccgcgacccccaaacaacgaaaaaaaaaaaaaaaaaaaaattacgctcgacgactctcgactcgcgaaaaaaaacgcaaaaaaacgcccgaaacgacgcgccgaaaaaaacgcccgcccaacaacaacgcgacgacgaaaaaacgacaacataaaacgcgaaccgcgaaccgacccgccgaacgcccgctactacgcccgcgacccgcgccgaaaataactccgaactcgacgcccaaaccccgcgcgctccgcccgcaacccgacgaccgaaacgcgacccgcgccgaccgccgccgccgcctcctaaaacgaccccgaacgcgacgatccatacgaacgactccccgcgatccgcgacgcgcccgaaacccgaaacccgcgaaaacgaaaccaaaattaaacgcgccgcgaaattacgcccgcgcccgaaaccccgcgtccccgcgccccgcgaactccgacgacgactaaaacgacgactacgacgaccgaacaacataccgaaaaaaaaacaacaaaccccccgacgctcgacaaataacgaacgcgcgacccgcgccgcgaaaaataaacgccgaaaaaaacaaaaaaaaaaaacttcgcgaaccgaaatacgaaacgtaaaccgcgaaccgccccaaactaaaaaaaaaaaacccaacctacgctaaccacaatcgtctaaaaactacgatcgccgtcctcccccacac

SEQ ID NO: 14697 - DNA, 731 bp, Artificial Sequence
  chemically treated genomic DNA (Homo sapiens) CpG-island No: 14697
gcgcgtttaggagtgtttgttttacgcggtttaggtgttatgttggcggtggcgcgttgttagtaggcgtttttttacgggttcggggaggcgttggtttttatcgaggtcgttcgtttttttttgcggtaggagcgcgacgcgcgttagcgtttggtttgtttcgtcgtttacggggagtcgttgtaggtcgtcgttagcgttttgggcgtcgcggtgcgtttgtatttcgagttgggttagtcggtcgtcgtcgtcgttttttgtttcgagttggtcgtcgttttgcgcgatttgggttagtcggtcgtcgtcgtcggttatttttagcgcgtcgtttagttttagttgttttagttgtttttggtcgcgttgtaggcgtttggcgaggtcgttttttgttcgttgttggcgcgcgattatatcggcgttttggcggtttttacgcgtatgtagcgtttggcgcgggagtacggtagttattcggtgtagttattgtcgtcgttttcgtcgtcggattttagttcgggttcggggcgacgttcgttttatcggtcgcgttgtttttttcgaatttcggttcggcggcgttttttttcgtcgttttgggcgttttttcggacgtgttggttcgttgcgaggtgtttcgcgtgttgttgttgttttttttgtaattatcgttcgttaagttgttgtcggagtacgtttagattttggagaagtatttttgg

SEQ ID NO: 14698 - DNA, 731 bp, Artificial Sequence
  chemically treated genomic DNA (Homo sapiens) CpG-island No: 14698
ccaaaaatacttctccaaaatctaaacgtactccgacaacaacttaacgaacgataattacaaaaaaaacaacaacaacacgcgaaacacctcgcaacgaaccaacacgtccgaaaaaacgcccaaaacgacgaaaaaaaacgccgccgaaccgaaattcgaaaaaaacaacgcgaccgataaaacgaacgtcgccccgaacccgaactaaaatccgacgacgaaaacgacgacaataactacaccgaataactaccgtactcccgcgccaaacgctacatacgcgtaaaaaccgccaaaacgccgatataatcgcgcgccaacaacgaacaaaaaacgacctcgccaaacgcctacaacgcgaccaaaaacaactaaaacaactaaaactaaacgacgcgctaaaaataaccgacgacgacgaccgactaacccaaatcgcgcaaaacgacgaccaactcgaaacaaaaaacgacgacgacgaccgactaacccaactcgaaatacaaacgcaccgcgacgcccaaaacgctaacgacgacctacaacgactccccgtaaacgacgaaacaaaccaaacgctaacgcgcgtcgcgctcctaccgcaaaaaaaaacgaacgacctcgataaaaaccaacgcctccccgaacccgtaaaaaaacgcctactaacaacgcgccaccgccaacataacacctaaaccgcgtaaaacaaacactcctaaacgcgc

SEQ ID NO: 14699 - DNA, 731 bp, Artificial Sequence
  chemically treated genomic DNA (Homo sapiens) CpG-island No: 14699
ttaggagtatttttttagggtttgggcgtgtttcggtagtagtttggcgggcggtggttgtaggaggagtagtagtagtacgcgggatatttcgtagcggattagtacgttcgagaaggcgtttagggcggcgggagagggcgtcgtcgagtcggagttcggaggaagtagcgcggtcggtagggcgggcgtcgtttcgggttcgggttggggttcggcggcgggggcggcggtagtgattgtatcgggtggttgtcgtgttttcgcgttaggcgttgtatgcgcgtgaagatcgttagggcgtcggtgtagtcgcgcgttagtagcgggtaggaggcggtttcgttaagcgtttgtagcgcggttaggggtagttggggtagttggagttgggcggcgcgttggaagtgatcggcggcggcggtcggttggtttaggtcgcgtagggcggcggttagttcgaggtagagggcggcggcggcggtcggttggtttagttcgaggtgtagacgtatcgcggcgtttagggcgttggcggcggtttgtagcggtttttcgtaggcggcggggtagattaggcgttggcgcgcgtcgcgtttttgtcgtaggaagaggcgggcggtttcggtgagggttagcgttttttcgggttcgtggaagagcgtttgttggtagcgcgttatcgttagtatggtatttaggtcgcgtagggtagatatttttgggcgcgt

SEQ ID NO: 14700 - DNA, 731 bp, Artificial Sequence
  chemically treated genomic DNA (Homo sapiens) CpG-island No: 14700
acgcgcccaaaaatatctaccctacgcgacctaaataccatactaacgataacgcgctaccaacaaacgctcttccacgaacccgaaaaaacgctaaccctcaccgaaaccgcccgcctcttcctacgacaaaaacgcgacgcgcgccaacgcctaatctaccccgccgcctacgaaaaaccgctacaaaccgccgccaacgccctaaacgccgcgatacgtctacacctcgaactaaaccaaccgaccgccgccgccgccctctacctcgaactaaccgccgccctacgcgacctaaaccaaccgaccgccgccgccgatcacttccaacgcgccgcccaactccaactaccccaactacccctaaccgcgctacaaacgcttaacgaaaccgcctcctacccgctactaacgcgcgactacaccgacgccctaacgatcttcacgcgcatacaacgcctaacgcgaaaacacgacaaccacccgatacaatcactaccgccgcccccgccgccgaaccccaacccgaacccgaaacgacgcccgccctaccgaccgcgctacttcctccgaactccgactcgacgacgccctctcccgccgccctaaacgccttctcgaacgtactaatccgctacgaaatatcccgcgtactactactactcctcctacaaccaccgcccgccaaactactaccgaaacacgcccaaaccctaaaaaaatactcctaa

SEQ ID NO: 14701 - DNA, 561 bp, Artificial Sequence
  chemically treated genomic DNA (Homo sapiens) CpG-island No: 14701
tcggcgttcgattggtttaggagttgttcgtagggaggtgaggagaggggttcggacgttcgcggggaaggtggggacgggggttcgacgttcgcggggaagtggggatttagtcgagtcgttcgggtagcggtcgatttttagagtcgtttgtcgggtaggtagcggacgggcgcggcgagttgttggttattaggcgtttttaggtcgtcggttcgcgttagcgttttagtcgtatttttagttagaaagcggtgaggtttgcggcgcgttcgggcgtagggcgggtttagtttttcgcgaggtgggatcggttgggcgttcggttcgtttttaaagtcggttgattggtgttcggtttttgtgttttgtgtttcggtgtgtggcgttttttgagcgagcgttgggggggacgtatttatttgtttgagtcgcgggttttatagcggtgggaggaaacgggattcggggggtggagtgacgcgttttagcgtttcgtttttgtgttattttcggggttttaaggtttttgttttggatttaggatattttttttaggaa

SEQ ID NO: 14702 - DNA, 561 bp, Artificial Sequence
  chemically treated genomic DNA (Homo sapiens) CpG-island No: 14702
ttcctaaaaaaaatatcctaaatccaaaacaaaaaccttaaaaccccgaaaataacacaaaaacgaaacgctaaaacgcgtcactccaccccccgaatcccgtttcctcccaccgctataaaacccgcgactcaaacaaataaatacgtcccccccaacgctcgctcaaaaaacgccacacaccgaaacacaaaacacaaaaaccgaacaccaatcaaccgactttaaaaacgaaccgaacgcccaaccgatcccacctcgcgaaaaactaaacccgccctacgcccgaacgcgccgcaaacctcaccgctttctaactaaaaatacgactaaaacgctaacgcgaaccgacgacctaaaaacgcctaataaccaacaactcgccgcgcccgtccgctacctacccgacaaacgactctaaaaatcgaccgctacccgaacgactcgactaaatccccacttccccgcgaacgtcgaacccccgtccccaccttccccgcgaacgtccgaacccctctcctcacctccctacgaacaactcctaaaccaatcgaacgccga

SEQ ID NO: 14703 - DNA, 561 bp, Artificial Sequence
  chemically treated genomic DNA (Homo sapiens) CpG-island No: 14703
tttttaaggagaatattttaaatttaaggtagaggttttagggtttcgagagtggtataagaacggggcgttggggcgcgttattttatttttcgggtttcgtttttttttatcgttgtgaaattcgcggtttagatagatgggtacgttttttttagcgttcgtttagggggcgttatatatcggaatataagatataggaatcgaatattaattagtcgattttaggggcgggtcggacgtttagtcggttttatttcgcggggagttgggttcgttttgcgttcgagcgcgtcgtaggttttatcgttttttgattggaaatgcggttgaggcgttggcgcgggtcggcggtttggagacgtttggtgattaataattcgtcgcgttcgttcgttgtttgttcggtagacggttttagagatcgatcgttgttcggacggttcggttgggtttttattttttcgcgggcgtcgggttttcgtttttatttttttcgcgggcgttcgggtttttttttttatttttttgcggatagtttttaggttagtcgagcgtcga

SEQ ID NO: 14704 - DNA, 561 bp, Artificial Sequence
  chemically treated genomic DNA (Homo sapiens) CpG-island No: 14704
tcgacgctcgactaacctaaaaactatccgcaaaaaaataaaaaaaaaaacccgaacgcccgcgaaaaaaataaaaacgaaaacccgacgcccgcgaaaaaataaaaacccaaccgaaccgtccgaacaacgatcgatctctaaaaccgtctaccgaacaaacaacgaacgaacgcgacgaattattaatcaccaaacgtctccaaaccgccgacccgcgccaacgcctcaaccgcatttccaatcaaaaaacgataaaacctacgacgcgctcgaacgcaaaacgaacccaactccccgcgaaataaaaccgactaaacgtccgacccgcccctaaaatcgactaattaatattcgattcctatatcttatattccgatatataacgccccctaaacgaacgctaaaaaaaacgtacccatctatctaaaccgcgaatttcacaacgataaaaaaaaacgaaacccgaaaaataaaataacgcgccccaacgccccgttcttataccactctcgaaaccctaaaacctctaccttaaatttaaaatattctccttaaaaa

SEQ ID NO: 14705 - DNA, 659 bp, Artificial Sequence
  chemically treated genomic DNA (Homo sapiens) CpG-island No: 14705
tgcgcgcgttttttttttcgtttttttttttttcgtagtttcgtcgttttggtgtttttttgttcggttcggcgtcgttcgttttcggtttcggtttcgttagttcgggttttcgcgttcggagtagtttagttttgtagtggttcgggattcgatgttatgagagggaagcgagtcgggcgtttagatttttaggaggcgtcggatgcgcggcgggttttgggatcgggtttttttttcggttcgttttgttttcgggtgattatttggtttcgtttatagttttgtttttttcggaggagttatcggtgtcgcgtgcgtgtggagtatttgtagatatgattgcgtggaggagattttagtcgttgtttttgtttttcgggttgttggtgttgtgcgcgaggttttttattgtagcgaagggtaagacggatttgtttttggtcggggaggcggtagagttttcggaggtttcgtgtgcggacgcgagtgtgcgttttggggatcgtagggtacggagtggtcgtttttgttcggcgttgttttatcgtcgaagttcggggaacgcgatgtacgggagggagtttttatcgcgttttttttagtttttttgggttttcgttttatttcgttatttttttttttttttttgggtttat

SEQ ID NO: 14706 - DNA, 659 bp, Artificial Sequence
  chemically treated genomic DNA (Homo sapiens) CpG-island No: 14706
ataaacccaaaaaaaaaaaaaaaaataacgaaataaaacgaaaacccaaaaaaactaaaaaaaacgcgataaaaactccctcccgtacatcgcgttccccgaacttcgacgataaaacaacgccgaacaaaaacgaccactccgtaccctacgatccccaaaacgcacactcgcgtccgcacacgaaacctccgaaaactctaccgcctccccgaccaaaaacaaatccgtcttacccttcgctacaataaaaaacctcgcgcacaacaccaacaacccgaaaaacaaaaacaacgactaaaatctcctccacgcaatcatatctacaaatactccacacgcacgcgacaccgataactcctccgaaaaaaacaaaactataaacgaaaccaaataatcacccgaaaacaaaacgaaccgaaaaaaaaacccgatcccaaaacccgccgcgcatccgacgcctcctaaaaatctaaacgcccgactcgcttccctctcataacatcgaatcccgaaccactacaaaactaaactactccgaacgcgaaaacccgaactaacgaaaccgaaaccgaaaacgaacgacgccgaaccgaacaaaaaaacaccaaaacgacgaaactacgaaaaaaaaaaaaacgaaaaaaaaaacgcgcgca

SEQ ID NO: 14707 - DNA, 659 bp, Artificial Sequence
  chemically treated genomic DNA (Homo sapiens) CpG-island No: 14707
gtgagtttaagagagggggaaggaatggcggggtggggcgggggtttaggagggttggggagagcgcgatggaagttttttttcgtgtatcgcgtttttcgagtttcggcgatggagtagcgtcgggtagaggcggttatttcgtattttgcggtttttaaaacgtatattcgcgttcgtatacggggttttcgagggttttatcgttttttcggttaggagtaagttcgttttatttttcgttgtagtgaggagtttcgcgtatagtattagtagttcgagaagtaggagtagcgattggaattttttttacgtagttatgtttgtagatattttatacgtacgcgatatcgatggttttttcgaggaaggtagggttatgagcggagttaaataattattcgagggtaaggcgagtcggagagagagttcggttttaagattcgtcgcgtattcgacgttttttgaaggtttgggcgttcggttcgttttttttttatagtatcgggtttcgagttattgtagggttgagttgtttcgagcgcggagattcgggttggcggggtcggggtcggggacgagcggcgtcgagtcgggtaggaaggtattaaggcggcgaggttgcgggagggggagaagcggggagaggagcgcgcgta

SEQ ID NO: 14708 - DNA, 659 bp, Artificial Sequence
  chemically treated genomic DNA (Homo sapiens) CpG-island No: 14708
tacgcgcgctcctctccccgcttctccccctcccgcaacctcgccgccttaataccttcctacccgactcgacgccgctcgtccccgaccccgaccccgccaacccgaatctccgcgctcgaaacaactcaaccctacaataactcgaaacccgatactataaaaaaaaaacgaaccgaacgcccaaaccttcaaaaaacgtcgaatacgcgacgaatcttaaaaccgaactctctctccgactcgccttaccctcgaataattatttaactccgctcataaccctaccttcctcgaaaaaaccatcgatatcgcgtacgtataaaatatctacaaacataactacgtaaaaaaaattccaatcgctactcctacttctcgaactactaatactatacgcgaaactcctcactacaacgaaaaataaaacgaacttactcctaaccgaaaaaacgataaaaccctcgaaaaccccgtatacgaacgcgaatatacgttttaaaaaccgcaaaatacgaaataaccgcctctacccgacgctactccatcgccgaaactcgaaaaacgcgatacacgaaaaaaaacttccatcgcgctctccccaaccctcctaaacccccgccccaccccgccattccttccccctctcttaaactcac

SEQ ID NO: 14709 - DNA, 874 bp, Artificial Sequence
  chemically treated genomic DNA (Homo sapiens) CpG-island No: 14709
ggggcgtgtgttcgttttcgttttttttcggcggtattaggtttatggggggcgtgtgttcgttttcgttttttttcggtcgtattaggtttatggggggcgtgtgttcgttttcgttttttttcggcggtattaggtcgatggggggtatgtgttcgttttcgttttttttcggcggtattaggtcgatggggggcgtgtgttcgttttcgttttttttcggcggtattaggtttatggggggcgtgtgttcgttttcgttttttttcggcggtattaggtcgatggggggcgtgtgttcgttttcgttttttttcggcggtattaggtcgatggggggcgtgtgttcgttttcgttttttttcggcggtattaggtcgatggggggcgtgtgttcgttttcgttttttttcggtcgtattaggtttatggggggcgtgtgttcgttttcgtttttttttggcggtattaggtcgatggggggcgtgtgttcgttttcgttttttttcggcggtattaggttgatggggggcgtgtgttcgttttcgttttttttcggtcgtattaggttgatggggggcgtgtgttcgttttcgtttttttcgggtcgtattaggtttatggggggcgtgtgttcgttttcgttttttttcggttatattaggttgatggggggcgtgtgttcgttttcgttttttttattgtttttcgcggtcgttggttgagattaggtggtagcgagttttttcgagaggaattgaaacgcgtgagtcgacgtgtgagttttagttatacgttgtttggcgtataggtttggacgcggtttttggtggtcgttttatttcgggtacgttatagggtgggttttttgagg

SEQ ID NO: 14710 - DNA, 874 bp, Artificial Sequence
  chemically treated genomic DNA (Homo sapiens) CpG-island No: 14710
cctcaaaaaacccaccctataacgtacccgaaataaaacgaccaccaaaaaccgcgtccaaacctatacgccaaacaacgtataactaaaactcacacgtcgactcacgcgtttcaattcctctcgaaaaaactcgctaccacctaatctcaaccaacgaccgcgaaaaacaataaaaaaaacgaaaacgaacacacgccccccatcaacctaatataaccgaaaaaaaacgaaaacgaacacacgccccccataaacctaatacgacccgaaaaaaacgaaaacgaacacacgccccccatcaacctaatacgaccgaaaaaaaacgaaaacgaacacacgccccccatcaacctaataccgccgaaaaaaaacgaaaacgaacacacgccccccatcgacctaataccgccaaaaaaaaacgaaaacgaacacacgccccccataaacctaatacgaccgaaaaaaaacgaaaacgaacacacgccccccatcgacctaataccgccgaaaaaaaacgaaaacgaacacacgccccccatcgacctaataccgccgaaaaaaaacgaaaacgaacacacgccccccatcgacctaataccgccgaaaaaaaacgaaaacgaacacacgccccccataaacctaataccgccgaaaaaaaacgaaaacgaacacacgccccccatcgacctaataccgccgaaaaaaaacgaaaacgaacacataccccccatcgacctaataccgccgaaaaaaaacgaaaacgaacacacgccccccataaacctaatacgaccgaaaaaaaacgaaaacgaacacacgccccccataaacctaataccgccgaaaaaaaacgaaaacgaacacacgcccc

SEQ ID NO: 14711 - DNA, 874 bp, Artificial Sequence
  chemically treated genomic DNA (Homo sapiens) CpG-island No: 14711
ttttagggagtttattttgtgacgtgttcgaggtgaggcggttattagaggtcgcgtttaaatttgtgcgttaggtagcgtgtggttgaggtttatacgtcgatttacgcgttttagtttttttcgagaaaattcgttgttatttggttttagttagcgatcgcgagggatagtgagaaaggcgagagcgggtatacgttttttattaatttggtgtggtcgggggaaggcgagagcgggtatacgttttttatgaatttggtacggttcggggaaggcgagagcgggtatacgttttttattaatttggtgcggtcgggggaaggcgagagcgggtatacgttttttattaatttggtatcgtcgggggaaggcgagagcgggtatacgttttttatcgatttggtatcgttaggggaaggcgagagcgggtatacgttttttatgaatttggtgcggtcgggggaaggcgagagcgggtatacgttttttatcgatttggtatcgtcgggggaaggcgagagcgggtatacgttttttatcgatttggtatcgtcgggggaaggcgagagcgggtatacgttttttatcgatttggtatcgtcgggggaaggcgagagcgggtatacgttttttatgaatttggtatcgtcgggggaaggcgagagcgggtatacgttttttatcgatttggtatcgtcgggggaaggcgagagcgggtatatgttttttatcgatttggtatcgtcgggggaaggcgagagcgggtatacgttttttatgaatttggtgcggtcgggggaaggcgagagcgggtatacgttttttatgaatttggtatcgtcgggggaaagcgagagcgggtatacgtttt

SEQ ID NO: 14712 - DNA, 874 bp, Artificial Sequence
  chemically treated genomic DNA (Homo sapiens) CpG-island No: 14712
aaaacgtatacccgctctcgctttcccccgacgataccaaattcataaaaaacgtatacccgctctcgccttcccccgaccgcaccaaattcataaaaaacgtatacccgctctcgccttcccccgacgataccaaatcgataaaaaacatatacccgctctcgccttcccccgacgataccaaatcgataaaaaacgtatacccgctctcgccttcccccgacgataccaaattcataaaaaacgtatacccgctctcgccttcccccgacgataccaaatcgataaaaaacgtatacccgctctcgccttcccccgacgataccaaatcgataaaaaacgtatacccgctctcgccttcccccgacgataccaaatcgataaaaaacgtatacccgctctcgccttcccccgaccgcaccaaattcataaaaaacgtatacccgctctcgccttcccctaacgataccaaatcgataaaaaacgtatacccgctctcgccttcccccgacgataccaaattaataaaaaacgtatacccgctctcgccttcccccgaccgcaccaaattaataaaaaacgtatacccgctctcgccttccccgaaccgtaccaaattcataaaaaacgtatacccgctctcgccttcccccgaccacaccaaattaataaaaaacgtatacccgctctcgcctttctcactatccctcgcgatcgctaactaaaaccaaataacaacgaattttctcgaaaaaaactaaaacgcgtaaatcgacgtataaacctcaaccacacgctacctaacgcacaaatttaaacgcgacctctaataaccgcctcacctcgaacacgtcacaaaataaactccctaaaa

SEQ ID NO: 14713 - DNA, 512 bp, Artificial Sequence
  chemically treated genomic DNA (Homo sapiens) CpG-island No: 14713
ttcggagtagtttcggtttaggaggggcgggcgaggggttcgtttatagtttagattgcggcggatacgtttcggtcgtttcgtttatttgttcgttgttttaatgatatggagattttaaatttaagtgtttttgagggattgaaagggtcgatcgtggtagaggtcgtgcggcggtttaggggatacggggaggcgttcgtggtagattagtttcgcgtcgagggacggtcgttgtttttacgaggttggaggaggggtgtttattttagcggtatagattcgcgggtatcgtagtaggtttcgagcgttttcgtttcggaagatataggttttataaacgtttttagcgcgcgagcgcgtggtacggggcggttttcgttgacgcgtaatttatcgcgagttcgtttttagcggagtttttttacggtttttttttacgatgcggaatgcgtggagattatattagaaaaggagttatacggagttttgtggtatttttttaaatttat

SEQ ID NO: 14714 - DNA, 512 bp, Artificial Sequence
  chemically treated genomic DNA (Homo sapiens) CpG-island No: 14714
ataaatttaaaaaaataccacaaaactccgtataactccttttctaatataatctccacgcattccgcatcgtaaaaaaaaaccgtaaaaaaactccgctaaaaacgaactcgcgataaattacgcgtcaacgaaaaccgccccgtaccacgcgctcgcgcgctaaaaacgtttataaaacctatatcttccgaaacgaaaacgctcgaaacctactacgatacccgcgaatctataccgctaaaataaacacccctcctccaacctcgtaaaaacaacgaccgtccctcgacgcgaaactaatctaccacgaacgcctccccgtatcccctaaaccgccgcacgacctctaccacgatcgaccctttcaatccctcaaaaacacttaaatttaaaatctccatatcattaaaacaacgaacaaataaacgaaacgaccgaaacgtatccgccgcaatctaaactataaacgaacccctcgcccgcccctcctaaaccgaaactactccgaa

SEQ ID NO: 14715 - DNA, 512 bp, Artificial Sequence
  chemically treated genomic DNA (Homo sapiens) CpG-island No: 14715
gtagatttgaaaaaatgttatagagtttcgtgtggttttttttttaatgtgatttttacgtatttcgtatcgtggagaagggtcgtgaggaggtttcgttgggggcggattcgcggtggattacgcgttagcgagggtcgtttcgtgttacgcgttcgcgcgttgagagcgtttgtggggtttgtgtttttcgaaacggaggcgttcggggtttgttgcggtgttcgcgggtttgtgtcgttgaagtgggtattttttttttagtttcgtgaggatagcggtcgtttttcggcgcggggttggtttgttacgggcgttttttcgtgttttttgggtcgtcgtacggtttttgttacggtcggtttttttagttttttagaagtatttgggtttaaagtttttatgttattaaaataacgagtaggtagacgaggcggtcggagcgtgttcgtcgtagtttgggttgtgaacgggtttttcgttcgttttttttgagtcggagttgtttcgga

SEQ ID NO: 14716 - DNA, 512 bp, Artificial Sequence
  chemically treated genomic DNA (Homo sapiens) CpG-island No: 14716
tccgaaacaactccgactcaaaaaaaacgaacgaaaaacccgttcacaacccaaactacgacgaacacgctccgaccgcctcgtctacctactcgttattttaataacataaaaactttaaacccaaatacttctaaaaaactaaaaaaaccgaccgtaacaaaaaccgtacgacgacccaaaaaacacgaaaaaacgcccgtaacaaaccaaccccgcgccgaaaaacgaccgctatcctcacgaaactaaaaaaaaaatacccacttcaacgacacaaacccgcgaacaccgcaacaaaccccgaacgcctccgtttcgaaaaacacaaaccccacaaacgctctcaacgcgcgaacgcgtaacacgaaacgaccctcgctaacgcgtaatccaccgcgaatccgcccccaacgaaacctcctcacgacccttctccacgatacgaaatacgtaaaaatcacattaaaaaaaaaaccacacgaaactctataacattttttcaaatctac

SEQ ID NO: 14717 - DNA, 667 bp, Artificial Sequence
  chemically treated genomic DNA (Homo sapiens) CpG-island No: 14717
ggaagcgtgtttttacgtttattgtcgatattgtaaatttgagggaagcgtgttttcgcgtttattgtcgacgttgcgagggaagcgtttttatatttattgtcgacgtaaatttgagggaagcgtgtttttacgttcgttgttaacgtaaatttgagggaagcgtgtttttacgtttattgtcgacgttgtaaatttgagggaagcgtgtttttacgttcgttgtcgacgtaaatttgagggaagcgtgtttttacgttcgttgtcgacgtaaatttgagggaagcgtgtttttatgtttattgtcgacgttgtaaatttgagggaagcgtgttttcgcgtttattgtcgacgtaaatttgagggaagcgtgtttttacgtttattgtcgatattgtaaatttgagggaagcgtgttttcgcgtttattgtcgacgttgtaaatttgagggaagcgtgtttttacgtttatcgtcgacgtaaatttgagggaagcgtgtttttttattgttaattttgtaagggaagcgtgttttcgcgtttattgtcgacgttgtaaatttgagggaagcgtgtttttatatttattgtcgacgttgtaagggaagcgtgtttttatatttattgtcgatattgtgagggaagtgtatttttacgttgtcgatat

SEQ ID NO: 14718 - DNA, 667 bp, Artificial Sequence
  chemically treated genomic DNA (Homo sapiens) CpG-island No: 14718
atatcgacaacgtaaaaatacacttccctcacaatatcgacaataaatataaaaacacgcttcccttacaacgtcgacaataaatataaaaacacgcttccctcaaatttacaacgtcgacaataaacgcgaaaacacgcttcccttacaaaattaacaataaaaaaacacgcttccctcaaatttacgtcgacgataaacgtaaaaacacgcttccctcaaatttacaacgtcgacaataaacgcgaaaacacgcttccctcaaatttacaatatcgacaataaacgtaaaaacacgcttccctcaaatttacgtcgacaataaacgcgaaaacacgcttccctcaaatttacaacgtcgacaataaacataaaaacacgcttccctcaaatttacgtcgacaacgaacgtaaaaacacgcttccctcaaatttacgtcgacaacgaacgtaaaaacacgcttccctcaaatttacaacgtcgacaataaacgtaaaaacacgcttccctcaaatttacgttaacaacgaacgtaaaaacacgcttccctcaaatttacgtcgacaataaatataaaaacgcttccctcgcaacgtcgacaataaacgcgaaaacacgcttccctcaaatttacaatatcgacaataaacgtaaaaacacgcttcc

SEQ ID NO: 14719 - DNA, 667 bp, Artificial Sequence
  chemically treated genomic DNA (Homo sapiens) CpG-island No: 14719
atgtcgatagcgtgagaatatattttttttataatgtcgatagtgagtgtgagaatacgttttttttgtaacgtcgatagtgagtgtgagaatacgttttttttaggtttataacgtcgatagtgagcgcgagaatacgttttttttgtaaagttgatagtgagagaatacgttttttttaggtttacgtcgacggtgagcgtgagaatacgttttttttaggtttataacgtcgatagtgagcgcgagaatacgttttttttaggtttataatgtcgatagtgagcgtgagaatacgttttttttaggtttacgtcgatagtgagcgcgagaatacgttttttttaggtttataacgtcgatagtgagtatgagaatacgttttttttaggtttacgtcgatagcgagcgtgagaatacgttttttttaggtttacgtcgatagcgagcgtgagaatacgttttttttaggtttataacgtcgatagtgagcgtgagaatacgttttttttaggtttacgttgatagcgagcgtgagaatacgttttttttaggtttacgtcgatagtgagtgtgaaaacgtttttttcgtaacgtcgatagtgagcgcgagaatacgttttttttaggtttataatgtcgatagtgagcgtgagaatacgttttt

SEQ ID NO: 14720 - DNA, 667 bp, Artificial Sequence
  chemically treated genomic DNA (Homo sapiens) CpG-island No: 14720
aaaaacgtattctcacgctcactatcgacattataaacctaaaaaaaacgtattctcgcgctcactatcgacgttacgaaaaaaacgttttcacactcactatcgacgtaaacctaaaaaaaacgtattctcacgctcgctatcaacgtaaacctaaaaaaaacgtattctcacgctcactatcgacgttataaacctaaaaaaaacgtattctcacgctcgctatcgacgtaaacctaaaaaaaacgtattctcacgctcgctatcgacgtaaacctaaaaaaaacgtattctcatactcactatcgacgttataaacctaaaaaaaacgtattctcgcgctcactatcgacgtaaacctaaaaaaaacgtattctcacgctcactatcgacattataaacctaaaaaaaacgtattctcgcgctcactatcgacgttataaacctaaaaaaaacgtattctcacgctcaccgtcgacgtaaacctaaaaaaaacgtattctctcactatcaactttacaaaaaaaacgtattctcgcgctcactatcgacgttataaacctaaaaaaaacgtattctcacactcactatcgacgttacaaaaaaaacgtattctcacactcactatcgacattataaaaaaaatatattctcacgctatcgacat

SEQ ID NO: 14721 - DNA, 978 bp, Artificial Sequence
  chemically treated genomic DNA (Homo sapiens) CpG-island No: 14721
ggaagcgtgtttttacgtttattgtcgatattgtaaatttgagggaagcgtgtttttacgtttattgtcgacgttgcgagggaagcgtttttatattgtcgacgtaaatttgagggaagcgtgtttttacgttcgttgttaacgtaaatttgagggaagcgtgtttttacgtttattgtcgacgttgtaaatttgagggaagcgtgtttttacgttcgttgttaacgtaaatttgagggaagcgtgtttttacgtttattgtcgacgtaaatttgagggaagcgtgtttttacgttcgttgtcgacgtaaatttgagggaagcgtgtttttacgtttattgtcgacgttgtaaatttgagggaagtgtgtttttatatttattcgacgtgagggaagcgtgtttttacgtttattgtcgatattgtaaatttgagggaagtatgtttttatatttattgtcgacgttgtaaatttgagggaagcgtgtttttacgtttatcgtcgacgttgtaaatttgagggaagtgtgtttttacgtttatcgtcgacgttgtaaatttgagggaagcgtgtttttacgtttattgttaacgttgtaaatttgagggaagcgtgtttttacgtttattgttaacgttgtgagggaagggtgtttttacgtttattgtcgacgttgcgagggaagcgtgtttttacgtttatcgtcgacgttgtaaattcgagggaagcgtgtttttacgtttattgttaacgttgtgagggaagggtgtttttacgtttattgtcgacgttgcgatggaagcgtgtttttatgtttatcgtcgatattgtaaatttgagtgaagtgtgtttttacgtttattgtcgacgttgcgagggaagcgtgtttttatgtttattgtcgacgttgtgagggaagcgtgtttttacgtttattgttaacgttgtaaatttgagggaaaggaatttttttttat

SEQ ID NO: 14722 - DNA, 978 bp, Artificial Sequence
  chemically treated genomic DNA (Homo sapiens) CpG-island No: 14722
ataaaaaaaaattcctttccctcaaatttacaacgttaacaataaacgtaaaaacacgcttccctcacaacgtcgacaataaacataaaaacacgcttccctcgcaacgtcgacaataaacgtaaaaacacacttcactcaaatttacaatatcgacgataaacataaaaacacgcttccatcgcaacgtcgacaataaacgtaaaaacacccttccctcacaacgttaacaataaacgtaaaaacacgcttccctcgaatttacaacgtcgacgataaacgtaaaaacacgcttccctcgcaacgtcgacaataaacgtaaaaacacccttccctcacaacgttaacaataaacgtaaaaacacgcttccctcaaatttacaacgttaacaataaacgtaaaaacacgcttccctcaaatttacaacgtcgacgataaacgtaaaaacacacttccctcaaatttacaacgtcgacgataaacgtaaaaacacgcttccctcaaatttacaacgtcgacaataaatataaaaacatacttccctcaaatttacaatatcgacaataaacgtaaaaacacgcttccctcacgtcgaataaatataaaaacacacttccctcaaatttacaacgtcgacaataaacgtaaaaacacgcttccctcaaatttacgtcgacaacgaacgtaaaaacacgcttccctcaaatttacgtcgacaataaacgtaaaaacacgcttccctcaaatttacgttaacaacgaacgtaaaaacacgcttccctcaaatttacaacgtcgacaataaacgtaaaaacacgcttccctcaaatttacgttaacaacgaacgtaaaaacacgcttccctcaaatttacgtcgacaatataaaaacgcttccctcgcaacgtcgacaataaacgtaaaaacacgcttccctcaaatttacaatatcgacaataaacgtaaaaacacgcttcc

SEQ ID NO: 14723 - DNA, 978 bp, Artificial Sequence
  chemically treated genomic DNA (Homo sapiens) CpG-island No: 14723
gtgagagagaattttttttttttaggtttataacgttgatagtgagcgtgagaatacgttttttttataacgtcgatagtgagtatgagaatacgtttttttcgtaacgtcgatagtgagcgtgagaatatattttatttaggtttatagtgtcgacggtgagtatgagaatacgtttttatcgtaacgtcgatagtgagcgtgaaaatattttttttttataacgttgatagtgagcgtgagaatacgtttttttcgggtttataacgtcgacggtgagcgtgagaatacgtttttttcgtaacgtcgatagtgagcgtgaaaatattttttttttataacgttgatagtgaacgtgagaatacgttttttttaggtttataacgttgatagtgagcgtgagaatacgttttttttaggtttataacgtcgacggtgagcgtgagaatatattttttttaggtttataacgtcgacggtgagcgtgagaatacgttttttttaggtttataacgtcgatagtgagtgtgagaatatgttttttttaggtttataatgtcgatagtgagcgtgagaatacgttttttttacgtcgagtgagtgtgagaatatattttttttaggtttataacgtcgatagtgagcgtgagaatacgttttttttaggtttacgtcgatagcgagcgtgagaatacgttttttttaggtttacgtcgatagtgagcgtgagaatacgttttttttaggtttacgttgatagcgagcgtgagaatacgttttttttaggtttataacgtcgatagtgagcgtgagaatacgttttttttaggtttacgttgatagcgagcgtgagaatacgttttttttaggtttacgtcgatagtgtgaaaacgtttttttcgtaacgtcgatagtgagcgtgagaatacgttttttttaggtttataatgtcgatagtgagcgtgagaatacgttttt

SEQ ID NO: 14724 - DNA, 978 bp, Artificial Sequence
  chemically treated genomic DNA (Homo sapiens) CpG-island No: 14724
aaaaacgtattctcacgctcactatcgacattataaacctaaaaaaaacgtattctcacgctcactatcgacgttacgaaaaaaacgttttcacactatcgacgtaaacctaaaaaaaacgtattctcacgctcgctatcaacgtaaacctaaaaaaaacgtattctcacgctcactatcgacgttataaacctaaaaaaaacgtattctcacgctcgctatcaacgtaaacctaaaaaaaacgtattctcacgctcactatcgacgtaaacctaaaaaaaacgtattctcacgctcgctatcgacgtaaacctaaaaaaaacgtattctcacgctcactatcgacgttataaacctaaaaaaaatatattctcacactcactcgacgtaaaaaaaacgtattctcacgctcactatcgacattataaacctaaaaaaaacatattctcacactcactatcgacgttataaacctaaaaaaaacgtattctcacgctcaccgtcgacgttataaacctaaaaaaaatatattctcacgctcaccgtcgacgttataaacctaaaaaaaacgtattctcacgctcactatcaacgttataaacctaaaaaaaacgtattctcacgttcactatcaacgttataaaaaaaaaatattttcacgctcactatcgacgttacgaaaaaaacgtattctcacgctcaccgtcgacgttataaacccgaaaaaaacgtattctcacgctcactatcaacgttataaaaaaaaaatattttcacgctcactatcgacgttacgataaaaacgtattctcatactcaccgtcgacactataaacctaaataaaatatattctcacgctcactatcgacgttacgaaaaaaacgtattctcatactcactatcgacgttataaaaaaaacgtattctcacgctcactatcaacgttataaacctaaaaaaaaaaaattctctctcac

SEQ ID NO: 14725 - DNA, 713 bp, Artificial Sequence
  chemically treated genomic DNA (Homo sapiens) CpG-island No: 14725
ggttttcgagaaggtcgggaggaagtagttttttcggtcgcgtggaggatagttagtgagttaggtcgtcggtagggtagcgagttgttagttaggtgaaacggtcgaggtttcgttgttttcgtcggtttcgtttttttcggtgagaggcggcgcggcgttttgggtttatttggttggggcgttttgcgggcgcggggttcggtcgtttatcgttttgcggggcgttgcgcgggttttagtttttaggcggcgcgttattgttggggtgggagaggtcggcgggttagggcgggacgcgcgttttttcgaggtcggagcgaagttggttgagcgttaagagttcgttcgagtcgttttagtttcggtcggttcgtttttcgggtgcgtttttatttgcgggtttcggtttttagttcgcgggcgtcgtcgtcgtttttataaggtttagcgggcgtttagagtacggcggaggaggcggtggcgttgtagttttcgtttcgtggggtttattgggtagttatttggcgtttttcggagggagaggagtcgtcggggttggaaaaggaggaggagcggggtcgggcgtacgggtatcgttgttacgtcggtagcgtatttttaggttttttcggtcgagtttgtataaataaaacgttttaggaaaatttttttcgaagagaagttgggagggttgatttttttttttttat

SEQ ID NO: 14726 - DNA, 713 bp, Artificial Sequence
  chemically treated genomic DNA (Homo sapiens) CpG-island No: 14726
ataaaaaaaaaaaaatcaaccctcccaacttctcttcgaaaaaaattttcctaaaacgttttatttatacaaactcgaccgaaaaaacctaaaaatacgctaccgacgtaacaacgatacccgtacgcccgaccccgctcctcctccttttccaaccccgacgactcctctccctccgaaaaacgccaaataactacccaataaaccccacgaaacgaaaactacaacgccaccgcctcctccgccgtactctaaacgcccgctaaaccttataaaaacgacgacgacgcccgcgaactaaaaaccgaaacccgcaaataaaaacgcacccgaaaaacgaaccgaccgaaactaaaacgactcgaacgaactcttaacgctcaaccaacttcgctccgacctcgaaaaaacgcgcgtcccgccctaacccgccgacctctcccaccccaacaataacgcgccgcctaaaaactaaaacccgcgcaacgccccgcaaaacgataaacgaccgaaccccgcgcccgcaaaacgccccaaccaaataaacccaaaacgccgcgccgcctctcaccgaaaaaaacgaaaccgacgaaaacaacgaaacctcgaccgtttcacctaactaacaactcgctaccctaccgacgacctaactcactaactatcctccacgcgaccgaaaaaactacttcctcccgaccttctcgaaaacc

SEQ ID NO: 14727 - DNA, 713 bp, Artificial Sequence
  chemically treated genomic DNA (Homo sapiens) CpG-island No: 14727
gtgggaaaagagagattagtttttttaattttttttcgggaaaagtttttttagggcgttttgtttgtgtaaattcggtcggaggagtttgggagtgcgttgtcggcgtggtagcggtgttcgtgcgttcggtttcgttttttttttttttttagtttcggcggttttttttttttcgagaggcgttaaatggttatttagtaaattttacggggcgggggttgtagcgttatcgtttttttcgtcgtgttttgggcgttcgttagattttgtagagacggcggcggcgttcgcgggttgggagtcggggttcgtaggtggaagcgtattcgggaggcgggtcggtcggggttggagcggttcgggcgggtttttgacgtttagttagtttcgtttcggtttcgggaaggcgcgcgtttcgttttgattcgtcggttttttttattttagtagtgacgcgtcgtttgggagttggagttcgcgtagcgtttcgtagggcgatggacggtcgaatttcgcgttcgtaggacgttttagttaggtaagtttagagcgtcgcgtcgttttttatcggggagggcgaggtcggcgaggatagcgaggtttcggtcgttttatttggttggtaattcgttgttttgtcggcggtttgatttattgattgttttttacgcggtcggggaggttgttttttttcggttttttcggaggtt

SEQ ID NO: 14728 - DNA, 713 bp, Artificial Sequence
  chemically treated genomic DNA (Homo sapiens) CpG-island No: 14728
aacctccgaaaaaaccgaaaaaaaacaacctccccgaccgcgtaaaaaacaatcaataaatcaaaccgccgacaaaacaacgaattaccaaccaaataaaacgaccgaaacctcgctatcctcgccgacctcgccctccccgataaaaaacgacgcgacgctctaaacttacctaactaaaacgtcctacgaacgcgaaattcgaccgtccatcgccctacgaaacgctacgcgaactccaactcccaaacgacgcgtcactactaaaataaaaaaaaccgacgaatcaaaacgaaacgcgcgccttcccgaaaccgaaacgaaactaactaaacgtcaaaaacccgcccgaaccgctccaaccccgaccgacccgcctcccgaatacgcttccacctacgaaccccgactcccaacccgcgaacgccgccgccgtctctacaaaatctaacgaacgcccaaaacacgacgaaaaaaacgataacgctacaacccccgccccgtaaaatttactaaataaccatttaacgcctctcgaaaaaaaaaaaaccgccgaaactaaaaaaaaaaaaaaaacgaaaccgaacgcacgaacaccgctaccacgccgacaacgcactcccaaactcctccgaccgaatttacacaaacaaaacgccctaaaaaaacttttcccgaaaaaaaattaaaaaaactaatctctcttttcccac

SEQ ID NO: 14729 - DNA, 752 bp, Artificial Sequence
  chemically treated genomic DNA (Homo sapiens) CpG-island No: 14729
cgtgggaacgagaagatatttatggaggagtcggtagagtaggtatagcggcgcgacgagatgttgttttttagagttgttgtttaatttgtattcgcgtgggaattagaagatattcgtggaggagtcggtagagtaggtatagcggcgcgacgagattcgcgtgggaagaaatagatatttttggaggagtcggtagagtaggtatagcggcgcgacgagattcgcgtgggaacgagaagatatttttggaggcgtcggtagagtaggtagattaaggagtttattttttcggagttgttgtttaatttgtattcgcgtgggaacgagaagatattcgtggaggagtcggtagagtaggtatagcggcgcgacgagatgttgttttttagagttgttgtttaatttgtattcgcgtgggaacgagaagatattcgtggaggagtcggtagagtaggtatagcggcgcgacgagatgttgttttttagagttgttgtttaatttgtattcgtttgggaattagaagatattcgtggaggagtcggtagagtaggtatagcggcgcgacgagattcgcgtgggaagaaatagatatttttggaggagtcggtagagtaggtatagcggcgcgacgagattcgcgtgggaacgagaagatattcgtggaggagtcggtagagtaggtagattaaggagtttattttttcggagttgttgtttaatttgtattcgcgtagggataagaagatat

SEQ ID NO: 14730 - DNA, 752 bp, Artificial Sequence
  chemically treated genomic DNA (Homo sapiens) CpG-island No: 14730
atatcttcttatccctacgcgaatacaaattaaacaacaactccgaaaaaataaactccttaatctacctactctaccgactcctccacgaatatcttctcgttcccacgcgaatctcgtcgcgccgctatacctactctaccgactcctccaaaaatatctatttcttcccacgcgaatctcgtcgcgccgctatacctactctaccgactcctccacgaatatcttctaattcccaaacgaatacaaattaaacaacaactctaaaaaacaacatctcgtcgcgccgctatacctactctaccgactcctccacgaatatcttctcgttcccacgcgaatacaaattaaacaacaactctaaaaaacaacatctcgtcgcgccgctatacctactctaccgactcctccacgaatatcttctcgttcccacgcgaatacaaattaaacaacaactccgaaaaaataaactccttaatctacctactctaccgacgcctccaaaaatatcttctcgttcccacgcgaatctcgtcgcgccgctatacctactctaccgactcctccaaaaatatctatttcttcccacgcgaatctcgtcgcgccgctatacctactctaccgactcctccacgaatatcttctaattcccacgcgaatacaaattaaacaacaactctaaaaaacaacatctcgtcgcgccgctatacctactctaccgactcctccataaatatcttctcgttcccacg

SEQ ID NO: 14731 - DNA, 752 bp, Artificial Sequence
  chemically treated genomic DNA (Homo sapiens) CpG-island No: 14731
gtgtttttttgtttttacgcgagtgtaggttggatagtagtttcgagaagatgaattttttggtttgtttgttttgtcgatttttttacgagtgttttttcgtttttacgcgagtttcgtcgcgtcgttgtgtttgttttgtcgatttttttaggagtgtttatttttttttacgcgagtttcgtcgcgtcgttgtgtttgttttgtcgatttttttacgagtgttttttggtttttaagcgagtgtaggttggatagtagttttgagaagtagtatttcgtcgcgtcgttgtgtttgttttgtcgatttttttacgagtgttttttcgtttttacgcgagtgtaggttggatagtagttttgagaagtagtatttcgtcgcgtcgttgtgtttattttgtcgatttttttacgagtgttttttcgtttttacgcgagtgtaggttggatagtagtttcgagaagatgaattttttggtttgtttgttttgtcgacgtttttaggagtgttttttcgtttttacgcgagtttcgtcgcgtcgttgtgtttgttttgtcgatttttttaggagtgtttatttttttttacgcgagtttcgtcgcgtcgttgtgtttgttttgtcgatttttttacgagtgttttttggtttttacgcgagtgtaggttggatagtagttttgagaagtagtatttcgtcgcgtcgttgtgtttattttgtcgatttttttatgagtgttttttcgtttttacg

SEQ ID NO: 14732 - DNA, 752 bp, Artificial Sequence
  chemically treated genomic DNA (Homo sapiens) CpG-island No: 14732
cgtaaaaacgaaaaaacactcataaaaaaatcgacaaaataaacacaacgacgcgacgaaatactacttctcaaaactactatccaacctacactcgcgtaaaaaccaaaaaacactcgtaaaaaaatcgacaaaacaaacacaacgacgcgacgaaactcgcgtaaaaaaaaataaacactcctaaaaaaatcgacaaaacaaacacaacgacgcgacgaaactcgcgtaaaaacgaaaaaacactcctaaaaacgtcgacaaaacaaacaaaccaaaaaattcatcttctcgaaactactatccaacctacactcgcgtaaaaacgaaaaaacactcgtaaaaaaatcgacaaaataaacacaacgacgcgacgaaatactacttctcaaaactactatccaacctacactcgcgtaaaaacgaaaaaacactcgtaaaaaaatcgacaaaacaaacacaacgacgcgacgaaatactacttctcaaaactactatccaacctacactcgcttaaaaaccaaaaaacactcgtaaaaaaatcgacaaaacaaacacaacgacgcgacgaaactcgcgtaaaaaaaaataaacactcctaaaaaaatcgacaaaacaaacacaacgacgcgacgaaactcgcgtaaaaacgaaaaaacactcgtaaaaaaatcgacaaaacaaacaaaccaaaaaattcatcttctcgaaactactatccaacctacactcgcgtaaaaacaaaaaaacac

SEQ ID NO: 14733 - DNA, 571 bp, Artificial Sequence
  chemically treated genomic DNA (Homo sapiens) CpG-island No: 14733
  misc_feature (203)..(203): n is either a, c, g or t
cgtcgcgtattttttaggttagttttacgcgtggttattttttagggagattcgttcgtcggcgtttcgcggttatcgcgggggaatggcgtttagtttcgggttaatgagagtagcggaattttttttatttagcgcggggttaggtttttgttcggaaaggggcggggcgtcgcgtcgggggtggggtcgtcgcgcgcggngggagagggcggggtcggtttttttgtttggttaatcggcgtcgcgttcggggggggagagggggggtttaggttttttttttttttcgcgcggggattaatttcgattttataagtttgaatttttgttattttcggattagcgagcgcgttcgaggaggtatttcgtcgcgtcggttttaggggtaggagcggttttaatttttttcgcgtcgggcgttaggttgttgtcgtcgcgttttcgatttcgtttttaatttatttttattttcgcgtggaaatttttttagggaaagcgtgattttttatttatagtttttttcgaggtgcggagagtaaatttgagaagggagaggaagtattcggtt

SEQ ID NO: 14734 - DNA, 571 bp, Artificial Sequence
  chemically treated genomic DNA (Homo sapiens) CpG-island No: 14734
  misc_feature (369)..(369): n is either a, c, g or t
aaccgaatacttcctctcccttctcaaatttactctccgcacctcgaaaaaaactataaataaaaaatcacgctttccctaaaaaaatttccacgcgaaaataaaaataaattaaaaacgaaatcgaaaacgcgacgacaacaacctaacgcccgacgcgaaaaaaattaaaaccgctcctacccctaaaaccgacgcgacgaaatacctcctcgaacgcgctcgctaatccgaaaataacaaaaattcaaacttataaaatcgaaattaatccccgcgcgaaaaaaaaaaaaaacctaaaccccccctctccccccccgaacgcgacgccgattaaccaaacaaaaaaaccgaccccgccctctcccnccgcgcgcgacgaccccacccccgacgcgacgccccgcccctttccgaacaaaaacctaaccccgcgctaaataaaaaaaattccgctactctcattaacccgaaactaaacgccattcccccgcgataaccgcgaaacgccgacgaacgaatctccctaaaaaataaccacgcgtaaaactaacctaaaaaatacgcgacg

SEQ ID NO: 14735 - DNA, 571 bp, Artificial Sequence
  chemically treated genomic DNA (Homo sapiens) CpG-island No: 14735
  misc_feature (369)..(369): n is either a, c, g or t
ggtcgggtgttttttttttttttttaagtttatttttcgtatttcggagagggttgtaggtgagggattacgttttttttagagaggtttttacgcgaaaatgggggtgggttgggggcgggatcgggggcgcggcggtagtagtttgacgttcggcgcgggaagggttaaagtcgtttttgtttttggagtcggcgcggcggggtattttttcgggcgcgttcgttagttcgagggtggtaaaagtttaagtttgtaaagtcgggattggttttcgcgcggaggggaaaaaaggtttgggtttttttttttttttttcgggcgcggcgtcgattggttaggtagaggggtcggtttcgtttttttttntcgcgcgcggcggttttattttcggcgcggcgtttcgttttttttcgggtaggagtttggtttcgcgttgaatgaaagaaatttcgttatttttattggttcggggttgggcgttattttttcgcggtgatcgcggggcgtcggcgggcgggtttttttggagagtgattacgcgtggagttagtttggggagtgcgcggcg

SEQ ID NO: 14736 - DNA, 571 bp, Artificial Sequence
  chemically treated genomic DNA (Homo sapiens) CpG-island No: 14736
  misc_feature (203)..(203): n is either a, c, g or t
cgccgcgcactccccaaactaactccacgcgtaatcactctccaaaaaaacccgcccgccgacgccccgcgatcaccgcgaaaaaataacgcccaaccccgaaccaataaaaataacgaaatttctttcattcaacgcgaaaccaaactcctacccgaaaaaaaacgaaacgccgcgccgaaaataaaaccgccgcgcgcganaaaaaaaaacgaaaccgacccctctacctaaccaatcgacgccgcgcccgaaaaaaaaaaaaaaaaacccaaaccttttttcccctccgcgcgaaaaccaatcccgactttacaaacttaaacttttaccaccctcgaactaacgaacgcgcccgaaaaaataccccgccgcgccgactccaaaaacaaaaacgactttaacccttcccgcgccgaacgtcaaactactaccgccgcgcccccgatcccgcccccaacccacccccattttcgcgtaaaaacctctctaaaaaaaacgtaatccctcacctacaaccctctccgaaatacgaaaaataaacttaaaaaaaaaaaaaaaacacccgacc

SEQ ID NO: 14737 - DNA, 706 bp, Artificial Sequence
  chemically treated genomic DNA (Homo sapiens) CpG-island No: 14737
aaggttcgtcggtttatgtggggtttttttggcggcgcgtcgtttgtagtttttttaaagcgcgggggttggagttgttgagtagtttcgtcgttgtggtttatgtagtcgttggtcgcgcgcggattgcggttcggcgtgcgcgtgttttcggtcgtttcgtttcggcgagtttttttatgttgtcgttttgcggcgttttttcgacgataggttgtgcgcggtttgtacggcgtttcgcggcggagttttatgtggggttgcgattcgcgtagtcggcgtttcgttgagggaacggattttcggtaatcggagatcgttttttttttatttttggcgttaaaggatatcgtatgtttaggtttaaacgttcggggttggtgcggcgattttggcgaagtcgtgtggttttcgatcgggaggaaggcggtagcggcggcggcggtggcggcgacgaggatgggagtttgggtagtcgagttgagtcggtttcgcgggtaagagagggcggaggttgcggtcgtttcgaagttcgttcggtagtttcgcggcggtttcgggacgtagtgggatagcgaggcgtttagggcgcggggaggcgtcggcgcgtagggggtttttcgaggtttatgtcggagttaggggtcggcgttgggagttttttgttggacgtggcggagtcgggaggttcgggttggttgttcga

SEQ ID NO: 14738 - DNA, 706 bp, Artificial Sequence
  chemically treated genomic DNA (Homo sapiens) CpG-island No: 14738
tcgaacaaccaacccgaacctcccgactccgccacgtccaacaaaaaactcccaacgccgacccctaactccgacataaacctcgaaaaaccccctacgcgccgacgcctccccgcgccctaaacgcctcgctatcccactacgtcccgaaaccgccgcgaaactaccgaacgaacttcgaaacgaccgcaacctccgccctctcttacccgcgaaaccgactcaactcgactacccaaactcccatcctcgtcgccgccaccgccgccgccgctaccgccttcctcccgatcgaaaaccacacgacttcgccaaaatcgccgcaccaaccccgaacgtttaaacctaaacatacgatatcctttaacgccaaaaataaaaaaaaaacgatctccgattaccgaaaatccgttccctcaacgaaacgccgactacgcgaatcgcaaccccacataaaactccgccgcgaaacgccgtacaaaccgcgcacaacctatcgtcgaaaaaacgccgcaaaacgacaacataaaaaaactcgccgaaacgaaacgaccgaaaacacgcgcacgccgaaccgcaatccgcgcgcgaccaacgactacataaaccacaacgacgaaactactcaacaactccaacccccgcgctttaaaaaaactacaaacgacgcgccgccaaaaaaaccccacataaaccgacgaacctt

SEQ ID NO: 14739 - DNA, 706 bp, Artificial Sequence
  chemically treated genomic DNA (Homo sapiens) CpG-island No: 14739
tcgggtagttagttcgggtttttcggtttcgttacgtttagtagggagtttttagcgtcggtttttggtttcgatatgggtttcggggggttttttgcgcgtcggcgttttttcgcgttttgggcgtttcgttgttttattgcgtttcggggtcgtcgcggggttatcgggcggatttcggagcggtcgtagttttcgtttttttttgttcgcggggtcggtttagttcggttgtttaagtttttattttcgtcgtcgttatcgtcgtcgtcgttgtcgtttttttttcggtcggggattatacgatttcgttaaagtcgtcgtattagtttcgagcgtttggatttgaatatacgatattttttggcgttaggggtgggggggaggcggttttcggttatcgggggttcgtttttttagcgaggcgtcggttgcgcgggtcgtagttttatatgaagtttcgtcgcggagcgtcgtgtagatcgcgtatagtttgtcgtcgaaggggcgtcgtagggcgataatatgagggagttcgtcgaggcgggacggtcgggaatacgcgtacgtcgagtcgtagttcgcgcgcggttagcggttatatggattatagcggcggggttgtttaataattttagttttcgcgttttaggggggttgtaggcggcgcgtcgttagaaagattttatatgggtcggcgagtttt

SEQ ID NO: 14740 - DNA, 706 bp, Artificial Sequence
  chemically treated genomic DNA (Homo sapiens) CpG-island No: 14740
aaaactcgccgacccatataaaatctttctaacgacgcgccgcctacaacccccctaaaacgcgaaaactaaaattattaaacaaccccgccgctataatccatataaccgctaaccgcgcgcgaactacgactcgacgtacgcgtattcccgaccgtcccgcctcgacgaactccctcatattatcgccctacgacgccccttcgacgacaaactatacgcgatctacacgacgctccgcgacgaaacttcatataaaactacgacccgcgcaaccgacgcctcgctaaaaaaacgaacccccgataaccgaaaaccgcctcccccccacccctaacgccaaaaaatatcgtatattcaaatccaaacgctcgaaactaatacgacgactttaacgaaatcgtataatccccgaccgaaaaaaaaacgacaacgacgacgacgataacgacgacgaaaataaaaacttaaacaaccgaactaaaccgaccccgcgaacaaaaaaaaacgaaaactacgaccgctccgaaatccgcccgataaccccgcgacgaccccgaaacgcaataaaacaacgaaacgcccaaaacgcgaaaaaacgccgacgcgcaaaaaaccccccgaaacccatatcgaaaccaaaaaccgacgctaaaaactccctactaaacgtaacgaaaccgaaaaacccgaactaactacccga

SEQ ID NO: 14741 - DNA, 595 bp, Artificial Sequence
  chemically treated genomic DNA (Homo sapiens) CpG-island No: 14741
gtgattgcgagacggtgatttgttgttttttttcggagcgggacgtcgtcggcgcgtttcgggacgttagcgattttttggtcggggcggttttggagtcggcgggcggcgggcggagtcgcgaagcgcgttcgcggttgttgttgttggagtaggaatttaaaatcgttacgtattcgttgttgaagcggtttaaggagcgttcgttggatacgttgttggaggcggtggagtttcgcggcggcgtgtcgggcggttgcgtgttggtgtcgcgcgtcgattttcgtttgggcggttagttcgcgtcgtcgtagttgttgttcggtcgtttttttcgttggttcgatttgtagtacgtcgtggagttgaagtttttgtgcggttgttatagtttcgtcgtcgtcgtcgacggttttatcgtgtgttgtaatttttattattttagtcggttttgcgggttcggtgagcgcgttgcgtcggtcgggggggtttcgggttttcgtttttattttttttcgtgtttttttttttgtgatattgcgggtcggcgtagttgcgggtgttttttcgggtgtttttggagcgtgggagttat

SEQ ID NO: 14742 - DNA, 595 bp, Artificial Sequence
  chemically treated genomic DNA (Homo sapiens) CpG-island No: 14742
ataactcccacgctccaaaaacacccgaaaaaacacccgcaactacgccgacccgcaatatcacaaaaaaaaaaacacgaaaaaaaataaaaacgaaaacccgaaacccccccgaccgacgcaacgcgctcaccgaacccgcaaaaccgactaaaataataaaaattacaacacacgataaaaccgtcgacgacgacgacgaaactataacaaccgcacaaaaacttcaactccacgacgtactacaaatcgaaccaacgaaaaaaacgaccgaacaacaactacgacgacgcgaactaaccgcccaaacgaaaatcgacgcgcgacaccaacacgcaaccgcccgacacgccgccgcgaaactccaccgcctccaacaacgtatccaacgaacgctccttaaaccgcttcaacaacgaatacgtaacgattttaaattcctactccaacaacaacaaccgcgaacgcgcttcgcgactccgcccgccgcccgccgactccaaaaccgccccgaccaaaaaatcgctaacgtcccgaaacgcgccgacgacgtcccgctccgaaaaaaaacaacaaatcaccgtctcgcaatcac

SEQ ID NO: 14743 - DNA, 595 bp, Artificial Sequence
  chemically treated genomic DNA (Homo sapiens) CpG-island No: 14743
gtggtttttacgttttaagggtattcgggggagtattcgtagttgcgtcgattcgtagtgttatagagagaagggtacggaaggggatggggacggggattcggggttttttcggtcggcgtagcgcgtttatcgggttcgtagagtcggttgaagtggtaggggttgtagtatacggtagggtcgtcggcggcggcggcgaagttgtggtagtcgtataggggttttagttttacggcgtgttgtaggtcgggttagcgaaagaggcggtcgagtagtagttgcggcggcgcgggttggtcgtttaggcggaggtcggcgcgcggtattagtacgtagtcgttcggtacgtcgtcgcgggattttatcgtttttagtagcgtgtttagcgagcgttttttgagtcgttttagtagcgagtacgtgacggttttgagtttttgttttagtagtagtagtcgcgagcgcgtttcgcgatttcgttcgtcgttcgtcggttttagggtcgtttcggttagggggtcgttggcgtttcggggcgcgtcggcggcgtttcgtttcgaaaagagatagtaggttatcgtttcgtagttat

SEQ ID NO: 14744 - DNA, 595 bp, Artificial Sequence
  chemically treated genomic DNA (Homo sapiens) CpG-island No: 14744
ataactacgaaacgataacctactatctcttttcgaaacgaaacgccgccgacgcgccccgaaacgccaacgaccccctaaccgaaacgaccctaaaaccgacgaacgacgaacgaaatcgcgaaacgcgctcgcgactactactactaaaacaaaaactcaaaaccgtcacgtactcgctactaaaacgactcaaaaaacgctcgctaaacacgctactaaaaacgataaaatcccgcgacgacgtaccgaacgactacgtactaataccgcgcgccgacctccgcctaaacgaccaacccgcgccgccgcaactactactcgaccgcctctttcgctaacccgacctacaacacgccgtaaaactaaaacccctatacgactaccacaacttcgccgccgccgccgacgaccctaccgtatactacaacccctaccacttcaaccgactctacgaacccgataaacgcgctacgccgaccgaaaaaaccccgaatccccgtccccatccccttccgtacccttctctctataacactacgaatcgacgcaactacgaatactcccccgaatacccttaaaacgtaaaaaccac

SEQ ID NO: 14745 - DNA, 956 bp, Artificial Sequence
  chemically treated genomic DNA (Homo sapiens) CpG-island No: 14745
acgcggttttgtttttttatcggtgtaaaggggtattcggcgtttttagggttttgggcgtcggaaatacgtgtgtgtttatttacgtgtatatacgtgagtatatttatagtagtagggggcgttcgggtcggtagggggtagtatagattcggtttgtaattattcggcgtagtttcgagggaggagggcgtgttgtagtttcggcggtagcggcggcggcggcggcggcggcggttggaggtgtagttttttaggtgggaggcgggggttgcgggcgtaggaaaaggcgttttgggagcgggcgttcggcggggttttttcgggtttcgggcgcggcgcggcgagtgggagcgagcgcgttaggattacgtaggcgttttgtttcggttggttttcggtcggcgcgcggcgcgggagtagttcgtagttcgtttttcgcgttttcggtagttttttggtagttcgtagtcgttcgttcggagtagtttttcggtagttcgcgtaggtcgtcggttcgggagagcgcgcggcggcggcggcggcgggacggtttcgagcgcgttttttcgtttgcggttattcgtagtcggcgttggtcgggtcggcgcgtttcgtaggcggttagagcgcggtttcggtttcggcgcgggtttgtttcgggtcgtagttcgcgagaggcggcgcgggcggtcgagggtattgacggcgtcgcgggacgttttcgggcggcggcgtagcggtagcggtagcggtagcggtagcgtagggggcggaggtagggggcgtttttagttaggatgttgcggtttttgcgtcggatttttggtcgtcgttttatgtagcgttacgcgcggggcgcggcggggcgcggggtcgtcgggttggggaataagttattttgtttgtttagtgaaaaaggtggttttgggtttgttaattaatgatattttttt

SEQ ID NO: 14746 - DNA, 956 bp, Artificial Sequence
  chemically treated genomic DNA (Homo sapiens) CpG-island No: 14746
aaaaaaatatcattaattaacaaacccaaaaccacctttttcactaaacaaacaaaataacttattccccaacccgacgaccccgcgccccgccgcgccccgcgcgtaacgctacataaaacgacgaccaaaaatccgacgcaaaaaccgcaacatcctaactaaaaacgccccctacctccgccccctacgctaccgctaccgctaccgctaccgctacgccgccgcccgaaaacgtcccgcgacgccgtcaataccctcgaccgcccgcgccgcctctcgcgaactacgacccgaaacaaacccgcgccgaaaccgaaaccgcgctctaaccgcctacgaaacgcgccgacccgaccaacgccgactacgaataaccgcaaacgaaaaaacgcgctcgaaaccgtcccgccgccgccgccgccgcgcgctctcccgaaccgacgacctacgcgaactaccgaaaaactactccgaacgaacgactacgaactaccaaaaaactaccgaaaacgcgaaaaacgaactacgaactactcccgcgccgcgcgccgaccgaaaaccaaccgaaacaaaacgcctacgtaatcctaacgcgctcgctcccactcgccgcgccgcgcccgaaacccgaaaaaaccccgccgaacgcccgctcccaaaacgccttttcctacgcccgcaacccccgcctcccacctaaaaaactacacctccaaccgccgccgccgccgccgccgccgctaccgccgaaactacaacacgccctcctccctcgaaactacgccgaataattacaaaccgaatctatactaccccctaccgacccgaacgccccctactactataaatatactcacgtatatacacgtaaataaacacacacgtatttccgacgcccaaaaccctaaaaacgccgaatacccctttacaccgataaaaaaacaaaaccgcgt

SEQ ID NO: 14747 - DNA, 956 bp, Artificial Sequence
  chemically treated genomic DNA (Homo sapiens) CpG-island No: 14747
aggaaagtgttattggttggtaaatttaaggttattttttttattgagtaggtagaatggtttgttttttagttcggcggtttcgcgtttcgtcgcgtttcgcgcgtagcgttgtatggagcggcggttaaaggttcggcgtaggaatcgtagtattttggttgggggcgttttttgttttcgttttttgcgttgtcgttgtcgttgtcgttgtcgttgcgtcgtcgttcgggagcgtttcgcgacgtcgttagtgttttcggtcgttcgcgtcgtttttcgcgggttacggttcggggtaagttcgcgtcgaggtcgaggtcgcgttttagtcgtttgcggggcgcgtcggttcggttagcgtcggttgcgagtggtcgtaggcgggagggcgcgttcggggtcgtttcgtcgtcgtcgtcgtcgcgcgttttttcgggtcggcggtttgcgcgggttgtcgaggggttgtttcggacgggcggttgcgggttgttagggggttgtcgggggcgcgggaggcgggttgcgggttgttttcgcgtcgcgcgtcggtcgagggttagtcggagtagggcgtttgcgtggttttggcgcgttcgtttttattcgtcgcgtcgcgttcggggttcgaggaggtttcgtcgagcgttcgtttttaaggcgtttttttttgcgttcgtagttttcgttttttatttgggaggttgtatttttagtcgtcgtcgtcgtcgtcgtcgtcgttgtcgtcgggattgtagtacgtttttttttttcggggttgcgtcgggtaattgtaagtcgggtttgtgttgttttttgtcggttcgagcgttttttgttgttgtaggtgtgtttacgtgtgtatacgtaggtgagtatatacgtgttttcggcgtttagagttttggaggcgtcgagtgtttttttgtatcgataggaaaataaggtcgcgt

SEQ ID NO: 14748 - DNA, 956 bp, Artificial Sequence
  chemically treated genomic DNA (Homo sapiens) CpG-island No: 14748
acgcgaccttattttcctatcgatacaaaaaaacactcgacgcctccaaaactctaaacgccgaaaacacgtatatactcacctacgtatacacacgtaaacacacctacaacaacaaaaaacgctcgaaccgacaaaaaacaacacaaacccgacttacaattacccgacgcaaccccgaaaaaaaaaaacgtactacaatcccgacgacaacgacgacgacgacgacgacgacgactaaaaatacaacctcccaaataaaaaacgaaaactacgaacgcaaaaaaaaacgccttaaaaacgaacgctcgacgaaacctcctcgaaccccgaacgcgacgcgacgaataaaaacgaacgcgccaaaaccacgcaaacgccctactccgactaaccctcgaccgacgcgcgacgcgaaaacaacccgcaacccgcctcccgcgcccccgacaaccccctaacaacccgcaaccgcccgtccgaaacaacccctcgacaacccgcgcaaaccgccgacccgaaaaaacgcgcgacgacgacgacgacgaaacgaccccgaacgcgccctcccgcctacgaccactcgcaaccgacgctaaccgaaccgacgcgccccgcaaacgactaaaacgcgacctcgacctcgacgcgaacttaccccgaaccgtaacccgcgaaaaacgacgcgaacgaccgaaaacactaacgacgtcgcgaaacgctcccgaacgacgacgcaacgacaacgacaacgacaacgacaacgcaaaaaacgaaaacaaaaaacgcccccaaccaaaatactacgattcctacgccgaacctttaaccgccgctccatacaacgctacgcgcgaaacgcgacgaaacgcgaaaccgccgaactaaaaaacaaaccattctacctactcaataaaaaaaataaccttaaatttaccaaccaataacactttcct

SEQ ID NO: 14749 - DNA, 1215 bp, Artificial Sequence
  chemically treated genomic DNA (Homo sapiens) CpG-island No: 14749
ttcgcgcgcggttagttgtagtcgtcggcgagtcgattggggaggggtgtggacgtcgaggttcgcggagtggtgttcgtagttttatttatataacgttttaatttttttttcgggggggatttgcggagttattcggagtagattattttattatcgtttatggtgcgcgcgtttcgggtttcgggtcgggtagttgaggggcggcgggcgcgttttcgatatagtcgacgtttgtcgagcgcgtagtggcgagaatttagtttttttggtcgcgtatttcggacggattgggcggatagattttacggtgcgcgggttttacgagttcgagttttttttttgtaggtttacgaatttgaatagaacgcgagtcggggtcgcgggcgcgtcggtttttttttagtgcgttcgtttcgtttttagacgtgtcgtttcgttagttgttttagtagcgttcggatttagcgggattttgtttcgattcggtgtcggagtttttgttttttgcgtttcgttttttagggataagatttttttagagcgtttttcgaaatagatatagcgttgtttatatatatatatatatatatatatatatataatgtttcgcgcggtgttcgttcgttcgtttattcgttttcggtttcgatgcgttcggagcgatttttttttttttttttcgggggagggtgggttatttcgcggcgttcggtgaacgtcgaggaaaggggaagtcgcgagtcgtttacgggtagcgggcgcggggttggtttcgggttatagagggagtcgtagggttggtagcgaagcgcggggcgtttttgagcggcgggcgtagggaggtcgtaggttaagtcggagggtgggttcgttttcgcggtcgtcgaagagggcggggagtagtagaggaacgaggcgtttggcggtttggtttttgggagggatttcgttgtttcgttttttcgcgtttttttttcgtcgttttttttatttcggggttcgcggtaggttttgagcggttcggttttagatttcgatttttttttttttttttcggtcgtcgggtttttttttttttttttttttttttttttttttacgtttaggttcggtttcggtttttgtttagattttttttgaaatttcgtcggagtgtttttagttaaaataataagggtcgggggaggagacggacgaagggagggagtaagg

SEQ ID NO: 14750 - DNA, 1215 bp, Artificial Sequence
  chemically treated genomic DNA (Homo sapiens) CpG-island No: 14750
ccttactccctcccttcgtccgtctcctcccccgacccttattattttaactaaaaacactccgacgaaatttcaaaaaaaatctaaacaaaaaccgaaaccgaacctaaacgtaaaaaaaaaaaaaaaaaaaaaaaaaaaaaaaaacccgacgaccgaaaaaaaaaaaaaaaaatcgaaatctaaaaccgaaccgctcaaaacctaccgcgaaccccgaaataaaaaaaacgacgaaaaaaaaacgcgaaaaaacgaaacaacgaaatccctcccaaaaaccaaaccgccaaacgcctcgttcctctactactccccgccctcttcgacgaccgcgaaaacgaacccaccctccgacttaacctacgacctccctacgcccgccgctcaaaaacgccccgcgcttcgctaccaaccctacgactccctctataacccgaaaccaaccccgcgcccgctacccgtaaacgactcgcgacttcccctttcctcgacgttcaccgaacgccgcgaaataacccaccctcccccgaaaaaaaaaaaaaaaaatcgctccgaacgcatcgaaaccgaaaacgaataaacgaacgaacgaacaccgcgcgaaacattatatatatatatatatatatatatatatataaacaacgctatatctatttcgaaaaacgctctaaaaaaatcttatccctaaaaaacgaaacgcaaaaaacaaaaactccgacaccgaatcgaaacaaaatcccgctaaatccgaacgctactaaaacaactaacgaaacgacacgtctaaaaacgaaacgaacgcactaaaaaaaaaccgacgcgcccgcgaccccgactcgcgttctattcaaattcgtaaacctacaaaaaaaaaactcgaactcgtaaaacccgcgcaccgtaaaatctatccgcccaatccgtccgaaatacgcgaccaaaaaaactaaattctcgccactacgcgctcgacaaacgtcgactatatcgaaaacgcgcccgccgcccctcaactacccgacccgaaacccgaaacgcgcgcaccataaacgataataaaataatctactccgaataactccgcaaatcccccccgaaaaaaaaattaaaacgttatataaataaaactacgaacaccactccgcgaacctcgacgtccacacccctccccaatcgactcgccgacgactacaactaaccgcgcgcgaa

SEQ ID NO: 14751 - DNA, 1215 bp, Artificial Sequence
  chemically treated genomic DNA (Homo sapiens) CpG-island No: 14751
ttttgtttttttttttcgttcgttttttttttcggtttttgttgttttggttggaagtatttcggcggagttttagagaaagtttgggtagaaatcggagtcgggtttgaacgtgggaaggggaggaggagagggaggaagaaggagttcggcggtcgggagagggagggagggatcgggatttggggtcgagtcgtttaggatttgtcgcgagtttcggggtgggggaggcggcgggggaggagcgcgaggggacgggatagcgggattttttttaggagttaagtcgttaagcgtttcgtttttttgttgtttttcgtttttttcggcggtcgcgagagcggatttatttttcggtttgatttgcgatttttttgcgttcgtcgtttagaaacgtttcgcgtttcgttgttaattttgcggttttttttgtgattcgggattagtttcgcgttcgttgttcgtaggcggttcgcggtttttttttttttcggcgtttatcgagcgtcgcgaagtgatttattttttttcgaggagagggaaggaggatcgtttcgggcgtatcgaaatcgagggcgggtgggcgggcgagcgggtatcgcgcggggtattgtgtgtgtgtgtgtgtgtgtgtgtgtgtgtgagtagcgttgtgtttgtttcggaaagcgttttggggaggttttgtttttagggggcggagcgtaaaggatagaagtttcggtatcgagtcggggtagagtttcgttgagttcgagcgttgttgaggtagttggcgagacggtacgtttggaggcgaggcgggcgtattgaaaggaggtcggcgcgttcgcggtttcggttcgcgttttgtttaggttcgtgggtttgtagaggagagattcgaattcgtggaattcgcgtatcgtggagtttgttcgtttagttcgttcggggtgcgcgattaggagagttaggttttcgttattgcgcgttcggtaggcgtcggttgtgtcgggagcgcgttcgtcgttttttagttgttcggttcggagttcgagacgcgcgtattatgagcggtggtgaagtggtttgtttcggatggtttcgtaagtttttttcggagaaaaagttgaagcgttatgtaagtagagttgcgggtattatttcgcgggtttcggcgtttatatttttttttagtcggttcgtcggcggttgtagttggtcgcgcgcggg

SEQ ID NO: 14752 - DNA, 1215 bp, Artificial Sequence
  chemically treated genomic DNA (Homo sapiens) CpG-island No: 14752
cccgcgcgcgaccaactacaaccgccgacgaaccgactaaaaaaaaatataaacgccgaaacccgcgaaataatacccgcaactctacttacataacgcttcaactttttctccgaaaaaaacttacgaaaccatccgaaacaaaccacttcaccaccgctcataatacgcgcgtctcgaactccgaaccgaacaactaaaaaacgacgaacgcgctcccgacacaaccgacgcctaccgaacgcgcaataacgaaaacctaactctcctaatcgcgcaccccgaacgaactaaacgaacaaactccacgatacgcgaattccacgaattcgaatctctcctctacaaacccacgaacctaaacaaaacgcgaaccgaaaccgcgaacgcgccgacctcctttcaatacgcccgcctcgcctccaaacgtaccgtctcgccaactacctcaacaacgctcgaactcaacgaaactctaccccgactcgataccgaaacttctatcctttacgctccgccccctaaaaacaaaacctccccaaaacgctttccgaaacaaacacaacgctactcacacacacacacacacacacacacacacacaataccccgcgcgatacccgctcgcccgcccacccgccctcgatttcgatacgcccgaaacgatcctccttccctctcctcgaaaaaaaataaatcacttcgcgacgctcgataaacgccgaaaaaaaaaaaaaccgcgaaccgcctacgaacaacgaacgcgaaactaatcccgaatcacaaaaaaaaccgcaaaattaacaacgaaacgcgaaacgtttctaaacgacgaacgcaaaaaaatcgcaaatcaaaccgaaaaataaatccgctctcgcgaccgccgaaaaaaacgaaaaacaacaaaaaaacgaaacgcttaacgacttaactcctaaaaaaaatcccgctatcccgtcccctcgcgctcctcccccgccgcctcccccaccccgaaactcgcgacaaatcctaaacgactcgaccccaaatcccgatccctccctccctctcccgaccgccgaactccttcttcctccctctcctcctccccttcccacgttcaaacccgactccgatttctacccaaactttctctaaaactccgccgaaatacttccaaccaaaacaacaaaaaccgaaaaaaaaaacgaacgaaaaaaaaaaacaaaa

SEQ ID NO: 14753 - DNA, 722 bp, Artificial Sequence
  chemically treated genomic DNA (Homo sapiens) CpG-island No: 14753
tatttttattatttatttttttacgtttttgttgttttttttttttttcgggcggtttcgtttttaatatatttgtttatttttacggttgttagacgttaggtgtttacgttgtattttatttcgcgtttttttaattcgattggcgtttttttgttcgtttcgaaggttagtttgttcggagtattttttgttttttattttcgtgtttattcgtagatttttttttagtttttattttcgcgggcgtcgggagagaaattagtatcgtatttggcgagagttcggcggtcgttgcgagtagtaggagagtttggcggagcgttgagtagagcgttcgggttatcgttattaggcggtcgcgtcggggttgcgaggttttagagtagagcgaggtagtcggggtagtacggttcgttttgaagttttcgggtcgcgggaggggagcgcggtatcgatatttttttgaagtgcgcggttggttttagttagtgtgggcgttttttttttcggtcgtttttattttacgttttttgcggttggcggtgcgcggcgtttttgttattggtttcgtagtcgggcggggagcgggtggtggggcgggcggtagagttcgtttttgtcgcgttttcgttttttgcgttttttcgtagtcgttcgggtttgttgttgtagggtaggtaggtaaaggcggttttgtgttcggtagtgagatcgtttag

SEQ ID NO: 14754 - DNA, 722 bp, Artificial Sequence
  chemically treated genomic DNA (Homo sapiens) CpG-island No: 14754
ctaaacgatctcactaccgaacacaaaaccgcctttacctacctaccctacaacaacaaacccgaacgactacgaaaaaacgcaaaaaacgaaaacgcgacaaaaacgaactctaccgcccgccccaccacccgctccccgcccgactacgaaaccaataacaaaaacgccgcgcaccgccaaccgcaaaaaacgtaaaataaaaacgaccgaaaaaaaaaacgcccacactaactaaaaccaaccgcgcacttcaaaaaaatatcgataccgcgctcccctcccgcgacccgaaaacttcaaaacgaaccgtactaccccgactacctcgctctactctaaaacctcgcaaccccgacgcgaccgcctaataacgataacccgaacgctctactcaacgctccgccaaactctcctactactcgcaacgaccgccgaactctcgccaaatacgatactaatttctctcccgacgcccgcgaaaataaaaactaaaaaaaaatctacgaataaacacgaaaataaaaaacaaaaaatactccgaacaaactaaccttcgaaacgaacaaaaaaacgccaatcgaattaaaaaaacgcgaaataaaatacaacgtaaacacctaacgtctaacaaccgtaaaaataaacaaatatattaaaaacgaaaccgcccgaaaaaaaaaaaaaacaacaaaaacgtaaaaaaataaataataaaaata

SEQ ID NO: 14755 - DNA, 722 bp, Artificial Sequence
  chemically treated genomic DNA (Homo sapiens) CpG-island No: 14755
ttgggcgattttattgtcgggtatagggtcgtttttgtttgtttgttttgtagtagtaggttcgggcggttgcgagagggcgtagggggcggaggcgcggtaggggcgggttttgtcgttcgttttattattcgtttttcgttcggttgcggggttagtggtaggagcgtcgcgtatcgttagtcgtagggggcgtgggatgggggcggtcggggaggggggcgtttatattgattagagttaatcgcgtattttaaaagggtgtcggtgtcgcgtttttttttcgcggttcgggaattttaaagcgggtcgtgttgtttcggttgtttcgttttgttttggggtttcgtagtttcggcgcggtcgtttggtggcgatgattcgggcgttttgtttagcgtttcgttaggtttttttgttgttcgtagcggtcgtcgagttttcgttaggtacggtgttggtttttttttcgacgttcgcgagggtgggagttgggaggaggtttgcgggtgagtacgggggtgggggatagggggtgtttcgagtaaattgattttcggggcggatagggaagcgttagtcggattgagggggcgcgggatagggtgtagcgtgggtatttgacgtttggtagtcgtaggggtagataggtgtgttggggacgaagtcgttcggaagagggaaaaggtagtagggacgtgggggaataagtagtaggggtg

SEQ ID NO: 14756 - DNA, 722 bp, Artificial Sequence
  chemically treated genomic DNA (Homo sapiens) CpG-island No: 14756
cacccctactacttattcccccacgtccctactaccttttccctcttccgaacgacttcgtccccaacacacctatctacccctacgactaccaaacgtcaaatacccacgctacaccctatcccgcgccccctcaatccgactaacgcttccctatccgccccgaaaatcaatttactcgaaacaccccctatcccccacccccgtactcacccgcaaacctcctcccaactcccaccctcgcgaacgtcgaaaaaaaaaccaacaccgtacctaacgaaaactcgacgaccgctacgaacaacaaaaaaacctaacgaaacgctaaacaaaacgcccgaatcatcgccaccaaacgaccgcgccgaaactacgaaaccccaaaacaaaacgaaacaaccgaaacaacacgacccgctttaaaattcccgaaccgcgaaaaaaaaacgcgacaccgacacccttttaaaatacgcgattaactctaatcaatataaacgcccccctccccgaccgcccccatcccacgccccctacgactaacgatacgcgacgctcctaccactaaccccgcaaccgaacgaaaaacgaataataaaacgaacgacaaaacccgcccctaccgcgcctccgccccctacgccctctcgcaaccgcccgaacctactactacaaaacaaacaaacaaaaacgaccctatacccgacaataaaatcgcccaa

SEQ ID NO: 14757 - DNA, 673 bp, Artificial Sequence
  chemically treated genomic DNA (Homo sapiens) CpG-island No: 14757
gcgggcggggagttttttttcggagaaaaaattttaataagcggagagggtataaaggttttttacgtcgcgtttcgagttttttcggtattttaagggcggttcggggtggtgggaaagcgttaagttttgggagtgcgtcggtgggttcgggacggcggggttttcgttagggtttttggttttcgatgatttcggttgagatcgcgagtcgcgcggcggaaagcggaggaattttcgttcggttttgtagtcgttcgtatcgcgtttcgttattcgtcgttttttcgcgttcgggcgttttagtcgcggggtttcggaagtttttggtttttggttttttttgtttggttcggggcggttggtcgtggacgcgtttcgattttagtttttttcgtttagtcgttcgttttaggatgtttttttatcgtagtttcgtcgtggttaggaggtgtgggcggttacgttcggagggtttacggtggtttcggacgttcgttttttttaggttttggttcgggtcggggtgggtcgggacggtttttggtgtttaggtttttttttttttaggtttttttcgtacgtgttggtttcgattgtcgtgggattcggtttttgttttaggcgggatatggtcggttgtagcgtttggcgggggtttggtttttaggtt

SEQ ID NO: 14758 - DNA, 673 bp, Artificial Sequence
  chemically treated genomic DNA (Homo sapiens) CpG-island No: 14758
aacctaaaaaccaaacccccgccaaacgctacaaccgaccatatcccgcctaaaacaaaaaccgaatcccacgacaatcgaaaccaacacgtacgaaaaaaacctaaaaaaaaaaaaacctaaacaccaaaaaccgtcccgacccaccccgacccgaaccaaaacctaaaaaaaacgaacgtccgaaaccaccgtaaaccctccgaacgtaaccgcccacacctcctaaccacgacgaaactacgataaaaaaacatcctaaaacgaacgactaaacgaaaaaaactaaaatcgaaacgcgtccacgaccaaccgccccgaaccaaacaaaaaaaaccaaaaaccaaaaacttccgaaaccccgcgactaaaacgcccgaacgcgaaaaaacgacgaataacgaaacgcgatacgaacgactacaaaaccgaacgaaaattcctccgctttccgccgcgcgactcgcgatctcaaccgaaatcatcgaaaaccaaaaaccctaacgaaaaccccgccgtcccgaacccaccgacgcactcccaaaacttaacgctttcccaccaccccgaaccgcccttaaaataccgaaaaaactcgaaacgcgacgtaaaaaacctttataccctctccgcttattaaaattttttctccgaaaaaaaactccccgcccgc

SEQ ID NO: 14759 - DNA, 673 bp, Artificial Sequence
  chemically treated genomic DNA (Homo sapiens) CpG-island No: 14759
gatttgggggttaggttttcgttaggcgttgtaatcggttatgtttcgtttggggtaggggtcgggttttacggtagtcggggttagtacgtacgaagaaagtttgaaaaaaaaaaggtttaagtattaggaatcgtttcggtttatttcggttcgggttagggtttaggaagggcgggcgttcggagttatcgtgggtttttcgggcgtggtcgtttatattttttggttacggcggggttgcggtgggggaatattttggggcgggcggttggacggaagggattagagtcggggcgcgtttacggttaatcgtttcgaattaagtaggggaggttagggattaggagttttcggggtttcgcggttggagcgttcggacgcgaaggggcggcgggtgacggggcgcggtgcgggcggttatagggtcggacgggagttttttcgtttttcgtcgcgcggttcgcggttttagtcgaggttatcgagggttaggagttttggcggaggtttcgtcgtttcggatttatcgacgtatttttagggtttggcgtttttttattatttcggatcgtttttggggtgtcggaggggttcggggcgcggcgtggggagtttttgtgtttttttcgtttgttgaggtttttttttcggaggagagtttttcgttcgt

SEQ ID NO: 14760 - DNA, 673 bp, Artificial Sequence
  chemically treated genomic DNA (Homo sapiens) CpG-island No: 14760
acgaacgaaaaactctcctccgaaaaaaaaacctcaacaaacgaaaaaaacacaaaaactccccacgccgcgccccgaacccctccgacaccccaaaaacgatccgaaataataaaaaaacgccaaaccctaaaaatacgtcgataaatccgaaacgacgaaacctccgccaaaactcctaaccctcgataacctcgactaaaaccgcgaaccgcgcgacgaaaaacgaaaaaactcccgtccgaccctataaccgcccgcaccgcgccccgtcacccgccgccccttcgcgtccgaacgctccaaccgcgaaaccccgaaaactcctaatccctaacctcccctacttaattcgaaacgattaaccgtaaacgcgccccgactctaatcccttccgtccaaccgcccgccccaaaatattcccccaccgcaaccccgccgtaaccaaaaaatataaacgaccacgcccgaaaaacccacgataactccgaacgcccgcccttcctaaaccctaacccgaaccgaaataaaccgaaacgattcctaatacttaaaccttttttttttcaaactttcttcgtacgtactaaccccgactaccgtaaaacccgacccctaccccaaacgaaacataaccgattacaacgcctaacgaaaacctaacccccaaatc

SEQ ID NO: 14761 - DNA, 777 bp, Artificial Sequence
  chemically treated genomic DNA (Homo sapiens) CpG-island No: 14761
gtcggcgcggaggaaggacgtcgcgcggtttaggtttcggttgcggttcggttcgcgagttgttgttcgcgaggttttcgcgatttcggtttggcgatttcgttttcgcgttttttttttagtttttttttttgcgttttttgttcgcggggttgcgtttcggatttcggttcgtttgttttcgtcggcggtcgcggtttttcggattcggcgttcgtcggggtcggcgggagtagcgtaggcgatcggcggcgggagtcggagttacgcgttttttcgtattttcggcgttagttcggttggagtcgtcgggattatggtgttggattaggaggacggtaggtgttcggcgttcggtgtcggtgttcgggggtacgcgggacgtggggcggagattgcggcgttggttttgcggagtttatttcgttagcggcggtagagtttttagtattcgcgggtttttttcggttgatgggtggtttttcggaagcgcggcggttgatgtgtgcgtcggtgtcggggtcgcggtgttaggtttagcgttcgggtttcggcggcggcgggattaggaagtttttcggttttaacgaggtcgttagttttgcgcgtttcggttgggaatttttttacggatttttgtcgttttgcgggtattcggagcgtttttgcgattcgtatcgcgggtttttcggtagtgtttattgttagttagttttttagtttttttgggtgtttgtacgtttttttttcgtattttattgcggaacggattttagt

SEQ ID NO: 14762 - DNA, 777 bp, Artificial Sequence
  chemically treated genomic DNA (Homo sapiens) CpG-island No: 14762
actaaaatccgttccgcaataaaatacgaaaaaaaaacgtacaaacacccaaaaaaactaaaaaactaactaacaataaacactaccgaaaaacccgcgatacgaatcgcaaaaacgctccgaatacccgcaaaacgacaaaaatccgtaaaaaaattcccaaccgaaacgcgcaaaactaacgacctcgttaaaaccgaaaaacttcctaatcccgccgccgccgaaacccgaacgctaaacctaacaccgcgaccccgacaccgacgcacacatcaaccgccgcgcttccgaaaaaccacccatcaaccgaaaaaaacccgcgaatactaaaaactctaccgccgctaacgaaataaactccgcaaaaccaacgccgcaatctccgccccacgtcccgcgtacccccgaacaccgacaccgaacgccgaacacctaccgtcctcctaatccaacaccataatcccgacgactccaaccgaactaacgccgaaaatacgaaaaaacgcgtaactccgactcccgccgccgatcgcctacgctactcccgccgaccccgacgaacgccgaatccgaaaaaccgcgaccgccgacgaaaacaaacgaaccgaaatccgaaacgcaaccccgcgaacaaaaaacgcaaaaaaaaaaactaaaaaaaaaacgcgaaaacgaaatcgccaaaccgaaatcgcgaaaacctcgcgaacaacaactcgcgaaccgaaccgcaaccgaaacctaaaccgcgcgacgtccttcctccgcgccgac

SEQ ID NO: 14763 - DNA, 777 bp, Artificial Sequence
  chemically treated genomic DNA (Homo sapiens) CpG-island No: 14763
gttgggattcgtttcgtagtagggtgcggaaggggaacgtgtagatatttagagaggttgggagattggttggtagtgggtattgtcgggaagttcgcggtgcgggtcgtagaggcgtttcggatgttcgtaaggcggtaagagttcgtgagaaagtttttagtcggagcgcgtagggttggcggtttcgttgggatcgggagattttttaatttcgtcgtcgtcgaagttcgggcgttgagtttggtatcgcgatttcggtatcggcgtatatattagtcgtcgcgttttcgggaagttatttattagtcggaggaggttcgcgggtgttgagggttttgtcgtcgttagcggggtggatttcgtagggttagcgtcgtagttttcgttttacgtttcgcgtgttttcgggtatcggtatcgggcgtcgggtatttatcgtttttttggtttaatattatggtttcgacggttttagtcggattagcgtcgaggatacggaggggcgcgtggtttcgattttcgtcgtcggtcgtttgcgttgttttcgtcggtttcggcgggcgtcgagttcggagagtcgcgatcgtcgacgggggtagacggatcggagttcggagcgtagtttcgcgggtagggagcgtaggaggagggattggggggaaggcgcgggggcgagatcgttaggtcgggatcgcgggagtttcgcgagtagtagttcgcgggtcgggtcgtagtcggagtttgagtcgcgcggcgtttttttttcgcgtcggt

SEQ ID NO: 14764 - DNA, 777 bp, Artificial Sequence
  chemically treated genomic DNA (Homo sapiens) CpG-island No: 14764
accgacgcgaaaaaaaaacgccgcgcgactcaaactccgactacgacccgacccgcgaactactactcgcgaaactcccgcgatcccgacctaacgatctcgcccccgcgccttccccccaatccctcctcctacgctccctacccgcgaaactacgctccgaactccgatccgtctacccccgtcgacgatcgcgactctccgaactcgacgcccgccgaaaccgacgaaaacaacgcaaacgaccgacgacgaaaatcgaaaccacgcgcccctccgtatcctcgacgctaatccgactaaaaccgtcgaaaccataatattaaaccaaaaaaacgataaatacccgacgcccgataccgatacccgaaaacacgcgaaacgtaaaacgaaaactacgacgctaaccctacgaaatccaccccgctaacgacgacaaaaccctcaacacccgcgaacctcctccgactaataaataacttcccgaaaacgcgacgactaatatatacgccgataccgaaatcgcgataccaaactcaacgcccgaacttcgacgacgacgaaattaaaaaatctcccgatcccaacgaaaccgccaaccctacgcgctccgactaaaaactttctcacgaactcttaccgccttacgaacatccgaaacgcctctacgacccgcaccgcgaacttcccgacaatacccactaccaaccaatctcccaacctctctaaatatctacacgttccccttccgcaccctactacgaaacgaatcccaac

SEQ ID NO: 14765 - DNA, 925 bp, Artificial Sequence
  chemically treated genomic DNA (Homo sapiens) CpG-island No: 14765
cgaagatcggtcgtttttttaaagcgcgtttcgagtcggcgtttttttttcggtcgagtttagttgcggttggatacggagcgttcgagatgatggtgttggataaggaggacggtaggtggcgggtcggggtttcgacgttttttattttttcgttttttgtcgcggcgcgtaggtatatatacgcggggatacgggcgtatatttgttgggttgtgcggggattgcggggcgggcggcgcgttgggggtcggggttggggcggggggaagtatcgggggatagtcgggcggaatttgcggggggaggaggtcgagtttcgggttgtacgcgttcggtcgtacgtttttcgggtttcggtcgcgagtcgaggagttgtgtattggtcgtgtgttgcgtcgcggggtcgcgcggaggttggggtttttttgcgattttcgtcgcggaggttcgttttgagtatttcgtgtttgaggttgttgtttttatcgtagttattattttcgcgttagtcgtcgcgtaattcgagaggcgttgagcgtcgagtaaattagcggtttcggggagaatcgggttttagagttcggggtaagcgggagcgcgggaggacggcgcgagcgttagggtgttcggtaggcgaggggaaggcgggttggatttttcgggggatatttgtatgagcgtgattcggtgagaaagagagtcgttttttgtgtcggttcgttagttttttgtttttttgagcgcggaggcgggagtttggtttagaggaagaaagtgtttcgtcgtcggtcggtagtatttgtgcgggagcggtttgcgagagtggtacggatttttcgtggtcgagttttagtgcgttttagaaaattgtagggtacgggaaaggtcggaatagaggagtttatggttgttggaagttatt

SEQ ID NO: 14766 - DNA, 925 bp, Artificial Sequence
  chemically treated genomic DNA (Homo sapiens) CpG-island No: 14766
aataacttccaacaaccataaactcctctattccgacctttcccgtaccctacaattttctaaaacgcactaaaactcgaccacgaaaaatccgtaccactctcgcaaaccgctcccgcacaaatactaccgaccgacgacgaaacactttcttcctctaaaccaaactcccgcctccgcgctcaaaaaaacaaaaaactaacgaaccgacacaaaaaacgactctctttctcaccgaatcacgctcatacaaatatcccccgaaaaatccaacccgccttcccctcgcctaccgaacaccctaacgctcgcgccgtcctcccgcgctcccgcttaccccgaactctaaaacccgattctccccgaaaccgctaatttactcgacgctcaacgcctctcgaattacgcgacgactaacgcgaaaataataactacgataaaaacaacaacctcaaacacgaaatactcaaaacgaacctccgcgacgaaaatcgcaaaaaaaccccaacctccgcgcgaccccgcgacgcaacacacgaccaatacacaactcctcgactcgcgaccgaaacccgaaaaacgtacgaccgaacgcgtacaacccgaaactcgacctcctccccccgcaaattccgcccgactatcccccgatacttccccccgccccaaccccgacccccaacgcgccgcccgccccgcaatccccgcacaacccaacaaatatacgcccgtatccccgcgtatatatacctacgcgccgcgacaaaaaacgaaaaaataaaaaacgtcgaaaccccgacccgccacctaccgtcctccttatccaacaccatcatctcgaacgctccgtatccaaccgcaactaaactcgaccgaaaaaaaaacgccgactcgaaacgcgctttaaaaaaacgaccgatcttcg

SEQ ID NO: 14767 - DNA, 925 bp, Artificial Sequence
  chemically treated genomic DNA (Homo sapiens) CpG-island No: 14767
agtggtttttagtagttatgggtttttttgtttcgatttttttcgtgttttgtagttttttagggcgtattgaggttcgattacggaaggttcgtgttattttcgtaggtcgttttcgtataagtgttatcggtcggcggcgggatattttttttttttgggttaaattttcgttttcgcgtttagagagatagggagttagcgggtcggtataagaggcggtttttttttttatcgagttacgtttatgtagatgtttttcggagggtttaattcgtttttttttcgtttgtcgggtattttggcgttcgcgtcgttttttcgcgttttcgtttgtttcgagttttggagttcgatttttttcgaagtcgttgatttgttcggcgtttagcgtttttcgggttacgcggcggttggcgcgagggtgatggttgcggtgagagtagtagttttagatacgaaatgtttagagcgaattttcgcggcggagatcgtaagggagttttagttttcgcgcggtttcgcggcgtagtatacggttagtgtatagtttttcggttcgcggtcgggattcggggggcgtgcggtcgggcgcgtgtagttcggggttcgatttttttttttcgtaagtttcgttcggttgtttttcggtattttttttcgttttagtttcggtttttagcgcgtcgttcgtttcgtaattttcgtatagtttagtaggtgtgcgttcgtgttttcgcgtgtgtgtgtttgcgcgtcgcggtagggggcgagggggtgaggggcgtcgagatttcggttcgttatttatcgttttttttgtttagtattattatttcgggcgtttcgtgtttagtcgtagttaggttcggtcgggagaagggcgtcgattcggggcgcgttttggaggggcggtcggttttcg

SEQ ID NO: 14768 - DNA, 925 bp, Artificial Sequence
  chemically treated genomic DNA (Homo sapiens) CpG-island No: 14768
cgaaaaccgaccgcccctccaaaacgcgccccgaatcgacgcccttctcccgaccgaacctaactacgactaaacacgaaacgcccgaaataataatactaaacaaaaaaaacgataaataacgaaccgaaatctcgacgcccctcaccccctcgccccctaccgcgacgcgcaaacacacacacgcgaaaacacgaacgcacacctactaaactatacgaaaattacgaaacgaacgacgcgctaaaaaccgaaactaaaacgaaaaaaaataccgaaaaacaaccgaacgaaacttacgaaaaaaaaaaatcgaaccccgaactacacgcgcccgaccgcacgccccccgaatcccgaccgcgaaccgaaaaactatacactaaccgtatactacgccgcgaaaccgcgcgaaaactaaaactcccttacgatctccgccgcgaaaattcgctctaaacatttcgtatctaaaactactactctcaccgcaaccatcaccctcgcgccaaccgccgcgtaacccgaaaaacgctaaacgccgaacaaatcaacgacttcgaaaaaaatcgaactccaaaactcgaaacaaacgaaaacgcgaaaaaacgacgcgaacgccaaaatacccgacaaacgaaaaaaaaacgaattaaaccctccgaaaaacatctacataaacgtaactcgataaaaaaaaaaaccgcctcttataccgacccgctaactccctatctctctaaacgcgaaaacgaaaatttaacccaaaaaaaaaaaatatcccgccgccgaccgataacacttatacgaaaacgacctacgaaaataacacgaaccttccgtaatcgaacctcaatacgccctaaaaaactacaaaacacgaaaaaaatcgaaacaaaaaaacccataactactaaaaaccact

SEQ ID NO: 14769 - DNA, 883 bp, Artificial Sequence
  chemically treated genomic DNA (Homo sapiens) CpG-island No: 14769
ggtatcgattattagtagttcgggtttcgtcggcgttggcgcgggttcggggcgggggcggggcgggggcggagagcgggtgggggcggggcgggaggcgtcggtagagtcgcggcggtatcggcgtattcgtcgttatttcggggattttgcgtcggttcggtcggttcggtttcggtcgcgcgttttttttcgttttttcgtttcggcgttcgtttttcgtttttttttttcgtttttttttttcgtttttcgtttttcgtttttttgttcgcgttttttttttcgcgcgtttttagttttcggtcgtcgtttcgttgagtttagaacgagtcgggtcggggcggcggggtcgggcggggcgggcgggcgcgcggatttcgcggttatgaagtggttttcgggggttcggagttcgatagttttcggggagggagtcgtacgcggtttagggtagcggtttaggggcgtcggggtcggggcgtaggggtcgttgttcgcgatggatcgtatcggagacgtttcggattcgtcgtcgtaggttagtgtttttcgcgttttcgcgggcgtttcgtcgcgtatagagtttttttttgcgtttttatcggtgtttacgttatgttttttcgggcgcgcgttggggtgtgtgtgtgtgtgtgtgtgtgtgtgtgtgtgtgcgttgcgcgcgttgggggtagttggaaagggggtcgagaatcgagttcgggttgggaggcgttgttgtcgaggggttgcgaaataaaattcggtatagtttgttttcgtcgatcgggattaggggaagagttggtttttagtagtttttaataatcggttcgggtttttagtcgttagttttcggtttttttagtaggtggttttt

SEQ ID NO: 14770 - DNA, 883 bp, Artificial Sequence
  chemically treated genomic DNA (Homo sapiens) CpG-island No: 14770
aaaaaccacctactaaaaaaaccgaaaactaacgactaaaaacccgaaccgattattaaaaactactaaaaaccaactcttcccctaatcccgatcgacgaaaacaaactataccgaattttatttcgcaacccctcgacaacaacgcctcccaacccgaactcgattctcgaccccctttccaactacccccaacgcgcgcaacgcacacacacacacacacacacacacacacacacaccccaacgcgcgcccgaaaaaacataacgtaaacaccgataaaaacgcaaaaaaaaactctatacgcgacgaaacgcccgcgaaaacgcgaaaaacactaacctacgacgacgaatccgaaacgtctccgatacgatccatcgcgaacaacgacccctacgccccgaccccgacgcccctaaaccgctaccctaaaccgcgtacgactccctccccgaaaactatcgaactccgaacccccgaaaaccacttcataaccgcgaaatccgcgcgcccgcccgccccgcccgaccccgccgccccgacccgactcgttctaaactcaacgaaacgacgaccgaaaactaaaaacgcgcgaaaaaaaaaacgcgaacaaaaaaacgaaaaacgaaaaacgaaaaaaaaaaacgaaaaaaaaaaacgaaaaacgaacgccgaaacgaaaaaacgaaaaaaaacgcgcgaccgaaaccgaaccgaccgaaccgacgcaaaatccccgaaataacgacgaatacgccgataccgccgcgactctaccgacgcctcccgccccgcccccacccgctctccgcccccgccccgcccccgccccgaacccgcgccaacgccgacgaaacccgaactactaataatcgatacc

SEQ ID NO: 14771 - DNA, 883 bp, Artificial Sequence
  chemically treated genomic DNA (Homo sapiens) CpG-island No: 14771
agaaattatttgttgagggggtcgggaattgacgattgagagttcgggtcgattgttagaagttgttgagaattagttttttttttaatttcggtcgacgagggtaggttgtgtcgggttttgtttcgtagtttttcggtagtagcgttttttagttcgagttcggttttcggttttttttttagttgtttttagcgcgcgtagcgtatatatatatatatatatatatatatatatatattttagcgcgcgttcgggaggatatggcgtgggtatcgatggggacgtagaaaggggttttgtgcgcggcggggcgttcgcgggggcgcggggagtattgatttgcggcgacgagttcggagcgttttcggtgcggtttatcgcgggtaacggtttttacgtttcggtttcggcgtttttagatcgttgttttgggtcgcgtgcggtttttttttcggggattgtcgggtttcgggttttcgggggttattttatagtcgcggggttcgcgcgttcgttcgtttcgttcggtttcgtcgtttcggttcggttcgttttgggtttagcgaggcggcggtcgaaggttgggagcgcgcgggagggagggcgcgggtagggaggcggggggcggggggcggggagggggagcggggagggggagcggggagcgggcgtcggggcgagagggcgagggggggcgcgcggtcggagtcgagtcgatcgggtcggcgtagagttttcgaggtggcggcggatgcgtcggtgtcgtcgcggttttgtcggcgtttttcgtttcgtttttattcgtttttcgttttcgtttcgttttcgtttcgagttcgcgttagcgtcggcgggattcgagttgttaatggtcggtatt

SEQ ID NO: 14772 - DNA, 883 bp, Artificial Sequence
  chemically treated genomic DNA (Homo sapiens) CpG-island No: 14772
aataccgaccattaacaactcgaatcccgccgacgctaacgcgaactcgaaacgaaaacgaaacgaaaacgaaaaacgaataaaaacgaaacgaaaaacgccgacaaaaccgcgacgacaccgacgcatccgccgccacctcgaaaactctacgccgacccgatcgactcgactccgaccgcgcgccccccctcgccctctcgccccgacgcccgctccccgctccccctccccgctccccctccccgccccccgccccccgcctccctacccgcgccctccctcccgcgcgctcccaaccttcgaccgccgcctcgctaaacccaaaacgaaccgaaccgaaacgacgaaaccgaacgaaacgaacgaacgcgcgaaccccgcgactataaaataacccccgaaaacccgaaacccgacaatccccgaaaaaaaaaccgcacgcgacccaaaacaacgatctaaaaacgccgaaaccgaaacgtaaaaaccgttacccgcgataaaccgcaccgaaaacgctccgaactcgtcgccgcaaatcaatactccccgcgcccccgcgaacgccccgccgcgcacaaaacccctttctacgtccccatcgatacccacgccatatcctcccgaacgcgcgctaaaatatatatatatatatatatatatatatatatatacgctacgcgcgctaaaaacaactaaaaaaaaaaccgaaaaccgaactcgaactaaaaaacgctactaccgaaaaactacgaaacaaaacccgacacaacctaccctcgtcgaccgaaattaaaaaaaaaactaattctcaacaacttctaacaatcgacccgaactctcaatcgtcaattcccgaccccctcaacaaataatttct

SEQ ID NO: 14773 - DNA, 591 bp, Artificial Sequence
  chemically treated genomic DNA (Homo sapiens) CpG-island No: 14773
ggtttttcgatttcgtagatgagggtagtgattttcgacgcgaaacgtcgttcggcgtcgattttagggagtattgtacgtttgatcgcgatatcgtggaggtggtgcgtatcgagtacgtgtatacgcggttttcgttatggttcgatacgttgtttattatttacgtggtgacgtttatttatagtcgttcggtgtagaaggtcgagttgacgcgtatggttaatacgttgttgtacgtgtttaatttttattggttggtggtggaggatgcgtcgcgtcggacgtcgttgatcgcgcgtttgttgcgcgatatcggttttaattatacgtatttgtacgtggagacgtttcgtaattataagttgcgcggagacgttcgcgatttacgtatttcgcggggtattatgtagcgtaatttggttttgcgttggttgcgcgagattttttcgcgtaattttagttagtttggcgtggtttatttcgtcgacgacgataatatttatagtttggagtttttcgaagaggtgagggagggttcgatagtgagtagcgggattttcggttgcggggagtggaggggtttttcga

SEQ ID NO: 14774 - DNA, 591 bp, Artificial Sequence
  chemically treated genomic DNA (Homo sapiens) CpG-island No: 14774
tcgaaaaacccctccactccccgcaaccgaaaatcccgctactcactatcgaaccctccctcacctcttcgaaaaactccaaactataaatattatcgtcgtcgacgaaataaaccacgccaaactaactaaaattacgcgaaaaaatctcgcgcaaccaacgcaaaaccaaattacgctacataataccccgcgaaatacgtaaatcgcgaacgtctccgcgcaacttataattacgaaacgtctccacgtacaaatacgtataattaaaaccgatatcgcgcaacaaacgcgcgatcaacgacgtccgacgcgacgcatcctccaccaccaaccaataaaaattaaacacgtacaacaacgtattaaccatacgcgtcaactcgaccttctacaccgaacgactataaataaacgtcaccacgtaaataataaacaacgtatcgaaccataacgaaaaccgcgtatacacgtactcgatacgcaccacctccacgatatcgcgatcaaacgtacaatactccctaaaatcgacgccgaacgacgtttcgcgtcgaaaatcactaccctcatctacgaaatcgaaaaacc

SEQ ID NO: 14775 - DNA, 591 bp, Artificial Sequence
  chemically treated genomic DNA (Homo sapiens) CpG-island No: 14775
tcgggaagtttttttatttttcgtagtcggaggtttcgttgtttattgtcgggtttttttttattttttcgaagagttttaggttgtaggtgttgtcgtcgtcggcgaagtagattacgttaggttggttggagttgcgcgggaaggtttcgcgtagttagcgtagggttaggttgcgttgtatggtgtttcgcgggatgcgtgggtcgcgggcgttttcgcgtagtttgtagttgcggggcgtttttacgtgtaggtgcgtgtagttgaggtcggtgtcgcgtagtaggcgcgcggttagcggcgttcggcgcggcgtattttttattattagttagtggaggttgggtacgtgtagtagcgtgttggttatgcgcgttagttcggttttttgtatcgggcggttgtaggtgggcgttattacgtggatggtgggtagcgtgtcggattatggcgggggtcgcgtgtatacgtattcggtgcgtattatttttacgatgtcgcggttagacgtgtagtattttttggggtcggcgtcgggcggcgtttcgcgtcgggggttattgtttttatttgcggagtcgggagatt

SEQ ID NO: 14776 - DNA, 591 bp, Artificial Sequence
  chemically treated genomic DNA (Homo sapiens) CpG-island No: 14776
aatctcccgactccgcaaataaaaacaataacccccgacgcgaaacgccgcccgacgccgaccccaaaaaatactacacgtctaaccgcgacatcgtaaaaataatacgcaccgaatacgtatacacgcgacccccgccataatccgacacgctacccaccatccacgtaataacgcccacctacaaccgcccgatacaaaaaaccgaactaacgcgcataaccaacacgctactacacgtacccaacctccactaactaataataaaaaatacgccgcgccgaacgccgctaaccgcgcgcctactacgcgacaccgacctcaactacacgcacctacacgtaaaaacgccccgcaactacaaactacgcgaaaacgcccgcgacccacgcatcccgcgaaacaccatacaacgcaacctaaccctacgctaactacgcgaaaccttcccgcgcaactccaaccaacctaacgtaatctacttcgccgacgacgacaacacctacaacctaaaactcttcgaaaaaataaaaaaaaacccgacaataaacaacgaaacctccgactacgaaaaataaaaaaacttcccga

SEQ ID NO: 14777 - DNA, 582 bp, Artificial Sequence
  chemically treated genomic DNA (Homo sapiens) CpG-island No: 14777
tgcgggtcggttttcgtcggaggttttacgtggttatcgcgtgttttttaagcgcggggattcgggtttttattttagttcgtatttagtcgcgcgcgggagtttcgtcgcggggggcggagtcgcgcgttggtcgtttgggtaatcggttcgtcggcgtttattggttggggttcgcggtttcgcgtttgtagttttaggtttcgcgtaggcgggggcggggttggtcggggtcggggcggggtttttgtcgggggggggggcggggcggggttggtgggcggggcgaggtttcggtaggaaagggggttggcgggggcggggttggcggggcggggtttcggttaggggcggggcggggataaggtttcggtaggggaggggtttggtcggggcgggtttttagtgtcgtggagcggtgtagagttcgtcgtttttttgttcgcgaggcgtaggcgggtgcgggaatgttgcgtatttgttaaacgtcgaggtaaagtcgtttttcgtagcgttatattaggaagaacgtataaaaggcgttcgtaaagtaggggtaattaatagaattttttaaaataa

SEQ ID NO: 14778 - DNA, 582 bp, Artificial Sequence
  chemically treated genomic DNA (Homo sapiens) CpG-island No: 14778
ttattttaaaaaattctattaattacccctactttacgaacgccttttatacgttcttcctaatataacgctacgaaaaacgactttacctcgacgtttaacaaatacgcaacattcccgcacccgcctacgcctcgcgaacaaaaaaacgacgaactctacaccgctccacgacactaaaaacccgccccgaccaaacccctcccctaccgaaaccttatccccgccccgcccctaaccgaaaccccgccccgccaaccccgcccccgccaaccccctttcctaccgaaacctcgccccgcccaccaaccccgccccgcccccccccccgacaaaaaccccgccccgaccccgaccaaccccgcccccgcctacgcgaaacctaaaactacaaacgcgaaaccgcgaaccccaaccaataaacgccgacgaaccgattacccaaacgaccaacgcgcgactccgccccccgcgacgaaactcccgcgcgcgactaaatacgaactaaaataaaaacccgaatccccgcgcttaaaaaacacgcgataaccacgtaaaacctccgacgaaaaccgacccgca

SEQ ID NO: 14779 - DNA, 582 bp, Artificial Sequence
  chemically treated genomic DNA (Homo sapiens) CpG-island No: 14779
ttgttttaaaagattttgttggttgtttttgttttgcggacgttttttgtacgttttttttgatgtagcgttgcgaggggcgattttatttcggcgtttgataggtacgtagtattttcgtattcgtttgcgtttcgcgagtagaaagacggcggattttgtatcgttttacgatattggggattcgtttcggttagattttttttttatcgagattttgttttcgtttcgtttttggtcggggtttcgtttcgttagtttcgttttcgttagtttttttttttatcgagatttcgtttcgtttattagtttcgtttcgttttttttttcgatagaggtttcgtttcggtttcggttagtttcgttttcgtttgcgcgaggtttagggttgtaggcgcggagtcgcgagttttagttaatgagcgtcggcgggtcggttgtttaggcgattagcgcgcggtttcgtttttcgcggcgaggttttcgcgcgcggttgagtgcggattggagtgggaattcgggttttcgcgtttagagaatacgcgatgattacgtggagttttcggcggaggtcggttcgta

SEQ ID NO: 14780 - DNA, 582 bp, Artificial Sequence
  chemically treated genomic DNA (Homo sapiens) CpG-island No: 14780
tacgaaccgacctccgccgaaaactccacgtaatcatcgcgtattctctaaacgcgaaaacccgaattcccactccaatccgcactcaaccgcgcgcgaaaacctcgccgcgaaaaacgaaaccgcgcgctaatcgcctaaacaaccgacccgccgacgctcattaactaaaactcgcgactccgcgcctacaaccctaaacctcgcgcaaacgaaaacgaaactaaccgaaaccgaaacgaaacctctatcgaaaaaaaaaacgaaacgaaactaataaacgaaacgaaatctcgataaaaaaaaaaactaacgaaaacgaaactaacgaaacgaaaccccgaccaaaaacgaaacgaaaacaaaatctcgataaaaaaaaaatctaaccgaaacgaatccccaatatcgtaaaacgatacaaaatccgccgtctttctactcgcgaaacgcaaacgaatacgaaaatactacgtacctatcaaacgccgaaataaaatcgcccctcgcaacgctacatcaaaaaaaacgtacaaaaaacgtccgcaaaacaaaaacaaccaacaaaatcttttaaaacaa

SEQ ID NO: 14781 - DNA, 519 bp, Artificial Sequence
  chemically treated genomic DNA (Homo sapiens) CpG-island No: 14781
tttataacgtttattggttaatggttgcgtgaaattagtgcgaagtgggcgggatagagagcgtgggcgggggggttagtttcgtgcgggttttttaagtagcggttgcgtggtttttttggtacgttatttttacgacgttacggttaggtggtgtagagttggacggtaacgacgtcggacgcgtttttttttggaataatgttttattacggaggagtttttaaggtttttacgtgggtcgttgttagtcggcgaagttcgatagtgtttcgagcgttagagaggaggtcggcggaggagttgaatcgaataggttttgagggatatagtgtcggtagaggtggtcgttggagaggtatttttaggttttcggaggtcgtggtcgttggttacgaggaattgtcgttgtgttttgttttgaagagttattttgttggcgcggtaatcggtgagaatgggagtggttggtagggtaggataggtggggttaggggcggagtttgggcgaaggtattt

SEQ ID NO: 14782 - DNA, 519 bp, Artificial Sequence
  chemically treated genomic DNA (Homo sapiens) CpG-island No: 14782
aaataccttcgcccaaactccgcccctaaccccacctatcctaccctaccaaccactcccattctcaccgattaccgcgccaacaaaataactcttcaaaacaaaacacaacgacaattcctcgtaaccaacgaccacgacctccgaaaacctaaaaatacctctccaacgaccacctctaccgacactatatccctcaaaacctattcgattcaactcctccgccgacctcctctctaacgctcgaaacactatcgaacttcgccgactaacaacgacccacgtaaaaaccttaaaaactcctccgtaataaaacattattccaaaaaaaaacgcgtccgacgtcgttaccgtccaactctacaccacctaaccgtaacgtcgtaaaaataacgtaccaaaaaaaccacgcaaccgctacttaaaaaacccgcacgaaactaacccccccgcccacgctctctatcccgcccacttcgcactaatttcacgcaaccattaaccaataaacgttataaa

SEQ ID NO: 14783 - DNA, 519 bp, Artificial Sequence
  chemically treated genomic DNA (Homo sapiens) CpG-island No: 14783
aaatgttttcgtttaggtttcgtttttggttttatttattttgttttgttagttatttttatttttatcgattatcgcgttaataaagtggttttttaaagtaaaatatagcggtagtttttcgtgattagcggttacggttttcgggggtttagaggtgtttttttagcgattatttttgtcgatattatattttttaggatttgttcgatttaattttttcgtcggttttttttttggcgttcgggatattgtcgagtttcgtcgattagtaacgatttacgtagaggttttgggagttttttcgtggtgggatattgttttaagaaggggcgcgttcgacgtcgttgtcgtttagttttgtattatttgatcgtgacgtcgtaagagtagcgtgttagggaagttacgtagtcgttatttaaggagttcgtacgaggttagttttttcgtttacgttttttatttcgtttatttcgtattgattttacgtagttattggttagtgagcgttgtggg

SEQ ID NO: 14784 - DNA, 519 bp, Artificial Sequence
  chemically treated genomic DNA (Homo sapiens) CpG-island No: 14784
cccacaacgctcactaaccaataactacgtaaaatcaatacgaaataaacgaaataaaaaacgtaaacgaaaaaactaacctcgtacgaactccttaaataacgactacgtaacttccctaacacgctactcttacgacgtcacgatcaaataatacaaaactaaacgacaacgacgtcgaacgcgccccttcttaaaacaatatcccaccacgaaaaaactcccaaaacctctacgtaaatcgttactaatcgacgaaactcgacaatatcccgaacgccaaaaaaaaaaccgacgaaaaaattaaatcgaacaaatcctaaaaaatataatatcgacaaaaataatcgctaaaaaaacacctctaaacccccgaaaaccgtaaccgctaatcacgaaaaactaccgctatattttactttaaaaaaccactttattaacgcgataatcgataaaaataaaaataactaacaaaacaaaataaataaaaccaaaaacgaaacctaaacgaaaacattt

SEQ ID NO: 14785 - DNA, 537 bp, Artificial Sequence
  chemically treated genomic DNA (Homo sapiens) CpG-island No: 14785
ttcggcgtgacgttattttagcgggcgattaatgggagtgcggtttattggtaggcggcgtaggcggtcgttgttaaaggggaagtgatttggggttggagcgatggttcggggttggagttcgcggtcgtcgtcgtcgtagtcgtcgttattaacgttaataataacgtgtcgggagtagtcgcggtcgaagtcggagtaggggtcggagtcgcggttggagtggggtttgcgcgtgtgagtggtcgagagttgttcgtgtcggagattttaaatttcgggcgggagcgttttcggtcggtcgagtcgtcgtcgttcgcggtatcgtgtttttaaggtttagatagcggggcgggggtttattaggcgcgggattggttttttttaggtcgatttttttagtcgggtttcggatttttttcggtttcgggttttttttacgtttaggacggaggtcggagaacggtgattattatatattttagtcggttttttggttagggtattttttttgcggttaagtagtgttgggattgt

SEQ ID NO: 14786 - DNA, 537 bp, Artificial Sequence
  chemically treated genomic DNA (Homo sapiens) CpG-island No: 14786
acaatcccaacactacttaaccgcaaaaaaaataccctaaccaaaaaaccgactaaaatatataataatcaccgttctccgacctccgtcctaaacgtaaaaaaaacccgaaaccgaaaaaaatccgaaacccgactaaaaaaatcgacctaaaaaaaaccaatcccgcgcctaataaacccccgccccgctatctaaaccttaaaaacacgataccgcgaacgacgacgactcgaccgaccgaaaacgctcccgcccgaaatttaaaatctccgacacgaacaactctcgaccactcacacgcgcaaaccccactccaaccgcgactccgacccctactccgacttcgaccgcgactactcccgacacgttattattaacgttaataacgacgactacgacgacgacgaccgcgaactccaaccccgaaccatcgctccaaccccaaatcacttcccctttaacaacgaccgcctacgccgcctaccaataaaccgcactcccattaatcgcccgctaaaataacgtcacgccgaa

SEQ ID NO: 14787 - DNA, 537 bp, Artificial Sequence
  chemically treated genomic DNA (Homo sapiens) CpG-island No: 14787
ataattttaatattgtttggtcgtagagaaaatgttttggttaggaagtcggttggggtgtgtgatgattatcgtttttcggttttcgttttgaacgtgaagggggttcgaggtcgaggaagattcggagttcggttagaagggtcggtttgagagaagttagtttcgcgtttgatagattttcgtttcgttgtttgggttttggggatacggtgtcgcgggcgacggcggttcggtcgatcgaaagcgttttcgttcggagtttgaggttttcggtacgggtaattttcggttatttatacgcgtaggttttattttagtcgcgatttcggtttttgtttcggtttcggtcgcggttgttttcgatacgttgttgttggcgttggtggcggcggttgcggcggcggcggtcgcgagttttagtttcgggttatcgttttagttttagattattttttttttggtagcggtcgtttgcgtcgtttgttagtaagtcgtatttttattggtcgttcgttggggtgacgttacgtcggg

SEQ ID NO: 14788 - DNA, 537 bp, Artificial Sequence
  chemically treated genomic DNA (Homo sapiens) CpG-island No: 14788
cccgacgtaacgtcaccccaacgaacgaccaataaaaatacgacttactaacaaacgacgcaaacgaccgctaccaaaaaaaaaataatctaaaactaaaacgataacccgaaactaaaactcgcgaccgccgccgccgcaaccgccgccaccaacgccaacaacaacgtatcgaaaacaaccgcgaccgaaaccgaaacaaaaaccgaaatcgcgactaaaataaaacctacgcgtataaataaccgaaaattacccgtaccgaaaacctcaaactccgaacgaaaacgctttcgatcgaccgaaccgccgtcgcccgcgacaccgtatccccaaaacccaaacaacgaaacgaaaatctatcaaacgcgaaactaacttctctcaaaccgacccttctaaccgaactccgaatcttcctcgacctcgaacccccttcacgttcaaaacgaaaaccgaaaaacgataatcatcacacaccccaaccgacttcctaaccaaaacattttctctacgaccaaacaatattaaaattat

SEQ ID NO: 14789 - DNA, 1137 bp, Artificial Sequence
  chemically treated genomic DNA (Homo sapiens) CpG-island No: 14789
ggtagggcgcgggtttaaggggtttcgggagtttttttcggggtcgggtcgggacgcggttggtgagtttcggtttcggtttttgaattggggggttcgcgtttgttttaaacgtcgttttttttcgttttttatgttattttttgtattaataagatggtggttaaagtaggggaggagagtagtagcgagtcgtcgtcgtcgtcgcgtcgaggttggcgttgaaattttgtttcgtcggggattagcgcgttcgtagcgcggtcgttttcgtcgcgggggtcgttagtcgaggtcgcgtcgttttcgtcgagtcgttcgtcgggtcgttttcgtcgttcgggtttcgcggttgtcgtagtattttcgggaaggtgagttagtttcggtagttaatgtggttattgaaaatggtttcggagagcgttcggtagtttgttagcgagcgcgggggtcgtcggtgcgggggtcgggagcggcggttgggggcgggggcggtcgggggtttcggcgcgggcgcggggcgggggttcggacggcgtcggcgcggggtggggggcggttcgtcgtggtcgcgaggtgggtgaattttcggtaggtagttgtcgtcgtcgcgggagtcgggggtcgtttttcgtttttttttttttagttcgttcgtttttcgttttgttataatgtagtttttttttttcgtaagcggcgcgttcgttgacggacgtggtcgtcgattaatgggagtggcggttcgggtcgagcgttcggaatgagaacgcggtgatacggacggggcggggcgcggacgtcgacgttagagggttcgtcgcggtcgtcggtttagttttcgcggacgttttcggtttcgcgtcgggggttgttgcggggtgttcggggatgaaggtgggaggcgttttttgggatgcgacgaagttttttttatcgcggttcgcgattgttcgcgaagcgtggtcgagtcggagggtatttttggaatgcgttttaagtgttagttgcggtgtagatttttcgggaaattttttcggagcgtagtttttattttttattcgtagtttttaaggtatttttttatgtagaaattgtagaaatttagcggttaatgattttttttcggttaag

SEQ ID NO: 14790 - DNA, 1137 bp, Artificial Sequence
  chemically treated genomic DNA (Homo sapiens) CpG-island No: 14790
cttaaccgaaaaaaaatcattaaccgctaaatttctacaatttctacataaaaaaataccttaaaaactacgaataaaaaataaaaactacgctccgaaaaaatttcccgaaaaatctacaccgcaactaacacttaaaacgcattccaaaaataccctccgactcgaccacgcttcgcgaacaatcgcgaaccgcgataaaaaaaacttcgtcgcatcccaaaaaacgcctcccaccttcatccccgaacaccccgcaacaacccccgacgcgaaaccgaaaacgtccgcgaaaactaaaccgacgaccgcgacgaaccctctaacgtcgacgtccgcgccccgccccgtccgtatcaccgcgttctcattccgaacgctcgacccgaaccgccactcccattaatcgacgaccacgtccgtcaacgaacgcgccgcttacgaaaaaaaaaaactacattataacaaaacgaaaaacgaacgaactaaaaaaaaaaaaacgaaaaacgacccccgactcccgcgacgacgacaactacctaccgaaaattcacccacctcgcgaccacgacgaaccgccccccaccccgcgccgacgccgtccgaacccccgccccgcgcccgcgccgaaacccccgaccgcccccgcccccaaccgccgctcccgacccccgcaccgacgacccccgcgctcgctaacaaactaccgaacgctctccgaaaccattttcaataaccacattaactaccgaaactaactcaccttcccgaaaatactacgacaaccgcgaaacccgaacgacgaaaacgacccgacgaacgactcgacgaaaacgacgcgacctcgactaacgacccccgcgacgaaaacgaccgcgctacgaacgcgctaatccccgacgaaacaaaatttcaacgccaacctcgacgcgacgacgacgacgactcgctactactctcctcccctactttaaccaccatcttattaatacaaaaaataacataaaaaacgaaaaaaaacgacgtttaaaacaaacgcgaaccccccaattcaaaaaccgaaaccgaaactcaccaaccgcgtcccgacccgaccccgaaaaaaactcccgaaaccccttaaacccgcgccctacc

SEQ ID NO: 14791 - DNA, 1137 bp, Artificial Sequence
  chemically treated genomic DNA (Homo sapiens) CpG-island No: 14791
tttgatcggagagaggttattggtcgttaagtttttgtagtttttgtataggagagtattttggggattgcgagtggggggtggaggttacgtttcggagaggtttttcgaagagtttatatcgtaattgatatttaaaacgtattttagaaatgtttttcggttcggttacgtttcgcgggtaatcgcgaatcgcgatggagaaggtttcgtcgtattttaaaggacgttttttatttttattttcgagtatttcgtagtagttttcggcgcggggtcgagggcgttcgcgagaattaggtcggcggtcgcggcgagttttttggcgtcggcgttcgcgtttcgtttcgttcgtgttatcgcgtttttatttcgagcgttcggttcgggtcgttatttttattggtcggcggttacgttcgttagcgggcgcgtcgtttgcggagagaaaaggttatattgtaataaggcgaggagcgagcgagttgggaggaaggaggcggagggcggttttcggttttcgcggcggcggtagttatttgtcgagggtttatttatttcgcggttacggcgggtcgttttttatttcgcgtcggcgtcgttcggattttcgtttcgcgttcgcgtcgagattttcggtcgttttcgtttttagtcgtcgttttcggttttcgtatcggcggttttcgcgttcgttggtaaattgtcgagcgtttttcgaagttatttttaatggttatattggttatcggggttgatttattttttcgggaatgttgcggtagtcgcggggttcgggcggcgagagcggttcggcgggcggttcggcggaggcggcgcggtttcggttggcggttttcgcggcgggagcggtcgcgttgcgggcgcgttggttttcggcgaggtaaagttttagcgttagtttcggcgcggcggcggcggcgattcgttgttgttttttttttttgttttgattattattttattagtataggaaatgatatggaaaacggaagaaagcggcgtttggggtagacgcggattttttaatttaggggtcggagtcgagatttattagtcgcgtttcgattcggtttcggagaaaattttcggggttttttaggttcgcgttttgtt

SEQ ID NO: 14792 - DNA, 1137 bp, Artificial Sequence
  chemically treated genomic DNA (Homo sapiens) CpG-island No: 14792
aacaaaacgcgaacctaaaaaaccccgaaaattttctccgaaaccgaatcgaaacgcgactaataaatctcgactccgacccctaaattaaaaaatccgcgtctaccccaaacgccgctttcttccgttttccatatcatttcctatactaataaaataataatcaaaacaaaaaaaaaaaacaacaacgaatcgccgccgccgccgcgccgaaactaacgctaaaactttacctcgccgaaaaccaacgcgcccgcaacgcgaccgctcccgccgcgaaaaccgccaaccgaaaccgcgccgcctccgccgaaccgcccgccgaaccgctctcgccgcccgaaccccgcgactaccgcaacattcccgaaaaaataaatcaaccccgataaccaatataaccattaaaaataacttcgaaaaacgctcgacaatttaccaacgaacgcgaaaaccgccgatacgaaaaccgaaaacgacgactaaaaacgaaaacgaccgaaaatctcgacgcgaacgcgaaacgaaaatccgaacgacgccgacgcgaaataaaaaacgacccgccgtaaccgcgaaataaataaaccctcgacaaataactaccgccgccgcgaaaaccgaaaaccgccctccgcctccttcctcccaactcgctcgctcctcgccttattacaatataaccttttctctccgcaaacgacgcgcccgctaacgaacgtaaccgccgaccaataaaaataacgacccgaaccgaacgctcgaaataaaaacgcgataacacgaacgaaacgaaacgcgaacgccgacgccaaaaaactcgccgcgaccgccgacctaattctcgcgaacgccctcgaccccgcgccgaaaactactacgaaatactcgaaaataaaaataaaaaacgtcctttaaaatacgacgaaaccttctccatcgcgattcgcgattacccgcgaaacgtaaccgaaccgaaaaacatttctaaaatacgttttaaatatcaattacgatataaactcttcgaaaaacctctccgaaacgtaacctccaccccccactcgcaatccccaaaatactctcctatacaaaaactacaaaaacttaacgaccaataacctctctccgatcaaa

SEQ ID NO: 14793 - DNA, 687 bp, Artificial Sequence
  chemically treated genomic DNA (Homo sapiens) CpG-island No: 14793
ggtcgcggttgagcgagcgggtgttcggtgttcgtacgggtggtagcgtaggttttgtcgtcgtcgttatattaaggtagttcggaggttggggatattcgttcggttttcgcggcgttgtcgtttagttttggtatttttcgggtcgagtgcgtatcgggtttcgtgggaggttttggaatgcgtttatcgtttgattcggagcgatttttcgcggcgtttttttttatcgtttcgttcgggcgttcgttttttttcgttttttgcgcgtttttttttcggtcgttagttaattgcgtgtttttagggtcggtaagaagttatatgttttcgtaaggaatgtcgggtttggcgggcggggggcgggcgttgggtagggtcgggcgggtcgggtcgggtagggagtttttcgtcgggaaggttggcgagagggggagagttcgttcgcgttcgtttcggtcgtagtttatatcggttcgagacggggcggttacggggtagggggcggcgcgttcggtttgggtagttttttttttttttatcgcgcgttttcggttttgttggttcggaggagggggtaggtcgttacgttttttcgtattttttttagtcgtcgtcgtcggttttggggtttcggtggggagtagggggttgattagtcgaggagtaggggtgtggttagcgggg

SEQ ID NO: 14794 - DNA, 687 bp, Artificial Sequence
  chemically treated genomic DNA (Homo sapiens) CpG-island No: 14794
ccccgctaaccacacccctactcctcgactaatcaaccccctactccccaccgaaaccccaaaaccgacgacgacgactaaaaaaaatacgaaaaaacgtaacgacctaccccctcctccgaaccaacaaaaccgaaaacgcgcgataaaaaaaaaaaaaactacccaaaccgaacgcgccgccccctaccccgtaaccgccccgtctcgaaccgatataaactacgaccgaaacgaacgcgaacgaactctccccctctcgccaaccttcccgacgaaaaactccctacccgacccgacccgcccgaccctacccaacgcccgccccccgcccgccaaacccgacattccttacgaaaacatataacttcttaccgaccctaaaaacacgcaattaactaacgaccgaaaaaaaaacgcgcaaaaaacgaaaaaaaacgaacgcccgaacgaaacgataaaaaaaaacgccgcgaaaaatcgctccgaatcaaacgataaacgcattccaaaacctcccacgaaacccgatacgcactcgacccgaaaaataccaaaactaaacgacaacgccgcgaaaaccgaacgaatatccccaacctccgaactaccttaatataacgacgacgacaaaacctacgctaccacccgtacgaacaccgaacacccgctcgctcaaccgcgacc

SEQ ID NO: 14795 - DNA, 687 bp, Artificial Sequence
  chemically treated genomic DNA (Homo sapiens) CpG-island No: 14795
tttcgttggttatatttttgtttttcggttaattagttttttgttttttatcggggttttaaagtcggcggcggcgattgggaggggtgcggggaaacgtgacggtttgttttttttttcgagttagtagggtcgggggcgcgcggtggggaaggggagggttgtttaggtcgggcgcgtcgttttttgtttcgtggtcgtttcgtttcgggtcggtgtaggttgcggtcggggcgggcgcgggcgggttttttttttttcgttagttttttcggcggggagttttttgttcggttcggttcgttcggttttgtttagcgttcgtttttcgttcgttaggttcggtattttttgcgggggtatgtggttttttgtcggttttgggggtacgtagttggttggcggtcgggaggggggcgcgtagggagcgggaggaagcgggcgttcgggcggggcggtgggagagggcgtcgcggggggtcgtttcgggttaggcggtggacgtattttagggttttttacggggttcgatgcgtattcggttcggggggtgttagggttgggcgatagcgtcgcggaggtcgggcgggtgtttttagttttcgagttgttttggtgtggcggcgacgatagggtttgcgttgttattcgtgcggatatcggatattcgttcgtttagtcgcggtt

SEQ ID NO: 14796 - DNA, 687 bp, Artificial Sequence
  chemically treated genomic DNA (Homo sapiens) CpG-island No: 14796
aaccgcgactaaacgaacgaatatccgatatccgcacgaataacaacgcaaaccctatcgtcgccgccacaccaaaacaactcgaaaactaaaaacacccgcccgacctccgcgacgctatcgcccaaccctaacaccccccgaaccgaatacgcatcgaaccccgtaaaaaaccctaaaatacgtccaccgcctaacccgaaacgaccccccgcgacgccctctcccaccgccccgcccgaacgcccgcttcctcccgctccctacgcgcccccctcccgaccgccaaccaactacgtacccccaaaaccgacaaaaaaccacatacccccgcaaaaaataccgaacctaacgaacgaaaaacgaacgctaaacaaaaccgaacgaaccgaaccgaacaaaaaactccccgccgaaaaaactaacgaaaaaaaaaaaacccgcccgcgcccgccccgaccgcaacctacaccgacccgaaacgaaacgaccacgaaacaaaaaacgacgcgcccgacctaaacaaccctccccttccccaccgcgcgcccccgaccctactaactcgaaaaaaaaaacaaaccgtcacgtttccccgcacccctcccaatcgccgccgccgactttaaaaccccgataaaaaacaaaaaactaattaaccgaaaaacaaaaatataaccaacgaaa

SEQ ID NO: 14797 - DNA, 1063 bp, Artificial Sequence
  chemically treated genomic DNA (Homo sapiens) CpG-island No: 14797
gttagacgtttttcggttttgtagtatttaataaaaattgagaaatatttgggttgaaatcgttgttttatttggaggagttatagcgtcgggagagattattgttgcgcggggggagttcggggttttagtggttcgggtacgcggggtcgtcgcgttttagcgttcgcgttgttttcgggtgattttacgggcgcggtgtggggatttcgggttcgcggcggcgcgcggtcgtcgggggtcgggacgcgcgcggggggcggtggtttggcgaggtttttttcgcgttcgcggtttaggtgggtcgtgtttagcgttggcggagttcgggttttcgttttgttcgggttggatggtttattttgttggttgcgcggtggcggcggttgtgtgtgcgtcgcgttttgtcgttttttttggtttttcgagttcggggcgcgcgttttcgttcgggtcgttcgggtttcgcggcgtcgcggttcgaggtttcgggaagcgtagttatggttttgcggaggttgggggtcgcgttgttgttgttgtcgttgttcgtcgtcgtggaaggtgagcgagcgggcgggcgggcgggcgatgggggcggggagcggtcgggtacgggcggtcgtcggcgtttattttcgtttcgcggttcgtaaagtttgttcgggggtcggcgtcgggcgtaggtggtcgcggggaggtgtgttcggtcgcgtcgggaggagcgggtttcgcgggcgttcggggagcggcgggcgttgattgattgtgttaggaggaggcgaagggattattttgtcgaggttttgtagttagttcggcgagcgtcgtttagggttgggggttgtttacgcgcgttcgtcgttttcggttcgggtagtcgtttcgcgtcggtttggttttgtttcgtatagggtggaggggcgcgggttcggtcgtggcggggggcggggggggcgtcggcgttcggtcggggttggaaagtttggtagggagtagagggagggaggtatcgttttcggtcggggtgggggttttaggttcgcgtttttcgagatggggt

SEQ ID NO: 14798 - DNA, 1063 bp, Artificial Sequence
  chemically treated genomic DNA (Homo sapiens) CpG-island No: 14798
accccatctcgaaaaacgcgaacctaaaacccccaccccgaccgaaaacgatacctccctccctctactccctaccaaactttccaaccccgaccgaacgccgacgccccccccgccccccgccacgaccgaacccgcgcccctccaccctatacgaaacaaaaccaaaccgacgcgaaacgactacccgaaccgaaaacgacgaacgcgcgtaaacaacccccaaccctaaacgacgctcgccgaactaactacaaaacctcgacaaaataatcccttcgcctcctcctaacacaatcaatcaacgcccgccgctccccgaacgcccgcgaaacccgctcctcccgacgcgaccgaacacacctccccgcgaccacctacgcccgacgccgacccccgaacaaactttacgaaccgcgaaacgaaaataaacgccgacgaccgcccgtacccgaccgctccccgcccccatcgcccgcccgcccgcccgctcgctcaccttccacgacgacgaacaacgacaacaacaacaacgcgacccccaacctccgcaaaaccataactacgcttcccgaaacctcgaaccgcgacgccgcgaaacccgaacgacccgaacgaaaacgcgcgccccgaactcgaaaaaccaaaaaaaacgacaaaacgcgacgcacacacaaccgccgccaccgcgcaaccaacaaaataaaccatccaacccgaacaaaacgaaaacccgaactccgccaacgctaaacacgacccacctaaaccgcgaacgcgaaaaaaacctcgccaaaccaccgccccccgcgcgcgtcccgacccccgacgaccgcgcgccgccgcgaacccgaaatccccacaccgcgcccgtaaaatcacccgaaaacaacgcgaacgctaaaacgcgacgaccccgcgtacccgaaccactaaaaccccgaactccccccgcgcaacaataatctctcccgacgctataactcctccaaataaaacaacgatttcaacccaaatatttctcaatttttattaaatactacaaaaccgaaaaacgtctaac

SEQ ID NO: 14799 - DNA, 1063 bp, Artificial Sequence
  chemically treated genomic DNA (Homo sapiens) CpG-island No: 14799
gttttatttcggggggcgcgggtttggagtttttatttcggtcgggggcggtgtttttttttttttgttttttgttaaattttttagtttcgatcgagcgtcggcgtttttttcgtttttcgttacggtcgggttcgcgtttttttattttgtgcggagtaagattaggtcggcgcgaggcggttgttcgagtcgggggcggcgagcgcgcgtgggtagtttttagttttgggcggcgttcgtcgggttggttataaagtttcggtaagatggttttttcgtttttttttggtatagttaattagcgttcgtcgtttttcgggcgttcgcggggttcgtttttttcggcgcggtcggatatattttttcgcggttatttgcgttcggcgtcggttttcgggtaaattttgcgggtcgcggagcggaggtgggcgtcggcggtcgttcgtgttcggtcgtttttcgtttttatcgttcgttcgttcgttcgttcgtttattttttacggcggcgagtagcggtagtagtagtagcgcggtttttagttttcgtagagttatggttgcgtttttcggggtttcgggtcgcggcgtcgcggggttcggacggttcgggcgggagcgcgcgtttcgggttcggggggttagggggggcggtaaggcgcggcgtatatatagtcgtcgttatcgcgtagttagtagaatgagttatttagttcgggtagaacggggattcgggtttcgttagcgttgggtacggtttatttgagtcgcgggcgcggggggagtttcgttaggttatcgtttttcgcgcgcgtttcggttttcggcggtcgcgcgtcgtcgcgagttcggggtttttatatcgcgttcgtagggttattcgggggtagcgcgggcgttggagcgcggcgatttcgcgtgttcgggttattgagatttcgggtttttttcgcgtagtagtggtttttttcggcgttgtggtttttttagataaagtagcgattttagtttaaatgttttttaatttttattgaatgttgtaaagtcggagagcgtttggt

SEQ ID NO: 14800 - DNA, 1063 bp, Artificial Sequence
  chemically treated genomic DNA (Homo sapiens) CpG-island No: 14800
accaaacgctctccgactttacaacattcaataaaaattaaaaaacatttaaactaaaatcgctactttatctaaaaaaaccacaacgccgaaaaaaaccactactacgcgaaaaaaacccgaaatctcaataacccgaacacgcgaaatcgccgcgctccaacgcccgcgctacccccgaataaccctacgaacgcgatataaaaaccccgaactcgcgacgacgcgcgaccgccgaaaaccgaaacgcgcgcgaaaaacgataacctaacgaaactccccccgcgcccgcgactcaaataaaccgtacccaacgctaacgaaacccgaatccccgttctacccgaactaaataactcattctactaactacgcgataacgacgactatatatacgccgcgccttaccgccccccctaaccccccgaacccgaaacgcgcgctcccgcccgaaccgtccgaaccccgcgacgccgcgacccgaaaccccgaaaaacgcaaccataactctacgaaaactaaaaaccgcgctactactactaccgctactcgccgccgtaaaaaataaacgaacgaacgaacgaacgaacgataaaaacgaaaaacgaccgaacacgaacgaccgccgacgcccacctccgctccgcgacccgcaaaatttacccgaaaaccgacgccgaacgcaaataaccgcgaaaaaatatatccgaccgcgccgaaaaaaacgaaccccgcgaacgcccgaaaaacgacgaacgctaattaactataccaaaaaaaaacgaaaaaaccatcttaccgaaactttataaccaacccgacgaacgccgcccaaaactaaaaactacccacgcgcgctcgccgcccccgactcgaacaaccgcctcgcgccgacctaatcttactccgcacaaaataaaaaaacgcgaacccgaccgtaacgaaaaacgaaaaaaacgccgacgctcgatcgaaactaaaaaatttaacaaaaaacaaaaaaaaaaaaacaccgcccccgaccgaaataaaaactccaaacccgcgccccccgaaataaaac

SEQ ID NO: 14801 - DNA, 506 bp, Artificial Sequence
  chemically treated genomic DNA (Homo sapiens) CpG-island No: 14801
gtcggttttcgttttttcgtttttcgagtcggcgtttggtcggcggtttttcggagtttttagagcgtcgtttttttttttttggaggtcgtgagtagttcgtcggggtgaggcggggtttagttgggttgtttgcgtttcgggcggcgggtttttagtttagattgcgttcggttttgaatgtggtcgtaggttggagggttagcgcggcgcgaggcgggtagggtgggtgggttgggattggagatttttgttcgaggtttcggaagcgaggatgttgcggggtgggtgtcgcgttgtttttcgggcgagggaaacgtggcgataacgggttcggtacgtttagagggaggttgggaggcggagatttggcggtagaaggtgtcgagggagtttagttatttgcgaggtttcgtaggtaggcgggcgtgtgttttttttatcgtgtgttattttgattattcgtttgttagggttagcgagtcgaggttaggattttgagttgt

SEQ ID NO: 14802 - DNA, 506 bp, Artificial Sequence
  chemically treated genomic DNA (Homo sapiens) CpG-island No: 14802
acaactcaaaatcctaacctcgactcgctaaccctaacaaacgaataatcaaaataacacacgataaaaaaaacacacgcccgcctacctacgaaacctcgcaaataactaaactccctcgacaccttctaccgccaaatctccgcctcccaacctccctctaaacgtaccgaacccgttatcgccacgtttccctcgcccgaaaaacaacgcgacacccaccccgcaacatcctcgcttccgaaacctcgaacaaaaatctccaatcccaacccacccaccctacccgcctcgcgccgcgctaaccctccaacctacgaccacattcaaaaccgaacgcaatctaaactaaaaacccgccgcccgaaacgcaaacaacccaactaaaccccgcctcaccccgacgaactactcacgacctccaaaaaaaaaaaaacgacgctctaaaaactccgaaaaaccgccgaccaaacgccgactcgaaaaacgaaaaaacgaaaaccgac

SEQ ID NO: 14803 - DNA, 506 bp, Artificial Sequence
  chemically treated genomic DNA (Homo sapiens) CpG-island No: 14803
atagtttaggattttggtttcggttcgttggttttgataggcgggtggttagggtgatatacggtgggaagaatatacgttcgtttgtttgcgaagtttcgtaaatagttgggttttttcggtattttttgtcgttaggttttcgttttttaatttttttttgggcgtatcgagttcgttgtcgttacgtttttttcgttcgggaggtaacgcggtatttatttcgtagtattttcgttttcggggtttcgggtaagggtttttagttttagtttatttattttgttcgtttcgcgtcgcgttggttttttagtttgcggttatatttaaggtcgagcgtagtttgggttggaaattcgtcgttcggggcgtaggtagtttagttgggtttcgttttatttcgacgagttgtttacgatttttaaagggaagaaagcgacgttttgagaatttcgagaggtcgtcggttaagcgtcgattcggggggcgggggaacggaaatcgat

SEQ ID NO: 14804 - DNA, 506 bp, Artificial Sequence
  chemically treated genomic DNA (Homo sapiens) CpG-island No: 14804
atcgatttccgttcccccgccccccgaatcgacgcttaaccgacgacctctcgaaattctcaaaacgtcgctttcttccctttaaaaatcgtaaacaactcgtcgaaataaaacgaaacccaactaaactacctacgccccgaacgacgaatttccaacccaaactacgctcgaccttaaatataaccgcaaactaaaaaaccaacgcgacgcgaaacgaacaaaataaataaactaaaactaaaaacccttacccgaaaccccgaaaacgaaaatactacgaaataaataccgcgttacctcccgaacgaaaaaaacgtaacgacaacgaactcgatacgcccaaaaaaaaattaaaaaacgaaaacctaacgacaaaaaataccgaaaaaacccaactatttacgaaacttcgcaaacaaacgaacgtatattcttcccaccgtatatcaccctaaccacccgcctatcaaaaccaacgaaccgaaaccaaaatcctaaactat

SEQ ID NO: 14805 - DNA, 676 bp, Artificial Sequence
  chemically treated genomic DNA (Homo sapiens) CpG-island No: 14805
tttcgggtttcgtcggtgtttttttgtttttattgattcgtttgtaaatttttattcgttttgtttttttaggtcgcggtcgcggtttttcgattttttcggttatttggttttagtttgggatcgttttcgtttttagtcgttggaaagtatttttaggttggtggcgcggagtaagcgtcggttttaaggacgttcgaagtcgggagaaagagaatttggagtttgttcgcggtttttagttttttttcgcggagcgttcggtcgggagttttttgtattcgggttcgggtcggcgtgtttgtttttattttcgggttttttggcgtttttggcgtatagtttttcgttcgttcgttacggggttgggttcgcggcgattcgagttcgtagttcggttttttgtattcgaggataatgcgcggtcggttacgggtttaagcgcggcgaggcggcggcggcggcggcggcggggttgagcgttggtcgggtaggggagcgggcggttcgcggggttttcgtagttttcgtgttcggtttcgtcgtttttcgcgttgtttcgtttcgcgttttttcggcgtttttttagtttttttttgtacgttttcgtcgtttttcgttgttttttgttttttttttttttgttgttttttttttttttttttttgttgttttt

SEQ ID NO: 14806 - DNA, 676 bp, Artificial Sequence
  chemically treated genomic DNA (Homo sapiens) CpG-island No: 14806
aaaaacaacaaaaaaaaaaaaaaaaaaaacaacaaaaaaaaaaaaaacaaaaaacaacgaaaaacgacgaaaacgtacaaaaaaaaactaaaaaaacgccgaaaaaacgcgaaacgaaacaacgcgaaaaacgacgaaaccgaacacgaaaactacgaaaaccccgcgaaccgcccgctcccctacccgaccaacgctcaaccccgccgccgccgccgccgccgcctcgccgcgcttaaacccgtaaccgaccgcgcattatcctcgaatacaaaaaaccgaactacgaactcgaatcgccgcgaacccaaccccgtaacgaacgaacgaaaaactatacgccaaaaacgccaaaaaacccgaaaataaaaacaaacacgccgacccgaacccgaatacaaaaaactcccgaccgaacgctccgcgaaaaaaaactaaaaaccgcgaacaaactccaaattctctttctcccgacttcgaacgtccttaaaaccgacgcttactccgcgccaccaacctaaaaatactttccaacgactaaaaacgaaaacgatcccaaactaaaaccaaataaccgaaaaaatcgaaaaaccgcgaccgcgacctaaaaaaacaaaacgaataaaaatttacaaacgaatcaataaaaacaaaaaaacaccgacgaaacccgaaa

SEQ ID NO: 14807 - DNA, 676 bp, Artificial Sequence
  chemically treated genomic DNA (Homo sapiens) CpG-island No: 14807
ggaggtagtagggaggagagagagggaggtagtagggaggagggaggtagggagtagcgagggacggcgggagcgtgtagagagaagttggggaagcgtcgggagagcgcggagcggagtagcgcgaggggcggcgaggtcgggtacggaggttgcgagagtttcgcgggtcgttcgtttttttgttcggttagcgtttagtttcgtcgtcgtcgtcgtcgtcgtttcgtcgcgtttgggttcgtggtcggtcgcgtattgttttcgggtgtaaggagtcgggttgcggattcgaatcgtcgcgggtttaatttcgtagcgggcgggcggggagttgtgcgttaggagcgttaggggattcgagaataggaataggtacgtcggttcgagttcgggtgtagaaggttttcggtcgggcgtttcgcggggagaggttgggaatcgcgggtaggttttaggttttttttttttcggtttcgggcgtttttggggtcggcgtttatttcgcgttattagtttggagatgttttttagcggttggaggcgggagcggttttaggttggggttaggtgatcggaggagtcgaggagtcgcggtcgcggtttggggaggtagggcgaatgagggtttgtagacggattagtggagataggggaatatcggcggggttcggga

SEQ ID NO: 14808 - DNA, 676 bp, Artificial Sequence
  chemically treated genomic DNA (Homo sapiens) CpG-island No: 14808
tcccgaaccccgccgatattcccctatctccactaatccgtctacaaaccctcattcgccctacctccccaaaccgcgaccgcgactcctcgactcctccgatcacctaaccccaacctaaaaccgctcccgcctccaaccgctaaaaaacatctccaaactaataacgcgaaataaacgccgaccccaaaaacgcccgaaaccgaaaaaaaaaaaacctaaaacctacccgcgattcccaacctctccccgcgaaacgcccgaccgaaaaccttctacacccgaactcgaaccgacgtacctattcctattctcgaatcccctaacgctcctaacgcacaactccccgcccgcccgctacgaaattaaacccgcgacgattcgaatccgcaacccgactccttacacccgaaaacaatacgcgaccgaccacgaacccaaacgcgacgaaacgacgacgacgacgacgacgaaactaaacgctaaccgaacaaaaaaacgaacgacccgcgaaactctcgcaacctccgtacccgacctcgccgcccctcgcgctactccgctccgcgctctcccgacgcttccccaacttctctctacacgctcccgccgtccctcgctactccctacctccctcctccctactacctccctctctctcctccctactacctcc

SEQ ID NO: 14809 - DNA, 1056 bp, Artificial Sequence
  chemically treated genomic DNA (Homo sapiens) CpG-island No: 14809
gacgtttcgtaataagtgaagttaaagtcggcgtttttttattagacggggttcgcgttcggggacgttagttcgattttcggtttttcgtaattcggttttaaaggtttaaaaataggtttagcgtggcggtcggggtcggggcgggcggcggaggagtcgggcggaggtcgtagtattttcgtttcggagtttttgttttttggggtttcgggtcgttagaggtcggggtagttttttacgatgtcgttgcgtttcggattttcgtttggaatttttaggggaatcggttttttatttttatacggtttcgtcgtagttgtttcgttcgtcggtttttcgtcgtgagagtaagaggaaggacgaggagacggaagtaggaacgagagtttcggtcgagggttcgggttttgttcggttgttttatttttgtattttggggggcggcggggcggtagttgacgtaggtagaaatacgttcggttgcggttagttagtaattttgcggcggtttcgttttgtcgggaatatttcggggttgagggcggaggagaagggaggcggcggttgggtaggaagtcggggtttcggggttggcggcggcgggttgcgcggcggtatttgttatggtgttgtcgggtgcgtaggcggtcggggtagttttaggttggtgatttagagaagtcggtatcgggagggagcgcggttagcgaggaggtacggcggggaatcgagcgtttgtttcgtgcgtttttatagcggtcgttacgtggtcgcgtacgttttcgttgtcgttcgtatttttttagttgcgcggtcggtaggggcggtggttcgcggggtttcgggtttcgcgtttttttcggttttttttttttttttcggggttaggttgtcgttgcggttgcggtttatcggcgtttttgtttttattttttcggggcgtttgtttttgttaatcgcgcgttttttgtcgtcgttaaatttgggagttaagggggattttggggttgagtgcggtattaaattttttaagaagttaagggttagggaatt

SEQ ID NO: 14810 - DNA, 1056 bp, Artificial Sequence
  chemically treated genomic DNA (Homo sapiens) CpG-island No: 14810
aattccctaacccttaacttcttaaaaaatttaataccgcactcaaccccaaaatcccccttaactcccaaatttaacgacgacaaaaaacgcgcgattaacaaaaacaaacgccccgaaaaaataaaaacaaaaacgccgataaaccgcaaccgcaacgacaacctaaccccgaaaaaaaaaaaaaaaaccgaaaaaaacgcgaaacccgaaaccccgcgaaccaccgcccctaccgaccgcgcaactaaaaaaatacgaacgacaacgaaaacgtacgcgaccacgtaacgaccgctataaaaacgcacgaaacaaacgctcgattccccgccgtacctcctcgctaaccgcgctccctcccgataccgacttctctaaatcaccaacctaaaactaccccgaccgcctacgcacccgacaacaccataacaaataccgccgcgcaacccgccgccgccaaccccgaaaccccgacttcctacccaaccgccgcctcccttctcctccgccctcaaccccgaaatattcccgacaaaacgaaaccgccgcaaaattactaactaaccgcaaccgaacgtatttctacctacgtcaactaccgccccgccgccccccaaaatacaaaaataaaacaaccgaacaaaacccgaaccctcgaccgaaactctcgttcctacttccgtctcctcgtccttcctcttactctcacgacgaaaaaccgacgaacgaaacaactacgacgaaaccgtataaaaataaaaaaccgattcccctaaaaattccaaacgaaaatccgaaacgcaacgacatcgtaaaaaactaccccgacctctaacgacccgaaaccccaaaaaacaaaaactccgaaacgaaaatactacgacctccgcccgactcctccgccgcccgccccgaccccgaccgccacgctaaacctatttttaaacctttaaaaccgaattacgaaaaaccgaaaatcgaactaacgtccccgaacgcgaaccccgtctaataaaaaaacgccgactttaacttcacttattacgaaacgtc

SEQ ID NO: 14811 - DNA, 1056 bp, Artificial Sequence
  chemically treated genomic DNA (Homo sapiens) CpG-island No: 14811
ggttttttaatttttggttttttggggagtttgatgtcgtatttagttttaaagttttttttaatttttaggtttagcggcgatagggggcgcgcggttgataagggtaggcgtttcggggaagtaggagtaggggcgtcggtgagtcgtagtcgtagcggtagtttagtttcgagggagggaggaggagtcgagggagacgcgggattcggagtttcgcgggttatcgtttttgtcggtcgcgtagttgggaggatgcggacggtagcgagagcgtgcgcggttacgtgacggtcgttataagagcgtacggggtagacgttcggtttttcgtcgtgttttttcgttggtcgcgttttttttcggtgtcggtttttttgagttattaatttgaggttgtttcggtcgtttgcgtattcggtagtattatgataggtatcgtcgcgtagttcgtcgtcgttagtttcgggatttcggttttttgtttagtcgtcgttttttttttttttcgtttttagtttcggagtgttttcggtaggacgaaatcgtcgtaaagttgttggttggtcgtagtcgggcgtgtttttgtttgcgttagttgtcgtttcgtcgttttttagagtgtagggatggggtagtcgggtagagttcgggttttcggtcggagttttcgtttttgttttcgttttttcgtttttttttttgtttttacggcgaagggtcggcgggcggagtagttgcggcggggtcgtgtgggggtggggagtcggtttttttgggggttttaggcgggagttcggggcgtagcggtatcgtggggagttgtttcggtttttggcggttcggaattttaggaagtaggggtttcgaggcggggatattgcggttttcgttcggttttttcgtcgttcgtttcggtttcggtcgttacgttgagtttatttttaggtttttggggtcgggttgcgggaagtcgggagtcggattagcgttttcgggcgcgagtttcgtttggtgggagggcgtcggttttggttttatttgttgcgaggcgtt

SEQ ID NO: 14812 - DNA, 1056 bp, Artificial Sequence
  chemically treated genomic DNA (Homo sapiens) CpG-island No: 14812
aacgcctcgcaacaaataaaaccaaaaccgacgccctcccaccaaacgaaactcgcgcccgaaaacgctaatccgactcccgacttcccgcaacccgaccccaaaaacctaaaaataaactcaacgtaacgaccgaaaccgaaacgaacgacgaaaaaaccgaacgaaaaccgcaatatccccgcctcgaaacccctacttcctaaaattccgaaccgccaaaaaccgaaacaactccccacgataccgctacgccccgaactcccgcctaaaacccccaaaaaaaccgactccccacccccacacgaccccgccgcaactactccgcccgccgacccttcgccgtaaaaacaaaaaaaaaaacgaaaaaacgaaaacaaaaacgaaaactccgaccgaaaacccgaactctacccgactaccccatccctacactctaaaaaacgacgaaacgacaactaacgcaaacaaaaacacgcccgactacgaccaaccaacaactttacgacgatttcgtcctaccgaaaacactccgaaactaaaaacgaaaaaaaaaaaaaacgacgactaaacaaaaaaccgaaatcccgaaactaacgacgacgaactacgcgacgatacctatcataatactaccgaatacgcaaacgaccgaaacaacctcaaattaataactcaaaaaaaccgacaccgaaaaaaaacgcgaccaacgaaaaaacacgacgaaaaaccgaacgtctaccccgtacgctcttataacgaccgtcacgtaaccgcgcacgctctcgctaccgtccgcatcctcccaactacgcgaccgacaaaaacgataacccgcgaaactccgaatcccgcgtctccctcgactcctcctccctccctcgaaactaaactaccgctacgactacgactcaccgacgcccctactcctacttccccgaaacgcctacccttatcaaccgcgcgccccctatcgccgctaaacctaaaaattaaaaaaaactttaaaactaaatacgacatcaaactccccaaaaaaccaaaaattaaaaaacc

SEQ ID NO: 14813 - DNA, 689 bp, Artificial Sequence
  chemically treated genomic DNA (Homo sapiens) CpG-island No: 14813
tgttggtggcggcgttttcggtgttgacggttttttggtcgtttaataaagttggcggggaatttttatcgtagattaatgaaggcgatttgttgtatatgttatcgacgttgtcggggattttcgtagtagaggcggcgagtatgttgtaaaaaatcgataagttaattatgagcgtatttgaagtggcgcgggtatttggtaaaatcgggaaacggaaatcgttatcgattttgtttcgttggagatggtagaaacgattatttagtttaagtcgtaggagtagtggcggttaggtatgacgatggataaaattattgaggaattggataatatcgtgcggttgtcggggttggcgaatttgtgggtgtcgttaattcgtaatcgtatcgatatgtttttaatcggtattaaaagttttatcggtattaaagttttcggtattgtgttggcggatatcgacgcgatggttgagtaaattgaagaagtagcgcgaacggtgttaggcgtagtttttgcgttttcgagcggttggaaggtgggcgttatattaacgttgagattaatcgtgaaaaagtcgtacgttacggtatgacggtggcggatgtgtagttgtttgtgatttttgcggtgggcggggcgatggttggcgaaacggtggaagggattgttcgttatttaattaattt

SEQ ID NO: 14814 - DNA, 689 bp, Artificial Sequence
  chemically treated genomic DNA (Homo sapiens) CpG-island No: 14814
aaattaattaaataacgaacaatcccttccaccgtttcgccaaccatcgccccgcccaccgcaaaaatcacaaacaactacacatccgccaccgtcataccgtaacgtacgactttttcacgattaatctcaacgttaatataacgcccaccttccaaccgctcgaaaacgcaaaaactacgcctaacaccgttcgcgctacttcttcaatttactcaaccatcgcgtcgatatccgccaacacaataccgaaaactttaataccgataaaacttttaataccgattaaaaacatatcgatacgattacgaattaacgacacccacaaattcgccaaccccgacaaccgcacgatattatccaattcctcaataattttatccatcgtcatacctaaccgccactactcctacgacttaaactaaataatcgtttctaccatctccaacgaaacaaaatcgataacgatttccgtttcccgattttaccaaatacccgcgccacttcaaatacgctcataattaacttatcgattttttacaacatactcgccgcctctactacgaaaatccccgacaacgtcgataacatatacaacaaatcgccttcattaatctacgataaaaattccccgccaactttattaaacgaccaaaaaaccgtcaacaccgaaaacgccgccaccaaca

SEQ ID NO: 14815 - DNA, 689 bp, Artificial Sequence
  chemically treated genomic DNA (Homo sapiens) CpG-island No: 14815
agattaattggataacgggtaattttttttatcgtttcgttaattatcgtttcgtttatcgtagaagttataaataattgtatattcgttatcgttatatcgtaacgtgcggtttttttacggttaattttaacgttgatatagcgtttattttttagtcgttcggaagcgtagaagttacgtttggtatcgttcgcgttatttttttaatttgtttagttatcgcgtcgatattcgttagtatagtgtcggaaattttaatgtcgatggggtttttaatgtcggttgagagtatatcgatacggttacgaattggcggtatttatagattcgttagtttcggtagtcgtacggtgttatttagttttttaatgattttgtttatcgttatgtttggtcgttattgtttttgcggtttaagttggatggtcgtttttattatttttagcggagtagaatcggtggcggttttcgtttttcggttttgttaaatattcgcgttattttaggtacgtttataattagtttgtcggttttttgtagtatattcgtcgtttttgttgcggaaattttcggtagcgtcgatggtatatataataagtcgtttttattgatttgcggtaaaaatttttcgttaattttattgagcggttagagaatcgttagtatcgaaagcgtcgttattagta

SEQ ID NO: 14816 - DNA, 689 bp, Artificial Sequence
  chemically treated genomic DNA (Homo sapiens) CpG-island No: 14816
tactaataacgacgctttcgatactaacgattctctaaccgctcaataaaattaacgaaaaatttttaccgcaaatcaataaaaacgacttattatatataccatcgacgctaccgaaaatttccgcaacaaaaacgacgaatatactacaaaaaaccgacaaactaattataaacgtacctaaaataacgcgaatatttaacaaaaccgaaaaacgaaaaccgccaccgattctactccgctaaaaataataaaaacgaccatccaacttaaaccgcaaaaacaataacgaccaaacataacgataaacaaaatcattaaaaaactaaataacaccgtacgactaccgaaactaacgaatctataaataccgccaattcgtaaccgtatcgatatactctcaaccgacattaaaaaccccatcgacattaaaatttccgacactatactaacgaatatcgacgcgataactaaacaaattaaaaaaataacgcgaacgataccaaacgtaacttctacgcttccgaacgactaaaaaataaacgctatatcaacgttaaaattaaccgtaaaaaaaccgcacgttacgatataacgataacgaatatacaattatttataacttctacgataaacgaaacgataattaacgaaacgataaaaaaaattacccgttatccaattaatct

SEQ ID NO: 14817 - DNA, 503 bp, Artificial Sequence
  chemically treated genomic DNA (Homo sapiens) CpG-island No: 14817
gcgttacgttattacggagacgagtacgaaggtcgtggaggttatttcgatggttttggggttatcgaggagaatggtttttttatgaggttttagaggcggcgtttgcgggtcgtagaagcgtatgtcgcgaagagttttttcgttttttcgatttgcgtttgcgcgcgttcgtgttggattttgagtcgttcgtttagttcgtcgcgtcgtttttcgaagtagatgcgttagcgtggcgtgtatttgagtcgtacgttttagtagtttagtttttttaggaagcggcgcgtatatagttcgtcgagtattagtagtatttcggataggtagaaattgtagattagttggaagacggtcgggtcgcggtcgaagaagtattcgtttgtttgtttttcgtagtcgtcgtataggtttagttggcggttgcggttggtggaggtggttaggcgatttaggcgttttggggaagtcggttagttcgtagtagtttagttggtagt

SEQ ID NO: 14818 - DNA, 503 bp, Artificial Sequence
  chemically treated genomic DNA (Homo sapiens) CpG-island No: 14818
actaccaactaaactactacgaactaaccgacttccccaaaacgcctaaatcgcctaaccacctccaccaaccgcaaccgccaactaaacctatacgacgactacgaaaaacaaacaaacgaatacttcttcgaccgcgacccgaccgtcttccaactaatctacaatttctacctatccgaaatactactaatactcgacgaactatatacgcgccgcttcctaaaaaaactaaactactaaaacgtacgactcaaatacacgccacgctaacgcatctacttcgaaaaacgacgcgacgaactaaacgaacgactcaaaatccaacacgaacgcgcgcaaacgcaaatcgaaaaaacgaaaaaactcttcgcgacatacgcttctacgacccgcaaacgccgcctctaaaacctcataaaaaaaccattctcctcgataaccccaaaaccatcgaaataacctccacgaccttcgtactcgtctccgtaataacgtaacgc

SEQ ID NO: 14819 - DNA, 503 bp, Artificial Sequence
  chemically treated genomic DNA (Homo sapiens) CpG-island No: 14819
gttattagttggattattgcgagttggtcggtttttttaagacgtttaggtcgtttggttatttttattagtcgtagtcgttagttaagtttgtgcgacgattacgaggagtagatagacgaatattttttcgatcgcgattcggtcgttttttagttggtttataatttttatttgttcggggtgttgttggtgttcgacgggttgtgtacgcgtcgttttttggaggagttgggttattggggcgtgcggtttaagtatacgttacgttggcgtatttgtttcgaggagcggcgcgacgagttgagcgaacggtttaagatttagtacgagcgcgcgtaggcgtaggtcgaggaggcggaggaatttttcgcgatatgcgtttttacggttcgtaggcgtcgtttttggaattttatggagaagttatttttttcggtggttttaaggttatcggggtggtttttacgattttcgtgttcgttttcgtggtggcgtggcgt

SEQ ID NO: 14820 - DNA, 503 bp, Artificial Sequence
  chemically treated genomic DNA (Homo sapiens) CpG-island No: 14820
acgccacgccaccacgaaaacgaacacgaaaatcgtaaaaaccaccccgataaccttaaaaccaccgaaaaaaataacttctccataaaattccaaaaacgacgcctacgaaccgtaaaaacgcatatcgcgaaaaattcctccgcctcctcgacctacgcctacgcgcgctcgtactaaatcttaaaccgttcgctcaactcgtcgcgccgctcctcgaaacaaatacgccaacgtaacgtatacttaaaccgcacgccccaataacccaactcctccaaaaaacgacgcgtacacaacccgtcgaacaccaacaacaccccgaacaaataaaaattataaaccaactaaaaaacgaccgaatcgcgatcgaaaaaatattcgtctatctactcctcgtaatcgtcgcacaaacttaactaacgactacgactaataaaaataaccaaacgacctaaacgtcttaaaaaaaccgaccaactcgcaataatccaactaataac

SEQ ID NO: 14821 - DNA, 518 bp, Artificial Sequence
  chemically treated genomic DNA (Homo sapiens) CpG-island No: 14821
cggtagcggatattcgtatcggcgcggcgaagtagcggggtgagtagcggggagggggtcggaggggcgtggttaacgggaggcgcggcgggcgggcgggacgcggcggttttcggtttttttttttttcgacgcgttttttttgtacgcgtcgggtagtcgggtgttcgcgcggggagcgtgtcgagtgtgagcgtgcgtgagtgatcgcggtcgtggtcgtgtgtcgtcgtcgttattcggatcgttttaggggttcggttttcgcgtttttggggtttacgggggtcggggcgatcgttggttgtcgggtcgttttcgtttttaatttcgggtgtttgttttaattttttgatttagggaatttgtcgtagcgtgtgcgttttttatagttattattgtattttttcggtattcggagaatacgtagtagtagtagtagttagcgttgagattatcgttgttgttgttatcgtttttttattgacggggcgtgtatttggggggtatttgtagtt

SEQ ID NO: 14822 - DNA, 518 bp, Artificial Sequence
  chemically treated genomic DNA (Homo sapiens) CpG-island No: 14822
aactacaaataccccccaaatacacgccccgtcaataaaaaaacgataacaacaacaacgataatctcaacgctaactactactactactacgtattctccgaataccgaaaaaatacaataataactataaaaaacgcacacgctacgacaaattccctaaatcaaaaaattaaaacaaacacccgaaattaaaaacgaaaacgacccgacaaccaacgatcgccccgacccccgtaaaccccaaaaacgcgaaaaccgaacccctaaaacgatccgaataacgacgacgacacacgaccacgaccgcgatcactcacgcacgctcacactcgacacgctccccgcgcgaacacccgactacccgacgcgtacaaaaaaaacgcgtcgaaaaaaaaaaaaaccgaaaaccgccgcgtcccgcccgcccgccgcgcctcccgttaaccacgcccctccgaccccctccccgctactcaccccgctacttcgccgcgccgatacgaatatccgctaccg

SEQ ID NO: 14823 - DNA, 518 bp, Artificial Sequence
  chemically treated genomic DNA (Homo sapiens) CpG-island No: 14823
aattgtaagtattttttaggtgtacgtttcgttagtggggaggcggtggtaatagtaacgatagttttagcgttaattgttgttgttgttgcgtgtttttcgggtgtcgggagggtatagtaatgattgtagggagcgtatacgttgcggtaggttttttggattaggaaattaggataggtattcgggattggaggcgagggcggttcgataattagcggtcgtttcggttttcgtgagttttagaagcgcggaagtcgggtttttagagcggttcgggtggcggcggcggtatacgattacgatcgcggttatttacgtacgtttatattcgatacgtttttcgcgcgggtattcggttgttcggcgcgtgtaagaggagcgcgtcgagggaaaggagggtcgaagatcgtcgcgtttcgttcgttcgtcgcgtttttcgttgattacgttttttcggtttttttttcgttgtttatttcgttatttcgtcgcgtcggtgcgggtgttcgttatcg

SEQ ID NO: 14824 - DNA, 518 bp, Artificial Sequence
  chemically treated genomic DNA (Homo sapiens) CpG-island No: 14824
cgataacgaacacccgcaccgacgcgacgaaataacgaaataaacaacgaaaaaaaaaccgaaaaaacgtaatcaacgaaaaacgcgacgaacgaacgaaacgcgacgatcttcgaccctcctttccctcgacgcgctcctcttacacgcgccgaacaaccgaatacccgcgcgaaaaacgtatcgaatataaacgtacgtaaataaccgcgatcgtaatcgtataccgccgccgccacccgaaccgctctaaaaacccgacttccgcgcttctaaaactcacgaaaaccgaaacgaccgctaattatcgaaccgccctcgcctccaatcccgaatacctatcctaatttcctaatccaaaaaacctaccgcaacgtatacgctccctacaatcattactataccctcccgacacccgaaaaacacgcaacaacaacaacaattaacgctaaaactatcgttactattaccaccgcctccccactaacgaaacgtacacctaaaaaatacttacaatt

SEQ ID NO: 14825 - DNA, 584 bp, Artificial Sequence
  chemically treated genomic DNA (Homo sapiens) CpG-island No: 14825
cgcgggtagggaggacgtcgcgggagttcgggttcgaggttgggttgtggggttgcgggggcgtacgggcgaggtaggcggggcgcggggttttcgcggcggtataaagaggtcggtcgcggtagttttgaaaatattaaggaagttgatttgggtcggggtttaagaagtgacgaggagggagggaggtttgcgagcgagggaggaaaggagggagagggagaggagaaggcgggaaggagggagggaggaagggtgcgcggggcgaggggcggcggtagatttcgcggggttttagcgggaagcgcgggcggcggcgggatgcgcgttttgggcggcggggcgcggcgttaggcgttcggcggggtttttttaggttgcgatttcgcgggattttttatttttttcgtcgttttcgtagttcgcgcgtcggagtatgagtttcggtcggagttttacggtcgcgggcggcgtttaggacggcgattcgcgttttggaggattcgtcggtcgttcggttttattatagttttagtcgtttgtagcggggtttttttgaggttttagaggaagagattatgaaa

SEQ ID NO: 14826 - DNA, 584 bp, Artificial Sequence
  chemically treated genomic DNA (Homo sapiens) CpG-island No: 14826
tttcataatctcttcctctaaaacctcaaaaaaaccccgctacaaacgactaaaactataataaaaccgaacgaccgacgaatcctccaaaacgcgaatcgccgtcctaaacgccgcccgcgaccgtaaaactccgaccgaaactcatactccgacgcgcgaactacgaaaacgacgaaaaaaataaaaaatcccgcgaaatcgcaacctaaaaaaaccccgccgaacgcctaacgccgcgccccgccgcccaaaacgcgcatcccgccgccgcccgcgcttcccgctaaaaccccgcgaaatctaccgccgcccctcgccccgcgcacccttcctccctccctccttcccgccttctcctctccctctccctcctttcctccctcgctcgcaaacctccctccctcctcgtcacttcttaaaccccgacccaaatcaacttccttaatattttcaaaactaccgcgaccgacctctttataccgccgcgaaaaccccgcgccccgcctacctcgcccgtacgcccccgcaaccccacaacccaacctcgaacccgaactcccgcgacgtcctccctacccgcg

SEQ ID NO: 14827 - DNA, 584 bp, Artificial Sequence
  chemically treated genomic DNA (Homo sapiens) CpG-island No: 14827
ttttatggtttttttttttggggttttaggagggtttcgttgtaggcggttggagttgtagtggagtcgggcggtcggcggattttttagggcgcggatcgtcgttttaggcgtcgttcgcggtcgtggggtttcggtcgggatttatgtttcggcgcgcgggttgcggaggcggcgggaggagtggagggtttcgcggggtcgtagtttggggaagtttcgtcgggcgtttagcgtcgcgtttcgtcgtttagagcgcgtatttcgtcgtcgttcgcgtttttcgttggggtttcgcgaggtttgtcgtcgtttttcgtttcgcgtattttttttttttttttttttttcgtttttttttttttttttttttttttttttttttcgttcgtaagttttttttttttttcgttattttttgggtttcggtttagattaatttttttggtatttttaaaattgtcgcggtcggtttttttgtgtcgtcgcgggggtttcgcgtttcgtttatttcgttcgtgcgttttcgtagttttatagtttagtttcgaattcgggttttcgcggcgttttttttgttcgcg

SEQ ID NO: 14828 - DNA, 584 bp, Artificial Sequence
  chemically treated genomic DNA (Homo sapiens) CpG-island No: 14828
cgcgaacaaaaaaaacgccgcgaaaacccgaattcgaaactaaactataaaactacgaaaacgcacgaacgaaataaacgaaacgcgaaacccccgcgacgacacaaaaaaaccgaccgcgacaattttaaaaataccaaaaaaattaatctaaaccgaaacccaaaaaataacgaaaaaaaaaaaaaacttacgaacgaaaaaaaaaaaaaaaaaaaaaaaaaaaaaaaaacgaaaaaaaaaaaaaaaaaaaaaatacgcgaaacgaaaaacgacgacaaacctcgcgaaaccccaacgaaaaacgcgaacgacgacgaaatacgcgctctaaacgacgaaacgcgacgctaaacgcccgacgaaacttccccaaactacgaccccgcgaaaccctccactcctcccgccgcctccgcaacccgcgcgccgaaacataaatcccgaccgaaaccccacgaccgcgaacgacgcctaaaacgacgatccgcgccctaaaaaatccgccgaccgcccgactccactacaactccaaccgcctacaacgaaaccctcctaaaaccccaaaaaaaaaaaccataaaa

SEQ ID NO: 14829 - DNA, 523 bp, Artificial Sequence
  chemically treated genomic DNA (Homo sapiens) CpG-island No: 14829
gggaaggagtgggtgcggcgtttcggggtttttcgagagtttttttcgtacgcggttcgtagagtagttttggagcgtttgggtttggatagggttcgaggtggtcggttaagcgtttggtttacggttttcgagagttttcgcgtgttttgggttcgggttcgggtttcgtatttattttggtcgtcgtttcggcggggtcgcgcgggattagggcgagagaaatttgtaattagtcgtttttttttgtttgcgtcgtttcgttgtttggtaacggcgtgcgttagtttcgttttcggcgttcgtcgtcgtggcgttagtacgtattcggggcgaggttagcgtcggttttcgtcgtttaggattcgtttcggattcgttttttttgtttcgggtcgttttcgttgcgggtgggatcgggtttttatattggtcgagttttgggcgtcgggtcgttcgagttttttgttcgtgtttagttcgtcgttcgagtggtttttttttttttttttttttttttttt

SEQ ID NO: 14830 - DNA, 523 bp, Artificial Sequence
  chemically treated genomic DNA (Homo sapiens) CpG-island No: 14830
aaaaaaaaaaaaaaaaaaaaaaaaaaaaccactcgaacgacgaactaaacacgaacaaaaaactcgaacgacccgacgcccaaaactcgaccaatataaaaacccgatcccacccgcaacgaaaacgacccgaaacaaaaaaaacgaatccgaaacgaatcctaaacgacgaaaaccgacgctaacctcgccccgaatacgtactaacgccacgacgacgaacgccgaaaacgaaactaacgcacgccgttaccaaacaacgaaacgacgcaaacaaaaaaaaacgactaattacaaatttctctcgccctaatcccgcgcgaccccgccgaaacgacgaccaaaataaatacgaaacccgaacccgaacccaaaacacgcgaaaactctcgaaaaccgtaaaccaaacgcttaaccgaccacctcgaaccctatccaaacccaaacgctccaaaactactctacgaaccgcgtacgaaaaaaactctcgaaaaaccccgaaacgccgcacccactccttccc

SEQ ID NO: 14831 - DNA, 523 bp, Artificial Sequence
  chemically treated genomic DNA (Homo sapiens) CpG-island No: 14831
aaaaaagaaaaaaaaaaaaaagaaagaattattcgggcggcgaattgagtacggatagaaagttcgagcggttcggcgtttagggttcggttagtgtggaagttcgattttattcgtagcggaggcggttcggggtagggagggcgggttcggggcgggttttggacggcgggggtcggcgttggtttcgtttcggatgcgtgttgacgttacggcgacggacgtcggaagcggagttggcgtacgtcgttgttaggtaacggggcggcgtaggtaggagggaacggttggttgtaggtttttttcgttttggtttcgcgcggtttcgtcgaggcggcgattaaggtgggtgcggggttcgggttcgggtttaggatacgcggggattttcgggagtcgtgggttaggcgtttagtcggttatttcgggttttgtttaggtttaggcgttttagggttgttttgcgggtcgcgtgcgagagggattttcgggaggtttcggggcgtcgtatttattttttttt

SEQ ID NO: 14832 - DNA, 523 bp, Artificial Sequence
  chemically treated genomic DNA (Homo sapiens) CpG-island No: 14832
aaaaaaaaataaatacgacgccccgaaacctcccgaaaatccctctcgcacgcgacccgcaaaacaaccctaaaacgcctaaacctaaacaaaacccgaaataaccgactaaacgcctaacccacgactcccgaaaatccccgcgtatcctaaacccgaacccgaaccccgcacccaccttaatcgccgcctcgacgaaaccgcgcgaaaccaaaacgaaaaaaacctacaaccaaccgttccctcctacctacgccgccccgttacctaacaacgacgtacgccaactccgcttccgacgtccgtcgccgtaacgtcaacacgcatccgaaacgaaaccaacgccgacccccgccgtccaaaacccgccccgaacccgccctccctaccccgaaccgcctccgctacgaataaaatcgaacttccacactaaccgaaccctaaacgccgaaccgctcgaactttctatccgtactcaattcgccgcccgaataattctttcttttttttttttttctttttt

SEQ ID NO: 14833 - DNA, 536 bp, Artificial Sequence
  chemically treated genomic DNA (Homo sapiens) CpG-island No: 14833
acgggtagggagttgacgttgtaggtgggaatcgagagttaggacgcgtagggagttgtcgttgtaggtgggaattattagttaggacgggtagggagttgtcgttgtaggtgggaatcgcgagttaggacgggtagggagttgacgttgtaagtgggaatcgagagttaggacgcgtagggagttgtcgttgtaggtgggaattattagttaggacgggtagggagttgacgttgtaggtgggaatcgcgagttaggacgcgtagggagttgacgttgtaggtgggaatcgagagttaggacgcgtagggagttgtcgttgtaggtgggaattattagttaggacgggtagggagttgtcgttgtaggtgggaatcgcgagttaggacgggtagggagttgacgttgtaggtgggaatcgagagttaggacgcgtagggagttgtcgttgtaggtgggaatcgagagttaggaagtttagggagttgtcgttgtaggtgggaatcgcgagtcgggacgggtagggtagggagttg

SEQ ID NO: 14834 - DNA, 536 bp, Artificial Sequence
  chemically treated genomic DNA (Homo sapiens) CpG-island No: 14834
caactccctaccctacccgtcccgactcgcgattcccacctacaacgacaactccctaaacttcctaactctcgattcccacctacaacgacaactccctacgcgtcctaactctcgattcccacctacaacgtcaactccctacccgtcctaactcgcgattcccacctacaacgacaactccctacccgtcctaactaataattcccacctacaacgacaactccctacgcgtcctaactctcgattcccacctacaacgtcaactccctacgcgtcctaactcgcgattcccacctacaacgtcaactccctacccgtcctaactaataattcccacctacaacgacaactccctacgcgtcctaactctcgattcccacttacaacgtcaactccctacccgtcctaactcgcgattcccacctacaacgacaactccctacccgtcctaactaataattcccacctacaacgacaactccctacgcgtcctaactctcgattcccacctacaacgtcaactccctacccgt

SEQ ID NO: 14835 - DNA, 536 bp, Artificial Sequence
  chemically treated genomic DNA (Homo sapiens) CpG-island No: 14835
tagttttttgttttgttcgtttcggttcgcggtttttatttgtagcgatagttttttgggttttttggttttcggtttttatttgtagcgatagttttttgcgcgttttggttttcggtttttatttgtagcgttagttttttgttcgttttggttcgcggtttttatttgtagcgatagttttttgttcgttttggttgatggtttttatttgtagcgatagttttttgcgcgttttggttttcggtttttatttgtagcgttagttttttgcgcgttttggttcgcggtttttatttgtagcgttagttttttgttcgttttggttgatggtttttatttgtagcgatagttttttgcgcgttttggttttcggtttttatttgtagcgttagttttttgttcgttttggttcgcggtttttatttgtagcgatagttttttgttcgttttggttgatggtttttatttgtagcgatagttttttgcgcgttttggttttcggtttttatttgtagcgttagttttttgttcgt

SEQ ID NO: 14836 - DNA, 536 bp, Artificial Sequence
  chemically treated genomic DNA (Homo sapiens) CpG-island No: 14836
acgaacaaaaaactaacgctacaaataaaaaccgaaaaccaaaacgcgcaaaaaactatcgctacaaataaaaaccatcaaccaaaacgaacaaaaaactatcgctacaaataaaaaccgcgaaccaaaacgaacaaaaaactaacgctacaaataaaaaccgaaaaccaaaacgcgcaaaaaactatcgctacaaataaaaaccatcaaccaaaacgaacaaaaaactaacgctacaaataaaaaccgcgaaccaaaacgcgcaaaaaactaacgctacaaataaaaaccgaaaaccaaaacgcgcaaaaaactatcgctacaaataaaaaccatcaaccaaaacgaacaaaaaactatcgctacaaataaaaaccgcgaaccaaaacgaacaaaaaactaacgctacaaataaaaaccgaaaaccaaaacgcgcaaaaaactatcgctacaaataaaaaccgaaaaccaaaaaacccaaaaaactatcgctacaaataaaaaccgcgaaccgaaacgaacaaaacaaaaaacta

SEQ ID NO: 14837 - DNA, 647 bp, Artificial Sequence
  chemically treated genomic DNA (Homo sapiens) CpG-island No: 14837
tttattcgttattttcggtatcgtttttattttcgattttttacgagggtttttattcgttattttcggtatcgtttttattttttcgttttttacgagggtttttattcgttattttcggtattatttttattttcggttttttacgagggtttttattcgttattttcggtattatttttatttttcgttttttacgagggtttttattcgttattttcggtatcgtttttatttttcgttttttacgagtgtttttattcgttattttcggtatcgtttttattttcggttttttacgagggtttttattcgttattttcggtattatttttatttttcgttttttacgagggtttttattcgttattttcggtatcgtttttatttttcgttttttacgagggtttttattcgttattttcggtatcgtttttatttttcgttttttacgagggtttttattcgtcgttgggttgtatttggtcgattatttttcgggttttttttattttcgtgttttgcgtttcggtttcgatggtgtatgtttttgcgttattgaggttgtcgttttttttttgttttcgtgttttggttagttgggggttcgtgggggcgggcggtggggtcggggggtttacggggtt

SEQ ID NO: 14838 - DNA, 647 bp, Artificial Sequence
  chemically treated genomic DNA (Homo sapiens) CpG-island No: 14838
aaccccgtaaaccccccgaccccaccgcccgcccccacgaacccccaactaaccaaaacacgaaaacaaaaaaaaaacgacaacctcaataacgcaaaaacatacaccatcgaaaccgaaacgcaaaacacgaaaataaaaaaaacccgaaaaataatcgaccaaatacaacccaacgacgaataaaaaccctcgtaaaaaacgaaaaataaaaacgataccgaaaataacgaataaaaaccctcgtaaaaaacgaaaaataaaaacgataccgaaaataacgaataaaaaccctcgtaaaaaacgaaaaataaaaataataccgaaaataacgaataaaaaccctcgtaaaaaaccgaaaataaaaacgataccgaaaataacgaataaaaacactcgtaaaaaacgaaaaataaaaacgataccgaaaataacgaataaaaaccctcgtaaaaaacgaaaaataaaaataataccgaaaataacgaataaaaaccctcgtaaaaaaccgaaaataaaaataataccgaaaataacgaataaaaaccctcgtaaaaaacgaaaaaataaaaacgataccgaaaataacgaataaaaaccctcgtaaaaaatcgaaaataaaaacgataccgaaaataacgaataaa

SEQ ID NO: 14839 - DNA, 647 bp, Artificial Sequence
  chemically treated genomic DNA (Homo sapiens) CpG-island No: 14839
agtttcgtgggtttttcgattttatcgttcgtttttacggatttttagttgattaaggtacggaaataggaggaggacgatagttttagtgacgtagggatatatattatcgagatcgaggcgtaggatacggaggtggaggaggttcggaagatgatcgattaggtgtagtttagcggcgagtgagagttttcgtggggaacggggggtggaggcgatgtcgggggtggcgagtgagagttttcgtggggaacggggggtggaggcgatgtcgggggtggcgagtgagagttttcgtggggaacggggggtggaggtgatgtcgggggtggcgagtgagagttttcgtggggaatcgggggtggaggcgatgtcgggggtggcgagtgagagtattcgtggggaacggggggtggaggcgatgtcgggggtggcgagtgagagttttcgtggggaacggggggtggaggtgatgtcgggggtggcgagtgagagttttcgtggggaatcgggggtggaggtgatgtcgggggtggcgagtgagagttttcgtggggaacgggggggtggaggcgatgtcgggggtggcgagtgagagttttcgtggggaatcgggggtggaggcgatgtcgggggtggcgagtgag

SEQ ID NO: 14840 - DNA, 647 bp, Artificial Sequence
  chemically treated genomic DNA (Homo sapiens) CpG-island No: 14840
ctcactcgccacccccgacatcgcctccacccccgattccccacgaaaactctcactcgccacccccgacatcgcctccacccccccgttccccacgaaaactctcactcgccacccccgacatcacctccacccccgattccccacgaaaactctcactcgccacccccgacatcacctccaccccccgttccccacgaaaactctcactcgccacccccgacatcgcctccaccccccgttccccacgaatactctcactcgccacccccgacatcgcctccacccccgattccccacgaaaactctcactcgccacccccgacatcacctccaccccccgttccccacgaaaactctcactcgccacccccgacatcgcctccaccccccgttccccacgaaaactctcactcgccacccccgacatcgcctccaccccccgttccccacgaaaactctcactcgccgctaaactacacctaatcgatcatcttccgaacctcctccacctccgtatcctacgcctcgatctcgataatatatatccctacgtcactaaaactatcgtcctcctcctatttccgtaccttaatcaactaaaaatccgtaaaaacgaacgataaaatcgaaaaacccacgaaact

SEQ ID NO: 14841 - DNA, 1253 bp, Artificial Sequence
  chemically treated genomic DNA (Homo sapiens) CpG-island No: 14841
tcggcggtggaaggagcgtataggtcgggagaggtagggatagcggggagacggcggcgaagggaaatgaggagagaggggaggaggaggaagacggagggagggatcgcgggaggagagattaggttaggagggaggcggtcgggttcggcgggggagggagcggcgttttttgaattagcgtttttcgggggcggttatggtcgagtcggtgtcggggcggggattcgggtgtttaggtttgtcgtttttttcgtaggtcgcgtagaaacggggcggtttttttcggtttggcgtagattagggtcgttttcgcggcggcggggattcgtttgattaggtgcgtcgggcggtttttaattttcgcgtttttgttcggtttcggtcgggatttcgcgtttcgtgagattttatagtcgtgtaggtgcgggcgataggaggttcgggtcgcggttagcgttgggtcggcgcgttttatttgttgttcgggttttgttttcggttcgttttagttttcggtttggttttcggtttggttttcggtttgttttttagttcggttcggttcggtttttgttttcgcgttcgttcgttcgttcggtcgagcgttgggcggggtcgtcgtttaggatatgttcggcgaggttcgtacgttcgtggtagttcgggtcgagtttacggtagagcggtcgtcggcggtttcgcgcgcgggtttttgacgtttgcgggaggtttagtttcgttttcggaacgtttcgtttcgggtacgttttcgttcgtttcgttttcgttcggtcgcgtcgtatttcgcgtcgtttcgtcggaaattaggttagggcgggttttcggtcgttaggtgagcgcgtttcggtagtttcgcgcgtggttcggtcggtagaggtttggcgagtcgttatttcgtttttgttttaggtttatttttttttatcgtttaggtttcgttggttttttcggtttatttcgtattcggcgtagattttatgttttttcgtttcggtagcgtttttcgtttcgtttttcggttcggttttagttcgacgggcggaatcgggtgcgtatagtagtttcgcgttttggtttagggttagcgggttaacgtttaattacgttttaggagttgtaggttttagtcgcgtttcgagtttttaatttttggtttcggaagttaaaaagaggagcggacggtgaaggagttagggtgagttttagaggtcgtttttagattttttttt

SEQ ID NO: 14842 - DNA, 1253 bp, Artificial Sequence
  chemically treated genomic DNA (Homo sapiens) CpG-island No: 14842
aaaaaaaaatctaaaaacgacctctaaaactcaccctaactccttcaccgtccgctcctctttttaacttccgaaaccaaaaattaaaaactcgaaacgcgactaaaacctacaactcctaaaacgtaattaaacgttaacccgctaaccctaaaccaaaacgcgaaactactatacgcacccgattccgcccgtcgaactaaaaccgaaccgaaaaacgaaacgaaaaacgctaccgaaacgaaaaaacataaaatctacgccgaatacgaaataaaccgaaaaaaccaacgaaacctaaacgataaaaaaaaataaacctaaaacaaaaacgaaataacgactcgccaaacctctaccgaccgaaccacgcgcgaaactaccgaaacgcgctcacctaacgaccgaaaacccgccctaacctaatttccgacgaaacgacgcgaaatacgacgcgaccgaacgaaaacgaaacgaacgaaaacgtacccgaaacgaaacgttccgaaaacgaaactaaacctcccgcaaacgtcaaaaacccgcgcgcgaaaccgccgacgaccgctctaccgtaaactcgacccgaactaccacgaacgtacgaacctcgccgaacatatcctaaacgacgaccccgcccaacgctcgaccgaacgaacgaacgaacgcgaaaacaaaaaccgaaccgaaccgaactaaaaaacaaaccgaaaaccaaaccgaaaaccaaaccgaaaactaaaacgaaccgaaaacaaaacccgaacaacaaataaaacgcgccgacccaacgctaaccgcgacccgaacctcctatcgcccgcacctacacgactataaaatctcacgaaacgcgaaatcccgaccgaaaccgaacaaaaacgcgaaaattaaaaaccgcccgacgcacctaatcaaacgaatccccgccgccgcgaaaacgaccctaatctacgccaaaccgaaaaaaaccgccccgtttctacgcgacctacgaaaaaaacgacaaacctaaacacccgaatccccgccccgacaccgactcgaccataaccgcccccgaaaaacgctaattcaaaaaacgccgctccctcccccgccgaacccgaccgcctccctcctaacctaatctctcctcccgcgatccctccctccgtcttcctcctcctcccctctctcctcatttcccttcgccgccgtctccccgctatccctacctctcccgacctatacgctccttccaccgccga

SEQ ID NO: 14843 - DNA, 1253 bp, Artificial Sequence
  chemically treated genomic DNA (Homo sapiens) CpG-island No: 14843
gagggaaaatttgggagcggtttttggaatttattttgatttttttatcgttcgtttttttttttggttttcggggttaaaggttggggattcgaggcgcggttggagtttatagtttttggagcgtagttaagcgttaattcgttggttttgggttagggcgcggggttgttgtgcgtattcggtttcgttcgtcgagttggggtcggatcgggaggcgaagcggggggcgttgtcgagacgggagggtatggggtttgcgtcgggtgcgagatgagtcggggaggttagcggggtttgggcggtgggggaaggtgggtttggggtaggggcgggatggcggttcgttaagtttttgtcgatcggattacgcgcggggttatcggggcgcgtttatttggcggtcgaggattcgttttaatttggttttcggcggggcggcgcggggtgcggcgcggtcgggcgggggcggggcgggcgggggcgtgttcggggcggggcgtttcgggggcggggttgagtttttcgtagacgttagggattcgcgcgcgaggtcgtcggcggtcgttttgtcgtgggttcggttcgggttgttacgagcgtgcgggtttcgtcgggtatgttttaggcggcggtttcgtttagcgttcggtcgggcgggcgggcgggcgcgagggtagggatcgagtcgggtcgagttggggaataagtcggggattaagtcggggattaagtcggggattaaggcgagtcggagatagagttcgaatagtaggtaggacgcgtcggtttagcgttggtcgcggttcgggttttttatcgttcgtatttgtacggttgtggggttttacggggcgcggggtttcggtcgaggtcggataaaggcgcgggggttgggggtcgttcggcgtatttggttaggcgggttttcgtcgtcgcggaggcggttttggtttgcgttaggtcgggaggagtcgtttcgtttttacgcggtttgcggagggggcggtaagtttgggtattcgggttttcgtttcggtatcggttcggttatggtcgttttcggagagcgttgatttagaaggcgtcgttttttttttcgtcgggttcggtcgttttttttttggtttggttttttttttcgcggttttttttttcgttttttttttttttttttttttttttattttttttcgtcgtcgttttttcgttgtttttgtttttttcggtttgtgcgttttttttatcgtcgg

SEQ ID NO: 14844 - DNA, 1253 bp, Artificial Sequence
  chemically treated genomic DNA (Homo sapiens) CpG-island No: 14844
ccgacgataaaaaaaacgcacaaaccgaaaaaaacaaaaacaacgaaaaaacgacgacgaaaaaaaataaaaaaaaaaaaaaaaaaaaaaaaaacgaaaaaaaaaaccgcgaaaaaaaaaaccaaaccaaaaaaaaaacgaccgaacccgacgaaaaaaaaaacgacgccttctaaatcaacgctctccgaaaacgaccataaccgaaccgataccgaaacgaaaacccgaatacccaaacttaccgccccctccgcaaaccgcgtaaaaacgaaacgactcctcccgacctaacgcaaaccaaaaccgcctccgcgacgacgaaaacccgcctaaccaaatacgccgaacgacccccaacccccgcgcctttatccgacctcgaccgaaaccccgcgccccgtaaaaccccacaaccgtacaaatacgaacgataaaaaacccgaaccgcgaccaacgctaaaccgacgcgtcctacctactattcgaactctatctccgactcgccttaatccccgacttaatccccgacttaatccccgacttattccccaactcgacccgactcgatccctaccctcgcgcccgcccgcccgcccgaccgaacgctaaacgaaaccgccgcctaaaacatacccgacgaaacccgcacgctcgtaacaacccgaaccgaacccacgacaaaacgaccgccgacgacctcgcgcgcgaatccctaacgtctacgaaaaactcaaccccgcccccgaaacgccccgccccgaacacgcccccgcccgccccgcccccgcccgaccgcgccgcaccccgcgccgccccgccgaaaaccaaattaaaacgaatcctcgaccgccaaataaacgcgccccgataaccccgcgcgtaatccgatcgacaaaaacttaacgaaccgccatcccgcccctaccccaaacccaccttcccccaccgcccaaaccccgctaacctccccgactcatctcgcacccgacgcaaaccccataccctcccgtctcgacaacgccccccgcttcgcctcccgatccgaccccaactcgacgaacgaaaccgaatacgcacaacaaccccgcgccctaacccaaaaccaacgaattaacgcttaactacgctccaaaaactataaactccaaccgcgcctcgaatccccaacctttaaccccgaaaaccaaaaaaaaaaacgaacgataaaaaaatcaaaataaattccaaaaaccgctcccaaattttccctc

SEQ ID NO: 14845 - DNA, 956 bp, Artificial Sequence
  chemically treated genomic DNA (Homo sapiens) CpG-island No: 14845
agggttcgtttttatgcgttcgtttttgcgaaattgcgtcgcgcgatcgtcgtggtagcgttttagttagtttcgggttcgcgagaatttggggcggggcggggcggggattagacgggttttttaggcggagcgaattttttattttttatttcgcgtcgggttgtcgcgtttcggaatttaaattttcgtttcgaggttgtcgggggaagcgagaggcgcggagtttacgttcgggattttagcggaggaaacgtagattaaggcgtagcgtcgcgtatttatcgttagggggtagtttttacggcgtcggataggggcggcgcgggaggggagcggggttgaggggatcgggagggcgggaggggatttgcgattgaggggatagggagggcgggaggcgattcgcggttgagtgagggaagggcgggaggggattcgcggttgaggggatcgggagggcgggaggcgattcgcggttgagtgaggggagggtgggaggggattcgcggttgaggggatagggagggcgggaggggattcgcggttgaggggatcgggagggcgggaggcgattcggggttgagtgaggggagggcgggaggggagcggggttgaggggatcgggagggcgggaggggatttgcgattgaggggacggggaggatgtgaggcgattcggggttgagtgaggggagggcgggaggggattcgcggttgaggggatcgggagggcgggaggggagcggggttgaggggacggggagggcgggaggcgattcggggttgaggggacggggagggcgggaggcgattcggggttgaggggacggggagggcgggaggcgattcggggttgaggggacggggagggcgggaggggattcgcggttgaggggataggttttgcgtgcgggttggggagataggcgggcgagggtaggggtgtataaggt

SEQ ID NO: 14846 - DNA, 956 bp, Artificial Sequence
  chemically treated genomic DNA (Homo sapiens) CpG-island No: 14846
accttatacacccctaccctcgcccgcctatctccccaacccgcacgcaaaacctatcccctcaaccgcgaatcccctcccgccctccccgtcccctcaaccccgaatcgcctcccgccctccccgtcccctcaaccccgaatcgcctcccgccctccccgtcccctcaaccccgaatcgcctcccgccctccccgtcccctcaaccccgctcccctcccgccctcccgatcccctcaaccgcgaatcccctcccgccctcccctcactcaaccccgaatcgcctcacatcctccccgtcccctcaatcgcaaatcccctcccgccctcccgatcccctcaaccccgctcccctcccgccctcccctcactcaaccccgaatcgcctcccgccctcccgatcccctcaaccgcgaatcccctcccgccctccctatcccctcaaccgcgaatcccctcccaccctcccctcactcaaccgcgaatcgcctcccgccctcccgatcccctcaaccgcgaatcccctcccgcccttccctcactcaaccgcgaatcgcctcccgccctccctatcccctcaatcgcaaatcccctcccgccctcccgatcccctcaaccccgctcccctcccgcgccgcccctatccgacgccgtaaaaactaccccctaacgataaatacgcgacgctacgccttaatctacgtttcctccgctaaaatcccgaacgtaaactccgcgcctctcgcttcccccgacaacctcgaaacgaaaatttaaattccgaaacgcgacaacccgacgcgaaataaaaaataaaaaattcgctccgcctaaaaaacccgtctaatccccgccccgccccgccccaaattctcgcgaacccgaaactaactaaaacgctaccacgacgatcgcgcgacgcaatttcgcaaaaacgaacgcataaaaacgaaccct

SEQ ID NO: 14847 - DNA, 956 bp, Artificial Sequence
  chemically treated genomic DNA (Homo sapiens) CpG-island No: 14847
gttttgtgtatttttattttcgttcgtttgtttttttagttcgtacgtaggatttgtttttttagtcgcgggttttttttcgtttttttcgtttttttagtttcgggtcgtttttcgtttttttcgtttttttagtttcgggtcgtttttcgtttttttcgtttttttagtttcgggtcgtttttcgtttttttcgtttttttagtttcgtttttttttcgttttttcggtttttttagtcgcgggttttttttcgttttttttttatttagtttcggatcgttttatatttttttcgtttttttagtcgtaggttttttttcgttttttcggtttttttagtttcgtttttttttcgttttttttttatttagtttcgggtcgtttttcgttttttcggtttttttagtcgcgggttttttttcgttttttttgtttttttagtcgcgggtttttttttattttttttttatttagtcgcgggtcgtttttcgttttttcggtttttttagtcgcgggttttttttcgttttttttttatttagtcgcgggtcgtttttcgttttttttgtttttttagtcgtaggttttttttcgttttttcggtttttttagtttcgtttttttttcgcgtcgtttttgttcggcgtcgtaggagttgttttttggcggtgggtgcgcggcgttgcgttttggtttgcgtttttttcgttggagtttcgggcgtgggtttcgcgtttttcgtttttttcggtagtttcggggcgggaatttgggtttcggagcgcggtagttcggcgcggggtgggaggtggagggttcgtttcgtttgggaggttcgtttggttttcgtttcgtttcgttttaggttttcgcggattcggggttagttgaggcgttgttacggcggtcgcgcggcgtagtttcgtaggggcgggcgtatagaggcgggtttt

SEQ ID NO: 14848 - DNA, 956 bp, Artificial Sequence
  chemically treated genomic DNA (Homo sapiens) CpG-island No: 14848
aaaacccgcctctatacgcccgcccctacgaaactacgccgcgcgaccgccgtaacaacgcctcaactaaccccgaatccgcgaaaacctaaaacgaaacgaaacgaaaaccaaacgaacctcccaaacgaaacgaaccctccacctcccaccccgcgccgaactaccgcgctccgaaacccaaattcccgccccgaaactaccgaaaaaaacgaaaaacgcgaaacccacgcccgaaactccaacgaaaaaaacgcaaaccaaaacgcaacgccgcgcacccaccgccaaaaaacaactcctacgacgccgaacaaaaacgacgcgaaaaaaaaacgaaactaaaaaaaccgaaaaaacgaaaaaaaacctacgactaaaaaaacaaaaaaaacgaaaaacgacccgcgactaaataaaaaaaaaacgaaaaaaaacccgcgactaaaaaaaccgaaaaaacgaaaaacgacccgcgactaaataaaaaaaaaataaaaaaaaacccgcgactaaaaaaacaaaaaaaacgaaaaaaaacccgcgactaaaaaaaccgaaaaaacgaaaaacgacccgaaactaaataaaaaaaaaacgaaaaaaaaacgaaactaaaaaaaccgaaaaaacgaaaaaaaacctacgactaaaaaaacgaaaaaaatataaaacgatccgaaactaaataaaaaaaaaacgaaaaaaaacccgcgactaaaaaaaccgaaaaaacgaaaaaaaaacgaaactaaaaaaacgaaaaaaacgaaaaacgacccgaaactaaaaaaacgaaaaaaacgaaaaacgacccgaaactaaaaaaacgaaaaaaacgaaaaacgacccgaaactaaaaaaacgaaaaaaacgaaaaaaaacccgcgactaaaaaaacaaatcctacgtacgaactaaaaaaacaaacgaacgaaaataaaaatacacaaaac

SEQ ID NO: 14849 - DNA, 1042 bp, Artificial Sequence
  chemically treated genomic DNA (Homo sapiens) CpG-island No: 14849
ttgcgtttcgggagtcgttgggagttcggtcggtttcggtcgcggggaggaaaagtaacggtttgggttttttattcgtgacgcgcgtttttttgcgttttcggggtttttcgtgggtttcgtgcggggataaagttagcgttagtaggaagagtgcgggtaaaggggcgtcgggtttaaggggtcgtatgttcgtaagtcgggaggagagagcgggagatttcgggaggatttcgacgtaggttcggagggtgcgcggtttaagagaaggttagcgggattatagcgcggttacgcggtcggtcgtagtttttatcgcgcgtttgtttttgtttacgtttcgggggtcggttggagttgtattgggattcggtttttagtgtgtcgaagtttaagcgttgcggggcgcggggcgggaacgggaggcggtgtttggggttacggggtcgttttttaggatgagggcgtgttttagcgcgcgggattttcggaagttcgcgttgggtcgggcgggtattagtttcggatttagcgggttttagggttttttgcgtaacgtttgtttcggattcggatttcgggttcgttttttggtcgtcgttttcgggaggatttagtagggtaattgtcgcgtcgtttcggcggttttttttgggttttgtttttcgtcgtttttatttttcgagtttcggggttcgttacggttttttttggttggcggggttagtagaattcgcggcgtttaggttcggacggaaaaaagtagggtcggggtgcggtttggatgagcggagattttcgcgttttgggtttaaaggtgcggggtgcgttttgttgtcgagtttttgttcgtttaggaatattggttacgtcgttacgttagtcgtttttgttttaggtttggaggttcgatttgtttttttaggcgtagtatcgcgttttttttcgcgtgggggagcggcgggcggaagaggtttggggttgggtatcggggatacgcgtttagtttttttggtttttttggggggagtggtcggtttta

SEQ ID NO: 14850 - DNA, 1042 bp, Artificial Sequence
  chemically treated genomic DNA (Homo sapiens) CpG-island No: 14850
taaaaccgaccactccccccaaaaaaaccaaaaaaactaaacgcgtatccccgatacccaaccccaaacctcttccgcccgccgctcccccacgcgaaaaaaaacgcgatactacgcctaaaaaaacaaatcgaacctccaaacctaaaacaaaaacgactaacgtaacgacgtaaccaatattcctaaacgaacaaaaactcgacaacaaaacgcaccccgcacctttaaacccaaaacgcgaaaatctccgctcatccaaaccgcaccccgaccctacttttttccgtccgaacctaaacgccgcgaattctactaaccccgccaaccaaaaaaaaccgtaacgaaccccgaaactcgaaaaataaaaacgacgaaaaacaaaacccaaaaaaaaccgccgaaacgacgcgacaattaccctactaaatcctcccgaaaacgacgaccaaaaaacgaacccgaaatccgaatccgaaacaaacgttacgcaaaaaaccctaaaacccgctaaatccgaaactaatacccgcccgacccaacgcgaacttccgaaaatcccgcgcgctaaaacacgccctcatcctaaaaaacgaccccgtaaccccaaacaccgcctcccgttcccgccccgcgccccgcaacgcttaaacttcgacacactaaaaaccgaatcccaatacaactccaaccgacccccgaaacgtaaacaaaaacaaacgcgcgataaaaactacgaccgaccgcgtaaccgcgctataatcccgctaaccttctcttaaaccgcgcaccctccgaacctacgtcgaaatcctcccgaaatctcccgctctctcctcccgacttacgaacatacgaccccttaaacccgacgcccctttacccgcactcttcctactaacgctaactttatccccgcacgaaacccacgaaaaaccccgaaaacgcaaaaaaacgcgcgtcacgaataaaaaacccaaaccgttacttttcctccccgcgaccgaaaccgaccgaactcccaacgactcccgaaacgcaa

SEQ ID NO: 14851 - DNA, 1042 bp, Artificial Sequence
  chemically treated genomic DNA (Homo sapiens) CpG-island No: 14851
tgaaatcggttattttttttagggaggttaggggagttgggcgcgtgttttcggtgtttagttttagatttttttcgttcgtcgtttttttacgcggaagagaacgcggtgttgcgtttaggagagtaggtcgggtttttagatttggggtaggggcggttggcgtgacggcgtggttagtgtttttgagcgagtaggggttcggtagtagagcgtatttcgtatttttgagtttaaggcgcggagattttcgtttatttaggtcgtatttcggttttgttttttttcgttcggatttaggcgtcgcgggttttattgatttcgttagttaggggaagtcgtgacggatttcgaggttcggggggtggaggcggcgggagatagagtttagggagaatcgtcggggcgacgcggtagttattttattgggttttttcggggacggcgattagagagcgagttcggggttcggattcgaggtaggcgttgcgtagggagttttgagattcgttgagttcgaggttggtgttcgttcggtttagcgcggattttcgagggtttcgcgcgttgggatacgtttttattttgggggacgatttcgtggttttaggtatcgtttttcgttttcgtttcgcgtttcgtagcgtttaggtttcggtatattgaggatcgagttttagtgtagttttagtcgattttcgggacgtagataagggtaggcgcgcggtgaagattgcggtcggtcgcgtagtcgcgttgtggtttcgttggtttttttttgggtcgcgtatttttcggatttgcgtcgggattttttcggagtttttcgtttttttttttcggtttgcgaatatgcggttttttaagttcggcgtttttttgttcgtattttttttgttggcgttggttttgttttcgtacggagtttacgggaggtttcgggggcgtaggggagcgcgcgttacggataaggagtttaagtcgttgtttttttttttcgcggtcggggtcggtcggatttttagcggttttcggagcgtag

SEQ ID NO: 14852 - DNA, 1042 bp, Artificial Sequence
  chemically treated genomic DNA (Homo sapiens) CpG-island No: 14852
ctacgctccgaaaaccgctaaaaatccgaccgaccccgaccgcgaaaaaaaaaaacaacgacttaaactccttatccgtaacgcgcgctcccctacgcccccgaaacctcccgtaaactccgtacgaaaacaaaaccaacgccaacaaaaaaaatacgaacaaaaaaacgccgaacttaaaaaaccgcatattcgcaaaccgaaaaaaaaaaacgaaaaactccgaaaaaatcccgacgcaaatccgaaaaatacgcgacccaaaaaaaaaccaacgaaaccacaacgcgactacgcgaccgaccgcaatcttcaccgcgcgcctacccttatctacgtcccgaaaatcgactaaaactacactaaaactcgatcctcaatataccgaaacctaaacgctacgaaacgcgaaacgaaaacgaaaaacgatacctaaaaccacgaaatcgtcccccaaaataaaaacgtatcccaacgcgcgaaaccctcgaaaatccgcgctaaaccgaacgaacaccaacctcgaactcaacgaatctcaaaactccctacgcaacgcctacctcgaatccgaaccccgaactcgctctctaatcgccgtccccgaaaaaacccaataaaataactaccgcgtcgccccgacgattctccctaaactctatctcccgccgcctccaccccccgaacctcgaaatccgtcacgacttcccctaactaacgaaatcaataaaacccgcgacgcctaaatccgaacgaaaaaaaacaaaaccgaaatacgacctaaataaacgaaaatctccgcgccttaaactcaaaaatacgaaatacgctctactaccgaacccctactcgctcaaaaacactaaccacgccgtcacgccaaccgcccctaccccaaatctaaaaacccgacctactctcctaaacgcaacaccgcgttctcttccgcgtaaaaaaacgacgaacgaaaaaaatctaaaactaaacaccgaaaacacgcgcccaactcccctaacctccctaaaaaaaataaccgatttca

SEQ ID NO: 14853 - DNA, 683 bp, Artificial Sequence
  chemically treated genomic DNA (Homo sapiens) CpG-island No: 14853
tgtcgtaattaagagatttcggtttggcgaaatggcggcgtttggagtttgcgagtgacgttagttggtggggttgttaaggagaatattcgttacggcgtaattaacggtattgttattaagaaatcgtcgtttttgagaaaaaaagagacgttcggtcgtcgagaaatttcgtataagtgttgtgatagaaaaatcgtcggtttcgtagcggtaaaagagttaacgggaacgtcgggtgttgcgattatgatttcggtattggaggacgtgggatggagaatgggatatacggagcgagaagggaaacgtttcgtgtagattaattagcgtcgtcgttatcggaaaattgattcgttagtgttgttaatgaagtgcgtgtgagaaatcgatgattggtgggaggagtagcgttgggcgttggattcgcgagtgtgagaatttggcggcgttaggattttttaggcgcgggtacgaggcgaaatttagcgttgttgttaaagataaatgcgcgtttttttgggcgttattagcggtgtagttagtgattatttttaggttttgagaaattagagatgttagttataaatttttcgtttagggaaagtttgcggcgtcgtgacggatcgattggtattgggtgtaatattgttttgtggtttagagattagaatataaaaata

SEQ ID NO: 14854 - DNA, 683 bp, Artificial Sequence
  chemically treated genomic DNA (Homo sapiens) CpG-island No: 14854
tatttttatattctaatctctaaaccacaaaacaatattacacccaataccaatcgatccgtcacgacgccgcaaactttccctaaacgaaaaatttataactaacatctctaatttctcaaaacctaaaaataatcactaactacaccgctaataacgcccaaaaaaacgcgcatttatctttaacaacaacgctaaatttcgcctcgtacccgcgcctaaaaaatcctaacgccgccaaattctcacactcgcgaatccaacgcccaacgctactcctcccaccaatcatcgatttctcacacgcacttcattaacaacactaacgaatcaattttccgataacgacgacgctaattaatctacacgaaacgtttcccttctcgctccgtatatcccattctccatcccacgtcctccaataccgaaatcataatcgcaacacccgacgttcccgttaactcttttaccgctacgaaaccgacgatttttctatcacaacacttatacgaaatttctcgacgaccgaacgtctctttttttctcaaaaacgacgatttcttaataacaataccgttaattacgccgtaacgaatattctccttaacaaccccaccaactaacgtcactcgcaaactccaaacgccgccatttcgccaaaccgaaatctcttaattacgaca

SEQ ID NO: 14855 - DNA, 683 bp, Artificial Sequence
  chemically treated genomic DNA (Homo sapiens) CpG-island No: 14855
tgtttttatattttagtttttaggttataagataatgttgtatttagtgttagtcgattcgttacggcgtcgtaaattttttttgaacggagggtttgtggttgatatttttagttttttagagtttgggagtgattattggttgtatcgttgatggcgtttaaaagaacgcgtatttgtttttggtaatagcgttgggtttcgtttcgtgttcgcgtttgaagggttttagcgtcgttagatttttatattcgcgggtttagcgtttagcgttgttttttttattagttatcggttttttatacgtattttattggtagtattggcgagttagtttttcggtggcggcggcgttagttggtttgtacgaaacgttttttttttcgtttcgtgtgttttattttttattttacgttttttagtgtcggggttatggtcgtagtattcggcgttttcgttggtttttttgtcgttgcggagtcggcggtttttttgttatagtatttgtacggagtttttcggcggtcgaacgttttttttttttttagagacgacggttttttggtgatagtatcgttggttgcgtcgtaacgaatgttttttttgatagttttattagttggcgttattcgtaggttttagacgtcgttatttcgttaagtcgaggttttttggttgcggta

SEQ ID NO: 14856 - DNA, 683 bp, Artificial Sequence
  chemically treated genomic DNA (Homo sapiens) CpG-island No: 14856
taccgcaaccaaaaaacctcgacttaacgaaataacgacgtctaaaacctacgaataacgccaactaataaaactatcaaaaaaaacattcgttacgacgcaaccaacgatactatcaccaaaaaaccgtcgtctctaaaaaaaaaaaaaacgttcgaccgccgaaaaactccgtacaaatactataacaaaaaaaccgccgactccgcaacgacaaaaaaaccaacgaaaacgccgaatactacgaccataaccccgacactaaaaaacgtaaaataaaaaataaaacacacgaaacgaaaaaaaaaacgtttcgtacaaaccaactaacgccgccgccaccgaaaaactaactcgccaatactaccaataaaatacgtataaaaaaccgataactaataaaaaaaacaacgctaaacgctaaacccgcgaatataaaaatctaacgacgctaaaacccttcaaacgcgaacacgaaacgaaacccaacgctattaccaaaaacaaatacgcgttcttttaaacgccatcaacgatacaaccaataatcactcccaaactctaaaaaactaaaaatatcaaccacaaaccctccgttcaaaaaaaatttacgacgccgtaacgaatcgactaacactaaatacaacattatcttataacctaaaaactaaaatataaaaaca

SEQ ID NO: 14857 - DNA, 830 bp, Artificial Sequence
  chemically treated genomic DNA (Homo sapiens) CpG-island No: 14857
gttggcgttcgtttggtgttcgcgtttgtcgggttttagagtagttagatttttatattagcgagtttagcgtttagcgttatttttttttcggattatcggttttttatattcgtagtagtattggtttgatagtttttcggttgcgatagcgttagttgagttaaataaaacgtttttttgtttgttttgggcgttttattttttattcgaggttttttagtttcggtgttattgtcgtagtatttggcgttcgttagtttttttattagcggcgcggagcgggcggttttgttgttacggtatatgtggtacggagtttttcggtggtcgaaattttttttttttttagagtttagttttttggtgatagcgttgttggttgcgttataaggaatgttgtttttgataattcgtcggtcgtagttattcgtaagttttaggtatcgatatttcgtagaattgaggtttttcggttttagtatagttcgttgttcgatgtttttattttttcggggcgatagtatttaggtcgtcgatttgagggattcggagtttttttagttggggtgagtttggcgttttcgggcggcggcggcggcgttgggttaggggagttcgtcgtttttttaagtcggtgataggggagttgttcgggcgtcgtttttttttagcgtcgtcgtagaattcgtagaatagttcgatttttagaattttgtgttgtggcggcggggttggcgtgtttgtcgtaggatttcgtagattcgtttgtcgttggtttgttggttttaataagtttcgattttagggtgtttgcgtttttttttttt

SEQ ID NO: 14858 - DNA, 830 bp, Artificial Sequence
  chemically treated genomic DNA (Homo sapiens) CpG-island No: 14858
aaaaaaaaaaaacgcaaacaccctaaaatcgaaacttattaaaaccaacaaaccaacgacaaacgaatctacgaaatcctacgacaaacacgccaaccccgccgccacaacacaaaattctaaaaatcgaactattctacgaattctacgacgacgctaaaaaaaaacgacgcccgaacaactcccctatcaccgacttaaaaaaacgacgaactcccctaacccaacgccgccgccgccgcccgaaaacgccaaactcaccccaactaaaaaaactccgaatccctcaaatcgacgacctaaatactatcgccccgaaaaaataaaaacatcgaacaacgaactatactaaaaccgaaaaacctcaattctacgaaatatcgatacctaaaacttacgaataactacgaccgacgaattatcaaaaacaacattccttataacgcaaccaacaacgctatcaccaaaaaactaaactctaaaaaaaaaaaaaatttcgaccaccgaaaaactccgtaccacatataccgtaacaacaaaaccgcccgctccgcgccgctaataaaaaaactaacgaacgccaaatactacgacaataacaccgaaactaaaaaacctcgaataaaaaataaaacgcccaaaacaaacaaaaaaacgttttatttaactcaactaacgctatcgcaaccgaaaaactatcaaaccaatactactacgaatataaaaaaccgataatccgaaaaaaaaataacgctaaacgctaaactcgctaatataaaaatctaactactctaaaacccgacaaacgcgaacaccaaacgaacgccaac

SEQ ID NO: 14859 - DNA, 830 bp, Artificial Sequence
  chemically treated genomic DNA (Homo sapiens) CpG-island No: 14859
aagaaaaagaaacgtaggtattttgaaatcgaaatttgttaggattaataagttaacgatagacgaatttgcggggttttgcgatagatacgttagtttcgtcgttatagtatagggttttggaggtcgagttgttttgcgggttttgcggcggcgttgggaagagacggcgttcgggtagtttttttgttatcggtttggaggagcggcgggtttttttagtttagcgtcgtcgtcgtcgttcgggaacgttaggtttattttagttggggaagtttcgaattttttagatcggcgatttgagtgttgtcgtttcgagaaaatggaggtatcgagtaacgagttgtgttgagatcgagagattttagttttgcgaaatgtcggtgtttggagtttgcgaatgattgcggtcggcgggttgttaaggataatattttttatggcgtaattaatagcgttgttattaagaaattggattttgagaaaaaagagggtttcggttatcgagaaatttcgtgttatatgtgtcgtgatagtaaaatcgttcgtttcgcgtcgttggtgaaagagttaacgaacgttaggtgttgcgatagtgatatcgggattagaaggtttcggatggagaatgggacgtttagagtaagtaggaaaacgttttgtttggtttaattagcgttgtcgtaatcggaaaattgttaggttagtgttgttgcggatgtgagaaatcggtgattcgaaggaggagtggcgttgggcgttggattcgttggtgtgaaaatttggttgttttaggattcggtaagcgcgggtattaggcgaacgttagt

SEQ ID NO: 14860 - DNA, 830 bp, Artificial Sequence
  chemically treated genomic DNA (Homo sapiens) CpG-island No: 14860
actaacgttcgcctaatacccgcgcttaccgaatcctaaaacaaccaaattttcacaccaacgaatccaacgcccaacgccactcctccttcgaatcaccgatttctcacatccgcaacaacactaacctaacaattttccgattacgacaacgctaattaaaccaaacaaaacgttttcctacttactctaaacgtcccattctccatccgaaaccttctaatcccgatatcactatcgcaacacctaacgttcgttaactctttcaccaacgacgcgaaacgaacgattttactatcacgacacatataacacgaaatttctcgataaccgaaaccctcttttttctcaaaatccaatttcttaataacaacgctattaattacgccataaaaaatattatccttaacaacccgccgaccgcaatcattcgcaaactccaaacaccgacatttcgcaaaactaaaatctctcgatctcaacacaactcgttactcgatacctccattttctcgaaacgacaacactcaaatcgccgatctaaaaaattcgaaacttccccaactaaaataaacctaacgttcccgaacgacgacgacgacgctaaactaaaaaaacccgccgctcctccaaaccgataacaaaaaaactacccgaacgccgtctcttcccaacgccgccgcaaaacccgcaaaacaactcgacctccaaaaccctatactataacgacgaaactaacgtatctatcgcaaaaccccgcaaattcgtctatcgttaacttattaatcctaacaaatttcgatttcaaaatacctacgtttctttttctt

SEQ ID NO: 14861 - DNA, 699 bp, Artificial Sequence
  chemically treated genomic DNA (Homo sapiens) CpG-island No: 14861
agcgtagttcgggcggtatgagaaagagaaggcgtttcggtagtttttttgttatcggttcgaggagcgttggttttttagtttagcgtcgcgtcgttcggtaattttaggcgtaattgggtcgaattggggtagttgcgatatcgaattttttatatttgtaatttgggtgttgcggttattgagaaaatggaggcgtagattacgagcggtgtcgatttcgatagatttcggttggcgaaatggtggtgtcgggagtttgcgagtgacgttagtcggcggggttgttaaggataatattcgttttgacgtagttaatggcgtcgttattaagaaattatcgattttgagaaaaaagagaggttcggttatcgagaaatttcgtacgataagtgttgtggtagaaaaatcgtttatttcgcgttataggtaaaatagttaatggaaattttaggtgttgcgatcgtgatatcggtattagagggtttcggatggagaaagcggcgtacggagattaggaaattatgtgtagtataattagtagaaaatcgtttggtcggttattcgggagaaagcgcggattagaaataagcgatttcgatgtagggaatcgcgtagttattgaagaaagtgatttacgtgtagtggtgttagcgaaatattgtagtttggacggtagttgtgggatgttatagagaa

SEQ ID NO: 14862 - DNA, 699 bp, Artificial Sequence
  chemically treated genomic DNA (Homo sapiens) CpG-island No: 14862
ttctctataacatcccacaactaccgtccaaactacaatatttcgctaacaccactacacgtaaatcactttcttcaataactacgcgattccctacatcgaaatcgcttatttctaatccgcgctttctcccgaataaccgaccaaacgattttctactaattatactacacataatttcctaatctccgtacgccgctttctccatccgaaaccctctaataccgatatcacgatcgcaacacctaaaatttccattaactattttacctataacgcgaaataaacgatttttctaccacaacacttatcgtacgaaatttctcgataaccgaacctctcttttttctcaaaatcgataatttcttaataacgacgccattaactacgtcaaaacgaatattatccttaacaaccccgccgactaacgtcactcgcaaactcccgacaccaccatttcgccaaccgaaatctatcgaaatcgacaccgctcgtaatctacgcctccattttctcaataaccgcaacacccaaattacaaatataaaaaattcgatatcgcaactaccccaattcgacccaattacgcctaaaattaccgaacgacgcgacgctaaactaaaaaaccaacgctcctcgaaccgataacaaaaaaactaccgaaacgccttctctttctcataccgcccgaactacgct

SEQ ID NO: 14863 - DNA, 699 bp, Artificial Sequence
  chemically treated genomic DNA (Homo sapiens) CpG-island No: 14863
ttttttgtggtattttatagttgtcgtttaaattgtagtgtttcgttggtattattgtacgtgggttattttttttagtggttgcgcggttttttgtatcgaagtcgtttgtttttgattcgcgttttttttcggatggtcgattagacggttttttgttagttgtgttatatatagttttttggttttcgtgcgtcgttttttttattcgagattttttagtgtcggtgttacggtcgtagtatttggggtttttattggttgttttgtttgtggcgcggagtaggcggtttttttgttatagtatttgtcgtacggagtttttcggtggtcgaatttttttttttttttagagtcgatggttttttggtgacggcgttattggttgcgttaaaacgaatgttgtttttgataatttcgtcggttggcgttattcgtaggttttcggtattattatttcgttagtcgaggtttgtcgaggtcggtatcgttcgtggtttgcgtttttatttttttagtggtcgtagtatttaggttgtagatgtgagggattcggtgtcgtagttgttttagttcggtttagttgcgtttggagttatcgggcggcgcggcgttgggttggggagttagcgtttttcgggtcggtggtaggggagttgtcggggcgtttttttttttttatgtcgttcggattgcgtt

SEQ ID NO: 14864 - DNA, 699 bp, Artificial Sequence
  chemically treated genomic DNA (Homo sapiens) CpG-island No: 14864
aacgcaatccgaacgacataaaaaaaaaaaaacgccccgacaactcccctaccaccgacccgaaaaacgctaactccccaacccaacgccgcgccgcccgataactccaaacgcaactaaaccgaactaaaacaactacgacaccgaatccctcacatctacaacctaaatactacgaccactaaaaaaataaaaacgcaaaccacgaacgataccgacctcgacaaacctcgactaacgaaataataataccgaaaacctacgaataacgccaaccgacgaaattatcaaaaacaacattcgttttaacgcaaccaataacgccgtcaccaaaaaaccatcgactctaaaaaaaaaaaaaaattcgaccaccgaaaaactccgtacgacaaatactataacaaaaaaaccgcctactccgcgccacaaacaaaacaaccaataaaaaccccaaatactacgaccgtaacaccgacactaaaaaatctcgaataaaaaaaacgacgcacgaaaaccaaaaaactatatataacacaactaacaaaaaaccgtctaatcgaccatccgaaaaaaaacgcgaatcaaaaacaaacgacttcgatacaaaaaaccgcgcaaccactaaaaaaaataacccacgtacaataataccaacgaaacactacaatttaaacgacaactataaaataccacaaaaaa

SEQ ID NO: 14865 - DNA, 1272 bp, Artificial Sequence
  chemically treated genomic DNA (Homo sapiens) CpG-island No: 14865
tagcgcgttggtcgtcgtcgttattgttgttgttgcggttgttgtatatcgagcgcgtttcgggttggttttcggcgtttcgtcgttcgcgttcgtcgttcgcgtcggttttagatttttcggggtcgtttttcgttgttgtcgttttcgggaggcgtttcggatttttttcggagtcgtcggtcgtcgttattttttggtcggcgggttgtaggggtaggggcggaggcggtagttcgttcgtttttttgtatcgcggggttattttttttagcggttcgtttggtttcgcggcgcgttcgggggtttcgggggacgcgggtagcggcggtaggtagcgcggggtcgcggggatcggggtcggttttttcggcggcggcgtcggcggcggcggcgggggaggttgcgggggaggttcggcgttttcgtttttcgtttcgcgatatcgattgtcgtcgtggtcgtttttaaagtttatggttgtgtcgtcgtcgtttttttgtcggttcggttggcgggtcgggttttggttgtagggaaagagagcgcggagggggcgggagggagaggggaaaaggagggagggggttcggacgtttggggttagggggcgggacggggaggggatgcggaaggttttgtagttgcggcggcggtaggcgcggtcgttcggtggagtcgtcggttcggttttgatggaggcggcgtcgaattcggttgcgcgtgagagtcgcgtcgcggaagggggggtcggagaagcgagggggcgggagggaggagcggcgcggcgggggtgacggggcgcgggcgcggggtgggttgggggcgcggattagtgggacggagttcggggttcggtttcgagcgggcgggttggaagtgggggattttttagtcgtttttacgggtcggtttcgcgtttacgtcggtttcggggcggatgatttttttttaaacggcgtagcgttgcggttttcgtgagttgggaagtagggggtaggggagaggtcgcgggtttagaaatcgttattggatgggtcggtgggatgtggcgcgggtcgggtggggcgcgatagtttgagtcgagattcgcgtgggtttaagggtgcgcgaggcgggtgttttgggcgcgttcgaattggttgagtagtggagcgggaaagggcgcgggattcgggattgtaatcgttatttttaggttttcgtttttcgcgtttggagtttttaagggtatttttagggattttcgagagttttaaaatagaagttttt

SEQ ID NO: 14866 - DNA, 1272 bp, Artificial Sequence
  chemically treated genomic DNA (Homo sapiens) CpG-island No: 14866
aaaaacttctattttaaaactctcgaaaatccctaaaaatacccttaaaaactccaaacgcgaaaaacgaaaacctaaaaataacgattacaatcccgaatcccgcgccctttcccgctccactactcaaccaattcgaacgcgcccaaaacacccgcctcgcgcacccttaaacccacgcgaatctcgactcaaactatcgcgccccacccgacccgcgccacatcccaccgacccatccaataacgatttctaaacccgcgacctctcccctaccccctacttcccaactcacgaaaaccgcaacgctacgccgtttaaaaaaaaatcatccgccccgaaaccgacgtaaacgcgaaaccgacccgtaaaaacgactaaaaaatcccccacttccaacccgcccgctcgaaaccgaaccccgaactccgtcccactaatccgcgcccccaacccaccccgcgcccgcgccccgtcacccccgccgcgccgctcctccctcccgccccctcgcttctccgacccccccttccgcgacgcgactctcacgcgcaaccgaattcgacgccgcctccatcaaaaccgaaccgacgactccaccgaacgaccgcgcctaccgccgccgcaactacaaaaccttccgcatcccctccccgtcccgccccctaaccccaaacgtccgaaccccctccctccttttcccctctccctcccgccccctccgcgctctctttccctacaaccaaaacccgacccgccaaccgaaccgacaaaaaaacgacgacgacacaaccataaactttaaaaacgaccacgacgacaatcgatatcgcgaaacgaaaaacgaaaacgccgaacctcccccgcaacctcccccgccgccgccgccgacgccgccgccgaaaaaaccgaccccgatccccgcgaccccgcgctacctaccgccgctacccgcgtcccccgaaacccccgaacgcgccgcgaaaccaaacgaaccgctaaaaaaaataaccccgcgatacaaaaaaacgaacgaactaccgcctccgcccctacccctacaacccgccgaccaaaaaataacgacgaccgacgactccgaaaaaaatccgaaacgcctcccgaaaacgacaacaacgaaaaacgaccccgaaaaatctaaaaccgacgcgaacgacgaacgcgaacgacgaaacgccgaaaaccaacccgaaacgcgctcgatatacaacaaccgcaacaacaacaataacgacgacgaccaacgcgcta

SEQ ID NO: 14867 - DNA, 1272 bp, Artificial Sequence
  chemically treated genomic DNA (Homo sapiens) CpG-island No: 14867
agagatttttgttttaaggttttcgaggatttttgagagtgtttttgagggttttaagcgcggggagcgagggtttggaagtggcggttatagtttcgggtttcgcgttttttttcgttttattgtttagttagttcgggcgcgtttagggtattcgtttcgcgtatttttaagtttacgcgggtttcggtttagattgtcgcgttttattcggttcgcgttatattttatcggtttatttagtaacggtttttggattcgcggttttttttttgttttttattttttagtttacgagagtcgtagcgttgcgtcgtttggagaggggttattcgtttcggaatcgacgtgagcgcggggtcggttcgtggaggcggttgagggattttttatttttagttcgttcgttcggagtcgaatttcgaatttcgttttattgattcgcgtttttagtttatttcgcgttcgcgtttcgttattttcgtcgcgtcgtttttttttttcgttttttcgttttttcggttttttttttcgcggcgcggtttttacgcgtagtcgaattcggcgtcgtttttattagagtcgagtcggcggttttatcgaacggtcgcgtttgtcgtcgtcgtagttgtagaatttttcgtatttttttttcgtttcgttttttagttttaggcgttcgggtttttttttttttttttttttttttttttcgtttttttcgcgttttttttttttgtagttagagttcggttcgttagtcgggtcggtaggagggcggcggcggtataattatgagttttgagggcggttacggcggtagtcggtgtcgcggggcggagagcggggacgtcgagtttttttcgtaatttttttcgtcgtcgtcgtcgacgtcgtcgtcgggagagtcggtttcggttttcgcggtttcgcgttatttgtcgtcgttgttcgcgtttttcgagattttcgagcgcgtcgcggggttaagcgagtcgttaggggaggtggtttcgcggtgtaggggagcggacgagttgtcgttttcgtttttgtttttgtagttcgtcggttaggaagtggcggcggtcggcgatttcggggaaggttcgaggcgtttttcggaggcggtagtagcgaaaggcggtttcggggagtttgaggtcggcgcgggcggcgagcgcgagcggcggggcgtcggagattagttcgagacgcgttcggtgtgtagtagtcgtagtagtagtagtggcggcggcgattagcgcgttg

SEQ ID NO: 14868 - DNA, 1272 bp, Artificial Sequence
  chemically treated genomic DNA (Homo sapiens) CpG-island No: 14868
caacgcgctaatcgccgccgccactactactactacgactactacacaccgaacgcgtctcgaactaatctccgacgccccgccgctcgcgctcgccgcccgcgccgacctcaaactccccgaaaccgcctttcgctactaccgcctccgaaaaacgcctcgaaccttccccgaaatcgccgaccgccgccacttcctaaccgacgaactacaaaaacaaaaacgaaaacgacaactcgtccgctcccctacaccgcgaaaccacctcccctaacgactcgcttaaccccgcgacgcgctcgaaaatctcgaaaaacgcgaacaacgacgacaaataacgcgaaaccgcgaaaaccgaaaccgactctcccgacgacgacgtcgacgacgacgacgaaaaaaattacgaaaaaaactcgacgtccccgctctccgccccgcgacaccgactaccgccgtaaccgccctcaaaactcataattataccgccgccgccctcctaccgacccgactaacgaaccgaactctaactacaaaaaaaaaaaacgcgaaaaaaacgaaaaaaaaaaaaaaaaaaaaaaaaaaaaacccgaacgcctaaaactaaaaaacgaaacgaaaaaaaaatacgaaaaattctacaactacgacgacgacaaacgcgaccgttcgataaaaccgccgactcgactctaataaaaacgacgccgaattcgactacgcgtaaaaaccgcgccgcgaaaaaaaaaaccgaaaaaacgaaaaaacgaaaaaaaaaaacgacgcgacgaaaataacgaaacgcgaacgcgaaataaactaaaaacgcgaatcaataaaacgaaattcgaaattcgactccgaacgaacgaactaaaaataaaaaatccctcaaccgcctccacgaaccgaccccgcgctcacgtcgattccgaaacgaataacccctctccaaacgacgcaacgctacgactctcgtaaactaaaaaataaaaaacaaaaaaaaaaccgcgaatccaaaaaccgttactaaataaaccgataaaatataacgcgaaccgaataaaacgcgacaatctaaaccgaaacccgcgtaaacttaaaaatacgcgaaacgaataccctaaacgcgcccgaactaactaaacaataaaacgaaaaaaaacgcgaaacccgaaactataaccgccacttccaaaccctcgctccccgcgcttaaaaccctcaaaaacactctcaaaaatcctcgaaaaccttaaaacaaaaatctct

SEQ ID NO: 14869 - DNA, 508 bp, Artificial Sequence
  chemically treated genomic DNA (Homo sapiens) CpG-island No: 14869
cgtcgtttcgtttgttacgtgtagtcggacgtcgtggcggttttcgtagcggttatggacgtcgtcggcgaattcgacgcggtagaagtagcggcggtcgttagttagggcgaggcgttcgacgcgtagcgagaggtcgttgcggcgcgggttgtttagtagtcggaagcggtcgtgtaggtttagcgtcgtttggtagagttcgttgtttcgcgtcgtagcgtagcggaatatttgcgggttcgtatagggttcgttcgcgcgttagatggtcgttagcggttcgtcgtagtggcggtgcgggtgcgtgaaggtgtagggtagtattgtcgcgtcgtttgttttcgcgtttatttcgggtggtatttgtatggattagcgttgcgttggcgagtttgagggcggggcgggttgcgttaggttcggggttttggggtcgaggcgttcgtattcggggtttggaaattttacgatttaggaaacgtttttttaatttttagtttggaaa

SEQ ID NO: 14870 - DNA, 508 bp, Artificial Sequence
  chemically treated genomic DNA (Homo sapiens) CpG-island No: 14870
tttccaaactaaaaattaaaaaaacgtttcctaaatcgtaaaatttccaaaccccgaatacgaacgcctcgaccccaaaaccccgaacctaacgcaacccgccccgccctcaaactcgccaacgcaacgctaatccatacaaataccacccgaaataaacgcgaaaacaaacgacgcgacaatactaccctacaccttcacgcacccgcaccgccactacgacgaaccgctaacgaccatctaacgcgcgaacgaaccctatacgaacccgcaaatattccgctacgctacgacgcgaaacaacgaactctaccaaacgacgctaaacctacacgaccgcttccgactactaaacaacccgcgccgcaacgacctctcgctacgcgtcgaacgcctcgccctaactaacgaccgccgctacttctaccgcgtcgaattcgccgacgacgtccataaccgctacgaaaaccgccacgacgtccgactacacgtaacaaacgaaacgacg

SEQ ID NO: 14871 - DNA, 508 bp, Artificial Sequence
  chemically treated genomic DNA (Homo sapiens) CpG-island No: 14871
tttttaggttaggggttgggggagcgttttttgggtcgtggggtttttaggtttcgggtgcgggcgtttcgattttagggtttcgagtttgacgtagttcgtttcgtttttaggttcgttagcgtagcgttggtttatgtaggtgttattcgaggtgagcgcggaggtaggcgacgcggtagtgttgttttgtatttttacgtattcgtatcgttattacgacgggtcgttgacggttatttggcgcgcgggcgagttttatgcgggttcgtaggtgtttcgttgcgttgcggcgcggggtagcgagttttgttagacggcgttgagtttgtacggtcgttttcggttgttgggtaattcgcgtcgtaacgatttttcgttgcgcgtcgagcgtttcgttttggttgacgatcgtcgttatttttgtcgcgtcgagttcgtcggcgacgtttatgatcgttacgagagtcgttacggcgttcggttgtacgtgataggcgaggcggcg

SEQ ID NO: 14872 - DNA, 508 bp, Artificial Sequence
  chemically treated genomic DNA (Homo sapiens) CpG-island No: 14872
cgccgcctcgcctatcacgtacaaccgaacgccgtaacgactctcgtaacgatcataaacgtcgccgacgaactcgacgcgacaaaaataacgacgatcgtcaaccaaaacgaaacgctcgacgcgcaacgaaaaatcgttacgacgcgaattacccaacaaccgaaaacgaccgtacaaactcaacgccgtctaacaaaactcgctaccccgcgccgcaacgcaacgaaacacctacgaacccgcataaaactcgcccgcgcgccaaataaccgtcaacgacccgtcgtaataacgatacgaatacgtaaaaatacaaaacaacactaccgcgtcgcctacctccgcgctcacctcgaataacacctacataaaccaacgctacgctaacgaacctaaaaacgaaacgaactacgtcaaactcgaaaccctaaaatcgaaacgcccgcacccgaaacctaaaaaccccacgacccaaaaaacgctcccccaacccctaacctaaaaa

SEQ ID NO: 14873 - DNA, 592 bp, Artificial Sequence
  chemically treated genomic DNA (Homo sapiens) CpG-island No: 14873
ttttttaatacgatcggaggcgtcgcggtcgttattttcggttatcgttcgaggagcgaatttcgttcgaggttttatagtcgtcgttttaagtttagttcggtttattttttttattttttgtattattttcgttagttggttttcgttttttagtagttcgttgagttgtattagcgatacgtcggcgaatcgggtcgttttcggcgttcgttatttttacgtttcggtcgtcgtcgttatcgtcgttgcggttattaggtttcgtcgatcggaagcgtcgtttttaagggcgtttttcgcgggggggatacgtgacgttagttttgggtcgtgacgttattatcgcgcgggcgggcggacgtgacgtaagtgtcgcggttcgtttggagtggaatgtgttagggatagtcgggatttttaaagggaggggaagggttttatgattgggttgtgacgcgtgagcgtattaatgacgttattgcggttcgggagagcgcgttatgaggttataagagttttttttttttaggaagagagatatcgcgatttaaggaaaataggtagtgggaaggaagttttcgtagtttgt

SEQ ID NO: 14874 - DNA, 592 bp, Artificial Sequence
  chemically treated genomic DNA (Homo sapiens) CpG-island No: 14874
acaaactacgaaaacttccttcccactacctattttccttaaatcgcgatatctctcttcctaaaaaaaaaaaactcttataacctcataacgcgctctcccgaaccgcaataacgtcattaatacgctcacgcgtcacaacccaatcataaaacccttcccctccctttaaaaatcccgactatccctaacacattccactccaaacgaaccgcgacacttacgtcacgtccgcccgcccgcgcgataataacgtcacgacccaaaactaacgtcacgtatcccccccgcgaaaaacgcccttaaaaacgacgcttccgatcgacgaaacctaataaccgcaacgacgataacgacgacgaccgaaacgtaaaaataacgaacgccgaaaacgacccgattcgccgacgtatcgctaatacaactcaacgaactactaaaaaacgaaaaccaactaacgaaaataatacaaaaaataaaaaaaataaaccgaactaaacttaaaacgacgactataaaacctcgaacgaaattcgctcctcgaacgataaccgaaaataacgaccgcgacgcctccgatcgtattaaaaaa

SEQ ID NO: 14875 - DNA, 592 bp, Artificial Sequence
  chemically treated genomic DNA (Homo sapiens) CpG-island No: 14875
ataggttgcgggaattttttttttattgtttgttttttttggatcgcggtatttttttttttggaggaaaaaggtttttatgattttatggcgcgttttttcgagtcgtagtgacgttattaatgcgtttacgcgttatagtttaattatagggttttttttttttttttagaagtttcgattgtttttgatatattttattttaagcgagtcgcgatatttacgttacgttcgttcgttcgcgcggtgatgacgttacgatttagggttggcgttacgtgtttttttcgcggggggcgtttttgagggcggcgttttcggtcggcggagtttggtggtcgtagcggcggtggcgacgacggtcgagacgtggggatggcgggcgtcgggagcgattcggttcgtcggcgtgtcgttggtgtagtttaacgagttgttggaggacgagggttagttgacggagatggtgtagaagatggaggaggtgagtcgagttgggtttaaggcggcggttgtgaggtttcgagcggggttcgtttttcgaacggtggtcggagatggcgatcgcggcgttttcggtcgtgttgagggg

SEQ ID NO: 14876 - DNA, 592 bp, Artificial Sequence
  chemically treated genomic DNA (Homo sapiens) CpG-island No: 14876
cccctcaacacgaccgaaaacgccgcgatcgccatctccgaccaccgttcgaaaaacgaaccccgctcgaaacctcacaaccgccgccttaaacccaactcgactcacctcctccatcttctacaccatctccgtcaactaaccctcgtcctccaacaactcgttaaactacaccaacgacacgccgacgaaccgaatcgctcccgacgcccgccatccccacgtctcgaccgtcgtcgccaccgccgctacgaccaccaaactccgccgaccgaaaacgccgccctcaaaaacgccccccgcgaaaaaaacacgtaacgccaaccctaaatcgtaacgtcatcaccgcgcgaacgaacgaacgtaacgtaaatatcgcgactcgcttaaaataaaatatatcaaaaacaatcgaaacttctaaaaaaaaaaaaaaaaccctataattaaactataacgcgtaaacgcattaataacgtcactacgactcgaaaaaacgcgccataaaatcataaaaacctttttcctccaaaaaaaaaaataccgcgatccaaaaaaaacaaacaataaaaaaaaaattcccgcaacctat

SEQ ID NO: 14877 - DNA, 509 bp, Artificial Sequence
  chemically treated genomic DNA (Homo sapiens) CpG-island No: 14877
ggggatatcgggttgcgttttcgtcggtcgtcgcgtagatgcgtatttggagtagattcgggtttcggggttgggggaaagagaaattcgggttttaaatttttttggaagttttttgagggcgcgagttcgtagaggtaggagttttcgcgtacgtgtacgttcgaaattgttaaagtttacgcgcgagtttgatcgtcgcgtggaggcgtcggttgcggggagagaagtcgtttcgtttcggtttttttttgcggcgtttttcggttttggttcggttttagtcgtgcgcgggcggtcgtttttttataagttggtttggttgatttagcgtcgtcgttgggtttttaaagggcggtcgttttttgtcgtttcgggacgttcgtcgagtttttttcgttacggggcgggcgttttcgtcgttattttttttgtttttagtcgggaggacgtttttttattgtatttttcggtcgagttgggtagattttcgtttttttatttggggg

SEQ ID NO: 14878 - DNA, 509 bp, Artificial Sequence
  chemically treated genomic DNA (Homo sapiens) CpG-island No: 14878
cccccaaataaaaaaacgaaaatctacccaactcgaccgaaaaatacaataaaaaaacgtcctcccgactaaaaacaaaaaaaataacgacgaaaacgcccgccccgtaacgaaaaaaactcgacgaacgtcccgaaacgacaaaaaacgaccgccctttaaaaacccaacgacgacgctaaatcaaccaaaccaacttataaaaaaacgaccgcccgcgcacgactaaaaccgaaccaaaaccgaaaaacgccgcaaaaaaaaaccgaaacgaaacgacttctctccccgcaaccgacgcctccacgcgacgatcaaactcgcgcgtaaactttaacaatttcgaacgtacacgtacgcgaaaactcctacctctacgaactcgcgccctcaaaaaacttccaaaaaaatttaaaacccgaatttctctttcccccaaccccgaaacccgaatctactccaaatacgcatctacgcgacgaccgacgaaaacgcaacccgatatcccc

SEQ ID NO: 14879 - DNA, 509 bp, Artificial Sequence
  chemically treated genomic DNA (Homo sapiens) CpG-island No: 14879
tttttaggtgggaggacgggggtttgtttagttcggtcggggagtgtagtaggggggcgttttttcgattaagggtaaaggaggtgacggcggggacgttcgtttcgtgacgaggagggttcggcgagcgtttcggggcgataggaagcggtcgttttttgaaggtttagcggcggcgttgggttagttaggttagtttgtgggggagcggtcgttcgcgtacggttggggtcgggttagggtcggagggcgtcgtaggaaggggtcggggcggggcggttttttttttcgtagtcggcgtttttacgcggcggttaagttcgcgcgtgggttttagtagtttcgggcgtgtacgtgcgcggaggtttttgtttttgcggattcgcgtttttaagagatttttaggagggtttggagttcgggttttttttttttttagtttcggaattcgagtttgttttaagtgcgtatttgcgcggcggtcgacggggacgtagttcggtgttttt

SEQ ID NO: 14880 - DNA, 509 bp, Artificial Sequence
  chemically treated genomic DNA (Homo sapiens) CpG-island No: 14880
aaaaacaccgaactacgtccccgtcgaccgccgcgcaaatacgcacttaaaacaaactcgaattccgaaactaaaaaaaaaaaaaacccgaactccaaaccctcctaaaaatctcttaaaaacgcgaatccgcaaaaacaaaaacctccgcgcacgtacacgcccgaaactactaaaacccacgcgcgaacttaaccgccgcgtaaaaacgccgactacgaaaaaaaaaaccgccccgccccgaccccttcctacgacgccctccgaccctaacccgaccccaaccgtacgcgaacgaccgctcccccacaaactaacctaactaacccaacgccgccgctaaaccttcaaaaaacgaccgcttcctatcgccccgaaacgctcgccgaaccctcctcgtcacgaaacgaacgtccccgccgtcacctcctttacccttaatcgaaaaaacgcccccctactacactccccgaccgaactaaacaaacccccgtcctcccacctaaaaa

SEQ ID NO: 14881 - DNA, 543 bp, Artificial Sequence
  chemically treated genomic DNA (Homo sapiens) CpG-island No: 14881
acgcgtacgacgattcgttagtggaagtcgcggtggcgggttttggcgcggcgggcgtttttttttaatttcgtattggtgtttcgcgttttagtgtcgttttatttttttcgtagcgggtattattttttatttagtttattatttgattcggagattatttgtttatcggttttattattagagttatgggtacggggtcggtttcgtgtagagcgtagagtttagatataaaacgaatttagtagttcgagttgtttttaggtggggttttttgttggtcgtagtttttttgggcgggcggcgcggagaaagcggtttttgtgtgtcgggtttcgcggttgtaacgttttttagttaatcgtcggtaggaacggcgatagggaggtaaacgtgtaggagtcgttgtttcgcgtcgggtttgtttagttttcgttaaggcggcggcggcggcggttgttgttgttgttgttgttgttgttgttgttgttgttttcgtgtttcgtttcggttttcgtttttagggagttttagtttatagtt

SEQ ID NO: 14882 - DNA, 543 bp, Artificial Sequence
  chemically treated genomic DNA (Homo sapiens) CpG-island No: 14882
aactataaactaaaactccctaaaaacgaaaaccgaaacgaaacacgaaaacaacaacaacaacaacaacaacaacaacaacaacaaccgccgccgccgccgccttaacgaaaactaaacaaacccgacgcgaaacaacgactcctacacgtttacctccctatcgccgttcctaccgacgattaactaaaaaacgttacaaccgcgaaacccgacacacaaaaaccgctttctccgcgccgcccgcccaaaaaaactacgaccaacaaaaaaccccacctaaaaacaactcgaactactaaattcgttttatatctaaactctacgctctacacgaaaccgaccccgtacccataactctaataataaaaccgataaacaaataatctccgaatcaaataataaactaaataaaaaataatacccgctacgaaaaaaataaaacgacactaaaacgcgaaacaccaatacgaaattaaaaaaaaacgcccgccgcgccaaaacccgccaccgcgacttccactaacgaatcgtcgtacgcgt

SEQ ID NO: 14883 - DNA, 543 bp, Artificial Sequence
  chemically treated genomic DNA (Homo sapiens) CpG-island No: 14883
agttatgaattgaagttttttagggacggagatcggagcggagtacggaggtagtagtagtagtagtagtagtagtagtagtagtagtcgtcgtcgtcgtcgttttagcggaaattgagtagattcggcgcggagtaacgatttttgtacgtttatttttttgtcgtcgtttttgtcggcggttggttaaaagacgttatagtcgcgagattcgatatataaaagtcgtttttttcgcgtcgttcgtttagggaggttgcggttagtaagggattttatttgagagtagttcgggttgttgagttcgttttgtgtttgagttttgcgttttgtacggaatcgatttcgtatttatggttttgataatggaatcggtgagtaaatggttttcgagttaagtagtggattggatgaaaggtaatgttcgttgcggggagggtgaggcggtattggggcgcggggtattagtgcgaggttaggagggggcgttcgtcgcgttagagttcgttatcgcggtttttattggcggatcgtcgtacgcgt

SEQ ID NO: 14884 - DNA, 543 bp, Artificial Sequence
  chemically treated genomic DNA (Homo sapiens) CpG-island No: 14884
acgcgtacgacgatccgccaataaaaaccgcgataacgaactctaacgcgacgaacgccccctcctaacctcgcactaataccccgcgccccaataccgcctcaccctccccgcaacgaacattacctttcatccaatccactacttaactcgaaaaccatttactcaccgattccattatcaaaaccataaatacgaaatcgattccgtacaaaacgcaaaactcaaacacaaaacgaactcaacaacccgaactactctcaaataaaatcccttactaaccgcaacctccctaaacgaacgacgcgaaaaaaacgacttttatatatcgaatctcgcgactataacgtcttttaaccaaccgccgacaaaaacgacgacaaaaaaataaacgtacaaaaatcgttactccgcgccgaatctactcaatttccgctaaaacgacgacgacgacgactactactactactactactactactactactactacctccgtactccgctccgatctccgtccctaaaaaacttcaattcataact

SEQ ID NO: 14885 - DNA, 840 bp, Artificial Sequence
  chemically treated genomic DNA (Homo sapiens) CpG-island No: 14885
gcgtcgtcgagggaagtagtttttgtcgtacgtttttagttaatttgttcgttcgttttacgcgcgggagtgaagtttcgagtacgattagttgttcggcggaaatgacgaggggttttttgttatttaaaatattttttcgtagttttcgggtgcgtggcgcgcgttacgagttttttcgttcgttcgttgtcgcgcggtttcgtttttaggtcgacggaggcgcgcgaggcgtgcgcgtgcgcgtgtcggtacgaggtcgagtttagggtttgtttggtaggtagataggtgttagtagttcgtagtttggcgttttcgttttgggggtcgttcgggaatagaggcgcgcgaagtgcgcgtgcgcggcggcggaggcggtggcggcgcgaggtagagttagagttcggggtcggttaattaggtgcgggcggttggagtatggttttgtgaggtttttgaggggattcggcggtggcggttacggcgggacgggtcgtttattagttgaatttcgatagttgaggcggttgaggaggtattcgcggttttattatcgaggggagggggatattattgagcgcggggtttatagcgagagttcgggtttttttggttttcgttttcgttttcgtttttttcgttgttgagtgggtttcggaggtgattttcgagattcgcgtacgtttgtagagacggaggtgtggattgtcgtggacgagaacggggtttcgtttgttagaagcgtagcgatgatgaggtaggagggttagtgttgtcggatttttttcgggtgatgagcgggttttgggaagttaggcgttgaggttgttatttgtt

SEQ ID NO: 14886 - DNA, 840 bp, Artificial Sequence
  chemically treated genomic DNA (Homo sapiens) CpG-island No: 14886
aacaaataacaacctcaacgcctaacttcccaaaacccgctcatcacccgaaaaaaatccgacaacactaaccctcctacctcatcatcgctacgcttctaacaaacgaaaccccgttctcgtccacgacaatccacacctccgtctctacaaacgtacgcgaatctcgaaaatcacctccgaaacccactcaacaacgaaaaaaacgaaaacgaaaacgaaaaccaaaaaaacccgaactctcgctataaaccccgcgctcaataatatccccctcccctcgataataaaaccgcgaatacctcctcaaccgcctcaactatcgaaattcaactaataaacgacccgtcccgccgtaaccgccaccgccgaatcccctcaaaaacctcacaaaaccatactccaaccgcccgcacctaattaaccgaccccgaactctaactctacctcgcgccgccaccgcctccgccgccgcgcacgcgcacttcgcgcgcctctattcccgaacgacccccaaaacgaaaacgccaaactacgaactactaacacctatctacctaccaaacaaaccctaaactcgacctcgtaccgacacgcgcacgcgcacgcctcgcgcgcctccgtcgacctaaaaacgaaaccgcgcgacaacgaacgaacgaaaaaactcgtaacgcgcgccacgcacccgaaaactacgaaaaaatattttaaataacaaaaaacccctcgtcatttccgccgaacaactaatcgtactcgaaacttcactcccgcgcgtaaaacgaacgaacaaattaactaaaaacgtacgacaaaaactacttccctcgacgacgc

SEQ ID NO: 14887 - DNA, 840 bp, Artificial Sequence
  chemically treated genomic DNA (Homo sapiens) CpG-island No: 14887
ggtaggtgatagttttaacgtttgattttttaggattcgtttattattcggggaagattcgatagtattagtttttttgttttattatcgttgcgtttttggtaggcggagtttcgttttcgtttacggtagtttatattttcgtttttgtaggcgtacgcgggtttcgggaattattttcggagtttatttagtagcggggagggcgagggcgaaagcgagagttaggaaagttcgggttttcgttgtaagtttcgcgtttagtggtgttttttttttttcggtggtggggtcgcggatatttttttagtcgttttagttgtcggagtttaattggtgggcggttcgtttcgtcgtggtcgttatcgtcgggtttttttagaggttttataaagttatgttttagtcgttcgtatttgattgatcgatttcgggttttggttttgtttcgcgtcgttatcgttttcgtcgtcgcgtacgcgtatttcgcgcgtttttgttttcggacggtttttagagcgggaacgttaggttgcgagttgttggtatttgtttgtttgttagatagattttgggttcggtttcgtgtcggtacgcgtacgcgtacgtttcgcgcgttttcgtcggtttgggggcgggatcgcgcggtagcgagcgggcgggggggttcgtggcgcgcgttacgtattcgagggttgcggagagatattttgggtggtaggaggtttttcgttattttcgtcgggtagttagtcgtgttcggggttttattttcgcgcgtgaggcgagcgggtaagttggttgagggcgtgcggtagaggttgtttttttcggcgacgt

SEQ ID NO: 14888 - DNA, 840 bp, Artificial Sequence
  chemically treated genomic DNA (Homo sapiens) CpG-island No: 14888
acgtcgccgaaaaaaacaacctctaccgcacgccctcaaccaacttacccgctcgcctcacgcgcgaaaataaaaccccgaacacgactaactacccgacgaaaataacgaaaaacctcctaccacccaaaatatctctccgcaaccctcgaatacgtaacgcgcgccacgaacccccccgcccgctcgctaccgcgcgatcccgcccccaaaccgacgaaaacgcgcgaaacgtacgcgtacgcgtaccgacacgaaaccgaacccaaaatctatctaacaaacaaacaaataccaacaactcgcaacctaacgttcccgctctaaaaaccgtccgaaaacaaaaacgcgcgaaatacgcgtacgcgacgacgaaaacgataacgacgcgaaacaaaaccaaaacccgaaatcgatcaatcaaatacgaacgactaaaacataactttataaaacctctaaaaaaacccgacgataacgaccacgacgaaacgaaccgcccaccaattaaactccgacaactaaaacgactaaaaaaatatccgcgaccccaccaccgaaaaaaaaaaaacaccactaaacgcgaaacttacaacgaaaacccgaactttcctaactctcgctttcgccctcgccctccccgctactaaataaactccgaaaataattcccgaaacccgcgtacgcctacaaaaacgaaaatataaactaccgtaaacgaaaacgaaactccgcctaccaaaaacgcaacgataataaaacaaaaaaactaatactatcgaatcttccccgaataataaacgaatcctaaaaaatcaaacgttaaaactatcacctacc

SEQ ID NO: 14889 - DNA, 875 bp, Artificial Sequence
  chemically treated genomic DNA (Homo sapiens) CpG-island No: 14889
gttaagtcgtgggttcgaggggacggcgggggagcgggggggtggggcggcgttgggttttcggtgcgtatattttttgcggatatttagtttagatacgtcggtaggtatcgattacgtacgcggagatacgcgatgcgtttatcgacgtttatagttaagcgtaggttcgtaaacgtggatacgggcgtaaagtagtcgcgtaaagttacggatatataaaggtatcgatagcggcgcgttttcgatcgtaaatttataaagatttataaacgtgagatgtacgtgttcgtataaagatttatacggtttttgggcgtagtttttgtttttcgtaagattttttttttgggtcggcgttttttattttcgtttagttttaggcgttcgacgaaagttgaggggtttcggcgggatttagtttcgtttttgcgttcggcgtttttagttcgtttttcgaaggggtcgcgaggttaggatcggggatttgggatttttaatcgtagcgcggattttcgtttcgttcggggaattgtatttatttggaagtttgcgttatagtcgtttcggtacgtttatttcggcggttcggtcgcgggtttttcggttagcgttttttttcgcgcggcgcggttcgtttttcggttttcgttcgtagttaggtttttttttgtcgggcgtcgggtggcggttcgggtcggtcgcggggcggtttagggagtgtcgttaaagtgttagtttttttcggcgcgcgtttcgttcgcggagtttgagtcgagttcgggttttattttagggagcgttttaaaagtgcgttgttttcgttttttttagttggtttcgtttatagttttttgtatttcggatttttgttt

SEQ ID NO: 14890 - DNA, 875 bp, Artificial Sequence
  chemically treated genomic DNA (Homo sapiens) CpG-island No: 14890
aaacaaaaatccgaaatacaaaaaactataaacgaaaccaactaaaaaaaacgaaaacaacgcacttttaaaacgctccctaaaataaaacccgaactcgactcaaactccgcgaacgaaacgcgcgccgaaaaaaactaacactttaacgacactccctaaaccgccccgcgaccgacccgaaccgccacccgacgcccgacaaaaaaaaacctaactacgaacgaaaaccgaaaaacgaaccgcgccgcgcgaaaaaaaacgctaaccgaaaaacccgcgaccgaaccgccgaaataaacgtaccgaaacgactataacgcaaacttccaaataaatacaattccccgaacgaaacgaaaatccgcgctacgattaaaaatcccaaatccccgatcctaacctcgcgaccccttcgaaaaacgaactaaaaacgccgaacgcaaaaacgaaactaaatcccgccgaaacccctcaactttcgtcgaacgcctaaaactaaacgaaaataaaaaacgccgacccaaaaaaaaaatcttacgaaaaacaaaaactacgcccaaaaaccgtataaatctttatacgaacacgtacatctcacgtttataaatctttataaatttacgatcgaaaacgcgccgctatcgatacctttatatatccgtaactttacgcgactactttacgcccgtatccacgtttacgaacctacgcttaactataaacgtcgataaacgcatcgcgtatctccgcgtacgtaatcgatacctaccgacgtatctaaactaaatatccgcaaaaaatatacgcaccgaaaacccaacgccgccccacccccccgctcccccgccgtcccctcgaacccacgacttaac

SEQ ID NO: 14891 - DNA, 875 bp, Artificial Sequence
  chemically treated genomic DNA (Homo sapiens) CpG-island No: 14891
gggtagggattcgggatgtaggaagttgtgagcgaggttaattagagggggcgggagtagcgtatttttgagacgttttttagagtggaattcgggttcggtttaggtttcgcgggcggggcgcgcgtcgagagaggttggtattttggcgatattttttgagtcgtttcgcggtcggttcgagtcgttattcggcgttcggtaggggggagtttggttgcgggcggggatcggggggcgggtcgcgtcgcgcggagaaaagcgttggtcggagggttcgcggtcgggtcgtcggggtgagcgtgtcgaggcggttgtggcgtaggtttttaggtgagtgtagtttttcgggcggggcgagagttcgcgttgcggttgaagattttaagttttcgattttagtttcgcggttttttcggagggcgggttggggacgtcgggcgtaggggcggggttgggtttcgtcgaggttttttaattttcgtcggacgtttagggttgggcgggagtggggaacgtcgatttaggggagaggttttgcgggagataaaggttacgtttaggggtcgtgtgggtttttgtgcggatacgtgtattttacgtttgtgggtttttgtggatttgcggtcggggacgcgtcgttgtcggtgtttttgtgtgttcgtggttttgcgcggttgttttgcgttcgtgtttacgtttgcgggtttgcgtttggttgtgggcgtcggtgggcgtatcgcgtgttttcgcgtacgtggtcggtgtttgtcgacgtgtttgggttgggtgttcgtagagggtgtgcgtatcgagagtttaacgtcgttttattttttcgttttttcgtcgttttttcgggtttacgatttggt

SEQ ID NO: 14892 - DNA, 875 bp, Artificial Sequence
  chemically treated genomic DNA (Homo sapiens) CpG-island No: 14892
accaaatcgtaaacccgaaaaaacgacgaaaaaacgaaaaaataaaacgacgttaaactctcgatacgcacaccctctacgaacacccaacccaaacacgtcgacaaacaccgaccacgtacgcgaaaacacgcgatacgcccaccgacgcccacaaccaaacgcaaacccgcaaacgtaaacacgaacgcaaaacaaccgcgcaaaaccacgaacacacaaaaacaccgacaacgacgcgtccccgaccgcaaatccacaaaaacccacaaacgtaaaatacacgtatccgcacaaaaacccacacgacccctaaacgtaacctttatctcccgcaaaacctctcccctaaatcgacgttccccactcccgcccaaccctaaacgtccgacgaaaattaaaaaacctcgacgaaacccaaccccgcccctacgcccgacgtccccaacccgccctccgaaaaaaccgcgaaactaaaatcgaaaacttaaaatcttcaaccgcaacgcgaactctcgccccgcccgaaaaactacactcacctaaaaacctacgccacaaccgcctcgacacgctcaccccgacgacccgaccgcgaaccctccgaccaacgcttttctccgcgcgacgcgacccgccccccgatccccgcccgcaaccaaactcccccctaccgaacgccgaataacgactcgaaccgaccgcgaaacgactcaaaaaatatcgccaaaataccaacctctctcgacgcgcgccccgcccgcgaaacctaaaccgaacccgaattccactctaaaaaacgtctcaaaaatacgctactcccgccccctctaattaacctcgctcacaacttcctacatcccgaatccctaccc

SEQ ID NO: 14893 - DNA, 725 bp, Artificial Sequence
  chemically treated genomic DNA (Homo sapiens) CpG-island No: 14893
agggagcggcgggcgagcgaggttcgagcggagatagcggcgtacgttgggtttcgagtttcggtttcgaagtttttttttcggtagtaggtgtgcgcggttgaggtgtttattcgtttttcggttgggttcgtgcggggcgggggaggttagggcgggtttgcgagtttttttttcgtaagtcgggttcgatttatttgttgcggcggcggtagcgtttagttgcgcggggcgcggggagttttgttttcggagtacggggcggcggttcggggcgtcggggcggcggttgtcggggtagcgcgtattatttcgggttgttcgcgcgttttttcggggttgcgacgggttgggcggggcgcggcgaggcgaggcgagggatgcggatcgggtggggttacggaggacggaggcggagggtttagcgttttcgtcggcgcgattttttttttcgttgcggttttttttttttttcggtttcggttttatagtcgtcgtcgtcggttattatcggttggattcgttttagggtcgggcgttgaggatcggtcgttaggtgtagcgtttcgttttttgcggcggcggcggatgcgtcgattgttcgttttcggtttttagttcgtttcggcggttcggagggatatttgaatttagtcgggttcggggagtacgttgaggaggcgaaagtattgggcgaggttttatttttatcgtattttttattt

SEQ ID NO: 14894 - DNA, 725 bp, Artificial Sequence
  chemically treated genomic DNA (Homo sapiens) CpG-island No: 14894
aaataaaaaatacgataaaaataaaacctcgcccaatactttcgcctcctcaacgtactccccgaacccgactaaattcaaatatccctccgaaccgccgaaacgaactaaaaaccgaaaacgaacaatcgacgcatccgccgccgccgcaaaaaacgaaacgctacacctaacgaccgatcctcaacgcccgaccctaaaacgaatccaaccgataataaccgacgacgacgactataaaaccgaaaccgaaaaaaaaaaaaaaccgcaacgaaaaaaaaaatcgcgccgacgaaaacgctaaaccctccgcctccgtcctccgtaaccccacccgatccgcatccctcgcctcgcctcgccgcgccccgcccaacccgtcgcaaccccgaaaaaacgcgcgaacaacccgaaataatacgcgctaccccgacaaccgccgccccgacgccccgaaccgccgccccgtactccgaaaacaaaactccccgcgccccgcgcaactaaacgctaccgccgccgcaacaaataaatcgaacccgacttacgaaaaaaaaactcgcaaacccgccctaacctcccccgccccgcacgaacccaaccgaaaaacgaataaacacctcaaccgcgcacacctactaccgaaaaaaaaacttcgaaaccgaaactcgaaacccaacgtacgccgctatctccgctcgaacctcgctcgcccgccgctccct

SEQ ID NO: 14895 - DNA, 725 bp, Artificial Sequence
  chemically treated genomic DNA (Homo sapiens) CpG-island No: 14895
gggtggagggtgcggtagggatggagtttcgtttagtgttttcgtttttttagcgtgtttttcgggttcggttgggtttaggtgttttttcgggtcgtcggggcgggttggaggtcgggagcgggtagtcgacgtattcgtcgtcgtcgtaggaggcggagcgttgtatttggcggtcggtttttagcgttcggttttgaaacgggtttagtcggtagtgatcggcggcggcgattgtgaggtcggggtcggggaggaggaggagtcgtagcgggagagaaggtcgcgtcggcgggagcgttgggtttttcgttttcgtttttcgtggttttattcggttcgtatttttcgtttcgtttcgtcgcgtttcgtttagttcgtcgtagtttcggaggagcgcgcgagtagttcgggatggtgcgcgttgtttcgatagtcgtcgtttcggcgtttcgagtcgtcgtttcgtgtttcggggatagggtttttcgcgtttcgcgtagttgagcgttgtcgtcgtcgtagtaggtgagtcgggttcggtttgcggagaaggggttcgtagattcgttttggtttttttcgtttcgtacgggtttagtcggagggcgggtaggtattttagtcgcgtatatttgttgtcgggaaaggggtttcggggtcggggttcggagtttagcgtgcgtcgttgttttcgttcgggtttcgttcgttcgtcgtttttt

SEQ ID NO: 14896 - DNA, 725 bp, Artificial Sequence
  chemically treated genomic DNA (Homo sapiens) CpG-island No: 14896
aaaaaacgacgaacgaacgaaacccgaacgaaaacaacgacgcacgctaaactccgaaccccgaccccgaaacccctttcccgacaacaaatatacgcgactaaaatacctacccgccctccgactaaacccgtacgaaacgaaaaaaaccaaaacgaatctacgaaccccttctccgcaaaccgaacccgactcacctactacgacgacgacaacgctcaactacgcgaaacgcgaaaaaccctatccccgaaacacgaaacgacgactcgaaacgccgaaacgacgactatcgaaacaacgcgcaccatcccgaactactcgcgcgctcctccgaaactacgacgaactaaacgaaacgcgacgaaacgaaacgaaaaatacgaaccgaataaaaccacgaaaaacgaaaacgaaaaacccaacgctcccgccgacgcgaccttctctcccgctacgactcctcctcctccccgaccccgacctcacaatcgccgccgccgatcactaccgactaaacccgtttcaaaaccgaacgctaaaaaccgaccgccaaatacaacgctccgcctcctacgacgacgacgaatacgtcgactacccgctcccgacctccaacccgccccgacgacccgaaaaaacacctaaacccaaccgaacccgaaaaacacgctaaaaaaacgaaaacactaaacgaaactccatccctaccgcaccctccaccc

SEQ ID NO: 14897 - DNA, 767 bp, Artificial Sequence
  chemically treated genomic DNA (Homo sapiens) CpG-island No: 14897
tatcgcgttttatttgtgacgtcgcggacgttcggttcgggtaggcgtggggggttcgcgcgtttcgggagtttcgaggcggtagcgcgcgtttttacgtcgcggtttcgcgggaaagtcgggggcggcggtttggttgaggttaagttcggattcggtgtcgagttaagcggggtcgtgcgtcgtcggggtttcgttttcgttcgcgtgattttcgtcgttttttttaattttcgttttttggtcgcgtttgcggtcgtacgtttagcgtttttcgtttaatttcgcgttcgggtcgcgtttttttttttttttgtttttcgtcgttttcgtttttcgagggaaaggttgttgttttttgttttgtttttattttcggtttaggtaatacgtttttttttttacgatatttattatagggttttcgcgtcgttgttttttttttttggatttggggttcgggttggtgagcggcgcgcgtcgtcgttttttcgcgggtaggtgagtcgatggcgtcgggagggtttttcgtttttgcgcgtcggtttgcgaggtttttgtttcggtagcgaggtcgttttcggtcgggttcggttaggtatgttcggtatcgtcgttgtagttagcgcggaggggagttcgtgagtttcgcggcgtttttggttttgttcgagcggttcgatggggttggggggcgggaagaaagggtggtaaataacgattttaaaaatttagttattagtatttgtaggacgaagaagttgatt

SEQ ID NO: 14898 - DNA, 767 bp, Artificial Sequence
  chemically treated genomic DNA (Homo sapiens) CpG-island No: 14898
aatcaacttcttcgtcctacaaatactaataactaaatttttaaaatcgttatttaccaccctttcttcccgccccccaaccccatcgaaccgctcgaacaaaaccaaaaacgccgcgaaactcacgaactcccctccgcgctaactacaacgacgataccgaacatacctaaccgaacccgaccgaaaacgacctcgctaccgaaacaaaaacctcgcaaaccgacgcgcaaaaacgaaaaaccctcccgacgccatcgactcacctacccgcgaaaaaacgacgacgcgcgccgctcaccaacccgaaccccaaatccaaaaaaaaaaaacaacgacgcgaaaaccctataataaatatcgtaaaaaaaaaaacgtattacctaaaccgaaaataaaaacaaaacaaaaaacaacaacctttccctcgaaaaacgaaaacgacgaaaaacaaaaaaaaaaaaaaacgcgacccgaacgcgaaattaaacgaaaaacgctaaacgtacgaccgcaaacgcgaccaaaaaacgaaaattaaaaaaaacgacgaaaatcacgcgaacgaaaacgaaaccccgacgacgcacgaccccgcttaactcgacaccgaatccgaacttaacctcaaccaaaccgccgcccccgactttcccgcgaaaccgcgacgtaaaaacgcgcgctaccgcctcgaaactcccgaaacgcgcgaaccccccacgcctacccgaaccgaacgtccgcgacgtcacaaataaaacgcgata

SEQ ID NO: 14899 - DNA, 767 bp, Artificial Sequence
  chemically treated genomic DNA (Homo sapiens) CpG-island No: 14899
gattagttttttcgttttataaatattaatgattggatttttaaaatcgttgtttgttatttttttttttcgttttttaattttatcgggtcgttcgggtagggttaagggcgtcgcgggatttacgagttttttttcgcgttggttgtagcggcgatgtcgggtatgtttggtcgggttcggtcgggggcggtttcgttgtcggggtagggatttcgtaggtcggcgcgtagaggcgaggaattttttcggcgttatcgatttatttattcgcggagaggcgacggcgcgcgtcgtttattagttcgggttttagatttaaggaggaggggtagcggcgcggggattttgtggtgggtgtcgtaaggaggaaaacgtgttatttaagtcggggatgaggatagagtaggaggtagtagtttttttttcgagaaacggaagcggcggggagtaggaggaggaggaggcgcggttcgggcgcgaggttaggcgaggggcgttgggcgtgcggtcgtaggcgcggttagaggacgagggttggggaggacggcggaggttacgcgagcgaaggcgaagtttcggcgacgtacggtttcgtttggttcggtatcggattcgagtttggttttagttaggtcgtcgttttcggttttttcgcgggatcgcggcgtggaaacgcgcgttgtcgtttcggggttttcgggacgcgcgggttttttacgtttgttcgagtcgggcgttcgcgacgttataagtggagcgcgatg

SEQ ID NO: 14900 - DNA, 767 bp, Artificial Sequence
  chemically treated genomic DNA (Homo sapiens) CpG-island No: 14900
catcgcgctccacttataacgtcgcgaacgcccgactcgaacaaacgtaaaaaacccgcgcgtcccgaaaaccccgaaacgacaacgcgcgtttccacgccgcgatcccgcgaaaaaaccgaaaacgacgacctaactaaaaccaaactcgaatccgataccgaaccaaacgaaaccgtacgtcgccgaaacttcgccttcgctcgcgtaacctccgccgtcctccccaaccctcgtcctctaaccgcgcctacgaccgcacgcccaacgcccctcgcctaacctcgcgcccgaaccgcgcctcctcctcctcctactccccgccgcttccgtttctcgaaaaaaaaactactacctcctactctatcctcatccccgacttaaataacacgttttcctccttacgacacccaccacaaaatccccgcgccgctacccctcctccttaaatctaaaacccgaactaataaacgacgcgcgccgtcgcctctccgcgaataaataaatcgataacgccgaaaaaattcctcgcctctacgcgccgacctacgaaatccctaccccgacaacgaaaccgcccccgaccgaacccgaccaaacatacccgacatcgccgctacaaccaacgcgaaaaaaaactcgtaaatcccgcgacgcccttaaccctacccgaacgacccgataaaattaaaaaacgaaaaaaaaaaataacaaacaacgattttaaaaatccaatcattaatatttataaaacgaaaaaactaatc

SEQ ID NO: 14901 - DNA, 606 bp, Artificial Sequence
  chemically treated genomic DNA (Homo sapiens) CpG-island No: 14901
ttttcgtacgtttttttcggtttcgttttttttagagcgtgggtttcgcgcgtcgttatcgttcggtcgggaggcgcggggttttttagaaggttcgggtatgtcggagggagtcgcggtgtagagatttgttacgcggttgttcgggcggcgcgcgttggagtagttttgttttttttgttttcgacgggtattttgttttgcggaatatttattcgagttttgcgcgggaggggcggtcgggaggcgcgcgggtatgcggaggggaaatagggttgtagttttaagtttaggtaggacgtttttagttattttatcggaaagtgggtagcgtcgcgttttcggttagttagagttttaggtaaataaagagttcggtgtttgcggggttttggttttagtggttcgttttgttatttcgttttttaatatacgtattcgtaggattttttttgagggtttttttttttggagtgagtattgaacgtagagcgtttggacggtggcgcggcgtttacgattcggtttcgcgtagattttagagatttttgtaggatagggagtagtttttaaaggtttttttttttttttttttatttgttttat

SEQ ID NO: 14902 - DNA, 606 bp, Artificial Sequence
  chemically treated genomic DNA (Homo sapiens) CpG-island No: 14902
ataaaacaaataaaaaaaaaaaaaaaaaaacctttaaaaactactccctatcctacaaaaatctctaaaatctacgcgaaaccgaatcgtaaacgccgcgccaccgtccaaacgctctacgttcaatactcactccaaaaaaaaaaaccctcaaaaaaaatcctacgaatacgtatattaaaaaacgaaataacaaaacgaaccactaaaaccaaaaccccgcaaacaccgaactctttatttacctaaaactctaactaaccgaaaacgcgacgctacccactttccgataaaataactaaaaacgtcctacctaaacttaaaactacaaccctatttcccctccgcatacccgcgcgcctcccgaccgcccctcccgcgcaaaactcgaataaatattccgcaaaacaaaatacccgtcgaaaacaaaaaaaacaaaactactccaacgcgcgccgcccgaacaaccgcgtaacaaatctctacaccgcgactccctccgacatacccgaaccttctaaaaaaccccgcgcctcccgaccgaacgataacgacgcgcgaaacccacgctctaaaaaaaacgaaaccgaaaaaaacgtacgaaaa

SEQ ID NO: 14903 - DNA, 606 bp, Artificial Sequence
  chemically treated genomic DNA (Homo sapiens) CpG-island No: 14903
gtgaggtaaataggaggaaggaggaaagggtttttaggagttgttttttattttgtaggagtttttggagtttgcgcggggtcgggtcgtgaacgtcgcgttatcgtttaagcgttttgcgtttagtgtttattttaaaaaaggaaatttttaaagaaagttttgcgggtgcgtgtattggaaagcggagtgatagagcgagttattgaggttagagtttcgtagatatcgagttttttatttatttggggttttgattaatcggagacgcggcgttgtttatttttcgataaggtgattaagggcgttttgtttgggtttgaagttgtagttttgtttttttttcgtatgttcgcgcgtttttcggtcgtttttttcgcgtagggttcgggtgggtgtttcgtagggtaggatgttcgtcgggagtagaggaaataaagttgttttagcgcgcgtcgttcgggtagtcgcgtggtaagtttttgtatcgcggtttttttcgatatgttcgagttttttagggagtttcgcgtttttcggtcgggcggtggcggcgcgcggggtttacgttttgaggagggcggggtcggggagggcgtgcgggga

SEQ ID NO: 14904 - DNA, 606 bp, Artificial Sequence
  chemically treated genomic DNA (Homo sapiens) CpG-island No: 14904
tccccgcacgccctccccgaccccgccctcctcaaaacgtaaaccccgcgcgccgccaccgcccgaccgaaaaacgcgaaactccctaaaaaactcgaacatatcgaaaaaaaccgcgatacaaaaacttaccacgcgactacccgaacgacgcgcgctaaaacaactttatttcctctactcccgacgaacatcctaccctacgaaacacccacccgaaccctacgcgaaaaaaacgaccgaaaaacgcgcgaacatacgaaaaaaaaacaaaactacaacttcaaacccaaacaaaacgcccttaatcaccttatcgaaaaataaacaacgccgcgtctccgattaatcaaaaccccaaataaataaaaaactcgatatctacgaaactctaacctcaataactcgctctatcactccgctttccaatacacgcacccgcaaaactttctttaaaaatttccttttttaaaataaacactaaacgcaaaacgcttaaacgataacgcgacgttcacgacccgaccccgcgcaaactccaaaaactcctacaaaataaaaaacaactcctaaaaaccctttcctccttcctcctatttacctcac

SEQ ID NO: 14905 - DNA, 734 bp, Artificial Sequence
  chemically treated genomic DNA (Homo sapiens) CpG-island No: 14905
gcgcgtcgttttcgtcgttgtcggggtcgtcggttcggggagtcgttcgtcgtttatcggtgaacgggagcgcgttttttttttcgagggattaagcgttcgcgtacgtatttcgtcgcgtcggaagcggggattattggcggtttagttgggagtgatcgcggtcgaatgattcggggcgatttcgtagtaagggcgttttcggaggcggtaaagttttttgagaatcggcgcgtttttcgtcgcgacggattttattcggtcgggcgtttagttttttcgtcgttttttttagttcggtcgttttttttaacggtcgtcgtagtttttttatggatcgagagcgcgggtttgtagtcggtagtttcgttcggcgcgcggtttcgggtaggtcgttttttttcgtttttttgcgtcgcgaggttttttttcgtttcgtttttcgggtttcggcgtaaattagagtgtcgcgtagttgacgagcgatgtttgcgatgattttatttttggtgtgggatgacgttaaatttaagatggatggaattatagcgcgatgcggcggttgggcgcgcgcgagtcgaagtgtgagcggaaaggggttcggcgtttgtttcgagattgaagatcggtgagtaattgttacgtttttagttttaggagaattgcggggttttttgggaggttatagttttttcgtaaaaaacggttttttttgacgtaattttgaggtgatt

SEQ ID NO: 14906 - DNA, 734 bp, Artificial Sequence
  chemically treated genomic DNA (Homo sapiens) CpG-island No: 14906
aatcacctcaaaattacgtcaaaaaaaaccgttttttacgaaaaaactataacctcccaaaaaaccccgcaattctcctaaaactaaaaacgtaacaattactcaccgatcttcaatctcgaaacaaacgccgaacccctttccgctcacacttcgactcgcgcgcgcccaaccgccgcatcgcgctataattccatccatcttaaatttaacgtcatcccacaccaaaaataaaatcatcgcaaacatcgctcgtcaactacgcgacactctaatttacgccgaaacccgaaaaacgaaacgaaaaaaaacctcgcgacgcaaaaaaacgaaaaaaaacgacctacccgaaaccgcgcgccgaacgaaactaccgactacaaacccgcgctctcgatccataaaaaaactacgacgaccgttaaaaaaaacgaccgaactaaaaaaaacgacgaaaaaactaaacgcccgaccgaataaaatccgtcgcgacgaaaaacgcgccgattctcaaaaaactttaccgcctccgaaaacgcccttactacgaaatcgccccgaatcattcgaccgcgatcactcccaactaaaccgccaataatccccgcttccgacgcgacgaaatacgtacgcgaacgcttaatccctcgaaaaaaaaaacgcgctcccgttcaccgataaacgacgaacgactccccgaaccgacgaccccgacaacgacgaaaacgacgcgc

SEQ ID NO: 14907 - DNA, 734 bp, Artificial Sequence
  chemically treated genomic DNA (Homo sapiens) CpG-island No: 14907
aattattttagagttacgttaggaaaggtcgttttttgcggggaggttgtagttttttaaggagtttcgtagtttttttagagttaggggcgtgatagttatttatcggtttttagtttcgaggtagacgtcgggttttttttcgtttatatttcggttcgcgcgcgtttagtcgtcgtatcgcgttgtgattttatttattttgaatttgacgttattttatattagggatgaggttatcgtaggtatcgttcgttaattgcgcggtattttgatttgcgtcgggattcggagggcggagcgggggggggtttcgcggcgtagggggacgggggagggcggtttgttcggagtcgcgcgtcgaacggagttgtcggttgtaagttcgcgttttcggtttatgaggggattgcggcggtcgttaggggaggcggtcgggttgggggaaacggcgaggaggttgagcgttcggtcgggtggagttcgtcgcggcgaggagcgcgtcgatttttaggggattttgtcgttttcggaggcgtttttgttgcggggtcgtttcgggttattcggtcgcggttatttttagttgggtcgttagtagttttcgttttcggcgcggcgggatgcgtgcgcgagcgtttagtttttcggaggggaggacgcgttttcgtttatcggtggacggcgggcgatttttcgagtcgacgatttcgatagcgacgggagcgacgcgt

SEQ ID NO: 14908 - DNA, 734 bp, Artificial Sequence
  chemically treated genomic DNA (Homo sapiens) CpG-island No: 14908
acgcgtcgctcccgtcgctatcgaaatcgtcgactcgaaaaatcgcccgccgtccaccgataaacgaaaacgcgtcctcccctccgaaaaactaaacgctcgcgcacgcatcccgccgcgccgaaaacgaaaactactaacgacccaactaaaaataaccgcgaccgaataacccgaaacgaccccgcaacaaaaacgcctccgaaaacgacaaaatcccctaaaaatcgacgcgctcctcgccgcgacgaactccacccgaccgaacgctcaacctcctcgccgtttcccccaacccgaccgcctcccctaacgaccgccgcaatcccctcataaaccgaaaacgcgaacttacaaccgacaactccgttcgacgcgcgactccgaacaaaccgccctcccccgtccccctacgccgcgaaacccccccccgctccgccctccgaatcccgacgcaaatcaaaataccgcgcaattaacgaacgatacctacgataacctcatccctaatataaaataacgtcaaattcaaaataaataaaatcacaacgcgatacgacgactaaacgcgcgcgaaccgaaatataaacgaaaaaaaacccgacgtctacctcgaaactaaaaaccgataaataactatcacgcccctaactctaaaaaaactacgaaactccttaaaaaactacaacctccccgcaaaaaacgacctttcctaacgtaactctaaaataatt

SEQ ID NO: 14909 - DNA, 624 bp, Artificial Sequence
  chemically treated genomic DNA (Homo sapiens) CpG-island No: 14909
agggtgatcgcgatttttatcgcgaggtggattagcgcgagatcgagtagttggtgggcgacgatttttagcgttgcgtttatttcgagatttcggttaagaagaatagtagtttggattagatgtttcgcgcgtttttcgttatggttaagttgtttagcgagatgagtttagatttgtatcgtaaggtttcggtgtagtattgcgacgtgttgtataagaaggcgttgcggaataagaagttgttgcgggtcggtagcggcggcggcggcggcgattcgggcgattttttggtatcgtggtatttttcgcgcgtcggtttagcgtatatagcgattttatgtatattcgcgagaaggttagcgtcggtagttaggttaaggataaggagcgttgcgttattagttaggagtttcgtcgcgttggcgatataatttaaggaggatttttttgttaagttaaatttaacggttcggtgcgttttaggtcgggagcgcgcgcggattggcgttttttttttcggcgattcgtttttagtattggggaggcgttattgaatcgagaagggacggttatttgtttcggaaggaaagagaacgggttaagattgggattattttttat

SEQ ID NO: 14910 - DNA, 624 bp, Artificial Sequence
  chemically treated genomic DNA (Homo sapiens) CpG-island No: 14910
ataaaaaataatcccaatcttaacccgttctctttccttccgaaacaaataaccgtcccttctcgattcaataacgcctccccaatactaaaaacgaatcgccgaaaaaaaaaacgccaatccgcgcgcgctcccgacctaaaacgcaccgaaccgttaaatttaacttaacaaaaaaatcctccttaaattatatcgccaacgcgacgaaactcctaactaataacgcaacgctccttatccttaacctaactaccgacgctaaccttctcgcgaatatacataaaatcgctatatacgctaaaccgacgcgcgaaaaataccacgataccaaaaaatcgcccgaatcgccgccgccgccgccgctaccgacccgcaacaacttcttattccgcaacgccttcttatacaacacgtcgcaatactacaccgaaaccttacgatacaaatctaaactcatctcgctaaacaacttaaccataacgaaaaacgcgcgaaacatctaatccaaactactattcttcttaaccgaaatctcgaaataaacgcaacgctaaaaatcgtcgcccaccaactactcgatctcgcgctaatccacctcgcgataaaaatcgcgatcaccct

SEQ ID NO: 14911 - DNA, 624 bp, Artificial Sequence
  chemically treated genomic DNA (Homo sapiens) CpG-island No: 14911
gtggggaatagttttagttttggttcgtttttttttttttcggagtagatgatcgttttttttcggtttagtggcgtttttttagtgttgggggcggatcgtcgggaggggagacgttagttcgcgcgcgttttcggtttggggcgtatcgggtcgttggatttgatttaataaaaaggttttttttaggttgtgtcgttagcgcggcgaggtttttagttgatgacgtagcgttttttgtttttggtttggttgtcggcgttggttttttcgcggatgtatatgaggtcgttgtgtacgttgggtcggcgcgcgaagggtgttacgatgttaaagggtcgttcgggtcgtcgtcgtcgtcgtcgttgtcggttcgtagtagttttttgtttcgtagcgtttttttgtgtagtacgtcgtagtattgtatcgagattttgcggtgtaggtttgggtttatttcgttgggtagtttggttatggcgaagagcgcgcggaatatttggtttaggttgttgttttttttggtcgagatttcgaagtaggcgtagcgttgggggtcgtcgtttattagttgttcgatttcgcgttggtttatttcgcggtagaagtcgcggttatttt

SEQ ID NO: 14912 - DNA, 624 bp, Artificial Sequence
  chemically treated genomic DNA (Homo sapiens) CpG-island No: 14912
aaaataaccgcgacttctaccgcgaaataaaccaacgcgaaatcgaacaactaataaacgacgacccccaacgctacgcctacttcgaaatctcgaccaaaaaaaacaacaacctaaaccaaatattccgcgcgctcttcgccataaccaaactacccaacgaaataaacccaaacctacaccgcaaaatctcgatacaatactacgacgtactacacaaaaaaacgctacgaaacaaaaaactactacgaaccgacaacgacgacgacgacgacgacccgaacgaccctttaacatcgtaacacccttcgcgcgccgacccaacgtacacaacgacctcatatacatccgcgaaaaaaccaacgccgacaaccaaaccaaaaacaaaaaacgctacgtcatcaactaaaaacctcgccgcgctaacgacacaacctaaaaaaaacctttttattaaatcaaatccaacgacccgatacgccccaaaccgaaaacgcgcgcgaactaacgtctcccctcccgacgatccgcccccaacactaaaaaaacgccactaaaccgaaaaaaaacgatcatctactccgaaaaaaaaaaaaacgaaccaaaactaaaactattccccac

SEQ ID NO: 14913 - DNA, 948 bp, Artificial Sequence
  chemically treated genomic DNA (Homo sapiens) CpG-island No: 14913
agtgttcgtcgcgtatcgtttttagagtaaagcgaattttagaagagggcgtggggttttgggcgtgtggggtttgggcgtgtgtgattcgggttaagtttaagttcgtaggaggttgcgcgggaagttgtttatagttacgattcgcggttttcggtttttagttttatcgtcgttaggtaagggtagggacgttaggttagttataggttcgggtgcggtagtcggcgattaaaggtattgggcgggaggtcggatttaaggggatattgttacgtagttgtagcggaatcggtaggttttgcggcgaaatatattgggatttgtagttttcggtttttttagagttgtcgcgagtttttagataaagaggtatttcgcggtgacggggaattatattttttagaaggtcggaatatgttgggggttatcgggaaagcgtttcgattggcggtatttattcggttttataggttcggtttcgggggcgcgtggttgtagcggggttcgcgtggtgtttttgaggcggttttcggatgaagagatttgggaattcgggagtcgaggtaacgaatagttcggtggtagggtttgattgttgcggaggtttcggtaatattgattttagataggtattgatcgtatcggatcgtcgcggaaattgggagagggatttgtaaggtcgaggggcgtgaaggtttgcggcgttttaaacgttgcgggcggggtcgttagtttttaggtaatgggggcgtggcgtggcgggggtgggggagtcgcgtgcgggagcgtcggttggtgtttgtgtgtgtgcgtgtgcgcgcgcgtgtaaattttagattgcgtgtgttagagacgggggcgtttttgagttcgtttgattgtgtgtttgtgtgtggttttgagattgtgtgagatttagaggttgttcgtgttagtttttgggat

SEQ ID NO: 14914 - DNA, 948 bp, Artificial Sequence
  chemically treated genomic DNA (Homo sapiens) CpG-island No: 14914
atcccaaaaactaacacgaacaacctctaaatctcacacaatctcaaaaccacacacaaacacacaatcaaacgaactcaaaaacgcccccgtctctaacacacgcaatctaaaatttacacgcgcgcgcacacgcacacacacaaacaccaaccgacgctcccgcacgcgactcccccacccccgccacgccacgcccccattacctaaaaactaacgaccccgcccgcaacgtttaaaacgccgcaaaccttcacgcccctcgaccttacaaatccctctcccaatttccgcgacgatccgatacgatcaatacctatctaaaatcaatattaccgaaacctccgcaacaatcaaaccctaccaccgaactattcgttacctcgactcccgaattcccaaatctcttcatccgaaaaccgcctcaaaaacaccacgcgaaccccgctacaaccacgcgcccccgaaaccgaacctataaaaccgaataaataccgccaatcgaaacgctttcccgataacccccaacatattccgaccttctaaaaaatataattccccgtcaccgcgaaatacctctttatctaaaaactcgcgacaactctaaaaaaaccgaaaactacaaatcccaatatatttcgccgcaaaacctaccgattccgctacaactacgtaacaatatccccttaaatccgacctcccgcccaatacctttaatcgccgactaccgcacccgaacctataactaacctaacgtccctacccttacctaacgacgataaaactaaaaaccgaaaaccgcgaatcgtaactataaacaacttcccgcgcaacctcctacgaacttaaacttaacccgaatcacacacgcccaaaccccacacgcccaaaaccccacgccctcttctaaaattcgctttactctaaaaacgatacgcgacgaacact

SEQ ID NO: 14915 - DNA, 948 bp, Artificial Sequence
  chemically treated genomic DNA (Homo sapiens) CpG-island No: 14915
attttaaagattaatacggataatttttgagttttatataattttagggttatatataggtatataattagacgagtttaggaacgttttcgtttttgatatacgtaatttgaggtttatacgcgcgcgtatacgtatatatatagatattagtcggcgttttcgtacgcggtttttttattttcgttacgttacgtttttattgtttgggaattggcggtttcgttcgtagcgtttgaggcgtcgtaagtttttacgtttttcggttttgtagattttttttttagttttcgcggcggttcggtgcggttagtatttgtttaaaattaatattgtcgaggttttcgtagtagttaggttttgttatcgagttgttcgttatttcggttttcgggtttttagatttttttattcgggggtcgttttaggagtattacgcgggtttcgttgtagttacgcgttttcggaatcggatttatagagtcgggtaagtgtcgttagtcggggcgttttttcggtgatttttaatatatttcggttttttgggaaatgtagtttttcgttatcgcgaagtgtttttttatttgggggttcgcgatagttttagaggagtcgagaattataagttttagtgtgtttcgtcgtagagtttgtcggtttcgttgtagttacgtagtagtatttttttggattcggtttttcgtttagtgtttttggtcgtcggttgtcgtattcgagtttgtaattgatttggcgtttttgtttttgtttggcggcggtggggttagaggtcgggggtcgcgggtcgtagttataagtagtttttcgcgtagttttttgcggatttggatttggttcgggttatatacgtttaggttttatacgtttagggttttacgtttttttttgaaattcgttttattttgggggcggtgcgcgacgagtatt

SEQ ID NO: 14916 - DNA, 948 bp, Artificial Sequence
  chemically treated genomic DNA (Homo sapiens) CpG-island No: 14916
aatactcgtcgcgcaccgcccccaaaataaaacgaatttcaaaaaaaaacgtaaaaccctaaacgtataaaacctaaacgtatataacccgaaccaaatccaaatccgcaaaaaactacgcgaaaaactacttataactacgacccgcgacccccgacctctaaccccaccgccgccaaacaaaaacaaaaacgccaaatcaattacaaactcgaatacgacaaccgacgaccaaaaacactaaacgaaaaaccgaatccaaaaaaatactactacgtaactacaacgaaaccgacaaactctacgacgaaacacactaaaacttataattctcgactcctctaaaactatcgcgaacccccaaataaaaaaacacttcgcgataacgaaaaactacatttcccaaaaaaccgaaatatattaaaaatcaccgaaaaaacgccccgactaacgacacttacccgactctataaatccgattccgaaaacgcgtaactacaacgaaacccgcgtaatactcctaaaacgacccccgaataaaaaaatctaaaaacccgaaaaccgaaataacgaacaactcgataacaaaacctaactactacgaaaacctcgacaatattaattttaaacaaatactaaccgcaccgaaccgccgcgaaaactaaaaaaaaaatctacaaaaccgaaaaacgtaaaaacttacgacgcctcaaacgctacgaacgaaaccgccaattcccaaacaataaaaacgtaacgtaacgaaaataaaaaaaccgcgtacgaaaacgccgactaatatctatatatatacgtatacgcgcgcgtataaacctcaaattacgtatatcaaaaacgaaaacgttcctaaactcgtctaattatatacctatatataaccctaaaattatataaaactcaaaaattatccgtattaatctttaaaat

SEQ ID NO: 14917 - DNA, 531 bp, Artificial Sequence
  chemically treated genomic DNA (Homo sapiens) CpG-island No: 14917
ttcgttcgggttatcgtcgcgggggtttattggtagcggtttttgcgtatgttcggaagagcgggtagggtttttatttcgggagcggagacggagaataggttatgtgggagtcggcgggggtatttgtcggcgatattcgagcgggggtcggaagtggggttatagttcgtagtaggagtttcgggttagatcgtggcgtcggtagcggtttttgggttggaggaggatgatgaggagcgacggaagcgacgcgggggtacgttgttgcgcggcgttcggtttcgtgttcgcggtcgattgcgtagtttgttcgcgagtttgagtaagtgcggttcggggatttcgagttcgcggggttcgagcgtcggttcgttttttttaggagggtcgcggggagtcgtcggtttttttaggcgggcgcgaaattttttcgggaggttgtggggggagtttcggggttagtgcggttttttttgggggtcgtgcgggggtcgagcgtcgggggttgtggaggattagttcggggtg

SEQ ID NO: 14918 - DNA, 531 bp, Artificial Sequence
  chemically treated genomic DNA (Homo sapiens) CpG-island No: 14918
caccccgaactaatcctccacaacccccgacgctcgacccccgcacgacccccaaaaaaaaccgcactaaccccgaaactccccccacaacctcccgaaaaaatttcgcgcccgcctaaaaaaaccgacgactccccgcgaccctcctaaaaaaaacgaaccgacgctcgaaccccgcgaactcgaaatccccgaaccgcacttactcaaactcgcgaacaaactacgcaatcgaccgcgaacacgaaaccgaacgccgcgcaacaacgtacccccgcgtcgcttccgtcgctcctcatcatcctcctccaacccaaaaaccgctaccgacgccacgatctaacccgaaactcctactacgaactataaccccacttccgacccccgctcgaatatcgccgacaaatacccccgccgactcccacataacctattctccgtctccgctcccgaaataaaaaccctacccgctcttccgaacatacgcaaaaaccgctaccaataaacccccgcgacgataacccgaacgaa

SEQ ID NO: 14919 - DNA, 531 bp, Artificial Sequence
  chemically treated genomic DNA (Homo sapiens) CpG-island No: 14919
tatttcgggttggttttttataattttcggcgttcggttttcgtacgatttttaggggaagtcgtattagtttcggggttttttttatagtttttcgggagggtttcgcgttcgtttggaggagtcggcggtttttcgcgatttttttagaaggagcggatcggcgttcgggtttcgcgggttcggggttttcgagtcgtatttatttagattcgcggataggttgcgtagtcggtcgcgggtacgaaatcgggcgtcgcgtagtagcgtattttcgcgtcgttttcgtcgttttttattatttttttttagtttaggggtcgttgtcggcgttacggtttagttcggagtttttgttgcgagttgtggttttattttcggttttcgttcgggtgtcgtcggtaaatgttttcgtcggtttttatataatttgtttttcgttttcgttttcggagtgggaattttgttcgttttttcgagtatgcgtagaagtcgttgttagtgagttttcgcgacggtggttcggacgga

SEQ ID NO: 14920 - DNA, 531 bp, Artificial Sequence
  chemically treated genomic DNA (Homo sapiens) CpG-island No: 14920
tccgtccgaaccaccgtcgcgaaaactcactaacaacgacttctacgcatactcgaaaaaacgaacaaaattcccactccgaaaacgaaaacgaaaaacaaattatataaaaaccgacgaaaacatttaccgacgacacccgaacgaaaaccgaaaataaaaccacaactcgcaacaaaaactccgaactaaaccgtaacgccgacaacgacccctaaactaaaaaaaaataataaaaaacgacgaaaacgacgcgaaaatacgctactacgcgacgcccgatttcgtacccgcgaccgactacgcaacctatccgcgaatctaaataaatacgactcgaaaaccccgaacccgcgaaacccgaacgccgatccgctccttctaaaaaaatcgcgaaaaaccgccgactcctccaaacgaacgcgaaaccctcccgaaaaactataaaaaaaaccccgaaactaatacgacttcccctaaaaatcgtacgaaaaccgaacgccgaaaattataaaaaaccaacccgaaata

SEQ ID NO: 14921 - DNA, 565 bp, Artificial Sequence
  chemically treated genomic DNA (Homo sapiens) CpG-island No: 14921
tgtgtgtggcgggtggcgtgtgtcgcgggtatgtgtgtggtgcgtgtgtgcgttatgtacggtatgattagggatatcgttcgtagttggcgggcgtacgtacgtttttgatgtcggttatttagatacgttagtttgttttttacgtcgtatacgagttcgttcgcgttacgtttgagtttagttaatagcggttttggattattatcgttcgaatttcgcgcgattttcgggacggcgtaggcgtcgcgttcggtatttataacgcgtaggtcgttagtaatatttagtaacgaatagttttcgttacgtcgagtcgttacgcgcgattttttagttatatacgttattttcgacgtttcgttcgatcgagtcgtcgattttagtaagtttatagaagaagttagttcgttagatcgataaaatcgtatagttacgagtagtatacgaacgtcgtattaacgtagtttattttaagcgtattatattagatttttcgtagtagtaatttacgcgtattattagttagttatcgtttttttcgtttcgagttttaggttataga

SEQ ID NO: 14922 - DNA, 565 bp, Artificial Sequence
  chemically treated genomic DNA (Homo sapiens) CpG-island No: 14922
tctataacctaaaactcgaaacgaaaaaaacgataactaactaataatacgcgtaaattactactacgaaaaatctaatataatacgcttaaaataaactacgttaatacgacgttcgtatactactcgtaactatacgattttatcgatctaacgaactaacttcttctataaacttactaaaatcgacgactcgatcgaacgaaacgtcgaaaataacgtatataactaaaaaatcgcgcgtaacgactcgacgtaacgaaaactattcgttactaaatattactaacgacctacgcgttataaataccgaacgcgacgcctacgccgtcccgaaaatcgcgcgaaattcgaacgataataatccaaaaccgctattaactaaactcaaacgtaacgcgaacgaactcgtatacgacgtaaaaaacaaactaacgtatctaaataaccgacatcaaaaacgtacgtacgcccgccaactacgaacgatatccctaatcataccgtacataacgcacacacgcaccacacacatacccgcgacacacgccacccgccacacaca

SEQ ID NO: 14923 - DNA, 565 bp, Artificial Sequence
  chemically treated genomic DNA (Homo sapiens) CpG-island No: 14923
tttgtggtttggggttcgaggcggggagggcggtggttggttggtggtgcgcgtgggttgttgttgcggggggtttggtgtggtgcgtttggggtgggttgcgttggtgcggcgttcgtgtgttgttcgtggttgtgcggttttgtcggtttggcgggttggttttttttgtgggtttgttggggtcggcggttcggtcgggcggggcgtcgggagtggcgtgtgtggttggggggtcgcgcgtggcggttcgacgtggcgagggttattcgttgttgggtgttgttggcggtttgcgcgttgtgggtgtcgagcgcggcgtttacgtcgtttcggggatcgcgcggggttcgggcgatggtagtttagggtcgttgttgattgggtttaggcgtggcgcggacgaattcgtgtgcggcgtgggggataggttgacgtgtttgagtgatcgatattagaggcgtgcgtgcgttcgttagttacgggcgatatttttggttatgtcgtatatgacgtatatacgtattatatatatattcgcgatatacgttattcgttatatata

SEQ ID NO: 14924 - DNA, 565 bp, Artificial Sequence
  chemically treated genomic DNA (Homo sapiens) CpG-island No: 14924
tatatataacgaataacgtatatcgcgaatatatatataatacgtatatacgtcatatacgacataaccaaaaatatcgcccgtaactaacgaacgcacgcacgcctctaatatcgatcactcaaacacgtcaacctatcccccacgccgcacacgaattcgtccgcgccacgcctaaacccaatcaacaacgaccctaaactaccatcgcccgaaccccgcgcgatccccgaaacgacgtaaacgccgcgctcgacacccacaacgcgcaaaccgccaacaacacccaacaacgaataaccctcgccacgtcgaaccgccacgcgcgaccccccaaccacacacgccactcccgacgccccgcccgaccgaaccgccgaccccaacaaacccacaaaaaaaaccaacccgccaaaccgacaaaaccgcacaaccacgaacaacacacgaacgccgcaccaacgcaacccaccccaaacgcaccacaccaaaccccccgcaacaacaacccacgcgcaccaccaaccaaccaccgccctccccgcctcgaaccccaaaccacaaa

SEQ ID NO: 14925 - DNA, 715 bp, Artificial Sequence
  chemically treated genomic DNA (Homo sapiens) CpG-island No: 14925
cgcgtttatttttatttgtcgcgtcgtcgggagtcgcgaggaggcgtacgtcggtcgtcgtagttaatgagcgacgtcggcgtggtagttgttgttataaagggttgggggcggcggcggcgcggtttagagcgcggtcgtcgcggttcggtacggaggtagggagggtgggcgaggggagaggatttgaatatacgggatcggataggatcgatcgaggggcggcggcgaaaggtagagcgtcgcgatttttgtcgggaagcgtaattttttcggtcgcggggtcgcgtagggggcgtttttaattcgcgttcgttttttttttttattttttgtcgtcgtagttatttcggggttcggttatcgcgcgcgtattttcgggattgttcgtttttggttttcgagggagtcgtcgtttttatcgttatatttgtacggtcgtattagaggtcgttcgggcgggattttagcgtgagtatcgggcgtttttttaggagtgtattattttcggagttttttttaatacggatcgtcgcgtcgggtatataagaatggttattgtaggtatttttttgtcgtcgaaagggaatcgggacggggaggagttgggtttagcgttcgcggagattgggcgggtgcggcggggggggtaggattaggtttagttaggttcgggttgggggggtaggattaagtttcggggtttgagagtggg

SEQ ID NO: 14926 - DNA, 715 bp, Artificial Sequence
  chemically treated genomic DNA (Homo sapiens) CpG-island No: 14926
cccactctcaaaccccgaaacttaatcctacccccccaacccgaacctaactaaacctaatcctaccccccccgccgcacccgcccaatctccgcgaacgctaaacccaactcctccccgtcccgattccctttcgacgacaaaaaaatacctacaataaccattcttatatacccgacgcgacgatccgtattaaaaaaaactccgaaaataatacactcctaaaaaaacgcccgatactcacgctaaaatcccgcccgaacgacctctaatacgaccgtacaaatataacgataaaaacgacgactccctcgaaaaccaaaaacgaacaatcccgaaaatacgcgcgcgataaccgaaccccgaaataactacgacgacaaaaaataaaaaaaaaaaacgaacgcgaattaaaaacgccccctacgcgaccccgcgaccgaaaaaattacgcttcccgacaaaaatcgcgacgctctacctttcgccgccgcccctcgatcgatcctatccgatcccgtatattcaaatcctctcccctcgcccaccctccctacctccgtaccgaaccgcgacgaccgcgctctaaaccgcgccgccgccgcccccaaccctttataacaacaactaccacgccgacgtcgctcattaactacgacgaccgacgtacgcctcctcgcgactcccgacgacgcgacaaataaaaataaacgcg

SEQ ID NO: 14927 - DNA, 715 bp, Artificial Sequence
  chemically treated genomic DNA (Homo sapiens) CpG-island No: 14927
tttatttttaggtttcgaggtttggttttatttttttaattcgggtttagttaggtttggttttatttttttcgtcgtattcgtttaattttcgcggacgttgggtttaattttttttcgtttcgattttttttcggcgataggggaatatttatagtgattatttttgtgtgttcggcgcggcggttcgtgttgaggggggtttcgggggtggtgtatttttaggggggcgttcgatgtttacgttggggtttcgttcgggcgatttttggtgcggtcgtgtagatgtggcgatgaaggcggcggttttttcgagggttagggacgggtaatttcggggatgcgcgcgcgatggtcgggtttcggggtggttgcggcggtaggggatggaaagagggagcgggcgcgggttgaggacgttttttgcgcggtttcgcggtcggggaggttgcgtttttcgatagagatcgcggcgttttgtttttcgtcgtcgtttttcggtcggttttgttcggtttcgtgtgtttaagtttttttttttcgtttattttttttgttttcgtgtcgggtcgcggcggtcgcgttttggatcgcgtcgtcgtcgtttttagttttttatagtagtagttgttacgtcggcgtcgtttattggttgcggcgatcgacgtacgttttttcgcggttttcgacggcgcggtaggtggaagtgagcgcg

SEQ ID NO: 14928 - DNA, 715 bp, Artificial Sequence
  chemically treated genomic DNA (Homo sapiens) CpG-island No: 14928
cgcgctcacttccacctaccgcgccgtcgaaaaccgcgaaaaaacgtacgtcgatcgccgcaaccaataaacgacgccgacgtaacaactactactataaaaaactaaaaacgacgacgacgcgatccaaaacgcgaccgccgcgacccgacacgaaaacaaaaaaaataaacgaaaaaaaaaaacttaaacacacgaaaccgaacaaaaccgaccgaaaaacgacgacgaaaaacaaaacgccgcgatctctatcgaaaaacgcaacctccccgaccgcgaaaccgcgcaaaaaacgtcctcaacccgcgcccgctccctctttccatcccctaccgccgcaaccaccccgaaacccgaccatcgcgcgcgcatccccgaaattacccgtccctaaccctcgaaaaaaccgccgccttcatcgccacatctacacgaccgcaccaaaaatcgcccgaacgaaaccccaacgtaaacatcgaacgcccccctaaaaatacaccacccccgaaacccccctcaacacgaaccgccgcgccgaacacacaaaaataatcactataaatattcccctatcgccgaaaaaaaatcgaaacgaaaaaaaattaaacccaacgtccgcgaaaattaaacgaatacgacgaaaaaaataaaaccaaacctaactaaacccgaattaaaaaaataaaaccaaacctcgaaacctaaaaataaa

SEQ ID NO: 14929 - DNA, 544 bp, Artificial Sequence
  chemically treated genomic DNA (Homo sapiens) CpG-island No: 14929
cgttaaattttatttcgaggatatcgattttatcgttaggaatcgggattttaattcgtagtattcggatttcgagaatagaggcgtcggggttaaatgggttgaatttggtattttatttttacgttttcgggtggatagcgatttttttcggtcgcgttttttcgtgggtttttttaattaataattcgtttcgttttttagttgagttcgaagttaatcgggtcgtagatttgtatttttttatttcgtttttttgggtattgattaatcgtagaaatttttttgggatttcgttttttttacgggtttttatttaattacgtcgcggttattaagcgtagttgaagcgtgaaggcgttaatgaggtttcggttatttcggtaggggcggaattaaaatgtcggttatatttttttttgtgatttagtttttgagcgttttaatacgatggtgttttcgcgggattaaattttagcgttatagttgaggattggtttcgtggtttttgatgggagagtatgaataggtggtatgtggtagg

SEQ ID NO: 14930 - DNA, 544 bp, Artificial Sequence
  chemically treated genomic DNA (Homo sapiens) CpG-island No: 14930
cctaccacataccacctattcatactctcccatcaaaaaccacgaaaccaatcctcaactataacgctaaaatttaatcccgcgaaaacaccatcgtattaaaacgctcaaaaactaaatcacaaaaaaaaatataaccgacattttaattccgcccctaccgaaataaccgaaacctcattaacgccttcacgcttcaactacgcttaataaccgcgacgtaattaaataaaaacccgtaaaaaaaacgaaatcccaaaaaaatttctacgattaatcaatacccaaaaaaacgaaataaaaaaatacaaatctacgacccgattaacttcgaactcaactaaaaaacgaaacgaattattaattaaaaaaacccacgaaaaaacgcgaccgaaaaaaatcgctatccacccgaaaacgtaaaaataaaataccaaattcaacccatttaaccccgacgcctctattctcgaaatccgaatactacgaattaaaatcccgattcctaacgataaaatcgatatcctcgaaataaaatttaacg

SEQ ID NO: 14931 - DNA, 544 bp, Artificial Sequence
  chemically treated genomic DNA (Homo sapiens) CpG-island No: 14931
tttattatatattatttgtttatgtttttttattagggattacgaagttagtttttagttgtgacgttgaagtttgatttcgcggggatattatcgtattaaaacgtttagagattgagttatagagaggggtgtggtcggtattttagtttcgtttttgtcggagtagtcgaagttttattggcgtttttacgttttagttgcgtttagtagtcgcggcgtaattggataaaagttcgtggagggggcgggattttaggggggtttttacgattagttaatatttaggagggcgggatagaaaggtgtagatttacgattcgattggtttcgggtttagttgggaggcgggacgaattattggttggggaaatttacgaggggacgcggtcgaggagggtcgttgtttattcgggggcgtgggagtgaggtattagatttagtttatttggtttcgacgtttttgttttcggaattcgggtgttgcggattgaggtttcggtttttaacggtgggatcggtgttttcgggatgagatttggcg

SEQ ID NO: 14932 - DNA, 544 bp, Artificial Sequence
  chemically treated genomic DNA (Homo sapiens) CpG-island No: 14932
cgccaaatctcatcccgaaaacaccgatcccaccgttaaaaaccgaaacctcaatccgcaacacccgaattccgaaaacaaaaacgtcgaaaccaaataaactaaatctaatacctcactcccacgcccccgaataaacaacgaccctcctcgaccgcgtcccctcgtaaatttccccaaccaataattcgtcccgcctcccaactaaacccgaaaccaatcgaatcgtaaatctacacctttctatcccgccctcctaaatattaactaatcgtaaaaacccccctaaaatcccgccccctccacgaacttttatccaattacgccgcgactactaaacgcaactaaaacgtaaaaacgccaataaaacttcgactactccgacaaaaacgaaactaaaataccgaccacacccctctctataactcaatctctaaacgttttaatacgataatatccccgcgaaatcaaacttcaacgtcacaactaaaaactaacttcgtaatccctaataaaaaaacataaacaaataatatataataaa

SEQ ID NO: 14933 - DNA, 587 bp, Artificial Sequence
  chemically treated genomic DNA (Homo sapiens) CpG-island No: 14933
tgaaatcgaattttttattttgggtatcgcggtttttttttatttttggttttcgcggtcggagcgtatttattgttagtcgttatggtcggacgagggggttgttcgacggtcgtttaggttcggggaatcggcgtcgagttcggtcgggcgcgcgtttttcggtaggttcggtgcgttcgggggtcgcgtcgcgtatagttttttttgtcgcgcgttttcgtcgcgtcgcgtcgtttcgcgtcgtttcgcgtttagtagtcgttagttttgcggtcgtcgtcggcgttttgagagtttagtttttcgggtagaacggtcgagttgcggcgtttagaggttggattttttttttttcgtttcgtcgcgttcgttttttttttttttttttttttttcgttttttttttaaagaggatgttcgtcgtaatttggaaatacgttttcggttacgttagggtcgtttttttacgttattttttttataacgttttcgttatatttttgttttttagttattttttttatttttcgttttatttttatttcgagttttttattagcggggttgggattttatgtttagtt

SEQ ID NO: 14934 - DNA, 587 bp, Artificial Sequence
  chemically treated genomic DNA (Homo sapiens) CpG-island No: 14934
aactaaacataaaatcccaaccccgctaataaaaaactcgaaataaaaataaaacgaaaaataaaaaaaataactaaaaaacaaaaatataacgaaaacgttataaaaaaaataacgtaaaaaaacgaccctaacgtaaccgaaaacgtatttccaaattacgacgaacatcctctttaaaaaaaaaacgaaaaaaaaaaaaaaaaaaaaaaaacgaacgcgacgaaacgaaaaaaaaaaaatccaacctctaaacgccgcaactcgaccgttctacccgaaaaactaaactctcaaaacgccgacgacgaccgcaaaactaacgactactaaacgcgaaacgacgcgaaacgacgcgacgcgacgaaaacgcgcgacaaaaaaaactatacgcgacgcgacccccgaacgcaccgaacctaccgaaaaacgcgcgcccgaccgaactcgacgccgattccccgaacctaaacgaccgtcgaacaaccccctcgtccgaccataacgactaacaataaatacgctccgaccgcgaaaaccaaaaataaaaaaaaaccgcgatacccaaaataaaaaattcgatttca

SEQ ID NO: 14935 - DNA, 587 bp, Artificial Sequence
  chemically treated genomic DNA (Homo sapiens) CpG-island No: 14935
ggttgagtatggggttttaatttcgttggtgagaagttcgaggtagggatgaagcggagaatggaaaaggtgattggaaaataaggatatagcgggaacgttgtaggaaaggtggcgtggagaggcgattttagcgtggtcgggagcgtgtttttaagttgcggcgagtattttttttgggggaggggcgggaaaggaaaggaggggagggggacggacgcggcgaggcgaggagggggagatttagtttttaggcgtcgtagttcggtcgttttgttcgggaggttgggtttttaggacgtcggcggcggtcgtagggttggcggttgttgggcgcggggcggcgcggggcggcgcggcgcggcgggggcgcgcggtaggaggggttgtgcgcggcgcggttttcgagcgtatcgggtttgtcgaggagcgcgcgttcggtcgggttcggcgtcggtttttcgaatttgggcggtcgtcgggtagttttttcgttcgattatggcgattgatagtgagtgcgtttcggtcgcggaggttaggggtggggggaggtcgcggtgtttagggtgggaagttcgatttta

SEQ ID NO: 14936 - DNA, 587 bp, Artificial Sequence
  chemically treated genomic DNA (Homo sapiens) CpG-island No: 14936
taaaatcgaacttcccaccctaaacaccgcgacctccccccacccctaacctccgcgaccgaaacgcactcactatcaatcgccataatcgaacgaaaaaactacccgacgaccgcccaaattcgaaaaaccgacgccgaacccgaccgaacgcgcgctcctcgacaaacccgatacgctcgaaaaccgcgccgcgcacaacccctcctaccgcgcgcccccgccgcgccgcgccgccccgcgccgccccgcgcccaacaaccgccaaccctacgaccgccgccgacgtcctaaaaacccaacctcccgaacaaaacgaccgaactacgacgcctaaaaactaaatctccccctcctcgcctcgccgcgtccgtccccctcccctcctttcctttcccgcccctcccccaaaaaaaatactcgccgcaacttaaaaacacgctcccgaccacgctaaaatcgcctctccacgccacctttcctacaacgttcccgctatatccttattttccaatcaccttttccattctccgcttcatccctacctcgaacttctcaccaacgaaattaaaaccccatactcaacc

SEQ ID NO: 14937 - DNA, 803 bp, Artificial Sequence
  chemically treated genomic DNA (Homo sapiens) CpG-island No: 14937
cgcggttcgatgattcggtttcggtgatagtagtcgcgacggcggtaatttcgatagggagttaggcggtttatggtgggttagggggcgatcgaggagggattacgcggtttgtagggggtagcgtcgagttcgggaggagatagtagtcggcgggtggggtgggtttgggttgtttttttcgggagttgtttcggggtcgtacggcgattgttatattcggtcgtttttgttcgtcgtgggttttttttcggcgtcgcgggttttaacggggttttgaggggacgtgatagagttcggtacgcggtagtttttggggagttagggttcggagagatttacgcgtcgtttttcgttcgttcggggtcgggagattttcgggagtcgttttcgcgtgtttagagagtgtcggggcggtcgttattttttttcgtttttcgtcggaggtgggcgtttttttttgcgtggcgggtgtttcgattttagttgttttgagtttcggggaagcgcgtttcgagtttttgacgtgggcgtttcgttatttcggggtgggtgtttggggtttttgaggtgggcgcgggttgtttcggggtgggcgttcggttcgcgcgggttatttttggcgttcgtagaggcgcgtgtgttggggcgtgttttttttttttaggtgtcgagagtcggggtttcgtcggcgtcggagttgattcgtttttttttttttttttttgtaggaatttttcgataattttgtcgtcgcgattttaatcgtgcgtaaggcgagagttcgaaataaatattatatt

SEQ ID NO: 14938 - DNA, 803 bp, Artificial Sequence
  chemically treated genomic DNA (Homo sapiens) CpG-island No: 14938
aatataatatttatttcgaactctcgccttacgcacgattaaaatcgcgacgacaaaattatcgaaaaattcctacaaaaaaaaaaaaaaaaaaacgaatcaactccgacgccgacgaaaccccgactctcgacacctaaaaaaaaaaaacacgccccaacacacgcgcctctacgaacgccaaaaataacccgcgcgaaccgaacgcccaccccgaaacaacccgcgcccacctcaaaaaccccaaacacccaccccgaaataacgaaacgcccacgtcaaaaactcgaaacgcgcttccccgaaactcaaaacaactaaaatcgaaacacccgccacgcaaaaaaaaacgcccacctccgacgaaaaacgaaaaaaaataacgaccgccccgacactctctaaacacgcgaaaacgactcccgaaaatctcccgaccccgaacgaacgaaaaacgacgcgtaaatctctccgaaccctaactccccaaaaactaccgcgtaccgaactctatcacgtcccctcaaaaccccgttaaaacccgcgacgccgaaaaaaaacccacgacgaacaaaaacgaccgaatataacaatcgccgtacgaccccgaaacaactcccgaaaaaaacaacccaaacccaccccacccgccgactactatctcctcccgaactcgacgctaccccctacaaaccgcgtaatccctcctcgatcgccccctaacccaccataaaccgcctaactccctatcgaaattaccgccgtcgcgactactatcaccgaaaccgaatcatcgaaccgcg

SEQ ID NO: 14939 - DNA, 803 bp, Artificial Sequence
  chemically treated genomic DNA (Homo sapiens) CpG-island No: 14939
gatgtgatgtttgtttcgagttttcgttttgcgtacggttaaagtcgcggcggtagaattatcggaagatttttgtaggggaaagaagagagagacgagttagtttcggcgtcggcggagtttcggttttcggtatttggggaaggaaaatacgttttaatatacgcgtttttgcgggcgttaaaaataattcgcgcgggtcgggcgtttatttcggggtaattcgcgtttattttaggggttttaggtatttatttcgaggtaacggggcgtttacgttaggggttcggggcgcgttttttcggggtttagagtaattggggtcggagtattcgttacgtaggaaaaggcgtttattttcggcgaagggcgaggggaagtggcggtcgtttcgatattttttggatacgcggaggcggttttcgaggatttttcggtttcgggcgggcggggggcgacgcgtgggttttttcggattttaattttttagaggttgtcgcgtgtcgagttttgttacgtttttttagagtttcgttaaggttcgcggcgtcgagaggaagtttacggcgggtaggggcggtcgggtatgataatcgtcgtgcggtttcggggtagttttcggagggggtagtttagatttattttattcgtcggttgttgttttttttcgagttcggcgttgttttttataggtcgcgtggttttttttcggtcgttttttgatttattatgagtcgtttagttttttgtcgagattgtcgtcgtcgcggttgttgttatcgaggtcgggttatcgggtcgcg

SEQ ID NO: 14940 - DNA, 803 bp, Artificial Sequence
  chemically treated genomic DNA (Homo sapiens) CpG-island No: 14940
cgcgacccgataacccgacctcgataacaacaaccgcgacgacgacaatctcgacaaaaaactaaacgactcataataaatcaaaaaacgaccgaaaaaaaaccacgcgacctataaaaaacaacgccgaactcgaaaaaaaacaacaaccgacgaataaaataaatctaaactaccccctccgaaaactaccccgaaaccgcacgacgattatcatacccgaccgcccctacccgccgtaaacttcctctcgacgccgcgaaccttaacgaaactctaaaaaaacgtaacaaaactcgacacgcgacaacctctaaaaaattaaaatccgaaaaaacccacgcgtcgccccccgcccgcccgaaaccgaaaaatcctcgaaaaccgcctccgcgtatccaaaaaatatcgaaacgaccgccacttcccctcgcccttcgccgaaaataaacgccttttcctacgtaacgaatactccgaccccaattactctaaaccccgaaaaaacgcgccccgaacccctaacgtaaacgccccgttacctcgaaataaatacctaaaacccctaaaataaacgcgaattaccccgaaataaacgcccgacccgcgcgaattatttttaacgcccgcaaaaacgcgtatattaaaacgtattttccttccccaaataccgaaaaccgaaactccgccgacgccgaaactaactcgtctctctcttctttcccctacaaaaatcttccgataattctaccgccgcgactttaaccgtacgcaaaacgaaaactcgaaacaaacatcacatc

SEQ ID NO: 14941 - DNA, 501 bp, Artificial Sequence
  chemically treated genomic DNA (Homo sapiens) CpG-island No: 14941
aatttttcgtagtcggagaggggtcgtcgtttcggatttcggaggatagagggcggaagacgagtcggagatcgaggcggatagcgtttagagaatcgatttaagaacgatatcgatttcgatagggagagggcggttacgttaattgtcgtaggttattaatttattttttttttagcgtggggtatttttatttagtttcgggagttcggcgagtagtagcggttgcggtttgggtttaaacgttatagtcgttggcggttgttttattagttaatcgggttttgcgaagatggagtaagggagggcggttattaggaagtgaaaggcggaaagggcgggacgtcgttgttagggtaggaaggggcgtgtttaggcgagtcgggggcggtatagtttgcgtgataggggtgttttttcgttttgtgttggtggcggttcgttgttttttgaagcgttgatggaaaaggaaatttttttttgatatttattattaattat

SEQ ID NO: 14942 - DNA, 501 bp, Artificial Sequence
  chemically treated genomic DNA (Homo sapiens) CpG-island No: 14942
ataattaataataaatatcaaaaaaaaatttccttttccatcaacgcttcaaaaaacaacgaaccgccaccaacacaaaacgaaaaaacacccctatcacgcaaactataccgcccccgactcgcctaaacacgccccttcctaccctaacaacgacgtcccgccctttccgcctttcacttcctaataaccgccctcccttactccatcttcgcaaaacccgattaactaataaaacaaccgccaacgactataacgtttaaacccaaaccgcaaccgctactactcgccgaactcccgaaactaaataaaaataccccacgctaaaaaaaaaataaattaataacctacgacaattaacgtaaccgccctctccctatcgaaatcgatatcgttcttaaatcgattctctaaacgctatccgcctcgatctccgactcgtcttccgccctctatcctccgaaatccgaaacgacgacccctctccgactacgaaaaatt

SEQ ID NO: 14943 - DNA, 501 bp, Artificial Sequence
  chemically treated genomic DNA (Homo sapiens) CpG-island No: 14943
gtgattgataatgaatgttagaggagagtttttttttttattaacgttttaggagatagcggatcgttattaatatagggcggaagagtatttttgttacgtagattgtgtcgttttcggttcgtttgggtacgtttttttttgttttagtagcggcgtttcgtttttttcgttttttattttttagtaatcgtttttttttgttttattttcgtaggattcgattggttgatggggtaatcgttaacggttgtggcgtttaaatttaagtcgtagtcgttgttgttcgtcgagttttcggagttgggtgggggtgttttacgttgaaagagaggtaagttagtggtttgcggtagttgacgtgatcgttttttttttgtcgggatcggtgtcgtttttgagtcggttttttaggcgttgttcgtttcggttttcggttcgtttttcgttttttgtttttcgggattcgggacggcggttttttttcggttacgaggggtt

SEQ ID NO: 14944 - DNA, 501 bp, Artificial Sequence
  chemically treated genomic DNA (Homo sapiens) CpG-island No: 14944
aacccctcgtaaccgaaaaaaaaccgccgtcccgaatcccgaaaaacaaaaaacgaaaaacgaaccgaaaaccgaaacgaacaacgcctaaaaaaccgactcaaaaacgacaccgatcccgacaaaaaaaaaacgatcacgtcaactaccgcaaaccactaacttacctctctttcaacgtaaaacacccccacccaactccgaaaactcgacgaacaacaacgactacgacttaaatttaaacgccacaaccgttaacgattaccccatcaaccaatcgaatcctacgaaaataaaacaaaaaaaaacgattactaaaaaataaaaaacgaaaaaaacgaaacgccgctactaaaacaaaaaaaaacgtacccaaacgaaccgaaaacgacacaatctacgtaacaaaaatactcttccgccctatattaataacgatccgctatctcctaaaacgttaataaaaaaaaaaactctcctctaacattcattatcaatcac

SEQ ID NO: 14945 - DNA, 527 bp, Artificial Sequence
  chemically treated genomic DNA (Homo sapiens) CpG-island No: 14945
cgaggcggtttattggggcgagacgaatttgggggcggggcgtggcgtggcgtggcgtgtacgggacgtggtttttttttttttttgagtcgttgttttagagtcgggtcgtacgggggcgtcgttggggtcgttttgttttcgagttgtcgagtagttgagaaggcgtttattttcgcgttcgtttcgcgcgttcggcggtcggcgagggtttggcgggtcgtaggttagtttgggaagttgtcgattcgttttattttttcggtgcggaagagtcgggcgcgggatgggtcggggcggataggcggcggggcgttttgaggaagggtacgggtcgcgttggtaacgcgtcgtttcgggttgtaggttcgggtttcgggtcgatttggggtttttaggtcgcggaagatcgtggcggggttttttggttttttagtttttttcggtttttttcgtttcggaagaggagtgtgagttttttgagcgatgttttttaaagtggggttcgcgggtagatttcgattttt

SEQ ID NO: 14946 - DNA, 527 bp, Artificial Sequence
  chemically treated genomic DNA (Homo sapiens) CpG-island No: 14946
aaaaatcgaaatctacccgcgaaccccactttaaaaaacatcgctcaaaaaactcacactcctcttccgaaacgaaaaaaaccgaaaaaaactaaaaaaccaaaaaaccccgccacgatcttccgcgacctaaaaaccccaaatcgacccgaaacccgaacctacaacccgaaacgacgcgttaccaacgcgacccgtacccttcctcaaaacgccccgccgcctatccgccccgacccatcccgcgcccgactcttccgcaccgaaaaaataaaacgaatcgacaacttcccaaactaacctacgacccgccaaaccctcgccgaccgccgaacgcgcgaaacgaacgcgaaaataaacgccttctcaactactcgacaactcgaaaacaaaacgaccccaacgacgcccccgtacgacccgactctaaaacaacgactcaaaaaaaaaaaaaaaccacgtcccgtacacgccacgccacgccacgccccgcccccaaattcgtctcgccccaataaaccgcctcg

SEQ ID NO: 14947 - DNA, 527 bp, Artificial Sequence
  chemically treated genomic DNA (Homo sapiens) CpG-island No: 14947
aggggtcgggatttgttcgcgaattttattttgaaaaatatcgtttaaggggtttatatttttttttcgaagcgggaagagtcgggaggagttggggagttagaaagtttcgttacggtttttcgcggtttggagattttaaatcggttcgaagttcgagtttgtagttcgggacggcgcgttattagcgcggttcgtgtttttttttagggcgtttcgtcgtttattcgtttcggtttatttcgcgttcggttttttcgtatcgggggggtggggcgggtcggtagttttttagattgatttgcggttcgttagattttcgtcggtcgtcggacgcgcggggcggacgcggaagtgaacgtttttttagttgttcggtaattcgggagtagagcggttttagcggcgttttcgtgcggttcggttttgaggtagcggtttagggagggagggaggttacgtttcgtgtacgttacgttacgttacgtttcgtttttagattcgtttcgttttagtgggtcgtttcg

SEQ ID NO: 14948 - DNA, 527 bp, Artificial Sequence
  chemically treated genomic DNA (Homo sapiens) CpG-island No: 14948
cgaaacgacccactaaaacgaaacgaatctaaaaacgaaacgtaacgtaacgtaacgtacacgaaacgtaacctccctccctccctaaaccgctacctcaaaaccgaaccgcacgaaaacgccgctaaaaccgctctactcccgaattaccgaacaactaaaaaaacgttcacttccgcgtccgccccgcgcgtccgacgaccgacgaaaatctaacgaaccgcaaatcaatctaaaaaactaccgacccgccccacccccccgatacgaaaaaaccgaacgcgaaataaaccgaaacgaataaacgacgaaacgccctaaaaaaaaacacgaaccgcgctaataacgcgccgtcccgaactacaaactcgaacttcgaaccgatttaaaatctccaaaccgcgaaaaaccgtaacgaaactttctaactccccaactcctcccgactcttcccgcttcgaaaaaaaaatataaaccccttaaacgatatttttcaaaataaaattcgcgaacaaatcccgacccct

SEQ ID NO: 14949 - DNA, 787 bp, Artificial Sequence
  chemically treated genomic DNA (Homo sapiens) CpG-island No: 14949
tgcgttttttaggtcgcgtagacggcgtaaagggggaaattttatttcgttcggtttcgcgttttttaaatgtacgtaaagggttgtcgttttttttttttttatttcgttcgggttttttaaggttcggcgcgaggagttcgcgaggcgcggtgcgcgggttttatttgtatacgtcgcgaatgtaggttttagttagatgcggtaagcggtttcgatgtgtttttgcgatattttttcgggtcgtatcgttttcgtttagcgttaggtcgttttttttagttgtagtcgcggggttatggttttggttttaggaacgtttttcgagttagatcgtcgtagtcgtcgtcgcggtttgtatcgtcgttttaatgggtttcgtattttgttagtaaggaggatttggcgtttttttaggtagttggttagttaattatttgtgcgcgttattgtcgtcgcgttcgttcgcgttcgatacgtacgatcggtcgtaaaggtcggtcgtcgatattcgatatatttcgcgtcgcggagcggttaaaggtggattttcgtcgcgttgagtatgcgcgtttttagtagttttttgtttttcgcgtttttaaatcgacgggttgaggtagaggaagcgtacgttcgaggcggttttgttacgtttttattggtatttttggaaaagtagcgttttagttttcgtttagggcggcgtattacgtattattattttaataaattagtgtttcgaaagttattttttgtttcggtattttttttttaattatgaagt

SEQ ID NO: 14950 - DNA, 787 bp, Artificial Sequence
  chemically treated genomic DNA (Homo sapiens) CpG-island No: 14950
acttcataattaaaaaaaaaataccgaaacaaaaaataactttcgaaacactaatttattaaaataataatacgtaatacgccgccctaaacgaaaactaaaacgctacttttccaaaaataccaataaaaacgtaacaaaaccgcctcgaacgtacgcttcctctacctcaacccgtcgatttaaaaacgcgaaaaacaaaaaactactaaaaacgcgcatactcaacgcgacgaaaatccacctttaaccgctccgcgacgcgaaatatatcgaatatcgacgaccgacctttacgaccgatcgtacgtatcgaacgcgaacgaacgcgacgacaataacgcgcacaaataattaactaaccaactacctaaaaaaacgccaaatcctccttactaacaaaatacgaaacccattaaaacgacgatacaaaccgcgacgacgactacgacgatctaactcgaaaaacgttcctaaaaccaaaaccataaccccgcgactacaactaaaaaaaacgacctaacgctaaacgaaaacgatacgacccgaaaaaatatcgcaaaaacacatcgaaaccgcttaccgcatctaactaaaacctacattcgcgacgtatacaaataaaacccgcgcaccgcgcctcgcgaactcctcgcgccgaaccttaaaaaacccgaacgaaataaaaaaaaaaaaaacgacaaccctttacgtacatttaaaaaacgcgaaaccgaacgaaataaaatttccccctttacgccgtctacgcgacctaaaaaacgca

SEQ ID NO: 14951 - DNA, 787 bp, Artificial Sequence
  chemically treated genomic DNA (Homo sapiens) CpG-island No: 14951
attttatggttaaaagggaagtatcggagtaagaaatagttttcgaggtattggtttgttagagtagtggtacgtagtgcgtcgttttgaacgggggttgagacgttgtttttttagaagtgttagtgaagacgtggtaagatcgtttcggacgtacgttttttttattttagttcgtcggtttaggggcgcgggaagtaggaggttgttgggaacgcgtatgtttagcgcggcgggagtttatttttaatcgtttcgcggcgcggggtgtgtcgggtgtcgacggtcggtttttgcggtcggtcgtgcgtgtcgggcgcgggcgggcgcggcggtagtggcgcgtataggtgattgattggttagttgtttgaaggagcgttaggttttttttgttggtaggatgcgaagtttattggggcggcggtgtagatcgcggcggcggttgcggcggtttggttcgggaggcgtttttggggttaaggttatggtttcgcggttgtagttggagaaggcggtttggcgttgggcggagacggtgcggttcgaggaggtgtcgtaggagtatatcgagatcgtttatcgtatttggttggagtttgtattcgcggcgtgtgtaggtgaggttcgcgtatcgcgtttcgcgggtttttcgcgtcggattttggaaagttcgggcggggtaggggaaaggaagacggtagttttttgcgtgtatttgggaggcgcggagtcgagcgaggtggagtttttttttttgcgtcgtttgcgcgatttgggaaacgta

SEQ ID NO: 14952 - DNA, 787 bp, Artificial Sequence
  chemically treated genomic DNA (Homo sapiens) CpG-island No: 14952
tacgtttcccaaatcgcgcaaacgacgcaaaaaaaaaaactccacctcgctcgactccgcgcctcccaaatacacgcaaaaaactaccgtcttcctttcccctaccccgcccgaactttccaaaatccgacgcgaaaaacccgcgaaacgcgatacgcgaacctcacctacacacgccgcgaatacaaactccaaccaaatacgataaacgatctcgatatactcctacgacacctcctcgaaccgcaccgtctccgcccaacgccaaaccgccttctccaactacaaccgcgaaaccataaccttaaccccaaaaacgcctcccgaaccaaaccgccgcaaccgccgccgcgatctacaccgccgccccaataaacttcgcatcctaccaacaaaaaaaacctaacgctccttcaaacaactaaccaatcaatcacctatacgcgccactaccgccgcgcccgcccgcgcccgacacgcacgaccgaccgcaaaaaccgaccgtcgacacccgacacaccccgcgccgcgaaacgattaaaaataaactcccgccgcgctaaacatacgcgttcccaacaacctcctacttcccgcgcccctaaaccgacgaactaaaataaaaaaaacgtacgtccgaaacgatcttaccacgtcttcactaacacttctaaaaaaacaacgtctcaacccccgttcaaaacgacgcactacgtaccactactctaacaaaccaatacctcgaaaactatttcttactccgatacttcccttttaaccataaaat

SEQ ID NO: 14953 - DNA, 689 bp, Artificial Sequence
  chemically treated genomic DNA (Homo sapiens) CpG-island No: 14953
gagaggcgttgttggtcggttgtttggtgtcgatttagtcgtcgtcgtagtcgtttgtcgcggttcggtagtagtagtagtagtagtggcgcggcgttcgagttcgtttagtttagttttatttggcggggcgtattattggtcgtgtcgcgtttcggttgtttttcggtcgttatcgtcgtcgttgcgtttattggtttcgtcgcgtcgtgtttgttcgttcggtttcgtagtttttcggcgcgttttcggttttttttttttttgtcgggggtcgtcggttttttgtttcgcgtcgtcgttcggtttcgtatataaggcgtttggtgtgggttttcgcgtcgtttgtttcgttacgtttcgttttttcgtcgttggatcggttcgttttcgtcgttttcgagttcggttgcgtttttttagtgtcgtcgcggcgtcggtttttttcgtttagtcgttttttttcgtttgatagggcgtttcggtatacggtattaacgttcgttcggagtagtacggtagcgcggttatagcgcggtcgcggcggtggcggtagtagggtttttttagggcgtacggttatttatgcgcgtcgtagttcgtttttttattttggtttagtagtttttagttttttagttcgagcgaagttggggtttaaattattttttgcgaaaattttagacgtt

SEQ ID NO: 14954 - DNA, 689 bp, Artificial Sequence
  chemically treated genomic DNA (Homo sapiens) CpG-island No: 14954
aacgtctaaaattttcgcaaaaaataatttaaaccccaacttcgctcgaactaaaaaactaaaaactactaaaccaaaataaaaaaacgaactacgacgcgcataaataaccgtacgccctaaaaaaaccctactaccgccaccgccgcgaccgcgctataaccgcgctaccgtactactccgaacgaacgttaataccgtataccgaaacgccctatcaaacgaaaaaaaacgactaaacgaaaaaaaccgacgccgcgacgacactaaaaaaacgcaaccgaactcgaaaacgacgaaaacgaaccgatccaacgacgaaaaaacgaaacgtaacgaaacaaacgacgcgaaaacccacaccaaacgccttatatacgaaaccgaacgacgacgcgaaacaaaaaaccgacgacccccgacaaaaaaaaaaaaaaccgaaaacgcgccgaaaaactacgaaaccgaacgaacaaacacgacgcgacgaaaccaataaacgcaacgacgacgataacgaccgaaaaacaaccgaaacgcgacacgaccaataatacgccccgccaaataaaactaaactaaacgaactcgaacgccgcgccactactactactactactaccgaaccgcgacaaacgactacgacgacgactaaatcgacaccaaacaaccgaccaacaacgcctctc

SEQ ID NO: 14955 - DNA, 689 bp, Artificial Sequence
  chemically treated genomic DNA (Homo sapiens) CpG-island No: 14955
agcgtttgggattttcgtagaagataatttaagttttagtttcgttcgggttggggggttgggggttgttgggttagggtgggggaacgggttgcggcgcgtataggtagtcgtacgttttgaggaggttttgttgtcgttatcgtcgcggtcgcgttgtaatcgcgttgtcgtgttgtttcgggcgggcgttggtgtcgtgtgtcgaggcgttttgttaggcgagggggagcggttgggcggggagagtcgacgtcgcggcggtattagaggaacgtagtcgggttcgggagcggcgagggcgggtcggtttagcggcggaggagcgaggcgtggcgaggtaggcggcgcggggatttatattaggcgttttgtgtgcgaggtcgagcggcggcgcggaatagagagtcggcgattttcggtaggaggagaaggagtcggagacgcgtcgagggattgcggggtcgggcgggtaaatacggcgcgacgagattaatggacgtagcggcgacggtggcggtcgagaggtagtcggggcgcgatacggttaatagtacgtttcgttaggtgaggttgggttgagcgggttcgagcgtcgcgttattgttgttgttgttgttgtcgggtcgcggtagacggttgcggcggcggttaaatcggtattaagtagtcgattaatagcgtttttt

SEQ ID NO: 14956 - DNA, 689 bp, Artificial Sequence
  chemically treated genomic DNA (Homo sapiens) CpG-island No: 14956
aaaaaacgctattaatcgactacttaataccgatttaaccgccgccgcaaccgtctaccgcgacccgacaacaacaacaacaacaataacgcgacgctcgaacccgctcaacccaacctcacctaacgaaacgtactattaaccgtatcgcgccccgactacctctcgaccgccaccgtcgccgctacgtccattaatctcgtcgcgccgtatttacccgcccgaccccgcaatccctcgacgcgtctccgactccttctcctcctaccgaaaatcgccgactctctattccgcgccgccgctcgacctcgcacacaaaacgcctaatataaatccccgcgccgcctacctcgccacgcctcgctcctccgccgctaaaccgacccgccctcgccgctcccgaacccgactacgttcctctaataccgccgcgacgtcgactctccccgcccaaccgctccccctcgcctaacaaaacgcctcgacacacgacaccaacgcccgcccgaaacaacacgacaacgcgattacaacgcgaccgcgacgataacgacaacaaaacctcctcaaaacgtacgactacctatacgcgccgcaacccgttcccccaccctaacccaacaacccccaaccccccaacccgaacgaaactaaaacttaaattatcttctacgaaaatcccaaacgct

SEQ ID NO: 14957 - DNA, 690 bp, Artificial Sequence
  chemically treated genomic DNA (Homo sapiens) CpG-island No: 14957
ggaggttttgttgttttttttcgtggttggttgtgttcgtcgtagtttgaaaggttagcggtatttagcgttgtgatagggttataggcgcgcgatgttttatagttcggagtagtatttatttggtattaggtcgcgtgtcgtaggttagtttttatcgttgggtttttgaagtaggaggcgcgagtcgcgttaaagtttgtaacggttttaagtttcgacgttagtttaggtaaaaggtaatgtatttaaacgaaaagaaaataggtttttttcgttttatcgtttcgggtagttatatttttatattttcggcggtgtatcggtttaaatgtcgtttgttagtaattttcgtttttttagttaaaagcgaaaaatagaggttcggaatcgttgcgtggtttttgttttttattcggtcgttttaaagggtgattttttttttgtttcggtttgcgtggtgtgggtttgtgggtttttgagattcgaaaattgagagcgttttcgtattttagcggttgtttttggcggttttgcggtcgttattatggtaaggaggatgtttcggacgttcgcgatatatagcgtttgagttagtgggatttgaggattttggggcgttggggtagggggtgagcggtggtaggcggaaatgagaattgttaagagaaaaggatggtagattcgtgg

SEQ ID NO: 14958 - DNA, 690 bp, Artificial Sequence
  chemically treated genomic DNA (Homo sapiens) CpG-island No: 14958
ccacgaatctaccatccttttctcttaacaattctcatttccgcctaccaccgctcaccccctaccccaacgccccaaaatcctcaaatcccactaactcaaacgctatatatcgcgaacgtccgaaacatcctccttaccataataacgaccgcaaaaccgccaaaaacaaccgctaaaatacgaaaacgctctcaattttcgaatctcaaaaacccacaaacccacaccacgcaaaccgaaacaaaaaaaaaatcaccctttaaaacgaccgaataaaaaacaaaaaccacgcaacgattccgaacctctatttttcgcttttaactaaaaaaacgaaaattactaacaaacgacatttaaaccgatacaccgccgaaaatataaaaatataactacccgaaacgataaaacgaaaaaaacctattttcttttcgtttaaatacattaccttttacctaaactaacgtcgaaacttaaaaccgttacaaactttaacgcgactcgcgcctcctacttcaaaaacccaacgataaaaactaacctacgacacgcgacctaataccaaataaatactactccgaactataaaacatcgcgcgcctataaccctatcacaacgctaaataccgctaacctttcaaactacgacgaacacaaccaaccacgaaaaaaaacaacaaaacctcc

SEQ ID NO: 14959 - DNA, 690 bp, Artificial Sequence
  chemically treated genomic DNA (Homo sapiens) CpG-island No: 14959
ttacgggtttattattttttttttttggtagtttttattttcgtttattatcgtttattttttattttagcgttttagagtttttaggttttattaatttagacgttgtgtgtcgcgagcgttcgaggtattttttttattatggtgacggtcgtagagtcgttaggagtagtcgttggagtgcgaaaacgtttttaattttcgggttttaaagatttataagtttatattacgtaggtcgggatagggaaagagttattttttaaaacggtcgagtgaagagtaagaattacgtagcggtttcgagtttttgtttttcgtttttagttaggaggacggaagttgttggtaggcggtatttgggtcgatatatcgtcggaagtgtggaggtgtggttgttcgaggcggtagagcggagaaagtttatttttttttcgtttagatatattgttttttgtttaggttggcgtcgagatttgaggtcgttgtagattttggcgcggttcgcgttttttgttttaagagtttagcggtgagagttggtttgcggtacgcggtttaatgttaggtgagtattgtttcgagttgtgagatatcgcgcgtttgtgattttgttatagcgttgggtatcgttgattttttaggttgcgacggatatagttagttacggaagaggataatagggttttt

SEQ ID NO: 14960 - DNA, 690 bp, Artificial Sequence
  chemically treated genomic DNA (Homo sapiens) CpG-island No: 14960
aaaaaccctattatcctcttccgtaactaactatatccgtcgcaacctaaaaaatcaacgatacccaacgctataacaaaatcacaaacgcgcgatatctcacaactcgaaacaatactcacctaacattaaaccgcgtaccgcaaaccaactctcaccgctaaactcttaaaacaaaaaacgcgaaccgcgccaaaatctacaacgacctcaaatctcgacgccaacctaaacaaaaaacaatatatctaaacgaaaaaaaaataaactttctccgctctaccgcctcgaacaaccacacctccacacttccgacgatatatcgacccaaataccgcctaccaacaacttccgtcctcctaactaaaaacgaaaaacaaaaactcgaaaccgctacgtaattcttactcttcactcgaccgttttaaaaaataactctttccctatcccgacctacgtaatataaacttataaatctttaaaacccgaaaattaaaaacgttttcgcactccaacgactactcctaacgactctacgaccgtcaccataataaaaaaaatacctcgaacgctcgcgacacacaacgtctaaattaataaaacctaaaaactctaaaacgctaaaataaaaaataaacgataataaacgaaaataaaaactaccaaaaaaaaaaaataataaacccgtaa

SEQ ID NO: 14961 - DNA, 705 bp, Artificial Sequence
  chemically treated genomic DNA (Homo sapiens) CpG-island No: 14961
cgagttagagcgggttcgtcgaggggtgcgcggttcggttcggtttcgtttcgcgtcgcgttgtatgttagttttcgttttcgggttcgacgtggtttcgatttcgggtttttagtttaggttttcgtttcgttttttttcgttcgagttcgggttcgggtcgtcgtcgtattttgttgaaggcgaaaagtttttgtttgagtttttcgcgttgcgggtcggcgttttgtcgtcggaatcgaaattttattattttgcgttcggttgtaggcgtttcgttcgtcgtcgtcgttcgtaggatggtcgcgcgtttcgcgggttttaaggcgcggcggggcgtaggcgtcgggcgggcgtcggggtcgtgtatgtacgcgggtgggcgcgggcgacgacgcgtcgttcgattagtgaacgagttcgtcgtgtcgttcgtttcgtttttgttggttagataatggtgaatttgggtttcggggttcggtcgggttcgcgaagagacgttcgtttatgtatcggtcggcgcggggttgtcgggatttgtagtttatgagtcggggttttagcgcgggcggttggggaagcgttttggagggggattggcgtacgttttcgggtttggaggagatttttttttttttttagagagcgagcgacgtgtttatttatgtaatggggtagttttgtttcgaaagttaagatagt

SEQ ID NO: 14962 - DNA, 705 bp, Artificial Sequence
  chemically treated genomic DNA (Homo sapiens) CpG-island No: 14962
actatcttaactttcgaaacaaaactaccccattacataaataaacacgtcgctcgctctctaaaaaaaaaaaaaaatctcctccaaacccgaaaacgtacgccaatccccctccaaaacgcttccccaaccgcccgcgctaaaaccccgactcataaactacaaatcccgacaaccccgcgccgaccgatacataaacgaacgtctcttcgcgaacccgaccgaaccccgaaacccaaattcaccattatctaaccaacaaaaacgaaacgaacgacacgacgaactcgttcactaatcgaacgacgcgtcgtcgcccgcgcccacccgcgtacatacacgaccccgacgcccgcccgacgcctacgccccgccgcgccttaaaacccgcgaaacgcgcgaccatcctacgaacgacgacgacgaacgaaacgcctacaaccgaacgcaaaataataaaatttcgattccgacgacaaaacgccgacccgcaacgcgaaaaactcaaacaaaaacttttcgccttcaacaaaatacgacgacgacccgaacccgaactcgaacgaaaaaaaacgaaacgaaaacctaaactaaaaacccgaaatcgaaaccacgtcgaacccgaaaacgaaaactaacatacaacgcgacgcgaaacgaaaccgaaccgaaccgcgcacccctcgacgaacccgctctaactcg

SEQ ID NO: 14963 - DNA, 705 bp, Artificial Sequence
  chemically treated genomic DNA (Homo sapiens) CpG-island No: 14963
gttgttttggttttcggaatagggttgttttattatatgagtgggtacgtcgttcgttttttgggaggaggaaaaagttttttttaagttcgggaacgtgcgttaatttttttttaaagcgtttttttagtcgttcgcgttggagtttcggtttatggattataagtttcggtagtttcgcgtcggtcgatgtataggcgggcgttttttcgcgagttcggtcgagtttcggggtttaagtttattattgtttggttaataggggcggggcgggcggtacggcgggttcgtttattggtcgggcggcgcgtcgtcgttcgcgtttattcgcgtgtatgtacggtttcggcgttcgttcggcgtttgcgtttcgtcgcgttttaggattcgcggggcgcgcggttattttgcgggcggcggcggcgggcgaggcgtttgtagtcgggcgtaagatgatgaagtttcggtttcggcggtagggcgtcgattcgtagcgcgagaagtttaagtaggagtttttcgtttttaataaggtgcggcggcggttcgggttcgggttcgggcgggagggggcgggacgggggtttgggttgggggttcggggtcggagttacgtcgggttcgggggcgggggttggtatgtagcgcggcgcggggcggggtcgggtcgggtcgcgtatttttcggcgggttcgttttggttcg

SEQ ID NO: 14964 - DNA, 705 bp, Artificial Sequence
  chemically treated genomic DNA (Homo sapiens) CpG-island No: 14964
cgaaccaaaacgaacccgccgaaaaatacgcgacccgacccgaccccgccccgcgccgcgctacataccaacccccgcccccgaacccgacgtaactccgaccccgaacccccaacccaaacccccgtcccgccccctcccgcccgaacccgaacccgaaccgccgccgcaccttattaaaaacgaaaaactcctacttaaacttctcgcgctacgaatcgacgccctaccgccgaaaccgaaacttcatcatcttacgcccgactacaaacgcctcgcccgccgccgccgcccgcaaaataaccgcgcgccccgcgaatcctaaaacgcgacgaaacgcaaacgccgaacgaacgccgaaaccgtacatacacgcgaataaacgcgaacgacgacgcgccgcccgaccaataaacgaacccgccgtaccgcccgccccgcccctattaaccaaacaataataaacttaaaccccgaaactcgaccgaactcgcgaaaaaacgcccgcctatacatcgaccgacgcgaaactaccgaaacttataatccataaaccgaaactccaacgcgaacgactaaaaaaacgctttaaaaaaaaattaacgcacgttcccgaacttaaaaaaaactttttcctcctcccaaaaaacgaacgacgtacccactcatataataaaacaaccctattccgaaaaccaaaacaac

SEQ ID NO: 14965 - DNA, 918 bp, Artificial Sequence
  chemically treated genomic DNA (Homo sapiens) CpG-island No: 14965
cgcggtttttatacgtatgggttcgcgttaagatttttttttcggggttcggggcgttttttagagtatgttcgtttttcgtcgttcgaggatttagagtagcgtcgtggggttatggcgcgtagcggttatacggatttgcgtgagaagtttaagtttatgacgtttcgggataattataaggcgggtagtcgggaggtcgtcgtttgtcgtagtcgtcgtagtcgtcgtagtcgtagtcgtcgtttcgtcgaattttattttgtgttcggggttaagcgtaagtattaggaggattcggatttcgagcgtagcgattatgaggagtagtagttgtagaaggaggaggaggcgcgtaaggtgaagagcggtattcgttagatgcgtttttttagttaggacgagtgcgttaagatcgaggttcgtattgacgaggtggtgtttcgcgttgagaagggtttgtataacgagtatacggtggatcgggttttattgcgtaataagtattttttcggcgaaggttatatttacggcgtttagttgtagaagcgcgggttcggttaggagcgtttttattcgtcgggcgacgtggacgagattttcgagtgggtgtattagttggtgatttaaaagttggtggagtatcgcgttattttcgagggtttcgttaatagcgtcgttattaacgattattagttcggcggttgtatcgtgttttacgtggattttatttatattttcgagcgttttatcgtgttcgtgtttttttttagcgattttgcgttgtgtttcggttgtaagttttagtttaagtttattcgggtgtcggaattagtgttttttttgtcggtgcgtaggggaagcgtgattgtgtttaggtaatttattcgggtggagggggcggttttgcgtttgttg

SEQ ID NO: 14966 - DNA, 918 bp, Artificial Sequence
  chemically treated genomic DNA (Homo sapiens) CpG-island No: 14966
caacaaacgcaaaaccgccccctccacccgaataaattacctaaacacaatcacgcttcccctacgcaccgacaaaaaaaacactaattccgacacccgaataaacttaaactaaaacttacaaccgaaacacaacgcaaaatcgctaaaaaaaaacacgaacacgataaaacgctcgaaaatataaataaaatccacgtaaaacacgatacaaccgccgaactaataatcgttaataacgacgctattaacgaaaccctcgaaaataacgcgatactccaccaacttttaaatcaccaactaatacacccactcgaaaatctcgtccacgtcgcccgacgaataaaaacgctcctaaccgaacccgcgcttctacaactaaacgccgtaaatataaccttcgccgaaaaaatacttattacgcaataaaacccgatccaccgtatactcgttatacaaacccttctcaacgcgaaacaccacctcgtcaatacgaacctcgatcttaacgcactcgtcctaactaaaaaaacgcatctaacgaataccgctcttcaccttacgcgcctcctcctccttctacaactactactcctcataatcgctacgctcgaaatccgaatcctcctaatacttacgcttaaccccgaacacaaaataaaattcgacgaaacgacgactacgactacgacgactacgacgactacgacaaacgacgacctcccgactacccgccttataattatcccgaaacgtcataaacttaaacttctcacgcaaatccgtataaccgctacgcgccataaccccacgacgctactctaaatcctcgaacgacgaaaaacgaacatactctaaaaaacgccccgaaccccgaaaaaaaaatcttaacgcgaacccatacgtataaaaaccgcg

SEQ ID NO: 14967 - DNA, 918 bp, Artificial Sequence
  chemically treated genomic DNA (Homo sapiens) CpG-island No: 14967
tagtaggcgtagggtcgttttttttattcgggtgggttatttgagtatagttacgttttttttgcgtatcggtagggaaagtattggtttcgatattcgaataggtttgaattggaatttgtagtcgaagtatagcgtagagtcgttaaagaaggatacggatacgatggggcgttcgaagatgtggatggggtttacgtgagatacgatgtagtcgtcgggttggtagtcgttgatgacggcgttgttgacgaagttttcggggatgacgcggtgttttattagtttttggattattagttggtgtatttattcggggatttcgtttacgtcgttcggcgggtagaggcgtttttggtcgggttcgcgtttttgtagttgggcgtcgtaagtgtagttttcgtcgaagaagtatttgttgcgtagtggggttcggtttatcgtgtgttcgttgtataggttttttttagcgcgggatattatttcgttaatgcgggtttcgattttggcgtattcgttttggttgaagaggcgtatttggcggatgtcgttttttattttgcgcgtttttttttttttttgtagttgttgttttttatagtcgttgcgttcggggttcgagtttttttgatatttgcgtttggtttcggatatagggtaaggttcggcggagcggcggttgcggttgcggcggttacggcggttgcggtaggcggcggtttttcggttgttcgttttatagttgtttcgggacgttatggatttgagttttttacgtaggttcgtgtagtcgttgcgcgttatggttttacgacgttgttttaggttttcgggcggcggggagcgggtatgttttaggggacgtttcgggtttcgagaggggggttttagcgcgaatttatgcgtatggggatcgcg

SEQ ID NO: 14968 - DNA, 918 bp, Artificial Sequence
  chemically treated genomic DNA (Homo sapiens) CpG-island No: 14968
cgcgatccccatacgcataaattcgcgctaaaacccccctctcgaaacccgaaacgtcccctaaaacatacccgctccccgccgcccgaaaacctaaaacaacgtcgtaaaaccataacgcgcaacgactacacgaacctacgtaaaaaactcaaatccataacgtcccgaaacaactataaaacgaacaaccgaaaaaccgccgcctaccgcaaccgccgtaaccgccgcaaccgcaaccgccgctccgccgaaccttaccctatatccgaaaccaaacgcaaatatcaaaaaaactcgaaccccgaacgcaacgactataaaaaacaacaactacaaaaaaaaaaaaaaacgcgcaaaataaaaaacgacatccgccaaatacgcctcttcaaccaaaacgaatacgccaaaatcgaaacccgcattaacgaaataatatcccgcgctaaaaaaaacctatacaacgaacacacgataaaccgaaccccactacgcaacaaatacttcttcgacgaaaactacacttacgacgcccaactacaaaaacgcgaacccgaccaaaaacgcctctacccgccgaacgacgtaaacgaaatccccgaataaatacaccaactaataatccaaaaactaataaaacaccgcgtcatccccgaaaacttcgtcaacaacgccgtcatcaacgactaccaacccgacgactacatcgtatctcacgtaaaccccatccacatcttcgaacgccccatcgtatccgtatccttctttaacgactctacgctatacttcgactacaaattccaattcaaacctattcgaatatcgaaaccaatactttccctaccgatacgcaaaaaaaacgtaactatactcaaataacccacccgaataaaaaaaacgaccctacgcctacta

SEQ ID NO: 14969 - DNA, 535 bp, Artificial Sequence
  chemically treated genomic DNA (Homo sapiens) CpG-island No: 14969
tattatttcgcgggttcggttggagaagtcgtttttgcgacgggggtttcggcggaatagttcgtttcggttgttatcgatttcgtcgtttatcgttatttttagcgttttgtttcgcgtttttacggttttgacgttggttcggaatagtagcgtgatgtttatcgttatagcgattcgtatttttagttttatattaggttcgtttacgtaagtagtcggcgagtcggcgcgaattcggtcgttgaaggattggttttgttttatacgttttttttcggtaacggcgacgcgagaagaaaggtttttgtttgcgttttgtatcgcggcgggaggaaaaaggtttcgttttagtcggcgtattggcggaggaggaattttcgacgcgttttcgggtatcggttttttttagtaaagtttggagggtttagttgcgcggagagtttagcgagtttttttgtgtttgtttggggcgtgtgggtttcgggagcgtgaggatcgggaagttaggaggtttttttttttttggcggttt

SEQ ID NO: 14970 - DNA, 535 bp, Artificial Sequence
  chemically treated genomic DNA (Homo sapiens) CpG-island No: 14970
aaaccgccaaaaaaaaaaaaacctcctaacttcccgatcctcacgctcccgaaacccacacgccccaaacaaacacaaaaaaactcgctaaactctccgcgcaactaaaccctccaaactttactaaaaaaaaccgatacccgaaaacgcgtcgaaaattcctcctccgccaatacgccgactaaaacgaaacctttttcctcccgccgcgatacaaaacgcaaacaaaaacctttcttctcgcgtcgccgttaccgaaaaaaaacgtataaaacaaaaccaatccttcaacgaccgaattcgcgccgactcgccgactacttacgtaaacgaacctaatataaaactaaaaatacgaatcgctataacgataaacatcacgctactattccgaaccaacgtcaaaaccgtaaaaacgcgaaacaaaacgctaaaaataacgataaacgacgaaatcgataacaaccgaaacgaactattccgccgaaacccccgtcgcaaaaacgacttctccaaccgaacccgcgaaataata

SEQ ID NO: 14971 - DNA, 535 bp, Artificial Sequence
  chemically treated genomic DNA (Homo sapiens) CpG-island No: 14971
gagtcgttagaagggaaggagttttttagtttttcggtttttacgttttcggagtttatacgttttaaatagatatagaagagttcgttgagtttttcgcgtagttaaattttttaagttttgttgggagaaatcgatgttcgagagcgcgtcgaaggtttttttttcgttagtgcgtcggttgaggcgaagttttttttttttcgtcgcggtatagggcgtaggtaggaattttttttttcgcgtcgtcgttgtcggggggaggcgtgtggggtaggattagttttttagcggtcgggttcgcgtcggttcgtcggttgtttacgtgggcgggtttagtgtggggttgagggtgcgggtcgttatggcggtggatattacgttgttatttcgggttagcgttaagatcgtgaagacgcggaataaggcgttgggagtggcggtgggcggcggggtcgatggtagtcgggacgagttgtttcgtcggagttttcgtcgtaagggcgatttttttagtcgggttcgcgaagtggtg

SEQ ID NO: 14972 - DNA, 535 bp, Artificial Sequence
  chemically treated genomic DNA (Homo sapiens) CpG-island No: 14972
caccacttcgcgaacccgactaaaaaaatcgcccttacgacgaaaactccgacgaaacaactcgtcccgactaccatcgaccccgccgcccaccgccactcccaacgccttattccgcgtcttcacgatcttaacgctaacccgaaataacaacgtaatatccaccgccataacgacccgcaccctcaaccccacactaaacccgcccacgtaaacaaccgacgaaccgacgcgaacccgaccgctaaaaaactaatcctaccccacacgcctccccccgacaacgacgacgcgaaaaaaaaaattcctacctacgccctataccgcgacgaaaaaaaaaaaacttcgcctcaaccgacgcactaacgaaaaaaaaaccttcgacgcgctctcgaacatcgatttctcccaacaaaacttaaaaaatttaactacgcgaaaaactcaacgaactcttctatatctatttaaaacgtataaactccgaaaacgtaaaaaccgaaaaactaaaaaactccttcccttctaacgactc

SEQ ID NO: 14973 - DNA, 661 bp, Artificial Sequence
  chemically treated genomic DNA (Homo sapiens) CpG-island No: 14973
cgtatgcgtgcgggcggcgtagggattcggttttaggttttcgttgacgtttcgtatgttttcgcggggttcgttcgttttatttttagttcgtatcggcgtcgtttatattgtaggatgattttttcgaacgtttgtttttgtagtcggtttcggcgttttagttgtttcgagatgtggcgtttttagcgggggaagttagcggcgcggaggttcgacgatatgttatttgttgtttcggtattttagcgttattaatgcgagcgagggttgacggtcgtagtttgtagtatgaagtaattagtagaagcgggaatgtcggtaatttcggagtttatttttatatattggtagttttcgaggttattcgggacggtttttcggtttatgtcggaaatgattttcgagagggtcggaagattcgtttttttattcgaagtacgggtttaggagtcggtgtttacgtagggcgttcgttagtgacgttagtttgtagtcggaagcgttagttgtagagaggtggtcgtttgggggcgttcgggttttgcgtaaggtttagcgtcgggcgggaaggaggtaggaaaggggtcgttttcgtttgattgtttattttttttttgttgttttttaatttttttcgtgtttttttttttggtttgtt

SEQ ID NO: 14974 - DNA, 661 bp, Artificial Sequence
  chemically treated genomic DNA (Homo sapiens) CpG-island No: 14974
aacaaaccaaaaaaaaaaacacgaaaaaaattaaaaaacaacaaaaaaaaaataaacaatcaaacgaaaacgacccctttcctacctccttcccgcccgacgctaaaccttacgcaaaacccgaacgcccccaaacgaccacctctctacaactaacgcttccgactacaaactaacgtcactaacgaacgccctacgtaaacaccgactcctaaacccgtacttcgaataaaaaaacgaatcttccgaccctctcgaaaatcatttccgacataaaccgaaaaaccgtcccgaataacctcgaaaactaccaatatataaaaataaactccgaaattaccgacattcccgcttctactaattacttcatactacaaactacgaccgtcaaccctcgctcgcattaataacgctaaaataccgaaacaacaaataacatatcgtcgaacctccgcgccgctaacttcccccgctaaaaacgccacatctcgaaacaactaaaacgccgaaaccgactacaaaaacaaacgttcgaaaaaatcatcctacaatataaacgacgccgatacgaactaaaaataaaacgaacgaaccccgcgaaaacatacgaaacgtcaacgaaaacctaaaaccgaatccctacgccgcccgcacgcatacg

SEQ ID NO: 14975 - DNA, 661 bp, Artificial Sequence
  chemically treated genomic DNA (Homo sapiens) CpG-island No: 14975
gataggttaagaaaaaaaatacgaaaagggttgaaaagtagtaaaagaaaagtaagtagttaggcggaaacggttttttttttgtttttttttcgttcggcgttgggttttgcgtagggttcggacgtttttaagcggttatttttttgtagttgacgttttcggttataggttggcgttattagcgagcgttttgcgtaggtatcggtttttgagttcgtgtttcgggtgagggggcgggtttttcggttttttcgaaaattattttcggtatgagtcggaagatcgtttcggatggtttcggggattgttagtgtgtggaggtgagtttcgggattgtcggtattttcgtttttgttggttgttttatgttgtaggttgcggtcgttagttttcgttcgtattggtggcgttgaggtgtcggggtagtaagtgatatgtcgtcgggttttcgcgtcgttgatttttttcgttggaagcgttatatttcggagtaattgaggcgtcgggatcggttgtagagataggcgttcgaggagattattttgtagtgtgagcggcgtcggtgcgggttgggagtggggcgggcgggtttcgcggaggtatgcggggcgttagcgggaatttgaggtcgagtttttgcgtcgttcgtacgtatgcg

SEQ ID NO: 14976 - DNA, 661 bp, Artificial Sequence
  chemically treated genomic DNA (Homo sapiens) CpG-island No: 14976
cgcatacgtacgaacgacgcaaaaactcgacctcaaattcccgctaacgccccgcatacctccgcgaaacccgcccgccccactcccaacccgcaccgacgccgctcacactacaaaataatctcctcgaacgcctatctctacaaccgatcccgacgcctcaattactccgaaatataacgcttccaacgaaaaaaatcaacgacgcgaaaacccgacgacatatcacttactaccccgacacctcaacgccaccaatacgaacgaaaactaacgaccgcaacctacaacataaaacaaccaacaaaaacgaaaataccgacaatcccgaaactcacctccacacactaacaatccccgaaaccatccgaaacgatcttccgactcataccgaaaataattttcgaaaaaaccgaaaaacccgccccctcacccgaaacacgaactcaaaaaccgatacctacgcaaaacgctcgctaataacgccaacctataaccgaaaacgtcaactacaaaaaaataaccgcttaaaaacgtccgaaccctacgcaaaacccaacgccgaacgaaaaaaaaacaaaaaaaaaaccgtttccgcctaactacttacttttcttttactacttttcaacccttttcgtattttttttcttaacctatc

SEQ ID NO: 14977 - DNA, 593 bp, Artificial Sequence
  chemically treated genomic DNA (Homo sapiens) CpG-island No: 14977
  misc_feature (545)..(545): n is either a, c, g or t
tggtttcgcggtttcgtttgtatttttcggtttttcgttttttttttttgttttttttcgttttcgttttgttttttttcggcgttttttttttttgtcgtgtcgtttttttttgtcgtcgcgttttcgttttttttttgtgttttttcgttcgttttttttttttttattcgttttcgtttgtgttgtttcgcgatttcgttcgtttttttggtcgtcgttcgcgtacgtgtcggcgtaattttacgtgttttgttcgttatttcgcgcgtttggatagttgttatttcgttcgtgtcgttttttgttttgtttcgcgttttgttgttttcgtttcggtcgcgtattttgagtttcgtttcgttcggcgggtttgagagcggcgatttttagttcgtttttatttaattgattggttttttcgtgtattggttgtcgttttgcgtatttgtatagttattcgatgacgggcgagtcgtttatttttttcgtgcgttcgttaatatttttgtttcgttgtgtgtttttgtagtggcggtacgcgncgtgttgtgtcgttcgtttttcgtgttttttgtgttgtgttgttgttg

SEQ ID NO: 14978 - DNA, 593 bp, Artificial Sequence
  chemically treated genomic DNA (Homo sapiens) CpG-island No: 14978
  misc_feature (49)..(49): n is either a, c, g or t
caacaacaacacaacacaaaaaacacgaaaaacgaacgacacaacacgncgcgtaccgccactacaaaaacacacaacgaaacaaaaatattaacgaacgcacgaaaaaaataaacgactcgcccgtcatcgaataactatacaaatacgcaaaacgacaaccaatacacgaaaaaaccaatcaattaaataaaaacgaactaaaaatcgccgctctcaaacccgccgaacgaaacgaaactcaaaatacgcgaccgaaacgaaaacaacaaaacgcgaaacaaaacaaaaaacgacacgaacgaaataacaactatccaaacgcgcgaaataacgaacaaaacacgtaaaattacgccgacacgtacgcgaacgacgaccaaaaaaacgaacgaaatcgcgaaacaacacaaacgaaaacgaataaaaaaaaaaaaaacgaacgaaaaaacacaaaaaaaaaacgaaaacgcgacgacaaaaaaaaacgacacgacaaaaaaaaaaaacgccgaaaaaaaacaaaacgaaaacgaaaaaaaacaaaaaaaaaaaacgaaaaaccgaaaaatacaaacgaaaccgcgaaacca

SEQ ID NO: 14979 - DNA, 593 bp, Artificial Sequence
  chemically treated genomic DNA (Homo sapiens) CpG-island No: 14979
  misc_feature (49)..(49): n is either a, c, g or t
taataataatataatatagaaagtacgaggagcgagcgatataatacgncgcgtgtcgttattgtaaggatatataacgaagtagaggtattgacgagcgtacggagagaatgagcggttcgttcgttatcgagtgattatataaatacgtagggcgatagttaatatacgaaaagattaattaattaggtgaggacgggttagagatcgtcgtttttagattcgtcgagcgaggcgagatttagagtgcgcgatcgaggcggaggtaatagaacgcggagtaaggtaggaagcgatacgggcgagatgataattgtttaggcgcgcgggatagcgaatagaatacgtgaagttacgtcgatacgtgcgcggacgacgattaaagaaacgagcggggtcgcgaggtaatataagcgggaacgaataaaggagggagagacgaacggaagagtatagagggagggcgaaggcgcggcgataagaaggagcgatacggtaggggggagaaacgtcgggaagaagtaagacgggaacgggggaagataagaggagagggcggagaatcggaagatataaacgggatcgcgaggtta

SEQ ID NO: 14980 - DNA, 593 bp, Artificial Sequence
  chemically treated genomic DNA (Homo sapiens) CpG-island No: 14980
  misc_feature (545)..(545): n is either a, c, g or t
taacctcgcgatcccgtttatatcttccgattctccgccctctcctcttatcttcccccgttcccgtcttacttcttcccgacgtttctcccccctaccgtatcgctccttcttatcgccgcgccttcgccctccctctatactcttccgttcgtctctccctcctttattcgttcccgcttatattacctcgcgaccccgctcgtttctttaatcgtcgtccgcgcacgtatcgacgtaacttcacgtattctattcgctatcccgcgcgcctaaacaattatcatctcgcccgtatcgcttcctaccttactccgcgttctattacctccgcctcgatcgcgcactctaaatctcgcctcgctcgacgaatctaaaaacgacgatctctaacccgtcctcacctaattaattaatcttttcgtatattaactatcgccctacgtatttatataatcactcgataacgaacgaaccgctcattctctccgtacgctcgtcaatacctctacttcgttatatatccttacaataacgacacgcgncgtattatatcgctcgctcctcgtactttctatattatattattatta

SEQ ID NO: 14981 - DNA, 663 bp, Artificial Sequence
  chemically treated genomic DNA (Homo sapiens) CpG-island No: 14981
gtttattcggtagttggtgttttcggaatcgagatgtttttaaaatgtcgttagtgagtaggatcgggtgtttaaggttatttttcgtttttttcggttcgcgttttggttttcggtcgtcgttttatttggttcggcgagtcgggggcgggttcgagtttttcgggagcgttaggttcgcgtatatttggatcggtcgcgggaattcgagcgggtcgcgtttagtttcgtcggaggtttaggagtcgtcgtcgcgtagtgtgtagggggtggggaaggattcggtttcgttcgcgcgagttggttcggcgagggtgggggaggggttttttcgtcgtcgaaaggacgcgtgcgtttaggattcgcgggttattcgatttggatttttattttcgtttacgtcgcggattttagtttttcgtttcgatttcgttttcgttcgcggttgggttcgggcgtgcgcgtggggtttgttgtggtaatttcgggagatcgcgggcgttttggtcgtttttgtttcgtttcgggttgcgtggtttacggatttttttttttttggttaaagtcggcggacgagaaagtttttgatttttgtaaagttcggttcggtttgtacggttatttcgaacgtagttggttttcgttatagagtatttataataa

SEQ ID NO: 14982 - DNA, 663 bp, Artificial Sequence
  chemically treated genomic DNA (Homo sapiens) CpG-island No: 14982
ttattataaatactctataacgaaaaccaactacgttcgaaataaccgtacaaaccgaaccgaactttacaaaaatcaaaaactttctcgtccgccgactttaaccaaaaaaaaaaaaatccgtaaaccacgcaacccgaaacgaaacaaaaacgaccaaaacgcccgcgatctcccgaaattaccacaacaaaccccacgcgcacgcccgaacccaaccgcgaacgaaaacgaaatcgaaacgaaaaactaaaatccgcgacgtaaacgaaaataaaaatccaaatcgaataacccgcgaatcctaaacgcacgcgtcctttcgacgacgaaaaaacccctcccccaccctcgccgaaccaactcgcgcgaacgaaaccgaatccttccccaccccctacacactacgcgacgacgactcctaaacctccgacgaaactaaacgcgacccgctcgaattcccgcgaccgatccaaatatacgcgaacctaacgctcccgaaaaactcgaacccgcccccgactcgccgaaccaaataaaacgacgaccgaaaaccaaaacgcgaaccgaaaaaaacgaaaaataaccttaaacacccgatcctactcactaacgacattttaaaaacatctcgattccgaaaacaccaactaccgaataaac

SEQ ID NO: 14983 - DNA, 663 bp, Artificial Sequence
  chemically treated genomic DNA (Homo sapiens) CpG-island No: 14983
ttattataaatattttgtggcgggagttagttgcgttcgggataatcgtgtagatcgaatcggattttataaaaattagggattttttcgttcgtcggttttggttagggagggggaggttcgtgagttacgtagttcggggcggggtagaggcggttagggcgttcgcggtttttcggggttgttataatagattttacgcgtacgttcgagtttagtcgcgggcgggagcggggtcggggcgggggattgaggttcgcggcgtgggcgggggtgggggtttaggtcgggtagttcgcgggttttgagcgtacgcgttttttcggcggcgagagggttttttttttattttcgtcgagttagttcgcgcgggcggggtcgggtttttttttattttttgtatattacgcggcggcggtttttgagttttcggcggggttgggcgcggttcgttcgggttttcgcggtcgatttaggtgtgcgcggatttggcgttttcggggggttcggattcgttttcgattcgtcgagttaggtgaggcggcggtcggggattagggcgcgggtcggggaggacgggaggtggttttgggtattcgattttgtttattgacggtattttgggggtatttcgatttcgggagtattaattatcgggtaagt

SEQ ID NO: 14984 - DNA, 663 bp, Artificial Sequence
  chemically treated genomic DNA (Homo sapiens) CpG-island No: 14984
acttacccgataattaatactcccgaaatcgaaatacccccaaaataccgtcaataaacaaaatcgaatacccaaaaccacctcccgtcctccccgacccgcgccctaatccccgaccgccgcctcacctaactcgacgaatcgaaaacgaatccgaaccccccgaaaacgccaaatccgcgcacacctaaatcgaccgcgaaaacccgaacgaaccgcgcccaaccccgccgaaaactcaaaaaccgccgccgcgtaatatacaaaaaataaaaaaaaacccgaccccgcccgcgcgaactaactcgacgaaaataaaaaaaaaaccctctcgccgccgaaaaaacgcgtacgctcaaaacccgcgaactacccgacctaaacccccacccccgcccacgccgcgaacctcaatcccccgccccgaccccgctcccgcccgcgactaaactcgaacgtacgcgtaaaatctattataacaaccccgaaaaaccgcgaacgccctaaccgcctctaccccgccccgaactacgtaactcacgaacctccccctccctaaccaaaaccgacgaacgaaaaaatccctaatttttataaaatccgattcgatctacacgattatcccgaacgcaactaactcccgccacaaaatatttataataa

SEQ ID NO: 14985 - DNA, 557 bp, Artificial Sequence
  chemically treated genomic DNA (Homo sapiens) CpG-island No: 14985
aggcgtttcgagtttttttaaaagatcggttgcgaaaatttacggttatttgtattattttttttttttttgggtgttttagttttacggaaaggtaagtttcgtttacgcgtttatttatttcgagtagggtgttcgtacgtagattcgtttggagggttcgcgttgtatttttacgttaagttttagaattttggcggcgaggtttattttagttttcgtattttttcgaattcgggcggcgaggtcgttgcggtggtcgtatttgttggtttagttcggcggttttagtttaagtgacgagtgcgttgtcggcgtttttgggagcggttttcggttttggcgtcggggtcggggtattcgttggaggcgtttgggcgcgggttgggcgagcggattgtttggcgttcggggaggagggatgttcggcgaaagttgttagggaatttgattaattcgagcgcgtaggtgttagttttttgtataatttacggacggtggttggcgggttgcgtacggacgtttttattatattagttagatgagtattgcgtgtt

SEQ ID NO: 14986 - DNA, 557 bp, Artificial Sequence
  chemically treated genomic DNA (Homo sapiens) CpG-island No: 14986
aacacgcaatactcatctaactaatataataaaaacgtccgtacgcaacccgccaaccaccgtccgtaaattatacaaaaaactaacacctacgcgctcgaattaatcaaattccctaacaactttcgccgaacatccctcctccccgaacgccaaacaatccgctcgcccaacccgcgcccaaacgcctccaacgaataccccgaccccgacgccaaaaccgaaaaccgctcccaaaaacgccgacaacgcactcgtcacttaaactaaaaccgccgaactaaaccaacaaatacgaccaccgcaacgacctcgccgcccgaattcgaaaaaatacgaaaactaaaataaacctcgccgccaaaattctaaaacttaacgtaaaaatacaacgcgaaccctccaaacgaatctacgtacgaacaccctactcgaaataaataaacgcgtaaacgaaacttacctttccgtaaaactaaaacacccaaaaaaaaaaaaaataatacaaataaccgtaaattttcgcaaccgatcttttaaaaaaactcgaaacgcct

SEQ ID NO: 14987 - DNA, 557 bp, Artificial Sequence
  chemically treated genomic DNA (Homo sapiens) CpG-island No: 14987
ggtacgtagtgtttatttagttggtatagtgagaacgttcgtgcgtagttcgttagttatcgttcgtgaattatgtaggaagttggtatttgcgcgttcgagttgattaagttttttagtaattttcgtcgagtatttttttttttcggacgttaggtagttcgttcgtttagttcgcgtttaggcgtttttaacgggtgtttcggtttcggcgttaggatcggggatcgtttttagagacgtcgatagcgtattcgttatttgggttggagtcgtcggattgagttagtaggtgcgattatcgtagcggtttcgtcgttcgggttcggggggatgcgggggttggggtggatttcgtcgttagggttttggggtttggcgtgggggtgtagcgcgggttttttaggcgggtttgcgtgcggatattttgttcgaggtgggtgggcgcgtgggcgaggtttgttttttcgtggggttggagtatttagagggagaaagggtggtgtaggtgatcgtgggttttcgtagtcgattttttaaaggggttcggggcgttt

SEQ ID NO: 14988 - DNA, 557 bp, Artificial Sequence
  chemically treated genomic DNA (Homo sapiens) CpG-island No: 14988
aaacgccccgaacccctttaaaaaatcgactacgaaaacccacgatcacctacaccaccctttctccctctaaatactccaaccccacgaaaaaacaaacctcgcccacgcgcccacccacctcgaacaaaatatccgcacgcaaacccgcctaaaaaacccgcgctacacccccacgccaaaccccaaaaccctaacgacgaaatccaccccaacccccgcatccccccgaacccgaacgacgaaaccgctacgataatcgcacctactaactcaatccgacgactccaacccaaataacgaatacgctatcgacgtctctaaaaacgatccccgatcctaacgccgaaaccgaaacacccgttaaaaacgcctaaacgcgaactaaacgaacgaactacctaacgtccgaaaaaaaaaaatactcgacgaaaattactaaaaaacttaatcaactcgaacgcgcaaataccaacttcctacataattcacgaacgataactaacgaactacgcacgaacgttctcactataccaactaaataaacactacgtacc

SEQ ID NO: 14989 - DNA, 502 bp, Artificial Sequence
  chemically treated genomic DNA (Homo sapiens) CpG-island No: 14989
gtagcgaaagaatttttgggggttttgggatggggcgagaggcgtgagtttttagttgggaaggaggaggcggcgatttggggattcggtaatttgttcgggtagtgaggcgagtacggggaggggaggcgagaaaaggggagggtggagtaaaagttcgtgggtgtaggttttgggtcggggagagggaggaagcgcggagggaggcgaagacgtttggggtcgggtatttattcgtcgggcgttcgggttgaatgggtcgttatcgtagtgttcgttcgtttagtattacgttataattgtttttttcgatttcgaagatgtttcggagtagaattcgttcggtcgtcgttttcgtttgttgcggggacgttaatagcgtcggaggtatagcggtagttttcgggggcgttttttttttcggtcgttttttagggtatttattcggtttttgcgttttttttagggtatggcggagtcgtaggttgggttcgagttaggg

SEQ ID NO: 14990 - DNA, 502 bp, Artificial Sequence
  chemically treated genomic DNA (Homo sapiens) CpG-island No: 14990
ccctaactcgaacccaacctacgactccgccataccctaaaaaaaacgcaaaaaccgaataaataccctaaaaaacgaccgaaaaaaaaaacgcccccgaaaactaccgctatacctccgacgctattaacgtccccgcaacaaacgaaaacgacgaccgaacgaattctactccgaaacatcttcgaaatcgaaaaaaacaattataacgtaatactaaacgaacgaacactacgataacgacccattcaacccgaacgcccgacgaataaatacccgaccccaaacgtcttcgcctccctccgcgcttcctccctctccccgacccaaaacctacacccacgaacttttactccaccctccccttttctcgcctcccctccccgtactcgcctcactacccgaacaaattaccgaatccccaaatcgccgcctcctccttcccaactaaaaactcacgcctctcgccccatcccaaaacccccaaaaattctttcgctac

SEQ ID NO: 14991 - DNA, 502 bp, Artificial Sequence
  chemically treated genomic DNA (Homo sapiens) CpG-island No: 14991
ttttggttcgggtttagtttgcgatttcgttatgttttggaggaggcgtaggaatcgggtgagtgttttggagggcggtcgggagaagaggcgttttcggaggttgtcgttgtgttttcggcgttgttaacgttttcgtagtagacggaggcggcggtcgagcggattttgtttcggggtattttcgagatcgggagggatagttgtgacgtggtgttgagcgagcgagtattgcggtggcggtttatttagttcgagcgttcggcgggtgagtgttcggttttaagcgttttcgttttttttcgcgtttttttttttttttcggtttaaggtttatatttacgagtttttgttttattttttttttttttcgtttttttttttcgtgttcgttttattgttcggataggttatcgagtttttaagtcgtcgtttttttttttttaattgggaatttacgtttttcgttttattttagaatttttagggattttttcgttat

SEQ ID NO: 14992 - DNA, 502 bp, Artificial Sequence
  chemically treated genomic DNA (Homo sapiens) CpG-island No: 14992
ataacgaaaaaatccctaaaaattctaaaataaaacgaaaaacgtaaattcccaattaaaaaaaaaaaaacgacgacttaaaaactcgataacctatccgaacaataaaacgaacacgaaaaaaaaaaacgaaaaaaaaaaaaaataaaacaaaaactcgtaaatataaaccttaaaccgaaaaaaaaaaaaaaacgcgaaaaaaaacgaaaacgcttaaaaccgaacactcacccgccgaacgctcgaactaaataaaccgccaccgcaatactcgctcgctcaacaccacgtcacaactatccctcccgatctcgaaaataccccgaaacaaaatccgctcgaccgccgcctccgtctactacgaaaacgttaacaacgccgaaaacacaacgacaacctccgaaaacgcctcttctcccgaccgccctccaaaacactcacccgattcctacgcctcctccaaaacataacgaaatcgcaaactaaacccgaaccaaaa

SEQ ID NO: 14993 - DNA, 796 bp, Artificial Sequence
  chemically treated genomic DNA (Homo sapiens) CpG-island No: 14993
  misc_feature (641)..(641): n is either a, c, g or t
gtttttcgaaatggggtcgtagagttgtcggcggagattagtaggtgggaggttttacgtatatttttcgattcggtcgggacgcggttttcggatttcgcgtagggtttaagatcgtcgtttcgtttttttttttcggtttttttattaattttagtttgaaagaaaattttacgcggtcgaaatgaacgttattttatcgttttaagtttttagtcggtagaaaacgtgagatttattatgatacggggaggggagatgggggtcgtcgtggtatattcggaagcgggttatttggttttcgtcgcgagggtatcgtagttcggggattaacgggttgggggcgacgcggtcgggcgcgcgggtggcgcgagggagtgcgtcgtcgcggagttttcggggtagtatttgttttgtaatcgattgtcgagcgcgtcgagcggtttagcgcgtagatacgtcgatacggttcgttagttcgcgcgcgcgtatacgcgtttttatatatatacgtataggcgttcgggtttcgtatatacgtacgcgcgcgtacgtacgttcgttcgttcgcgttcggggttcgttgttcgtcgttagtcgttcgtcgtcgtcgtcgtcgtagtcgtcgtttagttcgtttnattttcgcgggcgtttgcgcgagttcggtcggcgggggagatgtgttcgggttttatcggatcggtttttcggggtttgattagttgtttcgggttaattttgtttttcgttgaagatggaggaagtaaaaataggattatttttagttatagat

SEQ ID NO: 14994 - DNA, 796 bp, Artificial Sequence
  chemically treated genomic DNA (Homo sapiens) CpG-island No: 14994
  misc_feature (156)..(156): n is either a, c, g or t
atctataactaaaaataatcctatttttacttcctccatcttcaacgaaaaacaaaattaacccgaaacaactaatcaaaccccgaaaaaccgatccgataaaacccgaacacatctcccccgccgaccgaactcgcgcaaacgcccgcgaaaatnaaacgaactaaacgacgactacgacgacgacgacgacgaacgactaacgacgaacaacgaaccccgaacgcgaacgaacgaacgtacgtacgcgcgcgtacgtatatacgaaacccgaacgcctatacgtatatatataaaaacgcgtatacgcgcgcgcgaactaacgaaccgtatcgacgtatctacgcgctaaaccgctcgacgcgctcgacaatcgattacaaaacaaatactaccccgaaaactccgcgacgacgcactccctcgcgccacccgcgcgcccgaccgcgtcgcccccaacccgttaatccccgaactacgataccctcgcgacgaaaaccaaataacccgcttccgaatataccacgacgacccccatctcccctccccgtatcataataaatctcacgttttctaccgactaaaaacttaaaacgataaaataacgttcatttcgaccgcgtaaaattttctttcaaactaaaattaataaaaaaaccgaaaaaaaaaaacgaaacgacgatcttaaaccctacgcgaaatccgaaaaccgcgtcccgaccgaatcgaaaaatatacgtaaaacctcccacctactaatctccgccgacaactctacgaccccatttcgaaaaac

SEQ ID NO: 14995 - DNA, 796 bp, Artificial Sequence
  chemically treated genomic DNA (Homo sapiens) CpG-island No: 14995
  misc_feature (156)..(156): n is either a, c, g or t
atttgtagttaagggtaattttgtttttattttttttatttttagcgaggagtagggttagttcgggatagttggttaaatttcgagaaatcgattcggtggagttcgagtatatttttttcgtcggtcgggttcgcgtagacgttcgcggggatngggcgggttaggcggcggttgcggcggcggcggcggcgggcggttggcggcgggtagcggatttcgggcgcgggcgagcggacgtgcgtgcgcgcgcgtgcgtgtgtgcggggttcgagcgtttgtgcgtgtgtgtatgagagcgcgtgtgcgcgcgcgcgggttggcgggtcgtgtcgacgtgtttgcgcgttaagtcgttcggcgcgttcggtaatcgattataggataagtgttgtttcggaggtttcgcgacggcgtattttttcgcgttattcgcgcgttcggtcgcgtcgtttttagttcgttggttttcggattgcggtattttcgcgacgggggttaggtaattcgttttcgagtgtgttacggcgatttttatttttttttttcgtgttataataaattttacgttttttgtcggttggaggtttggagcggtgaggtgacgtttatttcggtcgcgtgaagtttttttttaaattgggattggtggggaggtcgggggaagggagcggggcggcgattttaggttttgcgcggagttcgggagtcgcgtttcggtcgagtcggggagtgtgcgtggagttttttatttattggttttcgtcggtaattttgcggttttatttcggaaagt

SEQ ID NO: 14996 - DNA, 796 bp, Artificial Sequence
  chemically treated genomic DNA (Homo sapiens) CpG-island No: 14996
  misc_feature (641)..(641): n is either a, c, g or t
actttccgaaataaaaccgcaaaattaccgacgaaaaccaataaataaaaaactccacgcacactccccgactcgaccgaaacgcgactcccgaactccgcgcaaaacctaaaatcgccgccccgctcccttcccccgacctccccaccaatcccaatttaaaaaaaaacttcacgcgaccgaaataaacgtcacctcaccgctccaaacctccaaccgacaaaaaacgtaaaatttattataacacgaaaaaaaaaaataaaaatcgccgtaacacactcgaaaacgaattacctaacccccgtcgcgaaaataccgcaatccgaaaaccaacgaactaaaaacgacgcgaccgaacgcgcgaataacgcgaaaaaatacgccgtcgcgaaacctccgaaacaacacttatcctataatcgattaccgaacgcgccgaacgacttaacgcgcaaacacgtcgacacgacccgccaacccgcgcgcgcgcacacgcgctctcatacacacacgcacaaacgctcgaaccccgcacacacgcacgcgcgcgcacgcacgtccgctcgcccgcgcccgaaatccgctacccgccgccaaccgcccgccgccgccgccgccgcaaccgccgcctaacccgcccnatccccgcgaacgtctacgcgaacccgaccgacgaaaaaaatatactcgaactccaccgaatcgatttctcgaaatttaaccaactatcccgaactaaccctactcctcgctaaaaataaaaaaaataaaaacaaaattacccttaactacaaat

SEQ ID NO: 14997 - DNA, 663 bp, Artificial Sequence
  chemically treated genomic DNA (Homo sapiens) CpG-island No: 14997
agagggtatttgtttagttagggtttgtagtttttcgtttgtcgttagagtagttttcggttttttcggatttatttgttgaggcgttggcgtcgtttttacgtcggtttcggtggtcgcgttcgtttttgttatagtttcggttatcgcggtggtcgtagtcgttattataatcgtcgttagtgcggttatgtttattcgtcgagttattcgggtcgcggcggttatcggtgtttggggattcgtggtaggcgtattttggtttttgtagatagttttttgcgttgcgggtttggtcgggatgtagggcggggtcgagatgtagggcggggtcgggatgtagggcggggttgagatgcgggggtgtaggggtgtgggggtgcgggaggggcgggattggggtgtagggcggggtcgaaatgcgaggcgggggtcgggatttaggcggggaggggcggggcgagggaggggtaaggtgtcgggcggagtcgggatgtaggggaggggcgggtttggggttttggggcgggcgggtgtgggggcggggcggggcggggcgggggttgcgttttgttttgtcgcgggtttatatattttttgggtatttaatcgattgtgttagtttagttttatatttgttaagaaaatttattgttttatatt

SEQ ID NO: 14998 - DNA, 663 bp, Artificial Sequence
  chemically treated genomic DNA (Homo sapiens) CpG-island No: 14998
aatataaaacaataaattttcttaacaaatataaaactaaactaacacaatcgattaaatacccaaaaaatatataaacccgcgacaaaacaaaacgcaacccccgccccgccccgccccgcccccacacccgcccgccccaaaaccccaaacccgcccctcccctacatcccgactccgcccgacaccttacccctccctcgccccgcccctccccgcctaaatcccgacccccgcctcgcatttcgaccccgccctacaccccaatcccgcccctcccgcacccccacacccctacacccccgcatctcaaccccgccctacatcccgaccccgccctacatctcgaccccgccctacatcccgaccaaacccgcaacgcaaaaaactatctacaaaaaccaaaatacgcctaccacgaatccccaaacaccgataaccgccgcgacccgaataactcgacgaataaacataaccgcactaacgacgattataataacgactacgaccaccgcgataaccgaaactataacaaaaacgaacgcgaccaccgaaaccgacgtaaaaacgacgccaacgcctcaacaaataaatccgaaaaaaccgaaaactactctaacgacaaacgaaaaactacaaaccctaactaaacaaataccctct

SEQ ID NO: 14999 - DNA, 663 bp, Artificial Sequence
  chemically treated genomic DNA (Homo sapiens) CpG-island No: 14999
gatgtaagataatgaatttttttgataggtatgggattgggttggtatagtcggttaagtgtttaaagggtatataaattcgcgatagggtagagcgtagttttcgtttcgtttcgtttcgtttttatattcgttcgttttagaattttagattcgttttttttttgtatttcggtttcgttcggtattttgtttttttttcgtttcgttttttttcgtttgaatttcggttttcgtttcgtatttcggtttcgttttgtattttagtttcgtttttttcgtatttttatatttttgtattttcgtattttagtttcgttttgtatttcgatttcgttttatatttcggtttcgttttgtatttcggttaagttcgtagcgtagggagttgtttgtagaggttagggtgcgtttgttacgaatttttaggtatcggtggtcgtcgcggttcgagtagttcggcgggtaaatatggtcgtattgacgacggttgtggtagcggttgcggttatcgcggtagtcggggttgtggtaggggcgggcgcggttatcgggatcggcgtgggagcgacgttagcgttttaataggtaaattcgggagaatcgagagttgttttggcggtaggcgaggggttgtaggttttggttgaataggtgtttttt

SEQ ID NO: 15000 - DNA, 663 bp, Artificial Sequence
  chemically treated genomic DNA (Homo sapiens) CpG-island No: 15000
aaaaaacacctattcaaccaaaacctacaacccctcgcctaccgccaaaacaactctcgattctcccgaatttacctattaaaacgctaacgtcgctcccacgccgatcccgataaccgcgcccgcccctaccacaaccccgactaccgcgataaccgcaaccgctaccacaaccgtcgtcaatacgaccatatttacccgccgaactactcgaaccgcgacgaccaccgatacctaaaaattcgtaacaaacgcaccctaacctctacaaacaactccctacgctacgaacttaaccgaaatacaaaacgaaaccgaaatataaaacgaaatcgaaatacaaaacgaaactaaaatacgaaaatacaaaaatataaaaatacgaaaaaaacgaaactaaaatacaaaacgaaaccgaaatacgaaacgaaaaccgaaattcaaacgaaaaaaaacgaaacgaaaaaaaaacaaaataccgaacgaaaccgaaatacaaaaaaaaaacgaatctaaaattctaaaacgaacgaatataaaaacgaaacgaaacgaaacgaaaactacgctctaccctatcgcgaatttatataccctttaaacacttaaccgactataccaacccaatcccatacctatcaaaaaaattcattatcttacatc

SEQ ID NO: 15001 - DNA, 898 bp, Artificial Sequence
  chemically treated genomic DNA (Homo sapiens) CpG-island No: 15001
  misc_feature (530)..(530): n is either a, c, g or t
  misc_feature (537)..(537): n is either a, c, g or t
  misc_feature (586)..(586): n is either a, c, g or t
  misc_feature (660)..(660): n is either a, c, g or t
tcgtggtcgtttcgtgagtgatcgtcgtttttgttgaacggttcgggcgttgggtcgcggtttttcgtaaggttggttttttttttcgagtggtagtaggtgttcggatgatcgggagtagtttacgttttggtgaagtagcgcgattcgaggttcggtgtcgttttttatcgttacgtagcgcgttcgtgttagggtaggtttggagtgagggcggttgatttaaattttacgtttttcgtggggttttttgggtagggcgggaaagcgtttggatgtttatattttcgggaggtggtttgtttttttttcgtgggtatcgtagcgggatagcgtggttgagattcgcggttttttcgttaaagtttttgcgttttcgttgttgtcggcgaggtcggttcggtcgttttttcgcgggtcgttgttttcggtgttttggaagggttttaggtggcggtttcgttgtagaatttttcgagttgcgttcgtcgttcggtgttttcgtagcgtttcggttgggttgcgggttncgggcgngcgagcgtaggaagcgtcgcggggttatttttttttttttttgaagttntcgcgatcgtgtaacgggtcgcgtcgttttttgttgtgttttacggtgatttttaagagtacgcgggtagtggncggtgacgtcgtgtgtgtgtgttttttttcgcgtaggtgtcggggatacgggcggtaagtcgtttacgcggggcggtgattttgtagcgcggtttcgtaggacggaaggtattcgcgtcgcgtataggcggggagatcgcggcggcgttcgggatttgttggaggaggtttgcgattagtgcgcgttttagttggaaaaggtaggggagcgtttgtttttgcggttatttatgtagtt

SEQ ID NO: 15002 - DNA, 898 bp, Artificial Sequence
  chemically treated genomic DNA (Homo sapiens) CpG-island No: 15002
  misc_feature (239)..(239): n is either a, c, g or t
  misc_feature (313)..(313): n is either a, c, g or t
  misc_feature (362)..(362): n is either a, c, g or t
  misc_feature (369)..(369): n is either a, c, g or t
aactacataaataaccgcaaaaacaaacgctcccctaccttttccaactaaaacgcgcactaatcgcaaacctcctccaacaaatcccgaacgccgccgcgatctccccgcctatacgcgacgcgaataccttccgtcctacgaaaccgcgctacaaaatcaccgccccgcgtaaacgacttaccgcccgtatccccgacacctacgcgaaaaaaaacacacacacacgacgtcaccgnccactacccgcgtactcttaaaaatcaccgtaaaacacaacaaaaaacgacgcgacccgttacacgatcgcganaacttcaaaaaaaaaaaaaaataaccccgcgacgcttcctacgctcgcncgcccgnaacccgcaacccaaccgaaacgctacgaaaacaccgaacgacgaacgcaactcgaaaaattctacaacgaaaccgccacctaaaacccttccaaaacaccgaaaacaacgacccgcgaaaaaacgaccgaaccgacctcgccgacaacaacgaaaacgcaaaaactttaacgaaaaaaccgcgaatctcaaccacgctatcccgctacgatacccacgaaaaaaaaacaaaccacctcccgaaaatataaacatccaaacgctttcccgccctacccaaaaaaccccacgaaaaacgtaaaatttaaatcaaccgccctcactccaaacctaccctaacacgaacgcgctacgtaacgataaaaaacgacaccgaacctcgaatcgcgctacttcaccaaaacgtaaactactcccgatcatccgaacacctactaccactcgaaaaaaaaaaccaaccttacgaaaaaccgcgacccaacgcccgaaccgttcaacaaaaacgacgatcactcacgaaacgaccacga

SEQ ID NO: 15003 - DNA, 898 bp, Artificial Sequence
  chemically treated genomic DNA (Homo sapiens) CpG-island No: 15003
  misc_feature (239)..(239): n is either a, c, g or t
  misc_feature (313)..(313): n is either a, c, g or t
  misc_feature (362)..(362): n is either a, c, g or t
  misc_feature (369)..(369): n is either a, c, g or t
ggttgtatgggtggtcgtaggggtaggcgtttttttattttttttagttgggacgcgtattggtcgtaggttttttttagtaggtttcgggcgtcgtcgcggttttttcgtttgtacgcggcgcggatgtttttcgttttgcgggatcgcgttgtagggttatcgtttcgcgtggacggtttgtcgttcgtgttttcggtatttgcgcgggaggaagtatatatatacggcgttatcgnttattgttcgcgtgtttttgagaattatcgtggaatatagtaggaggcggcgcggttcgttgtacgatcgcggnggttttaggaagagagaggggtggtttcgcgacgttttttgcgttcgtncgttcgngattcgtaatttaatcggggcgttgcgaaggtatcgggcggcgagcgtagttcggaggattttgtagcgagatcgttatttggagtttttttagggtatcggggatagcggttcgcgggggagcggtcgggtcgatttcgtcgatagtagcggaggcgtaggggttttggcgagagagtcgcgggttttagttacgttgtttcgttgcggtgtttacgggggaaagataggttatttttcgggggtgtggatatttagacgttttttcgttttgtttagaaaattttacgaagggcgtgggatttaaattagtcgtttttattttagatttgttttggtacgaacgcgttgcgtaacgatgggggacgatatcgggtttcgggtcgcgttgttttattagagcgtgggttgttttcggttattcgagtatttgttgttattcgggaggagaggttagttttgcgggaggtcgcgatttagcgttcgggtcgtttagtaaaagcggcggttatttacggggcggttacgg

SEQ ID NO: 15004 - DNA, 898 bp, Artificial Sequence
  chemically treated genomic DNA (Homo sapiens) CpG-island No: 15004
  misc_feature (530)..(530): n is either a, c, g or t
  misc_feature (537)..(537): n is either a, c, g or t
  misc_feature (586)..(586): n is either a, c, g or t
  misc_feature (660)..(660): n is either a, c, g or t
ccgtaaccgccccgtaaataaccgccgcttttactaaacgacccgaacgctaaatcgcgacctcccgcaaaactaacctctcctcccgaataacaacaaatactcgaataaccgaaaacaacccacgctctaataaaacaacgcgacccgaaacccgatatcgtcccccatcgttacgcaacgcgttcgtaccaaaacaaatctaaaataaaaacgactaatttaaatcccacgcccttcgtaaaattttctaaacaaaacgaaaaaacgtctaaatatccacacccccgaaaaataacctatctttcccccgtaaacaccgcaacgaaacaacgtaactaaaacccgcgactctctcgccaaaacccctacgcctccgctactatcgacgaaatcgacccgaccgctcccccgcgaaccgctatccccgataccctaaaaaaactccaaataacgatctcgctacaaaatcctccgaactacgctcgccgcccgataccttcgcaacgccccgattaaattacgaatcncgaacgnacgaacgcaaaaaacgtcgcgaaaccacccctctctcttcctaaaaccnccgcgatcgtacaacgaaccgcgccgcctcctactatattccacgataattctcaaaaacacgcgaacaataancgataacgccgtatatatatacttcctcccgcgcaaataccgaaaacacgaacgacaaaccgtccacgcgaaacgataaccctacaacgcgatcccgcaaaacgaaaaacatccgcgccgcgtacaaacgaaaaaaccgcgacgacgcccgaaacctactaaaaaaaacctacgaccaatacgcgtcccaactaaaaaaaataaaaaaacgcctacccctacgaccacccatacaacc

SEQ ID NO: 15005 - DNA, 594 bp, Artificial Sequence
  chemically treated genomic DNA (Homo sapiens) CpG-island No: 15005
cggcgtttgcgcggtttttttttagttttttttgtagttacgttattttttacggtttttttcggcgtttgcgcggtttttttttagttttttttgtagttacgttattttttacggtttttttcggcgtttgcgcggtttttttttagttttttttgtagttacgttattttttacggtttttttcggcgtttgcgcggtttttttttagttttttttgtagttacgttattttttacggtttttttcggcgtttgcgcggtttttttttagttttttttgtagttacgttatttatttcggtttttttcggcgtttgcgcggtttttttttagttttttttgtagttatgttattttttacggttttcggcgtttgcgcggtcgcggtttcgtcgtttaatcgtatgcgcgatagcgttgaggttcggggagcgaggatttgtcgtcgtttagttcggagttcgtttagaaatttcgttttgtcgattcggacggtagtcgtcgttttggattttgtatttatttttttttaggttttggtttgtttcgtcgttggtgttatttaggagttgtttagtttcggttttattta

SEQ ID NO: 15006 - DNA, 594 bp, Artificial Sequence
  chemically treated genomic DNA (Homo sapiens) CpG-island No: 15006
taaataaaaccgaaactaaacaactcctaaataacaccaacgacgaaacaaaccaaaacctaaaaaaaaataaatacaaaatccaaaacgacgactaccgtccgaatcgacaaaacgaaatttctaaacgaactccgaactaaacgacgacaaatcctcgctccccgaacctcaacgctatcgcgcatacgattaaacgacgaaaccgcgaccgcgcaaacgccgaaaaccgtaaaaaataacataactacaaaaaaaactaaaaaaaaaccgcgcaaacgccgaaaaaaaccgaaataaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaaaaccgtaaaaaataacgtaactacaaaaaaaactaaaaaaaaaccgcgcaaacgccg

SEQ ID NO: 15007 - DNA, 594 bp, Artificial Sequence
  chemically treated genomic DNA (Homo sapiens) CpG-island No: 15007
tgagtgagatcgggattgggtagtttttagatgatattaacgacgggataagttagagtttgggaggaaatgaatgtaggatttaaaacggcggttgtcgttcgagtcggtagaacgaggtttttgagcgggtttcgggttgagcggcggtagattttcgtttttcgggttttagcgttgtcgcgtatgcggttgaacggcggagtcgcggtcgcgtaggcgtcggaggtcgtgggaggtgatatagttgtagggggagttggggaagagtcgcgtaggcgtcggaggaggtcggggtaggtgacgtagttgtagggggagttggggaagagtcgcgtaggcgtcggaggaggtcgtgggaggtgacgtagttgtagggggagttggggaagagtcgcgtaggcgtcggaggaggtcgtgggaggtgacgtagttgtagggggagttggggaagagtcgcgtaggcgtcggaggaggtcgtgggaggtgacgtagttgtagggggagttggggaagagtcgcgtaggcgtcggaggaggtcgtgggaggtgacgtagttgtagggggagttggggaagagtcgcgtaggcgtcg

SEQ ID NO: 15008 - DNA, 594 bp, Artificial Sequence
  chemically treated genomic DNA (Homo sapiens) CpG-island No: 15008
cgacgcctacgcgactcttccccaactccccctacaactacgtcacctcccacgacctcctccgacgcctacgcgactcttccccaactccccctacaactacgtcacctcccacgacctcctccgacgcctacgcgactcttccccaactccccctacaactacgtcacctcccacgacctcctccgacgcctacgcgactcttccccaactccccctacaactacgtcacctcccacgacctcctccgacgcctacgcgactcttccccaactccccctacaactacgtcacctaccccgacctcctccgacgcctacgcgactcttccccaactccccctacaactatatcacctcccacgacctccgacgcctacgcgaccgcgactccgccgttcaaccgcatacgcgacaacgctaaaacccgaaaaacgaaaatctaccgccgctcaacccgaaacccgctcaaaaacctcgttctaccgactcgaacgacaaccgccgttttaaatcctacattcatttcctcccaaactctaacttatcccgtcgttaatatcatctaaaaactacccaatcccgatctcactca

SEQ ID NO: 15009 - DNA, 937 bp, Artificial Sequence
  chemically treated genomic DNA (Homo sapiens) CpG-island No: 15009
cgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggattggtggtaggtgacgatggtgacggtgttagggatggtggtaggtgacgatggtgacggtgttagggatggtggtaggtgatgatggtgacgttgttagggatggtggtagttgatgatggtgacgttgttagggatggtggtagttgatgatggtgacggtgttagggatggtggcgacggtgttagggatggtggtaggtgatgatggtgacggtgttagggatggtggtaggtgatgatggtgacggtgttagggatggtggtaggtgatgatggtgacggtgttagggatggtggtaggtgatggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgatggtgttagggatggtggtaggtgatgacggtgacggtgttagggatggtggtaggtgatgatggtgatggtgttagggatggttgtaggtaa

SEQ ID NO: 15010 - DNA, 937 bp, Artificial Sequence
  chemically treated genomic DNA (Homo sapiens) CpG-island No: 15010
ttacctacaaccatccctaacaccatcaccatcatcacctaccaccatccctaacaccgtcaccgtcatcacctaccaccatccctaacaccatcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccatcacctaccaccatccctaacaccgtcaccatcatcacctaccaccatccctaacaccgtcaccatcatcacctaccaccatccctaacaccgtcaccatcatcacctaccaccatccctaacaccgtcgccaccatccctaacaccgtcaccatcatcaactaccaccatccctaacaacgtcaccatcatcaactaccaccatccctaacaacgtcaccatcatcacctaccaccatccctaacaccgtcaccatcgtcacctaccaccatccctaacaccgtcaccatcgtcacctaccaccaatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcg

SEQ ID NO: 15011 - DNA, 937 bp, Artificial Sequence
  chemically treated genomic DNA (Homo sapiens) CpG-island No: 15011
ttatttataattatttttaatattattattattattatttattattatttttaatatcgttatcgttattatttattattatttttaatattattatcgttattatttattattatttttaatatcgttatcgttattatttattattatttttaatatcgttatcgttattatttattattatttttaatatcgttatcgttattatttattattatttttaatatcgttatcgttattatttgttattatttttaatatcgttatcgttattatttgttattatttttaatatcgttatcgttattatttgttattatttttaatatcgttatcgttattatttgttattatttttaatatcgttattattatttgttattatttttaatatcgttattattattatttgttattatttttaatatcgttattattattatttgttattatttttaatatcgttattattattatttgttattatttttaatatcgtcgttattatttttaatatcgttattattattagttgttattatttttaataacgttattattattaattgttattatttttaataacgttattattattatttgttattatttttaatatcgttattatcgttatttgttattatttttaatatcgttattatcgttatttgttattaatttttaatatcgttattatcgttatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcg

SEQ ID NO: 15012 - DNA, 937 bp, Artificial Sequence
  chemically treated genomic DNA (Homo sapiens) CpG-island No: 15012
cgataataacgatattaaaaataataacaaataacgataataacgatattaaaaataataacaaataacgataataacgatattaaaaataataacaaataacgataataacgatattaaaaataataacaaataacgataataacgatattaaaaataataacaaataacgataataacgatattaaaaataataacaaataacgataataacgatattaaaaataataacaaataacgataataacgatattaaaaattaataacaaataacgataataacgatattaaaaataataacaaataacgataataacgatattaaaaataataacaaataataataataacgttattaaaaataataacaattaataataataacgttattaaaaataataacaactaataataataacgatattaaaaataataacgacgatattaaaaataataacaaataataataataacgatattaaaaataataacaaataataataataacgatattaaaaataataacaaataataataataacgatattaaaaataataacaaataataataacgatattaaaaataataacaaataataacgataacgatattaaaaataataacaaataataacgataacgatattaaaaataataacaaataataacgataacgatattaaaaataataacaaataataacgataacgatattaaaaataataataaataataacgataacgatattaaaaataataataaataataacgataacgatattaaaaataataataaataataacgataacgatattaaaaataataataaataataacgataataatattaaaaataataataaataataacgataacgatattaaaaataataataaataataataataataatattaaaaataattataaataa

SEQ ID NO: 15013 - DNA, 556 bp, Artificial Sequence
  chemically treated genomic DNA (Homo sapiens) CpG-island No: 15013
  misc_feature (273)..(273): n is either a, c, g or t
gtcgcgtcggtttttcgtcgggttggttaggttaaaggggttggaggcgagggtataggttacgggttggcggggcgggtaagggggggtatttattttagtcgaggatcgtgtgataggaagcggtgataatgagttatagggtagcggggcgaagcgtttttttttttttcgtatatgttcgtgggatggttttcgaagcgagcgtggtggtttattttagttattttagcggttatataatttcgttcgcgcgggggaggggcgtttcgnatttcgttcgcggtttttatgtaattagtgtttttttgatttaattttatgtcggatttattttatagggagtcgcgcgttcggaaggggtaatattcggcggcgcgagcggcggacgtaggcgtcgatcggatattttttgttggttatagtttagaggatcgggcgtaagtgcgaggagcgcgcgaagttttttttttcgttgggaaggtgcgagtaggtgtaagaggagattaggagtgtagcgggaggagagttagaggaatagagatagtgatatcga

SEQ ID NO: 15014 - DNA, 556 bp, Artificial Sequence
  chemically treated genomic DNA (Homo sapiens) CpG-island No: 15014
  misc_feature (284)..(284): n is either a, c, g or t
tcgatatcactatctctattcctctaactctcctcccgctacactcctaatctcctcttacacctactcgcaccttcccaacgaaaaaaaaaacttcgcgcgctcctcgcacttacgcccgatcctctaaactataaccaacaaaaaatatccgatcgacgcctacgtccgccgctcgcgccgccgaatattaccccttccgaacgcgcgactccctataaaataaatccgacataaaattaaatcaaaaaaacactaattacataaaaaccgcgaacgaaatncgaaacgcccctcccccgcgcgaacgaaattatataaccgctaaaataactaaaataaaccaccacgctcgcttcgaaaaccatcccacgaacatatacgaaaaaaaaaaaaacgcttcgccccgctaccctataactcattatcaccgcttcctatcacacgatcctcgactaaaataaatacccccccttacccgccccgccaacccgtaacctataccctcgcctccaacccctttaacctaaccaacccgacgaaaaaccgacgcgac

SEQ ID NO: 15015 - DNA, 556 bp, Artificial Sequence
  chemically treated genomic DNA (Homo sapiens) CpG-island No: 15015
  misc_feature (284)..(284): n is either a, c, g or t
tcggtgttattgtttttgtttttttgatttttttttcgttgtatttttggtttttttttatatttgttcgtatttttttagcgaggagaggaatttcgcgcgtttttcgtatttgcgttcggttttttgggttgtagttagtaggagatgttcggtcggcgtttgcgttcgtcgttcgcgtcgtcgggtgttgtttttttcgggcgcgcggttttttgtggggtgggttcggtatggaattaggttaggagagtattggttgtataagggtcgcgagcgagatncggggcgtttttttttcgcgcgagcgggattgtgtaatcgttgaggtaattgaagtgggttattacgttcgtttcggaaattattttacgagtatgtgcggggggagggggagcgtttcgtttcgttgttttgtgatttattgttatcgttttttattatacgattttcggttgaaatagatgtttttttttgttcgtttcgttaattcgtagtttgtgttttcgtttttaatttttttaatttggttagttcggcgggaggtcggcgcggt

SEQ ID NO: 15016 - DNA, 556 bp, Artificial Sequence
  chemically treated genomic DNA (Homo sapiens) CpG-island No: 15016
  misc_feature (273)..(273): n is either a, c, g or t
accgcgccgacctcccgccgaactaaccaaattaaaaaaattaaaaacgaaaacacaaactacgaattaacgaaacgaacaaaaaaaaacatctatttcaaccgaaaatcgtataataaaaaacgataacaataaatcacaaaacaacgaaacgaaacgctccccctccccccgcacatactcgtaaaataatttccgaaacgaacgtaataacccacttcaattacctcaacgattacacaatcccgctcgcgcgaaaaaaaaacgccccgnatctcgctcgcgacccttatacaaccaatactctcctaacctaattccataccgaacccaccccacaaaaaaccgcgcgcccgaaaaaaacaacacccgacgacgcgaacgacgaacgcaaacgccgaccgaacatctcctactaactacaacccaaaaaaccgaacgcaaatacgaaaaacgcgcgaaattcctctcctcgctaaaaaaatacgaacaaatataaaaaaaaaccaaaaatacaacgaaaaaaaaatcaaaaaaacaaaaacaataacaccga

SEQ ID NO: 15017 - DNA, 588 bp, Artificial Sequence
  chemically treated genomic DNA (Homo sapiens) CpG-island No: 15017
ttcgtcgttcgggtcgaggttcgtttcggagttttatataggcggttcgataagaacgtcgtagtgtcggcgcggaaagtggggtagcggttgtttttcgttcggtcgtgcgagcggcggtcgttatcgcgggtcgcggcgggaaggagaagaggggtcgcgttaggcgttattttatttgagaaattagcgggagtagcgtttgttttatcgagcgagttttgatttttagtttcgagtcgagggcgaagttcgaagagtcggagtcgtagattgtttcggcgtcgttaacgtcggcgggttcgggagaggcggttatggttttcggtttatttcgtagtcgggatttcgcgtcgcggcgagtttgtcgttagttagtttattcgttcgaggcggcggcgataggatattcgcgttaatcgagatttcgtttttaggggttcgtttttttagggtttcgtcgttaattttgcgttttcgacgttcgttatcgtatgttttcgtttattttcggtttttgtttcgttcgcgtagtttagtttggtgtgggttttttgtaattttattttttaagtcgggtttcgtttt

SEQ ID NO: 15018 - DNA, 588 bp, Artificial Sequence
  chemically treated genomic DNA (Homo sapiens) CpG-island No: 15018
aaaacgaaacccgacttaaaaaataaaattacaaaaaacccacaccaaactaaactacgcgaacgaaacaaaaaccgaaaataaacgaaaacatacgataacgaacgtcgaaaacgcaaaattaacgacgaaaccctaaaaaaacgaacccctaaaaacgaaatctcgattaacgcgaatatcctatcgccgccgcctcgaacgaataaactaactaacgacaaactcgccgcgacgcgaaatcccgactacgaaataaaccgaaaaccataaccgcctctcccgaacccgccgacgttaacgacgccgaaacaatctacgactccgactcttcgaacttcgccctcgactcgaaactaaaaatcaaaactcgctcgataaaacaaacgctactcccgctaatttctcaaataaaataacgcctaacgcgacccctcttctccttcccgccgcgacccgcgataacgaccgccgctcgcacgaccgaacgaaaaacaaccgctaccccactttccgcgccgacactacgacgttcttatcgaaccgcctatataaaactccgaaacgaacctcgacccgaacgacgaa

SEQ ID NO: 15019 - DNA, 588 bp, Artificial Sequence
  chemically treated genomic DNA (Homo sapiens) CpG-island No: 15019
ggggcgggattcggtttagggggtggggttgtagggagtttatattaggttggattgcgcgggcggggtagaggtcgggggtgggcggggatatacggtgacgggcgtcggggacgtagggttggcggcggagttttgggggggcgggtttttgggggcggggtttcggttggcgcgagtgttttgtcgtcgtcgtttcgggcgggtgggttgattggcggtaggttcgtcgcggcgcggagtttcggttgcgggatagatcgagggttatggtcgtttttttcggattcgtcggcgttggcggcgtcggagtagtttacggtttcggtttttcgggtttcgttttcgattcgggattggagattaaaattcgttcggtggagtagacgttattttcgttggttttttaggtaaagtggcgtttggcgcggttttttttttttttttcgtcgcggttcgcgatggcggtcgtcgttcgtacgatcggacgggaggtagtcgttgttttatttttcgcgtcggtattgcggcgtttttgtcggatcgtttgtgtggggtttcgggacgggtttcggttcgggcggcgag

SEQ ID NO: 15020 - DNA, 588 bp, Artificial Sequence
  chemically treated genomic DNA (Homo sapiens) CpG-island No: 15020
ctcgccgcccgaaccgaaacccgtcccgaaaccccacacaaacgatccgacaaaaacgccgcaataccgacgcgaaaaataaaacaacgactacctcccgtccgatcgtacgaacgacgaccgccatcgcgaaccgcgacgaaaaaaaaaaaaaaaaccgcgccaaacgccactttacctaaaaaaccaacgaaaataacgtctactccaccgaacgaattttaatctccaatcccgaatcgaaaacgaaacccgaaaaaccgaaaccgtaaactactccgacgccgccaacgccgacgaatccgaaaaaaacgaccataaccctcgatctatcccgcaaccgaaactccgcgccgcgacgaacctaccgccaatcaacccacccgcccgaaacgacgacgacaaaacactcgcgccaaccgaaaccccgcccccaaaaacccgcccccccaaaactccgccgccaaccctacgtccccgacgcccgtcaccgtatatccccgcccacccccgacctctaccccgcccgcgcaatccaacctaatataaactccctacaaccccaccccctaaaccgaatcccgcccc

SEQ ID NO: 15021 - DNA, 1135 bp, Artificial Sequence
  chemically treated genomic DNA (Homo sapiens) CpG-island No: 15021
ttcgttttttgtttttttcggggcggcggcggatgggcgcggaggcggatgggcgcggtttttttttttatttaggtttttttacggggcggggggtcgggttttttagtttttattcgcgtcgtgtttagtttttcgcgtgttcgcggcggagttttgagcgtattgggttcgagttttgcgcgtttttttattatttttttcgtatttgtttttttttttcggtttcgtttagcgcgttagtagttcgatttttagtgttgggagaagagagggggcgtaggcggcgatataaagggtggagcggcgggatcgggattcgggaggttgcgcggtatggacgtcgagtattttgtttttgagttttcgttttgtagcgagtttaagtatttgtgtcggcggttgcgggaagcgtatcgcgagtttaaggaggattttacgttttttaaggatgatcgttattataggtgggcgcggcgcgggtagcggcgggggcggtcggaggttttcgggtcgtagtttttttcgggatttcggcgcgtttcggttttggtttggtttcgtcgacggtcgttttcgtcggtcgggcgcggagtttacggatggggacggggtcggggcggggatttgggagggattaggaaggggacggggagtagggatattggtagcggcgggtaggtttttggatttagggtagttcggcgttttcgggcgaagggtcgattttcgtttagttgaaatttaagtcgaggttttcgttttttcggaaaggagttgcgggttgtggtttttttttgcgtttcgcgtcgtttttttttcgcgttcgtttcgtcgttttcgttcgggttttacgcggcgtagtttggggaggcgatcgcgcgcgttgcggcgtcgggaggagggttttggtcgtagttttgagcgttttaggttttgtaggacgtttcggaggcgggggcgtcgttaagggttgggggcggatgggcgcggcggggaagacgcggcggggcgttatgcggggatacggcgtttgggagcggttgtgtggaatttgtttgcgtttatttttgtttttttttttagcggtttaggggagagcggtggggattgtagattttggcgtcggttttcg

SEQ ID NO: 15022 - DNA, 1135 bp, Artificial Sequence
  chemically treated genomic DNA (Homo sapiens) CpG-island No: 15022
cgaaaaccgacgccaaaatctacaatccccaccgctctcccctaaaccgctaaaaaaaaaaacaaaaataaacgcaaacaaattccacacaaccgctcccaaacgccgtatccccgcataacgccccgccgcgtcttccccgccgcgcccatccgcccccaacccttaacgacgcccccgcctccgaaacgtcctacaaaacctaaaacgctcaaaactacgaccaaaaccctcctcccgacgccgcaacgcgcgcgatcgcctccccaaactacgccgcgtaaaacccgaacgaaaacgacgaaacgaacgcgaaaaaaaaacgacgcgaaacgcaaaaaaaaaccacaacccgcaactcctttccgaaaaaacgaaaacctcgacttaaatttcaactaaacgaaaatcgacccttcgcccgaaaacgccgaactaccctaaatccaaaaacctacccgccgctaccaatatccctactccccgtccccttcctaatccctcccaaatccccgccccgaccccgtccccatccgtaaactccgcgcccgaccgacgaaaacgaccgtcgacgaaaccaaaccaaaaccgaaacgcgccgaaatcccgaaaaaaactacgacccgaaaacctccgaccgcccccgccgctacccgcgccgcgcccacctataataacgatcatccttaaaaaacgtaaaatcctccttaaactcgcgatacgcttcccgcaaccgccgacacaaatacttaaactcgctacaaaacgaaaactcaaaaacaaaatactcgacgtccataccgcgcaacctcccgaatcccgatcccgccgctccaccctttatatcgccgcctacgccccctctcttctcccaacactaaaaatcgaactactaacgcgctaaacgaaaccgaaaaaaaaaaacaaatacgaaaaaaataataaaaaaacgcgcaaaactcgaacccaatacgctcaaaactccgccgcgaacacgcgaaaaactaaacacgacgcgaataaaaactaaaaaacccgaccccccgccccgtaaaaaaacctaaataaaaaaaaaaaccgcgcccatccgcctccgcgcccatccgccgccgccccgaaaaaaacaaaaaacgaa

SEQ ID NO: 15023 - DNA, 1135 bp, Artificial Sequence
  chemically treated genomic DNA (Homo sapiens) CpG-island No: 15023
cgggggtcggcgttagggtttgtagtttttatcgtttttttttaggtcgttgaagagggagatagagatgaacgtaaataagttttatatagtcgtttttaggcgtcgtgttttcgtatggcgtttcgtcgcgtttttttcgtcgcgtttattcgtttttagtttttggcggcgttttcgttttcgaggcgttttgtaaagtttagggcgtttagagttgcggttaagatttttttttcgacgtcgtagcgcgcgcggtcgtttttttagattgcgtcgcgtgaggttcgagcgggggcggcgaggcgggcgcggggggagaacgacgcggggcgtagggaggagttataattcgtagttttttttcggggaggcgggagtttcggtttgggttttagttgaacggaaatcggtttttcgttcgggggcgtcgggttgttttgaatttaggaatttgttcgtcgttgttagtatttttgtttttcgttttttttttggttttttttagattttcgtttcgatttcgtttttattcgtaggtttcgcgttcggtcggcggaggcggtcgtcggcgggattaggttaaggtcggggcgcgtcggggtttcggaggggattgcggttcggaagttttcggtcgttttcgtcgttgttcgcgtcgcgtttatttgtagtagcggttatttttgaagggcgtgaggttttttttgagttcgcggtacgtttttcgtagtcgtcggtataggtgtttgagttcgttgtagagcgggggtttaaaggtagggtattcggcgtttatgtcgcgtagtttttcgggtttcggtttcgtcgttttattttttgtgtcgtcgtttgcgttttttttttttttttagtattggggatcgggttgttggcgcgttgggcgggatcgaggaggaggagtaggtgcgggggaggtggtgagggggcgcgtaggattcggatttagtgcgtttagggtttcgtcgcgagtacgcgaggagttggatacggcgcgggtgggggttgggggattcggtttttcgtttcgtgaagaggtttgagtgggggagggagtcgcgtttattcgttttcgcgtttattcgtcgtcgtttcgggagaggtagaaggcggg

SEQ ID NO: 15024 - DNA, 1135 bp, Artificial Sequence
  chemically treated genomic DNA (Homo sapiens) CpG-island No: 15024
cccgccttctacctctcccgaaacgacgacgaataaacgcgaaaacgaataaacgcgactccctcccccactcaaacctcttcacgaaacgaaaaaccgaatcccccaacccccacccgcgccgtatccaactcctcgcgtactcgcgacgaaaccctaaacgcactaaatccgaatcctacgcgccccctcaccacctcccccgcacctactcctcctcctcgatcccgcccaacgcgccaacaacccgatccccaatactaaaaaaaaaaaaaaaacgcaaacgacgacacaaaaaataaaacgacgaaaccgaaacccgaaaaactacgcgacataaacgccgaataccctacctttaaacccccgctctacaacgaactcaaacacctataccgacgactacgaaaaacgtaccgcgaactcaaaaaaaacctcacgcccttcaaaaataaccgctactacaaataaacgcgacgcgaacaacgacgaaaacgaccgaaaacttccgaaccgcaatcccctccgaaaccccgacgcgccccgaccttaacctaatcccgccgacgaccgcctccgccgaccgaacgcgaaacctacgaataaaaacgaaatcgaaacgaaaatctaaaaaaaaccaaaaaaaaaacgaaaaacaaaaatactaacaacgacgaacaaattcctaaattcaaaacaacccgacgcccccgaacgaaaaaccgatttccgttcaactaaaacccaaaccgaaactcccgcctccccgaaaaaaaactacgaattataactcctccctacgccccgcgtcgttctccccccgcgcccgcctcgccgcccccgctcgaacctcacgcgacgcaatctaaaaaaacgaccgcgcgcgctacgacgtcgaaaaaaaaatcttaaccgcaactctaaacgccctaaactttacaaaacgcctcgaaaacgaaaacgccgccaaaaactaaaaacgaataaacgcgacgaaaaaaacgcgacgaaacgccatacgaaaacacgacgcctaaaaacgactatataaaacttatttacgttcatctctatctccctcttcaacgacctaaaaaaaaacgataaaaactacaaaccctaacgccgacccccg

SEQ ID NO: 15025 - DNA, 823 bp, Artificial Sequence
  chemically treated genomic DNA (Homo sapiens) CpG-island No: 15025
tcgcgcgttcgcggtttcgtttttatcgcgtcgcgttttttttcgtcgtgagagtcgttttcgcgtacgtgatttcggcgtcgcgttttgatgagtttttcgcggtcggtcgttgtttagtcgttgtcgtttcggtttcggttgcggttgtcgttgtcgaggttgttgcgcggcgtttggcgggttcgggacgcgcgggtcggggtcgagggttttgggcgtcgagatggagtcgtgagttttcggtcgagcgggcgggttggttggtttttcggatatttcggtcgaaagttggggatttttggttttcggcgtcgtgtcgtagggtttttggcgtttacgtggaattgggggtagggaaaagggcgttgaagggggtttcgcgggcgggttaggcggaggtgtttgcgcggggcgagagtagatcggggtcggggtttttttttgtttgttcgttcggtcgcggttagagatcgggatgcggtcggggtttcgggacggggttgcgagttatagcgtttatcggggggtcgagagaatcgggggcgttgcggttttttttcggcgtagggtggtcgttcgtacggagtttcgtcgtttttcgggtagttttttttgtcggaaaggtttcgtttcgtcgttttttcggtatcgagagcgtttcgcgttgttttgcggtttcgtttagcgtcgggtgcgaggtttttagaggcgattggtgacgtgggtatcggggagtttgtcgtaatagtttttttggattcggggtgtcgagttatatgagttttatgcgttttacgatttgttgattttgggttttttt

SEQ ID NO: 15026 - DNA, 823 bp, Artificial Sequence
  chemically treated genomic DNA (Homo sapiens) CpG-island No: 15026
aaaaaaacccaaaatcaacaaatcgtaaaacgcataaaactcatataactcgacaccccgaatccaaaaaaactattacgacaaactccccgatacccacgtcaccaatcgcctctaaaaacctcgcacccgacgctaaacgaaaccgcaaaacaacgcgaaacgctctcgataccgaaaaaacgacgaaacgaaacctttccgacaaaaaaaactacccgaaaaacgacgaaactccgtacgaacgaccaccctacgccgaaaaaaaaccgcaacgcccccgattctctcgaccccccgataaacgctataactcgcaaccccgtcccgaaaccccgaccgcatcccgatctctaaccgcgaccgaacgaacaaacaaaaaaaaaccccgaccccgatctactctcgccccgcgcaaacacctccgcctaacccgcccgcgaaacccccttcaacgcccttttccctacccccaattccacgtaaacgccaaaaaccctacgacacgacgccgaaaaccaaaaatccccaactttcgaccgaaatatccgaaaaaccaaccaacccgcccgctcgaccgaaaactcacgactccatctcgacgcccaaaaccctcgaccccgacccgcgcgtcccgaacccgccaaacgccgcgcaacaacctcgacaacgacaaccgcaaccgaaaccgaaacgacaacgactaaacaacgaccgaccgcgaaaaactcatcaaaacgcgacgccgaaatcacgtacgcgaaaacgactctcacgacgaaaaaaaacgcgacgcgataaaaacgaaaccgcgaacgcgcga

SEQ ID NO: 15027 - DNA, 823 bp, Artificial Sequence
  chemically treated genomic DNA (Homo sapiens) CpG-island No: 15027
aaaaaagtttaaagttagtagatcgtaaaacgtataaaatttatataattcgatatttcgagtttaaaggggttgttgcggtaggtttttcggtgtttacgttattaatcgtttttgagagtttcgtattcggcgttgggcgagatcgtagggtagcgcggggcgttttcgatatcgaggggacgacggggcggggttttttcggtaggagaggttgttcgggaggcggcgggatttcgtgcgggcggttattttacgtcggggaagggtcgtagcgttttcggttttttcggtttttcggtgagcgttgtggttcgtagtttcgtttcggaatttcgatcgtatttcggtttttaatcgcggtcgggcgggtaggtaggagggagtttcggtttcggtttattttcgtttcgcgtaaatattttcgtttgattcgttcgcgaagttttttttagcgtttttttttttgtttttagttttacgtgggcgttagggattttgcggtacggcgtcgggagttagggatttttaattttcggtcggagtgttcggagagttagttagttcgttcgttcggtcggggatttacggttttatttcggcgtttagagttttcggtttcggttcgcgcgtttcgagttcgttaggcgtcgcgtagtagtttcggtagcggtagtcgtagtcggagtcggagcgatagcggttgagtagcggtcggtcgcggaaaatttattagagcgcgacgtcgagattacgtgcgcggaagcgatttttacggcggaagagggcgcggcgcggtggaagcggggtcgcgggcgcgcgg

SEQ ID NO: 15028 - DNA, 823 bp, Artificial Sequence
  chemically treated genomic DNA (Homo sapiens) CpG-island No: 15028
ccgcgcgcccgcgaccccgcttccaccgcgccgcgccctcttccgccgtaaaaatcgcttccgcgcacgtaatctcgacgtcgcgctctaataaattttccgcgaccgaccgctactcaaccgctatcgctccgactccgactacgactaccgctaccgaaactactacgcgacgcctaacgaactcgaaacgcgcgaaccgaaaccgaaaactctaaacgccgaaataaaaccgtaaatccccgaccgaacgaacgaactaactaactctccgaacactccgaccgaaaattaaaaatccctaactcccgacgccgtaccgcaaaatccctaacgcccacgtaaaactaaaaacaaaaaaaaaaacgctaaaaaaaacttcgcgaacgaatcaaacgaaaatatttacgcgaaacgaaaataaaccgaaaccgaaactccctcctacctacccgcccgaccgcgattaaaaaccgaaatacgatcgaaattccgaaacgaaactacgaaccacaacgctcaccgaaaaaccgaaaaaaccgaaaacgctacgacccttccccgacgtaaaataaccgcccgcacgaaatcccgccgcctcccgaacaacctctcctaccgaaaaaaccccgccccgtcgtcccctcgatatcgaaaacgccccgcgctaccctacgatctcgcccaacgccgaatacgaaactctcaaaaacgattaataacgtaaacaccgaaaaacctaccgcaacaacccctttaaactcgaaatatcgaattatataaattttatacgttttacgatctactaactttaaactttttt

SEQ ID NO: 15029 - DNA, 681 bp, Artificial Sequence
  chemically treated genomic DNA (Homo sapiens) CpG-island No: 15029
tattatcggttcgtttcgtggttgtgtagtacgatcgagtagtcgaatagcgtgttgtgggggttttggtaaagtagcgcgtttttagtgtttacgttgtaggggcggtcggtcgggatttttaggtatagtaatagtattatcgtttttcggacggcggtttttcgggggtcgggtttcgcgtttcgttttttaagttatgcgttttcggtggggaatatttaatattaaacggttattattttaaagttgtacgggatgcgacgtttggttaacggggaagattttttaaagaattgaggttaagttttttcggttaagcggtttaaagaaaggagagaggaaagaggagggaaattcgtttatcgcgggcgaagttttcggttcggtttggaattcgtatattcgttcggtttaattttcgttttttgtcgtaagtcgggagtttcgggtttcggttttttttcgggtacggtcgttgggtggggtttcgggcgtggtgcggaggcgtagggtcgggtttcgtttttgtttacgcgcggttgtagggggcgttggggaatttcggttgcgtaggattcgcgttttggttcgggttttttagttcgtagagcgcgggatggttttgggtttagtaagagcggatttgatggggtacgggtttttttttttaacggtggt

SEQ ID NO: 15030 - DNA, 681 bp, Artificial Sequence
  chemically treated genomic DNA (Homo sapiens) CpG-island No: 15030
accaccgttaaaaaaaaaaacccgtaccccatcaaatccgctcttactaaacccaaaaccatcccgcgctctacgaactaaaaaacccgaaccaaaacgcgaatcctacgcaaccgaaattccccaacgccccctacaaccgcgcgtaaacaaaaacgaaacccgaccctacgcctccgcaccacgcccgaaaccccacccaacgaccgtacccgaaaaaaaaccgaaacccgaaactcccgacttacgacaaaaaacgaaaattaaaccgaacgaatatacgaattccaaaccgaaccgaaaacttcgcccgcgataaacgaatttccctcctctttcctctctcctttctttaaaccgcttaaccgaaaaaacttaacctcaattctttaaaaaatcttccccgttaaccaaacgtcgcatcccgtacaactttaaaataataaccgtttaatattaaatattccccaccgaaaacgcataacttaaaaaacgaaacgcgaaacccgacccccgaaaaaccgccgtccgaaaaacgataatactattactatacctaaaaatcccgaccgaccgcccctacaacgtaaacactaaaaacgcgctactttaccaaaacccccacaacacgctattcgactactcgatcgtactacacaaccacgaaacgaaccgataata

SEQ ID NO: 15031 - DNA, 681 bp, Artificial Sequence
  chemically treated genomic DNA (Homo sapiens) CpG-island No: 15031
attatcgttaaaaggggaagttcgtgttttattaggttcgtttttgttgagtttagagttatttcgcgttttgcgggttgggaggttcgggttaggacgcgagttttgcgtagtcgaggttttttagcgttttttgtagtcgcgcgtaggtagagacggagttcggttttgcgttttcgtattacgttcgggattttatttagcggtcgtattcggagaagaatcgggattcgaagttttcggtttgcggtagaaaacgggagttgggtcgggcgagtgtgcggattttaagtcgggtcgaaagtttcgttcgcggtgggcggattttttttttttttttttttttttttttttaagtcgtttggtcggaaaagtttggttttaattttttggggggtttttttcgttggttaaacgtcgtatttcgtgtaattttggggtagtggtcgtttagtgttgaatgttttttatcgagagcgtatggtttgggaagcgaggcgcgaagttcggttttcgaagggtcgtcgttcgggagacggtgatgttgttgttgtgtttgggggtttcgatcggtcgtttttataacgtggatattgagagcgcgttgttttattagggtttttataatacgttgttcggttattcggtcgtgttgtatagttacggggcgaatcgatggtg

SEQ ID NO: 15032 - DNA, 681 bp, Artificial Sequence
  chemically treated genomic DNA (Homo sapiens) CpG-island No: 15032
caccatcgattcgccccgtaactatacaacacgaccgaataaccgaacaacgtattataaaaaccctaataaaacaacgcgctctcaatatccacgttataaaaacgaccgatcgaaacccccaaacacaacaacaacatcaccgtctcccgaacgacgacccttcgaaaaccgaacttcgcgcctcgcttcccaaaccatacgctctcgataaaaaacattcaacactaaacgaccactaccccaaaattacacgaaatacgacgtttaaccaacgaaaaaaaccccccaaaaaattaaaaccaaacttttccgaccaaacgacttaaaaaaaaaaaaaaaaaaaaaaaaaaaaaatccgcccaccgcgaacgaaactttcgacccgacttaaaatccgcacactcgcccgacccaactcccgttttctaccgcaaaccgaaaacttcgaatcccgattcttctccgaatacgaccgctaaataaaatcccgaacgtaatacgaaaacgcaaaaccgaactccgtctctacctacgcgcgactacaaaaaacgctaaaaaacctcgactacgcaaaactcgcgtcctaacccgaacctcccaacccgcaaaacgcgaaataactctaaactcaacaaaaacgaacctaataaaacacgaacttccccttttaacgataat

SEQ ID NO: 15033 - DNA, 973 bp, Artificial Sequence
  chemically treated genomic DNA (Homo sapiens) CpG-island No: 15033
gcgggtcggggttgtcgggcgacgttcggtcgtcgtcgtcgtcgtcgttagtgatttatagcgtgagtaggacgattagcgtttcggtgtttagcgtttttacgaagtcggtgaggaggtcgagcgttagcggtttcgtttaatttatggggtttcgttcgtataggggttgcggtaggcgttttacgattagttgtagggcgttttagttcggcgcggggatcgcggcgcgtcgggggcgcggggtcggggtaaagggtacgcgggcggcggcgtcgggtcgcggtaggaagcgttgttcgaatttgcgtagttgtagcgtcgtttgttggtggaggtttttgtttagttttttggttacgttcgggcggtcgttgcgtcgtagggttcgagttaggcggttttaggatagggacgcggtttggggggttagttaggtcgttagcgtttttcggtagtcgtcggatatttttttaggttcggttattttgttcgtcgggttttcggtcgtttttcgtcgtcgtcgtcggttcggagatttcgacgtggtgttgagcggtttaggtcgcgttagtcggtttttagaaagtcgggataattcggtttttacgtcgggttcgggcgtttttaggagcgatcggaaatggtcgtattttttcggggttagtagttcggttagacggacggttgcgtgagggtttatagcgtttacggttttcgtcggagttagcgtttaaatttagagcgttaggattaaggcgttcgttagagttcgcgtcgttatttttggcgggaattagggatcgaggattgtgcggggacggggacgtggacgggtttcgcgtcggtgatgggggaggggtttcgaacgttcgcggattgtgggagggaggaggtttcgaatagtcgggaagtttagtggaggaggggattggggataagggggttgttaatatttagcgacggagacggg

SEQ ID NO: 15034 - DNA, 973 bp, Artificial Sequence
  chemically treated genomic DNA (Homo sapiens) CpG-island No: 15034
cccgtctccgtcgctaaatattaacaacccccttatccccaatcccctcctccactaaacttcccgactattcgaaacctcctccctcccacaatccgcgaacgttcgaaacccctcccccatcaccgacgcgaaacccgtccacgtccccgtccccgcacaatcctcgatccctaattcccgccaaaaataacgacgcgaactctaacgaacgccttaatcctaacgctctaaatttaaacgctaactccgacgaaaaccgtaaacgctataaaccctcacgcaaccgtccgtctaaccgaactactaaccccgaaaaaatacgaccatttccgatcgctcctaaaaacgcccgaacccgacgtaaaaaccgaattatcccgactttctaaaaaccgactaacgcgacctaaaccgctcaacaccacgtcgaaatctccgaaccgacgacgacgacgaaaaacgaccgaaaacccgacgaacaaaataaccgaacctaaaaaaatatccgacgactaccgaaaaacgctaacgacctaactaaccccccaaaccgcgtccctatcctaaaaccgcctaactcgaaccctacgacgcaacgaccgcccgaacgtaaccaaaaaactaaacaaaaacctccaccaacaaacgacgctacaactacgcaaattcgaacaacgcttcctaccgcgacccgacgccgccgcccgcgtaccctttaccccgaccccgcgcccccgacgcgccgcgatccccgcgccgaactaaaacgccctacaactaatcgtaaaacgcctaccgcaacccctatacgaacgaaaccccataaattaaacgaaaccgctaacgctcgacctcctcaccgacttcgtaaaaacgctaaacaccgaaacgctaatcgtcctactcacgctataaatcactaacgacgacgacgacgacgaccgaacgtcgcccgacaaccccgacccgc

SEQ ID NO: 15035 - DNA, 973 bp, Artificial Sequence
  chemically treated genomic DNA (Homo sapiens) CpG-island No: 15035
ttcgttttcgtcgttgggtgttggtagtttttttgtttttagtttttttttttattaggtttttcgattgttcggagtttttttttttttataattcgcgggcgttcggaattttttttttattatcggcgcggagttcgtttacgttttcgttttcgtatagttttcggtttttggttttcgttagggatggcggcgcggattttggcgagcgttttggttttggcgttttgggtttgggcgttggtttcggcgggggtcgtggacgttatgggtttttacgtagtcgttcgtttggtcgagttgttgatttcggaggagtgcggttattttcggtcgtttttggaggcgttcgagttcgacgtggaggtcgagttgtttcggttttttgaagatcggttggcgcggtttgagtcgtttaatattacgtcggggttttcgagtcggcggcggcggcgagaggcggtcgaggattcggcgggtagggtagtcgggtttggagaggtgttcgacggttgtcgggaggcgttggcggtttggttggttttttaggtcgcgtttttgttttgggatcgtttggttcgggttttgcggcgtagcggtcgttcggacgtggttagggagttgggtaagaatttttattagtaggcgacgttgtagttgcgtaagttcgggtagcgttttttgtcgcggttcggcgtcgtcgttcgcgtgttttttgtttcggtttcgcgttttcggcgcgtcgcggttttcgcgtcggattgggacgttttgtagttgatcgtggagcgtttgtcgtagtttttgtacgagcggagttttatgggttgggcggggtcgttggcgttcggtttttttatcggtttcgtgggggcgttgggtatcggggcgttggtcgttttgtttacgttatggattattggcggcggcggcgacggcgatcgggcgtcgttcggtagtttcggttcgt

SEQ ID NO: 15036 - DNA, 973 bp, Artificial Sequence
  chemically treated genomic DNA (Homo sapiens) CpG-island No: 15036
acgaaccgaaactaccgaacgacgcccgatcgccgtcgccgccgccgccaataatccataacgtaaacaaaacgaccaacgccccgatacccaacgcccccacgaaaccgataaaaaaaccgaacgccaacgaccccgcccaacccataaaactccgctcgtacaaaaactacgacaaacgctccacgatcaactacaaaacgtcccaatccgacgcgaaaaccgcgacgcgccgaaaacgcgaaaccgaaacaaaaaacacgcgaacgacgacgccgaaccgcgacaaaaaacgctacccgaacttacgcaactacaacgtcgcctactaataaaaattcttacccaactccctaaccacgtccgaacgaccgctacgccgcaaaacccgaaccaaacgatcccaaaacaaaaacgcgacctaaaaaaccaaccaaaccgccaacgcctcccgacaaccgtcgaacacctctccaaacccgactaccctacccgccgaatcctcgaccgcctctcgccgccgccgccgactcgaaaaccccgacgtaatattaaacgactcaaaccgcgccaaccgatcttcaaaaaaccgaaacaactcgacctccacgtcgaactcgaacgcctccaaaaacgaccgaaaataaccgcactcctccgaaatcaacaactcgaccaaacgaacgactacgtaaaaacccataacgtccacgacccccgccgaaaccaacgcccaaacccaaaacgccaaaaccaaaacgctcgccaaaatccgcgccgccatccctaacgaaaaccaaaaaccgaaaactatacgaaaacgaaaacgtaaacgaactccgcgccgataataaaaaaaaaattccgaacgcccgcgaattataaaaaaaaaaaaactccgaacaatcgaaaaacctaataaaaaaaaaaactaaaaacaaaaaaactaccaacacccaacgacgaaaacgaa

SEQ ID NO: 15037 - DNA, 611 bp, Artificial Sequence
  chemically treated genomic DNA (Homo sapiens) CpG-island No: 15037
agcgttcgttgtatgatttgttcgcgggtcgggttgtcgggtagcgttacgtaaaagcgggatagagaagcgtcggcgggtcgtttcgtttagagtcgcgggtcgcgaggtggtgtttataattagtacgtcgttagttttcgcgtcggagttttcgtttaggtaggttaggagcggtatttgtagcgcgttttttgtcgtcgcgtcgtcgtttcgggcggggagtagcgtttttagttcgttgatgaggagtacggagggtgggcggtagcgcgcggtcgcgaaggcggtttggaggaggcgcgcgttttcggcggcgtcgggcgtagttagggtcgcgtcgcgtaggcgtaatagcgtggcgtttagttgcgtggcgaggtagcggtttagtagcgttttgttcgcgtttcgcggtttaaagagtaggacggttcgcggcgggcgtaggttgttcgggtaggcgggcggtttgagtaggggttatattagttttttttttagcgtcgttttgagcgcgttttggttcgttatattcgtttattgtatcgggggttcgtagtttattattttgttcgttattagttttagggttttagggtttacgtttt

SEQ ID NO: 15038 - DNA, 611 bp, Artificial Sequence
  chemically treated genomic DNA (Homo sapiens) CpG-island No: 15038
aaaacgtaaaccctaaaaccctaaaactaataacgaacaaaataataaactacgaacccccgatacaataaacgaatataacgaaccaaaacgcgctcaaaacgacgctaaaaaaaaaactaatataacccctactcaaaccgcccgcctacccgaacaacctacgcccgccgcgaaccgtcctactctttaaaccgcgaaacgcgaacaaaacgctactaaaccgctacctcgccacgcaactaaacgccacgctattacgcctacgcgacgcgaccctaactacgcccgacgccgccgaaaacgcgcgcctcctccaaaccgccttcgcgaccgcgcgctaccgcccaccctccgtactcctcatcaacgaactaaaaacgctactccccgcccgaaacgacgacgcgacgacaaaaaacgcgctacaaataccgctcctaacctacctaaacgaaaactccgacgcgaaaactaacgacgtactaattataaacaccacctcgcgacccgcgactctaaacgaaacgacccgccgacgcttctctatcccgcttttacgtaacgctacccgacaacccgacccgcgaacaaatcatacaacgaacgct

SEQ ID NO: 15039 - DNA, 611 bp, Artificial Sequence
  chemically treated genomic DNA (Homo sapiens) CpG-island No: 15039
aaggcgtggattttggggttttggagttggtgacgagtaagatggtggattgcgggttttcggtgtagtgggcggatgtggcgggttagggcgcgtttaaggcggcgttggaggaggagttggtgtggtttttgtttaggtcgttcgtttattcgggtagtttgcgttcgtcgcggatcgttttgttttttgggtcgcggggcgcgggtaaagcgttgttgggtcgttgtttcgttacgtagttgggcgttacgttgttgcgtttgcgcggcgcgattttggttgcgttcggcgtcgtcgagggcgcgcgttttttttaggtcgttttcgcggtcgcgcgttgtcgtttatttttcgtattttttattagcgagttagaggcgttgtttttcgttcgggacgacggcgcggcggtagggggcgcgttgtaggtgtcgtttttggtttgtttggacgggggtttcggcgcgggggttgacggcgtgttggttgtgggtattatttcgcggttcgcggttttggacgaggcgattcgtcggcgtttttttgtttcgtttttacgtggcgttgttcgatagttcggttcgcgggtagattatgtagcgggcgtt

SEQ ID NO: 15040 - DNA, 611 bp, Artificial Sequence
  chemically treated genomic DNA (Homo sapiens) CpG-island No: 15040
aacgcccgctacataatctacccgcgaaccgaactatcgaacaacgccacgtaaaaacgaaacaaaaaaacgccgacgaatcgcctcgtccaaaaccgcgaaccgcgaaataatacccacaaccaacacgccgtcaacccccgcgccgaaacccccgtccaaacaaaccaaaaacgacacctacaacgcgccccctaccgccgcgccgtcgtcccgaacgaaaaacaacgcctctaactcgctaataaaaaatacgaaaaataaacgacaacgcgcgaccgcgaaaacgacctaaaaaaaacgcgcgccctcgacgacgccgaacgcaaccaaaatcgcgccgcgcaaacgcaacaacgtaacgcccaactacgtaacgaaacaacgacccaacaacgctttacccgcgccccgcgacccaaaaaacaaaacgatccgcgacgaacgcaaactacccgaataaacgaacgacctaaacaaaaaccacaccaactcctcctccaacgccgccttaaacgcgccctaacccgccacatccgcccactacaccgaaaacccgcaatccaccatcttactcgtcaccaactccaaaaccccaaaatccacgcctt

SEQ ID NO: 15041 - DNA, 756 bp, Artificial Sequence
  chemically treated genomic DNA (Homo sapiens) CpG-island No: 15041
gacggtacggcgaattttttacgaggagtcggggttcgtttcgggaattttttaaagggttttagttgcgggtcgtagacgggggagtttaggattttgagggggacgtcgttatcgtatttgttcgacgtttttttcgcggtttttggcggtttggttcggaattcgttgtttcgatattcgtcgttgttcgcggcggggtaggaggtttcgttagttacgggggttttggcgggttcgtacgcgtatttgcggtagcggttttcgggtttttcgtcggcggttttgcgttttagcgatagttcggattcggtattcggcgcggtcgtggggaagttataggcggtgggcggtgtcggcgcgggtaggggcgtgggcgcgggtaggttcggggttaggtagggggtcgggggtgggtttgggggcggcgggagcgcgttatagtcgggttgcgttgcgtagttttttgcgggatagttgtatagcggcgttgagggttcgtatttcggaggcggtgggggttgtaggagcgcggtcgggggcggcgggggtagcgcggcgttcgtttgcgcgtagtaattcggcgttaggtatttttcgtcgtagtcggtcgcgtattcgggcgtcgtcgatgggttttcgtacgtattgtcggcgtagaggggtttagggaggttttcggttaaaattggggagttttttagggtttcggaatcgtcgttatcgttcgatttggtttttgggaggttttcgtgg

SEQ ID NO: 15042 - DNA, 756 bp, Artificial Sequence
  chemically treated genomic DNA (Homo sapiens) CpG-island No: 15042
ccacgaaaacctcccaaaaaccaaatcgaacgataacgacgattccgaaaccctaaaaaactccccaattttaaccgaaaacctccctaaacccctctacgccgacaatacgtacgaaaacccatcgacgacgcccgaatacgcgaccgactacgacgaaaaatacctaacgccgaattactacgcgcaaacgaacgccgcgctacccccgccgcccccgaccgcgctcctacaacccccaccgcctccgaaatacgaaccctcaacgccgctatacaactatcccgcaaaaaactacgcaacgcaacccgactataacgcgctcccgccgcccccaaacccacccccgaccccctacctaaccccgaacctacccgcgcccacgcccctacccgcgccgacaccgcccaccgcctataacttccccacgaccgcgccgaataccgaatccgaactatcgctaaaacgcaaaaccgccgacgaaaaacccgaaaaccgctaccgcaaatacgcgtacgaacccgccaaaacccccgtaactaacgaaacctcctaccccgccgcgaacaacgacgaatatcgaaacaacgaattccgaaccaaaccgccaaaaaccgcgaaaaaaacgtcgaacaaatacgataacgacgtccccctcaaaatcctaaactcccccgtctacgacccgcaactaaaaccctttaaaaaattcccgaaacgaaccccgactcctcgtaaaaaattcgccgtaccgtc

SEQ ID NO: 15043 - DNA, 756 bp, Artificial Sequence
  chemically treated genomic DNA (Homo sapiens) CpG-island No: 15043
ttacgaaggttttttaggaattaaatcgggcggtggcggcggtttcggggttttggggggttttttagttttagtcgggaatttttttgaatttttttacgtcggtaatgcgtgcgggggtttatcggcggcgttcgagtacgcggtcggttacggcggggggtatttggcgtcgggttattgcgcgtagacgggcgtcgcgttgttttcgtcgttttcggtcgcgtttttgtagtttttatcgttttcggggtacgggtttttagcgtcgttgtataattatttcgtagggggttacgtagcgtagttcggttatggcgcgttttcgtcgtttttaggtttattttcggttttttatttgatttcgggtttgttcgcgtttacgtttttgttcgcgtcggtatcgtttatcgtttatggtttttttacggtcgcgtcgggtgtcgaattcgggttgtcgttgaagcgtaaggtcgtcgacgaggggttcgagggtcgttatcgtaagtacgcgtacgagttcgttaaggttttcgtggttgacggagttttttatttcgtcgcggataacggcgaatgtcggggtaacgggtttcgggttaagtcgttaggagtcgcggaggaggcgtcgggtaagtacggtggcggcgttttttttaaggttttgggttttttcgtttacggttcgtaattggagttttttgaaaagttttcggagcgggtttcggtttttcgtggggggttcgtcgtgtcgtt

SEQ ID NO: 15044 - DNA, 756 bp, Artificial Sequence
  chemically treated genomic DNA (Homo sapiens) CpG-island No: 15044
aacgacacgacgaaccccccacgaaaaaccgaaacccgctccgaaaacttttcaaaaaactccaattacgaaccgtaaacgaaaaaacccaaaaccttaaaaaaaacgccgccaccgtacttacccgacgcctcctccgcgactcctaacgacttaacccgaaacccgttaccccgacattcgccgttatccgcgacgaaataaaaaactccgtcaaccacgaaaaccttaacgaactcgtacgcgtacttacgataacgaccctcgaacccctcgtcgacgaccttacgcttcaacgacaacccgaattcgacacccgacgcgaccgtaaaaaaaccataaacgataaacgataccgacgcgaacaaaaacgtaaacgcgaacaaacccgaaatcaaataaaaaaccgaaaataaacctaaaaacgacgaaaacgcgccataaccgaactacgctacgtaaccccctacgaaataattatacaacgacgctaaaaacccgtaccccgaaaacgataaaaactacaaaaacgcgaccgaaaacgacgaaaacaacgcgacgcccgtctacgcgcaataacccgacgccaaataccccccgccgtaaccgaccgcgtactcgaacgccgccgataaacccccgcacgcattaccgacgtaaaaaaattcaaaaaaattcccgactaaaactaaaaaaccccccaaaaccccgaaaccgccgccaccgcccgatttaattcctaaaaaaccttcgtaa

SEQ ID NO: 15045 - DNA, 648 bp, Artificial Sequence
  chemically treated genomic DNA (Homo sapiens) CpG-island No: 15045
cgtttcgaggatttttgaattgatttaagtagggtgaagataattcggagggaggggtttaagagggagtcgttattttttttttttttgttttaggaaagcgcgcgagagggaggggtcggaataacgaacgttggttatttaacggttcggtttagttagttaggtttttaaagtttatatcgcgcgggtcgtcgaggtggtagtatagttataatcgttttaagggttaaggagtacgttaggagtattcgaggtgatgggaaacggggggtggggattgtgttgagcgacgtcgttatgttagcgtttttttttttcgtatttttatagtttttagttttgttgatttttgtttatcgttatttatttttttaggttattagtttatgattttttcggttattcgcgagttttgagtatagtcgtgtttataaagtatttttggaggaaaaggttgaacggtattttaaaggttacgggtttttataggttttcgttttttttcgcgagatcggattgataattttcgttcgttcgtttcgttttcggtatttttattttttttttggcgttttttttttttatttatacgtttttttttgttttttttttgagggagcgttttcgagttaggtgatttcgtta

SEQ ID NO: 15046 - DNA, 648 bp, Artificial Sequence
  chemically treated genomic DNA (Homo sapiens) CpG-island No: 15046
taacgaaatcacctaactcgaaaacgctccctcaaaaaaaaaacaaaaaaaaacgtataaataaaaaaaaaaaacgccaaaaaaaaaataaaaataccgaaaacgaaacgaacgaacgaaaattatcaatccgatctcgcgaaaaaaaacgaaaacctataaaaacccgtaacctttaaaataccgttcaaccttttcctccaaaaatactttataaacacgactatactcaaaactcgcgaataaccgaaaaaatcataaactaataacctaaaaaaataaataacgataaacaaaaatcaacaaaactaaaaactataaaaatacgaaaaaaaaaaacgctaacataacgacgtcgctcaacacaatccccaccccccgtttcccatcacctcgaatactcctaacgtactccttaacccttaaaacgattataactatactaccacctcgacgacccgcgcgatataaactttaaaaacctaactaactaaaccgaaccgttaaataaccaacgttcgttattccgacccctccctctcgcgcgctttcctaaaacaaaaaaaaaaaaaataacgactccctcttaaacccctccctccgaattatcttcaccctacttaaatcaattcaaaaatcctcgaaacg

SEQ ID NO: 15047 - DNA, 648 bp, Artificial Sequence
  chemically treated genomic DNA (Homo sapiens) CpG-island No: 15047
tgacggaattatttgattcggaggcgtttttttagaaggaaggtaagaaggggcgtgtgggtgaaggggaggggcgttagaaggaaggtggggatgtcgggagcggggcgagcgggcgggggttgttagttcgatttcgcgagagaggacggaagtttgtgggagttcgtggtttttaaagtgtcgtttagtttttttttttaggggtgttttgtaaatacggttgtgtttagggttcgcgggtgatcgaaaggattatgaattagtgatttggaaaggtgagtaacgatgggtagaggttagtagggttggagattgtagggatacggagaaagaaggcgttaatatggcgacgtcgtttagtatagtttttatttttcgttttttattatttcgggtgtttttgacgtgttttttagtttttggggcgattgtggttgtgttgttatttcggcggttcgcgcggtgtgggttttgggaatttgattggttgggtcggatcgttaggtaattagcgttcgttgtttcggtttttttttttcgcgcgtttttttaaggtagaggaaaaaggaataacggtttttttttagattttttttttcgaattatttttattttatttgggttagtttagaggttttcggggcg

SEQ ID NO: 15048 - DNA, 648 bp, Artificial Sequence
  chemically treated genomic DNA (Homo sapiens) CpG-island No: 15048
cgccccgaaaacctctaaactaacccaaataaaataaaaataattcgaaaaaaaaaatctaaaaaaaaaccgttattcctttttcctctaccttaaaaaaacgcgcgaaaaaaaaaaaccgaaacaacgaacgctaattacctaacgatccgacccaaccaatcaaattcccaaaacccacaccgcgcgaaccgccgaaataacaacacaaccacaatcgccccaaaaactaaaaaacacgtcaaaaacacccgaaataataaaaaacgaaaaataaaaactatactaaacgacgtcgccatattaacgccttctttctccgtatccctacaatctccaaccctactaacctctacccatcgttactcacctttccaaatcactaattcataatcctttcgatcacccgcgaaccctaaacacaaccgtatttacaaaacacccctaaaaaaaaaaactaaacgacactttaaaaaccacgaactcccacaaacttccgtcctctctcgcgaaatcgaactaacaacccccgcccgctcgccccgctcccgacatccccaccttccttctaacgcccctccccttcacccacacgccccttcttaccttccttctaaaaaaacgcctccgaatcaaataattccgtca

SEQ ID NO: 15049 - DNA, 776 bp, Artificial Sequence
  chemically treated genomic DNA (Homo sapiens) CpG-island No: 15049
aagtttttcgggtttgttcgattcggttttttttcgtttttgtatcggttgcggtattattttttgaagttacgtttcggcgagcggggttcgcggagcgagggggtcgttgtgtcgttatttattcgagtcgttcgggttggtcgcgagcggggattcgtaagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcggtagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcggcgcgttttttttcgaacgtcgtttttagggttgttggttgcgttttttattgtttcgcggttgttgttcggggtgggcggttaggcgggggggaggtgtcggtttggtcgtcggggagggtttatcgttcgggcggatttttattgcgagagcgatgcggttttaagcgcggagcgcggtggttggagggcgtttagaattgtgggtttgtcgggtcgcggaggttttttttttggttttttaaggtaatttggtttgttggttgggcgg

SEQ ID NO: 15050 - DNA, 776 bp, Artificial Sequence
  chemically treated genomic DNA (Homo sapiens) CpG-island No: 15050
ccgcccaaccaacaaaccaaattaccttaaaaaaccaaaaaaaaaacctccgcgacccgacaaacccacaattctaaacgccctccaaccaccgcgctccgcgcttaaaaccgcatcgctctcgcaataaaaatccgcccgaacgataaaccctccccgacgaccaaaccgacacctcccccccgcctaaccgcccaccccgaacaacaaccgcgaaacaataaaaaacgcaaccaacaaccctaaaaacgacgttcgaaaaaaaacgcgccgccgccgccgccgccgctaccgccaaaacaaacgcgcgccgcgtaaaaccgaacgaatacgaaaacgcgcgacgaaaaataaaaaacacgcgccgcgcgaaaaacgaaaacaataaaaaacgcgcgcgcgaacccgaaaaactcgcgaaaaaaacccgacgctcgacgcaacgcgacgcgaccaaactccgcgcctctaccgcccttcctcgacgcgctcgccctcgcctcgccgctcgcattcgctaaaaacgcccaaaaaaatacacaaaaacaacgactaaaaaaacgaaaattcaaaccacatatctacgtcctcgaaaaccaaaacccgccaacccttacgaatccccgctcgcgaccaacccgaacgactcgaataaataacgacacaacgaccccctcgctccgcgaaccccgctcgccgaaacgtaacttcaaaaaataataccgcaaccgatacaaaaacgaaaaaaaaccgaatcgaacaaacccgaaaaactt

SEQ ID NO: 15051 - DNA, 776 bp, Artificial Sequence
  chemically treated genomic DNA (Homo sapiens) CpG-island No: 15051
tcgtttagttaataaattaagttgttttgggaagttagaaggaaggttttcgcggttcggtaaatttatagttttaggcgttttttagttatcgcgtttcgcgtttgggatcgtatcgttttcgtagtgagggttcgttcgagcggtaagtttttttcggcggttaagtcgatatttttttttcgtttggtcgtttatttcgggtagtagtcgcggaataatggagagcgtagttagtagttttggagacggcgttcgggggaggacgcgtcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttatcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagtttttgcggattttcgttcgcggttagttcgagcggttcgggtgagtagcggtatagcggttttttcgtttcgcgggtttcgttcgtcgagacgtggttttaagaagtggtgtcgtaatcggtgtaaaagcggaggaaagtcgaatcgggtaagttcgggaggttt

SEQ ID NO: 15052 - DNA, 776 bp, Artificial Sequence
  chemically treated genomic DNA (Homo sapiens) CpG-island No: 15052
aaacctcccgaacttacccgattcgactttcctccgcttttacaccgattacgacaccacttcttaaaaccacgtctcgacgaacgaaacccgcgaaacgaaaaaaccgctataccgctactcacccgaaccgctcgaactaaccgcgaacgaaaatccgcaaaaactaacgaactctaacccccgaaaacgcaaacatataacttaaacctccgctcccctaaccgttacctctatacatctttctaaacgcccccaacgaatacgaacgacgaaacgaaaacgaacgcgccgaaaaaaaacgataaaaacgcgaaacttaaccgcgccgcgctacgccgaacgccgaactctccccgcgaactccccgaacccgcgcgcgcgccccccactacccccgccccccgcgcgacgcgtaccccccaccccccgccgcgcgccctcgcacccgcccgactccacgcgacgcgcgcctaccctaacgacaacgacgacgacgacgacgacgcgtcctcccccgaacgccgtctccaaaactactaactacgctctccattattccgcgactactacccgaaataaacgaccaaacgaaaaaaaaatatcgacttaaccgccgaaaaaaacttaccgctcgaacgaaccctcactacgaaaacgatacgatcccaaacgcgaaacgcgataactaaaaaacgcctaaaactataaatttaccgaaccgcgaaaaccttccttctaacttcccaaaacaacttaatttattaactaaacga

SEQ ID NO: 15053 - DNA, 720 bp, Artificial Sequence
  chemically treated genomic DNA (Homo sapiens) CpG-island No: 15053
cgcggaggtcgggcgtggggttttcgttcgggttcgtagttattatagtaatttcggttttaatttcgttcggtttttgttaaaggcgtgtttttttttcgggttagtgtttttcgtcggacgttagacgttttttcgcgtagtttcgtcgattttaggtagttcgggttggggtcgcgttttcgtgcgtttcgcgtcggatagacgcggtacgcggagggaaacggcgttagcgaggggttttaggcgttaaaacggaaattttcgcgaaatttcgcgggttagcggagtcgcgggcgggtattcggagcgtcggattcggaagcggcgtacgcggtcgttcggtttcgtttcgttcggttaggtagcgcggcgtcgtcgttaattttatttggtttcgcgcgtcgttgcgggacgggcgggaatgcggttaagggtcgtttcggttttcgcgtttatttcggattttttggttttcgttttttttttattgtttttaaagagcgttaaaaagtcgcgttgcggtttacgttcggagtgcgggtattttttttttgtagggcgttgtttcgtcgcgaaatatattttttgtgtggttcgtttattcgtgtttggtttttcgagagcgtagcgcgggttttatttttagggggtgtggcgtttcgtttttaaatttagtagtttagttttcgttgtatagattttttgttattttattag

SEQ ID NO: 15054 - DNA, 720 bp, Artificial Sequence
  chemically treated genomic DNA (Homo sapiens) CpG-island No: 15054
ctaataaaataacaaaaaatctatacaacgaaaactaaactactaaatttaaaaacgaaacgccacaccccctaaaaataaaacccgcgctacgctctcgaaaaaccaaacacgaataaacgaaccacacaaaaaatatatttcgcgacgaaacaacgccctacaaaaaaaaaatacccgcactccgaacgtaaaccgcaacgcgactttttaacgctctttaaaaacaataaaaaaaaaacgaaaaccaaaaaatccgaaataaacgcgaaaaccgaaacgacccttaaccgcattcccgcccgtcccgcaacgacgcgcgaaaccaaataaaattaacgacgacgccgcgctacctaaccgaacgaaacgaaaccgaacgaccgcgtacgccgcttccgaatccgacgctccgaatacccgcccgcgactccgctaacccgcgaaatttcgcgaaaatttccgttttaacgcctaaaacccctcgctaacgccgtttccctccgcgtaccgcgtctatccgacgcgaaacgcacgaaaacgcgaccccaacccgaactacctaaaatcgacgaaactacgcgaaaaaacgtctaacgtccgacgaaaaacactaacccgaaaaaaaaacacgcctttaacaaaaaccgaacgaaattaaaaccgaaattactataataactacgaacccgaacgaaaaccccacgcccgacctccgcg

SEQ ID NO: 15055 - DNA, 720 bp, Artificial Sequence
  chemically treated genomic DNA (Homo sapiens) CpG-island No: 15055
ttaatgaaatgataaagggtttgtgtagcgggggttgggttgttgggtttgggggcgaggcgttatattttttgagaataaagttcgcgttgcgttttcggagaattaggtacgagtgagcgaattatataaagaatatatttcgcgacgaaatagcgttttataggaagaaagtgttcgtatttcgagcgtgagtcgtagcgcgattttttggcgttttttgggagtagtgagagagaggcggaggttagagagttcggggtgggcgcgggagtcggggcggtttttggtcgtattttcgttcgtttcgtagcggcgcgcggagttaggtgaggttggcggcggcgtcgcgttatttggtcgggcggggcggggtcgggcggtcgcgtgcgtcgttttcgagttcggcgtttcggatgttcgttcgcggtttcgttggttcgcggagtttcgcgggagttttcgttttggcgtttaaagtttttcgttggcgtcgttttttttcgcgtgtcgcgtttgttcggcgcgggacgtacggaggcgcggttttagttcgggttgtttggggtcggcggggttgcgcgaggggacgtttggcgttcggcggagggtattggttcgggaggagggtacgtttttggtaaaggtcgggcggggttgggatcggggttgttatggtagttgcgagttcgggcgggagttttacgttcggttttcgcg

SEQ ID NO: 15056 - DNA, 720 bp, Artificial Sequence
  chemically treated genomic DNA (Homo sapiens) CpG-island No: 15056
cgcgaaaaccgaacgtaaaactcccgcccgaactcgcaactaccataacaaccccgatcccaaccccgcccgacctttaccaaaaacgtaccctcctcccgaaccaataccctccgccgaacgccaaacgtcccctcgcgcaaccccgccgaccccaaacaacccgaactaaaaccgcgcctccgtacgtcccgcgccgaacaaacgcgacacgcgaaaaaaaacgacgccaacgaaaaactttaaacgccaaaacgaaaactcccgcgaaactccgcgaaccaacgaaaccgcgaacgaacatccgaaacgccgaactcgaaaacgacgcacgcgaccgcccgaccccgccccgcccgaccaaataacgcgacgccgccgccaacctcacctaactccgcgcgccgctacgaaacgaacgaaaatacgaccaaaaaccgccccgactcccgcgcccaccccgaactctctaacctccgcctctctctcactactcccaaaaaacgccaaaaaatcgcgctacgactcacgctcgaaatacgaacactttcttcctataaaacgctatttcgtcgcgaaatatattctttatataattcgctcactcgtacctaattctccgaaaacgcaacgcgaactttattctcaaaaaatataacgcctcgcccccaaacccaacaacccaacccccgctacacaaaccctttatcatttcattaa

SEQ ID NO: 15057 - DNA, 853 bp, Artificial Sequence
  chemically treated genomic DNA (Homo sapiens) CpG-island No: 15057
ttttatcggattttagcgatcggcgttttttgcgttaggcgttcggtgtcgtatagtttttcgtcgtgtgtagtcgggtgttggtgttgttgtagcggcgttcgttaggaggtagcgtaggttcggtattggttgcggcgttttataatgtatcgggttttggggtttgtacgatagttttgaatttagttgcggggtcgcgagaaggcgggttcgggagtcggcgagggcggggttttcgaggaaagggtcgggagtcgacgcggaggcggtgggcggggcgttagggggcggggtcgggagtcgtcgagggggcggtgggcggggtattcggggggcggagtcgggagttttttagggggtagtgggtgggatcgggagtcggtcggtcgggtcggggatgcggtgagtcgagggcggggttttagggggcgggatcgtggagagggcggggtcgggtcgttggcgttgtcgtcggttgtagtggtcgtcgttggagatcgcgggatttggcgttgtagcgaggtaggggtttttcgggattttttttttcgggggtgggaagtttttttttcgtcgtgttaacgggagaagcggcgagttgttaaaatttagagacggtttcgtatttttcgttgtagttcgggttttattcgggggatcgattttaaaattttttgtttggtttcgtcgttttgttcgcgggtcggacgtggggcgtttgttttgggcgtttggggcgggcgattgtaagttcgcggtttatgttttttgtttcggagtgtggacgtgaatttcggggtgggttgggttgggtttttatagaggcgggaatttgtgagaattgggagag

SEQ ID NO: 15058 - DNA, 853 bp, Artificial Sequence
  chemically treated genomic DNA (Homo sapiens) CpG-island No: 15058
ctctcccaattctcacaaattcccgcctctataaaaacccaacccaacccaccccgaaattcacgtccacactccgaaacaaaaaacataaaccgcgaacttacaatcgcccgccccaaacgcccaaaacaaacgccccacgtccgacccgcgaacaaaacgacgaaaccaaacaaaaaattttaaaatcgatcccccgaataaaacccgaactacaacgaaaaatacgaaaccgtctctaaattttaacaactcgccgcttctcccgttaacacgacgaaaaaaaaacttcccacccccgaaaaaaaaaatcccgaaaaacccctacctcgctacaacgccaaatcccgcgatctccaacgacgaccactacaaccgacgacaacgccaacgacccgaccccgccctctccacgatcccgccccctaaaaccccgccctcgactcaccgcatccccgacccgaccgaccgactcccgatcccacccactaccccctaaaaaactcccgactccgccccccgaataccccgcccaccgccccctcgacgactcccgaccccgccccctaacgccccgcccaccgcctccgcgtcgactcccgaccctttcctcgaaaaccccgccctcgccgactcccgaacccgccttctcgcgaccccgcaactaaattcaaaactatcgtacaaaccccaaaacccgatacattataaaacgccgcaaccaataccgaacctacgctacctcctaacgaacgccgctacaacaacaccaacacccgactacacacgacgaaaaactatacgacaccgaacgcctaacgcaaaaaacgccgatcgctaaaatccgataaaa

SEQ ID NO: 15059 - DNA, 853 bp, Artificial Sequence
  chemically treated genomic DNA (Homo sapiens) CpG-island No: 15059
tttttttagtttttataaattttcgtttttgtagaaatttagtttagtttatttcggagtttacgtttatatttcgaggtaggggatatggatcgcgagtttgtaatcgttcgttttagacgtttagagtaggcgttttacgttcggttcgcgggtaggacgacggggttagataaagagttttaaaatcgatttttcgggtaaagttcgggttatagcgagaagtgcgaagtcgtttttaaattttagtagttcgtcgtttttttcgttggtacgacgaagaaaagattttttattttcgaaagggaagatttcgaagagtttttatttcgttgtagcgttaggtttcgcggtttttagcggcggttattgtagtcggcgatagcgttagcggttcggtttcgttttttttacggtttcgttttttgaggtttcgttttcggtttatcgtattttcggttcggtcggtcggttttcggttttatttattgttttttgggaggttttcggtttcgtttttcgaatatttcgtttatcgttttttcggcggttttcggtttcgttttttaacgtttcgtttatcgttttcgcgtcggttttcggtttttttttcggaggtttcgttttcgtcggttttcgggttcgttttttcgcggtttcgtagttgggtttaagattgtcgtgtaggttttagagttcggtgtattgtgggacgtcgtagttaatgtcgagtttgcgttgttttttggcgggcgtcgttgtaataatattagtattcggttgtatacggcggagggttatacggtatcgggcgtttagcgtagagggcgtcggtcgttggggttcggtaaaa

SEQ ID NO: 15060 - DNA, 853 bp, Artificial Sequence
  chemically treated genomic DNA (Homo sapiens) CpG-island No: 15060
ttttaccgaaccccaacgaccgacgccctctacgctaaacgcccgataccgtataaccctccgccgtatacaaccgaatactaatattattacaacgacgcccgccaaaaaacaacgcaaactcgacattaactacgacgtcccacaatacaccgaactctaaaacctacacgacaatcttaaacccaactacgaaaccgcgaaaaaacgaacccgaaaaccgacgaaaacgaaacctccgaaaaaaaaaccgaaaaccgacgcgaaaacgataaacgaaacgttaaaaaacgaaaccgaaaaccgccgaaaaaacgataaacgaaatattcgaaaaacgaaaccgaaaacctcccaaaaaacaataaataaaaccgaaaaccgaccgaccgaaccgaaaatacgataaaccgaaaacgaaacctcaaaaaacgaaaccgtaaaaaaaacgaaaccgaaccgctaacgctatcgccgactacaataaccgccgctaaaaaccgcgaaacctaacgctacaacgaaataaaaactcttcgaaatcttccctttcgaaaataaaaaatcttttcttcgtcgtaccaacgaaaaaaacgacgaactactaaaatttaaaaacgacttcgcacttctcgctataacccgaactttacccgaaaaatcgattttaaaactctttatctaaccccgtcgtcctacccgcgaaccgaacgtaaaacgcctactctaaacgtctaaaacgaacgattacaaactcgcgatccatatcccctacctcgaaatataaacgtaaactccgaaataaactaaactaaatttctacaaaaacgaaaatttataaaaactaaaaaaa

SEQ ID NO: 15061 - DNA, 553 bp, Artificial Sequence
  chemically treated genomic DNA (Homo sapiens) CpG-island No: 15061
gatgaacgtgtagtttgcggtgaaaaataacgaagtttatttgattgaagttaattcgcgtgcggcgcgtatcgtttcgttcgtttttaaagttatcggcgtatcgttggtaaaagtggcggcgcgcgtgatggttggtaaatcgttggttgagtagggcgtaattaaagaagttatttcgtcgtattattcggtgaaagaagtggtgttgtcgtttaataaattttcgggcgttgattcgttgttagggttagaaatgcgttttatcggggaagttatgggcgtgggtcgtattttcgttgaagcgtttgttaaagcgtagttgggtagtaattttattatgaagaaatacggtcgtgcgttgtttttcgtgcgcgaaggcgataaagaacgcgtggtggatttggcggtaaaattgttgaaatagggtttcgagttggatgcgatttacggtacggcgattgtgttgggcgaagtaggtattaattcgcgtttggtaaataggtgtatgaaggtcgttcgtatatttaggatcgtattaagaatggcgaat

SEQ ID NO: 15062 - DNA, 553 bp, Artificial Sequence
  chemically treated genomic DNA (Homo sapiens) CpG-island No: 15062
attcgccattcttaatacgatcctaaatatacgaacgaccttcatacacctatttaccaaacgcgaattaatacctacttcgcccaacacaatcgccgtaccgtaaatcgcatccaactcgaaaccctatttcaacaattttaccgccaaatccaccacgcgttctttatcgccttcgcgcacgaaaaacaacgcacgaccgtatttcttcataataaaattactacccaactacgctttaacaaacgcttcaacgaaaatacgacccacgcccataacttccccgataaaacgcatttctaaccctaacaacgaatcaacgcccgaaaatttattaaacgacaacaccacttctttcaccgaataatacgacgaaataacttctttaattacgccctactcaaccaacgatttaccaaccatcacgcgcgccgccacttttaccaacgatacgccgataactttaaaaacgaacgaaacgatacgcgccgcacgcgaattaacttcaatcaaataaacttcgttatttttcaccgcaaactacacgttcatc

SEQ ID NO: 15063 - DNA, 553 bp, Artificial Sequence
  chemically treated genomic DNA (Homo sapiens) CpG-island No: 15063
attcgttatttttgatacggttttgaatgtgcggacggtttttatgtatttgtttattagacgcgggttgatatttgtttcgtttagtataatcgtcgtgtcgtgggtcgtatttagttcgaagttttgttttagtagttttgtcgttaggtttattacgcgttttttatcgttttcgcgtacggaaagtagcgtacgatcgtgtttttttatggtggagttgttgtttagttgcgttttggtaaacgttttagcgaaggtgcggtttacgtttatgattttttcggtagagcgtatttttggttttaatagcgggttaacgttcgggaatttattgaacggtagtattattttttttatcgagtagtacggcgggataatttttttggttacgttttgtttagttagcgatttgttagttattacgcgcgtcgttatttttgttagcggtacgtcggtggttttggagacgaacggaacggtacgcgtcgtacgcgggttaattttaattaggtagatttcgttgttttttatcgtaaattgtacgtttatt

SEQ ID NO: 15064 - DNA, 553 bp, Artificial Sequence
  chemically treated genomic DNA (Homo sapiens) CpG-island No: 15064
aataaacgtacaatttacgataaaaaacaacgaaatctacctaattaaaattaacccgcgtacgacgcgtaccgttccgttcgtctccaaaaccaccgacgtaccgctaacaaaaataacgacgcgcgtaataactaacaaatcgctaactaaacaaaacgtaaccaaaaaaattatcccgccgtactactcgataaaaaaaataatactaccgttcaataaattcccgaacgttaacccgctattaaaaccaaaaatacgctctaccgaaaaaatcataaacgtaaaccgcaccttcgctaaaacgtttaccaaaacgcaactaaacaacaactccaccataaaaaaacacgatcgtacgctactttccgtacgcgaaaacgataaaaaacgcgtaataaacctaacgacaaaactactaaaacaaaacttcgaactaaatacgacccacgacacgacgattatactaaacgaaacaaatatcaacccgcgtctaataaacaaatacataaaaaccgtccgcacattcaaaaccgtatcaaaaataacgaat

SEQ ID NO: 15065 - DNA, 567 bp, Artificial Sequence
  chemically treated genomic DNA (Homo sapiens) CpG-island No: 15065
tacgtcgtcgttttgtcgttttaggtattttttttcgttttttagagattcggttagtttgttttgtcgtattcgagagcgtttcgggttttggtacggttatcgttcgtttcggttttcgttattttattcgttgagcggttgagttcgcggagttgggtgagtgtttgcggttgatcggttcgtgggagtagggagcgtatagtcggttggtgttggagggttacggggatttacggggtatcgcgggagtcgtcgagcgtagggaagttagtaggtatttgtagtgcggagtttgtaaggttgaggtaggagatcgttcgaggcggggagggcgggagcgagcgagcgagcgagcgcgtgggagacggaggcggcgtgttcgtttttaatttcggtatcgtcgtgcgtaggcggggtcgttttagttttttcgtgtttagaagcgttagagatagggagttagtgggcgcgtaattgcgttcggggattaaaagtagaaatagagatgttcgtgttttttttaagatttgggagggaatagagggagtattaaggggcgttagt

SEQ ID NO: 15066 - DNA, 567 bp, Artificial Sequence
  chemically treated genomic DNA (Homo sapiens) CpG-island No: 15066
actaacgccccttaatactccctctattccctcccaaatcttaaaaaaaacacgaacatctctatttctacttttaatccccgaacgcaattacgcgcccactaactccctatctctaacgcttctaaacacgaaaaaactaaaacgaccccgcctacgcacgacgataccgaaattaaaaacgaacacgccgcctccgtctcccacgcgctcgctcgctcgctcgctcccgccctccccgcctcgaacgatctcctacctcaaccttacaaactccgcactacaaatacctactaacttccctacgctcgacgactcccgcgataccccgtaaatccccgtaaccctccaacaccaaccgactatacgctccctactcccacgaaccgatcaaccgcaaacactcacccaactccgcgaactcaaccgctcaacgaataaaataacgaaaaccgaaacgaacgataaccgtaccaaaacccgaaacgctctcgaatacgacaaaacaaactaaccgaatctctaaaaaacgaaaaaaaatacctaaaacgacaaaacgacgacgta

SEQ ID NO: 15067 - DNA, 567 bp, Artificial Sequence
  chemically treated genomic DNA (Homo sapiens) CpG-island No: 15067
attggcgttttttggtgttttttttgtttttttttagattttgggagaagtacggatatttttgtttttgtttttggttttcgaacgtagttacgcgtttattggttttttgtttttggcgtttttgggtacgggggagttggggcggtttcgtttgcgtacggcggtgtcgggattgggggcgggtacgtcgttttcgttttttacgcgttcgttcgttcgttcgttttcgtttttttcgtttcgagcgattttttgttttagttttgtaggtttcgtattgtagatgtttgttggtttttttgcgttcggcggttttcgcggtgtttcgtaagttttcgtgattttttagtattagtcggttgtgcgttttttgtttttacgggtcggttagtcgtagatatttatttagtttcgcgagtttagtcgtttagcgagtggggtagcggggatcgagacggacggtagtcgtgttagagttcggggcgttttcggatgcggtaggataagttgatcgggtttttgaggaacggggggagatgtttgaagcggtagggcggcggcgtg

SEQ ID NO: 15068 - DNA, 567 bp, Artificial Sequence
  chemically treated genomic DNA (Homo sapiens) CpG-island No: 15068
cacgccgccgccctaccgcttcaaacatctccccccgttcctcaaaaacccgatcaacttatcctaccgcatccgaaaacgccccgaactctaacacgactaccgtccgtctcgatccccgctaccccactcgctaaacgactaaactcgcgaaactaaataaatatctacgactaaccgacccgtaaaaacaaaaaacgcacaaccgactaatactaaaaaatcacgaaaacttacgaaacaccgcgaaaaccgccgaacgcaaaaaaaccaacaaacatctacaatacgaaacctacaaaactaaaacaaaaaatcgctcgaaacgaaaaaaacgaaaacgaacgaacgaacgaacgcgtaaaaaacgaaaacgacgtacccgcccccaatcccgacaccgccgtacgcaaacgaaaccgccccaactcccccgtacccaaaaacgccaaaaacaaaaaaccaataaacgcgtaactacgttcgaaaaccaaaaacaaaaacaaaaatatccgtacttctcccaaaatctaaaaaaaaacaaaaaaaacaccaaaaaacgccaat

SEQ ID NO: 15069 - DNA, 1010 bp, Artificial Sequence
  chemically treated genomic DNA (Homo sapiens) CpG-island No: 15069
gtcgagtagtttaggtgcgcgttggagcgcgggtagagacggcgaggataattcggttttaggaagttttcgggattttgttgcgttcggtttttatttttttgtcgtaggtatagtatttgatgtcgttggttcggtcgtttttgtagtttttgtagtacgcgggagtcgtcggtatcgttgcggtcgtttaggattacgtcggagttcgaggtttcggtggagttgtcgaggttgtcgcggcgtcgtcggcggttttcggtttcgcggttttcgttcgtcgttttttttttttttgtgtagttgtatagttcgttgagtagttcgtttattagggacgtcgtgcggtttgtgcggtcgtcgtacgtttcgtcgggtttcgtgtttttatcgtcgttttacgtgtttcgggagcgtcgcggtcgtttcgtcgtttttcggaggcgcggggttgggggagttgtaggaatcgttttttttttttgattttttagtttcgtttcgttatcgtcgtcgcggaattttagtttcgttcggagtttcgggcggttttcgtcggtgggaaggacgtttatggttttcggcgcgcggttgttcggttttcgttgtttttttcgtttcgcggcgtcggttagtttcgggaggaggcgcggtttcgttttcgtcggtggtgttttttcgggcgcggcgttagcgggttttggattttcgaggtgttcgggtttttttcgagtcggtatttgagtcgttttttttcgtttcggatcgggcgagaaggagattgttacgttattgagttatttggggttatttgttgttcgggttcggtttttatttagagcgttttttcgtgcgcgagaaggcgtaggacgtggttagaatatcgttgggaagaagttagtagtacggagggggagggcgttgaggtcgtcgttatttttatttttaattaagtacgtgatttaatttaaaaagagggtgatttttgttttttatttagtcgttagtta

SEQ ID NO: 15070 - DNA, 1010 bp, Artificial Sequence
  chemically treated genomic DNA (Homo sapiens) CpG-island No: 15070
taactaacgactaaataaaaaacaaaaatcaccctctttttaaattaaatcacgtacttaattaaaaataaaaataacgacgacctcaacgccctccccctccgtactactaacttcttcccaacgatattctaaccacgtcctacgccttctcgcgcacgaaaaaacgctctaaataaaaaccgaacccgaacaacaaataaccccaaataactcaataacgtaacaatctccttctcgcccgatccgaaacgaaaaaaaacgactcaaataccgactcgaaaaaaacccgaacacctcgaaaatccaaaacccgctaacgccgcgcccgaaaaaacaccaccgacgaaaacgaaaccgcgcctcctcccgaaactaaccgacgccgcgaaacgaaaaaaacaacgaaaaccgaacaaccgcgcgccgaaaaccataaacgtccttcccaccgacgaaaaccgcccgaaactccgaacgaaactaaaattccgcgacgacgataacgaaacgaaactaaaaaatcaaaaaaaaaaaacgattcctacaactcccccaaccccgcgcctccgaaaaacgacgaaacgaccgcgacgctcccgaaacacgtaaaacgacgataaaaacacgaaacccgacgaaacgtacgacgaccgcacaaaccgcacgacgtccctaataaacgaactactcaacgaactatacaactacacaaaaaaaaaaaaaacgacgaacgaaaaccgcgaaaccgaaaaccgccgacgacgccgcgacaacctcgacaactccaccgaaacctcgaactccgacgtaatcctaaacgaccgcaacgataccgacgactcccgcgtactacaaaaactacaaaaacgaccgaaccaacgacatcaaatactatacctacgacaaaaaaataaaaaccgaacgcaacaaaatcccgaaaacttcctaaaaccgaattatcctcgccgtctctacccgcgctccaacgcgcacctaaactactcgac

SEQ ID NO: 15071 - DNA, 1010 bp, Artificial Sequence
  chemically treated genomic DNA (Homo sapiens) CpG-island No: 15071
tagttggcggttgaataagaggtaagagttattttttttttgagttaaattacgtgtttaattaaaagtgaaggtggcggcggttttagcgtttttttttttcgtgttgttggtttttttttaacggtgttttggttacgttttgcgttttttcgcgtacgggagagcgttttgggtagaggtcgggttcgggtagtaggtggttttaggtagtttagtggcgtggtagtttttttttcgttcggttcggagcggaggggagcggtttaggtgtcggttcgggggaggttcgggtatttcggggatttagagttcgttggcgtcgcgttcgggagggtattatcggcgaggacgaagtcgcgttttttttcggaattggtcggcgtcgcgaggcgggaggagtagcgggagtcgggtagtcgcgcgtcggggattatggacgttttttttatcggcgggggtcgttcggggtttcggacggagttggaatttcgcggcggcggtggcgaggcgaggttggagagttaggaggaagaaacgatttttgtagtttttttagtttcgcgttttcggggagcggcggagcggtcgcggcgttttcgggatacgtgggacggcgatgaggatacggagttcggcgaggcgtgcggcggtcgtataagtcgtacggcgtttttggtgagcgggttgtttaacgagttgtatagttgtatagaggaggaggaggcggcgggcgggggtcgcggggtcgagggtcgtcggcggcgtcgcgatagtttcgatagttttatcgaggtttcgggtttcgacgtggttttgggcggtcgtagcggtgtcggcgattttcgcgtgttgtaggagttgtaggagcgatcgagttagcggtattagatgttgtatttgcggtagaaaggtgagggtcgggcgtagtagggtttcgggggttttttggagtcgggttgttttcgtcgtttttgttcgcgttttagcgcgtatttgggttgttcggt

SEQ ID NO: 15072 - DNA, 1010 bp, Artificial Sequence
  chemically treated genomic DNA (Homo sapiens) CpG-island No: 15072
accgaacaacccaaatacgcgctaaaacgcgaacaaaaacgacgaaaacaacccgactccaaaaaacccccgaaaccctactacgcccgaccctcacctttctaccgcaaatacaacatctaataccgctaactcgatcgctcctacaactcctacaacacgcgaaaatcgccgacaccgctacgaccgcccaaaaccacgtcgaaacccgaaacctcgataaaactatcgaaactatcgcgacgccgccgacgaccctcgaccccgcgacccccgcccgccgcctcctcctcctctatacaactatacaactcgttaaacaacccgctcaccaaaaacgccgtacgacttatacgaccgccgcacgcctcgccgaactccgtatcctcatcgccgtcccacgtatcccgaaaacgccgcgaccgctccgccgctccccgaaaacgcgaaactaaaaaaactacaaaaatcgtttcttcctcctaactctccaacctcgcctcgccaccgccgccgcgaaattccaactccgtccgaaaccccgaacgacccccgccgataaaaaaaacgtccataatccccgacgcgcgactacccgactcccgctactcctcccgcctcgcgacgccgaccaattccgaaaaaaaacgcgacttcgtcctcgccgataataccctcccgaacgcgacgccaacgaactctaaatccccgaaatacccgaacctcccccgaaccgacacctaaaccgctcccctccgctccgaaccgaacgaaaaaaaaactaccacgccactaaactacctaaaaccacctactacccgaacccgacctctacccaaaacgctctcccgtacgcgaaaaaacgcaaaacgtaaccaaaacaccgttaaaaaaaaaccaacaacacgaaaaaaaaaaacgctaaaaccgccgccaccttcacttttaattaaacacgtaatttaactcaaaaaaaaaataactcttacctcttattcaaccgccaacta

SEQ ID NO: 15073 - DNA, 904 bp, Artificial Sequence
  chemically treated genomic DNA (Homo sapiens) CpG-island No: 15073
cgagggggtcgttgtgtcgttatttattcgagtcgttcgggttggtcgcgagtcgggattcgcgagggttgtcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcggcgcgttttttttcgaacgtcgtttttagggttgttggttgcgttttttattgtttcgcggttgttgttcggggtgggcggttaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgtt

SEQ ID NO: 15074 - DNA, 904 bp, Artificial Sequence
  chemically treated genomic DNA (Homo sapiens) CpG-island No: 15074
aacaaacaaaacaaaacctacttctaccccttaccctcctcgtcctcctctctccaacgacgacgaccgcaataacaacgacaataacgactactaccactactctaccgctaccgaaccgatcacctaaacacccgcgaaaccgcgccgctactaccgccccgacgacctcccgaaatacgcgaaaaaaacgacgaaaaaacgaaatatccataataaccgaaaatacgaaaaacgcccaacaacaacgaatacctaaaaaccaaaaaaaaacccccgcgcgccgacaacccccaatactaaacgccctacaacccccgcgcgccgcgcctaaacccgcatcgctctcgcaataaaaatccgcccgaacgataaaccctccccgacgaccaaaccgacacctcccccccgcctaaccgcccaccccgaacaacaaccgcgaaacaataaaaaacgcaaccaacaaccctaaaaacgacgttcgaaaaaaaacgcgccgccgccgccgccgccgctaccgccaaaacaaacgcgcgccgcgtaaaaccgaacgaatacgaaaacgcgcgacgaaaaataaaaaacacgcgccgcgcgaaaaacgaaaacaataaaaaacgcgcgcgcgaacccgaaaaactcgcgaaaaaaacccgacgctcgacgcaacgcgacgcgaccaaactccgcgcctctcccgcccttcctcgacgcgctcgccctcgcctcgccgctcgcattcgctaaaaacgcccaaaaaaatacacaaaaacaacgactaaaaaaacgaaaattcaaaccacatatctacgtcctcgaaaaccaaaacccgacaaccctcgcgaatcccgactcgcgaccaacccgaacgactcgaataaataacgacacaacgaccccctcg

SEQ ID NO: 15075 - DNA, 904 bp, Artificial Sequence
  chemically treated genomic DNA (Homo sapiens) CpG-island No: 15075
ggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttggtcgtttatttcgggtagtagtcgcggaataatggagagcgtagttagtagttttggagacggcgttcgggggaggacgcgtcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcggtagttttcgcggatttcggttcgcggttagttcgagcggttcgggtgaatagcggtatagcggttttttcg

SEQ ID NO: 15076 - DNA, 904 bp, Artificial Sequence
  chemically treated genomic DNA (Homo sapiens) CpG-island No: 15076
cgaaaaaaccgctataccgctattcacccgaaccgctcgaactaaccgcgaaccgaaatccgcgaaaactaccgaactctaacccccgaaaacgcaaacatataacttaaacctccgctcccctaaccgttacctctatacatctttctaaacgcccccaacgaatacgaacgacgaaacgaaaacgaacgcgccgaaaaaaaacgaaaaaaacgcgaaacttaaccgcgccgcgctacgccgaacgccgaactctccccgcgaactccccgaacccgcgcgcgcgccccccactacccccgccccccgcgcgacgcgtaccccccaccccccgccgcgcgccctcgcacccgcccgactccacgcgacgcgcgcctaccctaacgacaacgacgacgacgacgacgacgcgtcctcccccgaacgccgtctccaaaactactaactacgctctccattattccgcgactactacccgaaataaacgaccaaacgaaaaaaaaatatcgacttaaccgccgaaaaaaacttaccgctcgaacgaaccctcactacgaaaacgatacgaacccaaacgcgacgcgcgaaaactacaaaacgcctaacactaaaaattaccgacgcgcgaaaacctcctcctaactcccaaacactcgctactactaaacgcccctcgcatcctcgattactataaatatctcgctcctccgccgccccctccgcgcactccgaaaaaccgccgaaacgataacaacgacgcgactccgcgaatacccaaataaccgactcgacaacgacaaaacaataacaacaaccgccactaccgctattactacgatcgccgccgctaaaaaaaaaaaaacgaaaaaaacaaaaaacaaaaacaaatcctactctatctacc

SEQ ID NO: 15077 - DNA, 535 bp, Artificial Sequence
  chemically treated genomic DNA (Homo sapiens) CpG-island No: 15077
gcgtttttaggatttcgcgttacgcgtattttttttatttcgatatttattgttatttttatagcggagcgaggggtttcgtcgagggcgagcgtatttcgtgcggttgagatgttcggaacgttttttcgcgtttcggtttttttagaaggggttatagtcggttcgcgagttttcgggcgggggttgagtcgtagtgttaattaaggcgaggttattttggttcgcgcgttttttattttagggttttttcggtagagaggtgattgtaggttatcgttagtcgggtttttatttttcgttttcgtcgtttcggtttttatatttcggaattttttcggcggagtttgcgagttcgggaacgcggttttagttagagtggaagggatagcgcgggaattcggtagagagaaaaagcgggaattgggcgtcgtcgttttacgatcgggaggagattttttttcggttttttttggattttatttcggggatcgtttcggggttagagtttaggttgggagagtttttgggcgta

SEQ ID NO: 15078 - DNA, 535 bp, Artificial Sequence
  chemically treated genomic DNA (Homo sapiens) CpG-island No: 15078
tacgcccaaaaactctcccaacctaaactctaaccccgaaacgatccccgaaataaaatccaaaaaaaaccgaaaaaaaatctcctcccgatcgtaaaacgacgacgcccaattcccgctttttctctctaccgaattcccgcgctatcccttccactctaactaaaaccgcgttcccgaactcgcaaactccgccgaaaaaattccgaaatataaaaaccgaaacgacgaaaacgaaaaataaaaacccgactaacgataacctacaatcacctctctaccgaaaaaaccctaaaataaaaaacgcgcgaaccaaaataacctcgccttaattaacactacgactcaacccccgcccgaaaactcgcgaaccgactataaccccttctaaaaaaaccgaaacgcgaaaaaacgttccgaacatctcaaccgcacgaaatacgctcgccctcgacgaaacccctcgctccgctataaaaataacaataaatatcgaaataaaaaaaatacgcgtaacgcgaaatcctaaaaacgc

SEQ ID NO: 15079 - DNA, 535 bp, Artificial Sequence
  chemically treated genomic DNA (Homo sapiens) CpG-island No: 15079
tgcgtttagggatttttttagtttgggttttagtttcgaaacggttttcggagtgggatttaggaggggtcgggagggaattttttttcgatcgtgaagcggcggcgtttagttttcgttttttttttttgtcgggttttcgcgttattttttttattttggttgggatcgcgttttcgggttcgtaggtttcgtcggggaggtttcggggtgtgggggtcgggacggcggaggcggggagtaagggttcggttggcggtgatttgtagttatttttttgtcggaggggttttggaatgaaaggcgcgcgggttaaggtgatttcgttttggttggtattgcggtttagttttcgttcggggattcgcgggtcgattgtggttttttttggggaagtcggggcgcggggaggcgtttcgggtattttagtcgtacggggtacgttcgttttcggcggggtttttcgtttcgttgtgggagtggtagtgggtgtcggggtggagaaagtacgcgtggcgcggagttttggggacgt

SEQ ID NO: 15080 - DNA, 535 bp, Artificial Sequence
  chemically treated genomic DNA (Homo sapiens) CpG-island No: 15080
acgtccccaaaactccgcgccacgcgtactttctccaccccgacacccactaccactcccacaacgaaacgaaaaaccccgccgaaaacgaacgtaccccgtacgactaaaatacccgaaacgcctccccgcgccccgacttccccaaaaaaaaccacaatcgacccgcgaatccccgaacgaaaactaaaccgcaataccaaccaaaacgaaatcaccttaacccgcgcgcctttcattccaaaacccctccgacaaaaaaataactacaaatcaccgccaaccgaacccttactccccgcctccgccgtcccgacccccacaccccgaaacctccccgacgaaacctacgaacccgaaaacgcgatcccaaccaaaataaaaaaaataacgcgaaaacccgacaaaaaaaaaaaacgaaaactaaacgccgccgcttcacgatcgaaaaaaaattccctcccgacccctcctaaatcccactccgaaaaccgtttcgaaactaaaacccaaactaaaaaaatccctaaacgca

SEQ ID NO: 15081 - DNA, 742 bp, Artificial Sequence
  chemically treated genomic DNA (Homo sapiens) CpG-island No: 15081
ttattagttttaggagttttcgcgtaaatcgaagttcggggagtgagtcgtaggtagcggttttcggggaaggtgttttaggtcggttcgggtggagagtgtttttcgtcgttttttcgattttttgttgttttttttaaatttttttttaattttttacgtcggggggacgtttagggatcgtttatttttcgggatcgttcgttttttcgttttcgttttcgttttcgttttcgttttcgataaattgagtaatatttagagaggatggaaatggcgaagaggtttggcgtttgttcgttttcgcgtatgttttttgattttattaaggttacgttgtagttcgtaggaatgaaaatttattttttcgtattttcgaggtgatttggaagcggtttaattgttttggttttttagaagaggaggggatcgggcggtaacgaggagttaaggggaggagattgttcgtaaaattcggaaaagttttttcgatttattttgttagttttcgtgcgtttttagatatgcgtagtagtttttttcgcggtggcggcggcggcggcggcggcggtggttgtcgtggcggttgagagtttagagtcggacgtttcggtcgtttcgggttggcggttggagagcgttcgggttatgtttgtttagggggattgcgagtttttggtgtagcgagttcgggagttggtgtcgtaagatttgtgggtagttaaggcgtggttgattacgg

SEQ ID NO: 15082 - DNA, 742 bp, Artificial Sequence
  chemically treated genomic DNA (Homo sapiens) CpG-island No: 15082
ccgtaatcaaccacgccttaactacccacaaatcttacgacaccaactcccgaactcgctacaccaaaaactcgcaatccccctaaacaaacataacccgaacgctctccaaccgccaacccgaaacgaccgaaacgtccgactctaaactctcaaccgccacgacaaccaccgccgccgccgccgccgccgccaccgcgaaaaaaactactacgcatatctaaaaacgcacgaaaactaacaaaataaatcgaaaaaacttttccgaattttacgaacaatctcctccccttaactcctcgttaccgcccgatcccctcctcttctaaaaaaccaaaacaattaaaccgcttccaaatcacctcgaaaatacgaaaaaataaattttcattcctacgaactacaacgtaaccttaataaaatcaaaaaacatacgcgaaaacgaacaaacgccaaacctcttcgccatttccatcctctctaaatattactcaatttatcgaaaacgaaaacgaaaacgaaaacgaaaacgaaaaaacgaacgatcccgaaaaataaacgatccctaaacgtccccccgacgtaaaaaattaaaaaaaaatttaaaaaaaacaacaaaaaatcgaaaaaacgacgaaaaacactctccacccgaaccgacctaaaacaccttccccgaaaaccgctacctacgactcactccccgaacttcgatttacgcgaaaactcctaaaactaataa

SEQ ID NO: 15083 - DNA, 742 bp, Artificial Sequence
  chemically treated genomic DNA (Homo sapiens) CpG-island No: 15083
tcgtgattagttacgttttggttgtttataggttttgcggtattaattttcgggttcgttgtattaggaattcgtagtttttttgggtagatatgattcgagcgttttttagtcgttagttcgaagcggtcggaacgttcggttttggatttttagtcgttacggtagttatcgtcgtcgtcgtcgtcgtcgttatcgcgggggaggttattgcgtatgtttggaggcgtacggaggttggtagagtggatcgggaaagttttttcgggttttgcgagtagttttttttttttggtttttcgttatcgttcggttttttttttttttgagaagttagagtagttgaatcgtttttaggttatttcgaaaatgcggagaagtggatttttatttttgcgggttgtagcgtgattttggtgaagttagggagtatgcgcgggagcgggtaggcgttaggttttttcgttatttttattttttttgggtattgtttagtttgtcgggggcgggggcgggggcggaggcgggggcggggagacgggcggtttcggggaatgggcggtttttgggcgttttttcggcgtggaaggttgagaagaagtttgagaggaatagtagagggtcggggaggcggcgggaagtattttttattcgggtcggtttgaaatatttttttcgggggtcgttgtttgcgatttatttttcgggtttcgatttacgcgaaaatttttggggttggtgg

SEQ ID NO: 15084 - DNA, 742 bp, Artificial Sequence
  chemically treated genomic DNA (Homo sapiens) CpG-island No: 15084
ccaccaaccccaaaaattttcgcgtaaatcgaaacccgaaaaataaatcgcaaacaacgacccccgaaaaaaatatttcaaaccgacccgaataaaaaatacttcccgccgcctccccgaccctctactattcctctcaaacttcttctcaaccttccacgccgaaaaaacgcccaaaaaccgcccattccccgaaaccgcccgtctccccgcccccgcctccgcccccgcccccgcccccgacaaactaaacaatacccaaaaaaaataaaaataacgaaaaaacctaacgcctacccgctcccgcgcatactccctaacttcaccaaaatcacgctacaacccgcaaaaataaaaatccacttctccgcattttcgaaataacctaaaaacgattcaactactctaacttctcaaaaaaaaaaaaaaccgaacgataacgaaaaaccaaaaaaaaaaaactactcgcaaaacccgaaaaaactttcccgatccactctaccaacctccgtacgcctccaaacatacgcaataacctcccccgcgataacgacgacgacgacgacgacgataactaccgtaacgactaaaaatccaaaaccgaacgttccgaccgcttcgaactaacgactaaaaaacgctcgaatcatatctacccaaaaaaactacgaattcctaatacaacgaacccgaaaattaataccgcaaaacctataaacaaccaaaacgtaactaatcacga

SEQ ID NO: 15085 - DNA, 522 bp, Artificial Sequence
  chemically treated genomic DNA (Homo sapiens) CpG-island No: 15085
attcgattcgttcggagtttttagtgacgaagttaatatggtcgttttttacgaggtttttcgggttcgagtgatttgttagtcgtggcggggtgttcgggaggtttagatcgtaggtcgttttttagcggtgggttgttatcgttcggttacgtcgtttttatttcgcgcgcgttttcgacggttcgcgtcgcgtcggtgaagttgcgggcgggggaggggaatagggtgttcgtacgggggttgtttcgcgtcgttttagtttttttttttcggcgtttagaattttggttcgagatcgcgcgcgaaagtagggcgcgaatattttcgttcgttattcgggtattatagattttaagtggtcggttcgcggtcgtataggtgtatcggattttgttttcgtttcgtacgttggtcgggattttcggtttattttttcggatttgttttttttcgggcgttttttaatttttcggggtttgtttattttttttatggttcgttttttagtttatattgggg

SEQ ID NO: 15086 - DNA, 522 bp, Artificial Sequence
  chemically treated genomic DNA (Homo sapiens) CpG-island No: 15086
ccccaatataaactaaaaaacgaaccataaaaaaaataaacaaaccccgaaaaattaaaaaacgcccgaaaaaaaacaaatccgaaaaaataaaccgaaaatcccgaccaacgtacgaaacgaaaacaaaatccgatacacctatacgaccgcgaaccgaccacttaaaatctataatacccgaataacgaacgaaaatattcgcgccctactttcgcgcgcgatctcgaaccaaaattctaaacgccgaaaaaaaaaaactaaaacgacgcgaaacaacccccgtacgaacaccctattcccctcccccgcccgcaacttcaccgacgcgacgcgaaccgtcgaaaacgcgcgcgaaataaaaacgacgtaaccgaacgataacaacccaccgctaaaaaacgacctacgatctaaacctcccgaacaccccgccacgactaacaaatcactcgaacccgaaaaacctcgtaaaaaacgaccatattaacttcgtcactaaaaactccgaacgaatcgaat

SEQ ID NO: 15087 - DNA, 522 bp, Artificial Sequence
  chemically treated genomic DNA (Homo sapiens) CpG-island No: 15087
ttttagtgtgagttagagagcggattatgaaggaagtgggtagatttcgggaagttagaggacgttcggggaaaagtaggttcggggaggtgggtcgagagtttcggttagcgtgcggggcggaggtagggttcggtgtatttgtgcggtcgcgggtcggttatttggggtttgtggtgttcgagtggcgggcgggggtgttcgcgttttgttttcgcgcgcggtttcgggttaaggttttgggcgtcgggagaggagagttggggcggcgcggagtagttttcgtgcgggtattttgtttttttttttcgttcgtaattttatcggcgcggcgcgagtcgtcgggggcgcgcgcggggtgggggcggcgtggtcgggcggtggtagtttatcgttggggagcgatttgcggtttgggtttttcgggtatttcgttacggttggtaggttattcgggttcgaggggtttcgtggggagcggttatgttggtttcgttattgaggatttcgggcgggtcgggt

SEQ ID NO: 15088 - DNA, 522 bp, Artificial Sequence
  chemically treated genomic DNA (Homo sapiens) CpG-island No: 15088
acccgacccgcccgaaatcctcaataacgaaaccaacataaccgctccccacgaaacccctcgaacccgaataacctaccaaccgtaacgaaatacccgaaaaacccaaaccgcaaatcgctccccaacgataaactaccaccgcccgaccacgccgcccccaccccgcgcgcgcccccgacgactcgcgccgcgccgataaaattacgaacgaaaaaaaaaaacaaaatacccgcacgaaaactactccgcgccgccccaactctcctctcccgacgcccaaaaccttaacccgaaaccgcgcgcgaaaacaaaacgcgaacacccccgcccgccactcgaacaccacaaaccccaaataaccgacccgcgaccgcacaaatacaccgaaccctacctccgccccgcacgctaaccgaaactctcgacccacctccccgaacctacttttccccgaacgtcctctaacttcccgaaatctacccacttccttcataatccgctctctaactcacactaaaa

SEQ ID NO: 15089 - DNA, 543 bp, Artificial Sequence
  chemically treated genomic DNA (Homo sapiens) CpG-island No: 15089
gcgttacggcggggtagggagggaaggtttcggcggtcggtcggtttcggggttgtttttgttcgtttttcgggggtcgtgaggggtcggtggttcgggtgagattgtggggttacgagcggagtttggcgaggtcgggaagagaggaggggcgggaaggagtaagagaggaagtcgaaatagggggacggaagcggggagcgggtgttcgggtgggggaagggagaggtcggcggggggtaggggcgacgaggttcgaggttttttcgcgtcgcgtttcgacgtttttttcggtttgtttgtttttggtcgttttgtttatagttatgcggtcgggcgggggttcggagtatacgttcgatcgttatttttgtagggggataggggttgcggcggggaatgggggggtcggttttcgtagcgaagatataataatgagttttttcgtttcggaggggttaattttcgcgaattttcgtttttggggaaaacggggtttttttaatttttttttattttcgttttcgggtttttcggtggtta

SEQ ID NO: 15090 - DNA, 543 bp, Artificial Sequence
  chemically treated genomic DNA (Homo sapiens) CpG-island No: 15090
taaccaccgaaaaacccgaaaacgaaaataaaaaaaaattaaaaaaaccccgttttccccaaaaacgaaaattcgcgaaaattaacccctccgaaacgaaaaaactcattattatatcttcgctacgaaaaccgacccccccattccccgccgcaacccctatccccctacaaaaataacgatcgaacgtatactccgaacccccgcccgaccgcataactataaacaaaacgaccaaaaacaaacaaaccgaaaaaaacgtcgaaacgcgacgcgaaaaaacctcgaacctcgtcgcccctaccccccgccgacctctcccttcccccacccgaacacccgctccccgcttccgtccccctatttcgacttcctctcttactccttcccgcccctcctctcttcccgacctcgccaaactccgctcgtaaccccacaatctcacccgaaccaccgacccctcacgacccccgaaaaacgaacaaaaacaaccccgaaaccgaccgaccgccgaaaccttccctccctaccccgccgtaacgc

SEQ ID NO: 15091 - DNA, 543 bp, Artificial Sequence
  chemically treated genomic DNA (Homo sapiens) CpG-island No: 15091
tggttatcgaggggttcgggagcgggggtgggagggagttgggggagtttcgttttttttaggggcgggggttcgcggggattaattttttcggggcggaagggtttattgttatgttttcgttgcggaggtcgatttttttatttttcgtcgtagtttttatttttttataggagtggcgatcgggcgtgtgtttcggattttcgttcggtcgtatagttgtgagtagggcggttagaggtaggtaggtcgggaggggcgtcggggcgcggcgcgggggggtttcgggtttcgtcgtttttgtttttcgtcggtttttttttttttttattcgggtattcgtttttcgttttcgtttttttgtttcggtttttttttttattttttttcgtttttttttttttttcgatttcgttaaatttcgttcgtggttttatagttttattcgggttatcggttttttacgattttcggaaagcggataaaaatagtttcgaggtcggtcggtcgtcgggattttttttttttgtttcgtcgtggcgt

SEQ ID NO: 15092 - DNA, 543 bp, Artificial Sequence
  chemically treated genomic DNA (Homo sapiens) CpG-island No: 15092
acgccacgacgaaacaaaaaaaaaaaatcccgacgaccgaccgacctcgaaactatttttatccgctttccgaaaatcgtaaaaaaccgataacccgaataaaactataaaaccacgaacgaaatttaacgaaatcgaaaaaaaaaaaaaaacgaaaaaaaataaaaaaaaaaaccgaaacaaaaaaacgaaaacgaaaaacgaatacccgaataaaaaaaaaaaaaaaccgacgaaaaacaaaaacgacgaaacccgaaacccccccgcgccgcgccccgacgcccctcccgacctacctacctctaaccgccctactcacaactatacgaccgaacgaaaatccgaaacacacgcccgatcgccactcctataaaaaaataaaaactacgacgaaaaataaaaaaatcgacctccgcaacgaaaacataacaataaacccttccgccccgaaaaaattaatccccgcgaacccccgcccctaaaaaaaacgaaactcccccaactccctcccacccccgctcccgaacccctcgataacca

SEQ ID NO: 15093 - DNA, 754 bp, Artificial Sequence
  chemically treated genomic DNA (Homo sapiens) CpG-island No: 15093
ggttggtggtatcgagtagtttgggtttagagcggttgtcgggtcgatagattcgggcggggtaaagtcgggcggggaaagttgggttcgtttcgtttcggtttcgtttttatttcgggagttcgatatcggttttagagttttgggtagcgtgcgcgttttttttggcggttgcgtaggtaagtgggatcggggtggggttacgtgatcgggagaggagggttcggcggttttcggtttaggtgtgttgcgacggacggttgttcgcgttcggcgtttagtttgttatagttcgcgggggaggtcggagttagggattcggggaggttcgcgtttcgttaggtttcgttttgcggacgtaggtgcggtcgagtcgtcgttttttcgggcgcggggcggggcgcgtatttcggggcgatttcggtgttttttatttgggaggtttttcggtttagtttcggtttcgttgggtcggaatttttaaagatagtgggttttagttagaaacgcgaagacgaacgtttagtcggcgcgggtagaatcgaggatataatgagatttgtgggatcgggcgtttagaggttggcgcgggggagattttatagttaaaatgttcggtattttcgggtagtcgtgggttagttagaatcgtagagtttttttcgatttttcggaagcgtagaagtattcgaaatttattcgttttttgggtttagtaaaatttttaagttaggtaaatcggtggttttgtttg

SEQ ID NO: 15094 - DNA, 754 bp, Artificial Sequence
  chemically treated genomic DNA (Homo sapiens) CpG-island No: 15094
caaacaaaaccaccgatttacctaacttaaaaattttactaaacccaaaaaacgaataaatttcgaatacttctacgcttccgaaaaatcgaaaaaaactctacgattctaactaacccacgactacccgaaaataccgaacattttaactataaaatctcccccgcgccaacctctaaacgcccgatcccacaaatctcattatatcctcgattctacccgcgccgactaaacgttcgtcttcgcgtttctaactaaaacccactatctttaaaaattccgacccaacgaaaccgaaactaaaccgaaaaacctcccaaataaaaaacaccgaaatcgccccgaaatacgcgccccgccccgcgcccgaaaaaacgacgactcgaccgcacctacgtccgcaaaacgaaacctaacgaaacgcgaacctccccgaatccctaactccgacctcccccgcgaactataacaaactaaacgccgaacgcgaacaaccgtccgtcgcaacacacctaaaccgaaaaccgccgaaccctcctctcccgatcacgtaaccccaccccgatcccacttacctacgcaaccgccaaaaaaaacgcgcacgctacccaaaactctaaaaccgatatcgaactcccgaaataaaaacgaaaccgaaacgaaacgaacccaactttccccgcccgactttaccccgcccgaatctatcgacccgacaaccgctctaaacccaaactactcgataccaccaacc

SEQ ID NO: 15095 - DNA, 754 bp, Artificial Sequence
  chemically treated genomic DNA (Homo sapiens) CpG-island No: 15095
taaatagaattatcggtttatttggtttaaaagttttgttggatttaagaaacgggtagatttcggatatttttgcgttttcgaggggtcgggaaaggttttgcggttttaattaatttacgattgttcgggggtatcgagtattttagttgtggggtttttttcgcgttagtttttgggcgttcggttttataaattttattgtgttttcggttttgttcgcgtcggttaggcgttcgttttcgcgtttttggttgaaatttattgtttttggagatttcgatttaacgaggtcgaaattaagtcgggagattttttaggtaaggagtatcgagatcgtttcgaggtgcgcgtttcgtttcgcgttcggaaggacggcggttcggtcgtatttgcgttcgtagagcgaaatttggcgggacgcgggttttttcggatttttggtttcggtttttttcgcgggttatggtaggttgagcgtcgagcgcgggtagtcgttcgtcgtagtatatttgggtcgggggtcgtcgggtttttttttttcggttacgtggttttatttcggttttatttatttgcgtagtcgttaggaagagcgcgtacgttgtttaggattttgaaatcggtatcgggttttcggggtgggggcggggtcgggacgggacgagtttagtttttttcgttcggttttgtttcgttcggatttgtcggttcgataatcgttttgggtttaggttgttcggtgttattagtt

SEQ ID NO: 15096 - DNA, 754 bp, Artificial Sequence
  chemically treated genomic DNA (Homo sapiens) CpG-island No: 15096
aactaataacaccgaacaacctaaacccaaaacgattatcgaaccgacaaatccgaacgaaacaaaaccgaacgaaaaaaactaaactcgtcccgtcccgaccccgcccccaccccgaaaacccgataccgatttcaaaatcctaaacaacgtacgcgctcttcctaacgactacgcaaataaataaaaccgaaataaaaccacgtaaccgaaaaaaaaaaacccgacgacccccgacccaaatatactacgacgaacgactacccgcgctcgacgctcaacctaccataacccgcgaaaaaaaccgaaaccaaaaatccgaaaaaacccgcgtcccgccaaatttcgctctacgaacgcaaatacgaccgaaccgccgtccttccgaacgcgaaacgaaacgcgcacctcgaaacgatctcgatactccttacctaaaaaatctcccgacttaatttcgacctcgttaaatcgaaatctccaaaaacaataaatttcaaccaaaaacgcgaaaacgaacgcctaaccgacgcgaacaaaaccgaaaacacaataaaatttataaaaccgaacgcccaaaaactaacgcgaaaaaaaccccacaactaaaatactcgatacccccgaacaatcgtaaattaattaaaaccgcaaaacctttcccgacccctcgaaaacgcaaaaatatccgaaatctacccgtttcttaaatccaacaaaacttttaaaccaaataaaccgataattctattta

SEQ ID NO: 15097 - DNA, 590 bp, Artificial Sequence
  chemically treated genomic DNA (Homo sapiens) CpG-island No: 15097
ttttagtttcgtagcgggttcgttttaatcgtttgttgattggtattttaggggaatgcggcggagagtggagtcggtggaaacgtagggtaacgtcgcgggggtttgtggggttggttttacggggcgggtttttgtcgtttttcgcgtattttcgtagtttgtcgtttatttcgtcgtcgttgatcgcgtcgatgtcgtcgaattttcggtttagttcgtcggagtcgtcgagtacgtacgcgtcgtcgggcgttagtagcgtatatagtagtaagggtatcgcggcgcggttcgtcgaattcgcggtcgtagttatagttttcgttcggcgttgttaggaagtcgagagtagttatttagttattgtgtgggttatatgatttcggcgtttagggaggcgggtttcgtcgtcgttacgatagatacgggtaggaggtcgttgatgttgacgtcgtcgtcgttattttgagtgcgggttaagggtttttgacgtagttggcggagtgttgagaaaagaagtagcgagtttttttttatcgttcgcgtgtttgtggttagttattggattttatatgtatttattgttg

SEQ ID NO: 15098 - DNA, 590 bp, Artificial Sequence
  chemically treated genomic DNA (Homo sapiens) CpG-island No: 15098
caacaataaatacatataaaatccaataactaaccacaaacacgcgaacgataaaaaaaaactcgctacttcttttctcaacactccgccaactacgtcaaaaacccttaacccgcactcaaaataacgacgacgacgtcaacatcaacgacctcctacccgtatctatcgtaacgacgacgaaacccgcctccctaaacgccgaaatcatataacccacacaataactaaataactactctcgacttcctaacaacgccgaacgaaaactataactacgaccgcgaattcgacgaaccgcgccgcgatacccttactactatatacgctactaacgcccgacgacgcgtacgtactcgacgactccgacgaactaaaccgaaaattcgacgacatcgacgcgatcaacgacgacgaaataaacgacaaactacgaaaatacgcgaaaaacgacaaaaacccgccccgtaaaaccaaccccacaaacccccgcgacgttaccctacgtttccaccgactccactctccgccgcattcccctaaaataccaatcaacaaacgattaaaacgaacccgctacgaaactaaaa

SEQ ID NO: 15099 - DNA, 590 bp, Artificial Sequence
  chemically treated genomic DNA (Homo sapiens) CpG-island No: 15099
tagtagtaagtatatgtgaaatttagtagttgattatagatacgcgagcgataagaaaaagttcgttgtttttttttttaatatttcgttagttgcgttagaggtttttgattcgtatttaaaatggcggcggcggcgttagtattagcggttttttgttcgtatttatcgtggcggcgacgggattcgtttttttgggcgtcggagttatgtgatttatataatggttgagtggttattttcggttttttggtaacgtcgagcgaaagttatgattgcggtcgcgggttcggcgggtcgcgtcgcggtgtttttgttgttgtgtgcgttgttggcgttcggcggcgcgtacgtgttcgacgatttcgacgggttgggtcgggagttcgacggtatcggcgcggttagcggcggcggggtgagcggtaagttgcggggatacgcggggggcggtaagagttcgtttcgtggggttagttttataagttttcgcggcgttgttttgcgtttttatcggttttatttttcgtcgtatttttttagggtgttagttagtaggcggttggggcgggttcgttgcggggttgggg

SEQ ID NO: 15100 - DNA, 590 bp, Artificial Sequence
  chemically treated genomic DNA (Homo sapiens) CpG-island No: 15100
ccccaaccccgcaacgaacccgccccaaccgcctactaactaacaccctaaaaaaatacgacgaaaaataaaaccgataaaaacgcaaaacaacgccgcgaaaacttataaaactaaccccacgaaacgaactcttaccgccccccgcgtatccccgcaacttaccgctcaccccgccgccgctaaccgcgccgataccgtcgaactcccgacccaacccgtcgaaatcgtcgaacacgtacgcgccgccgaacgccaacaacgcacacaacaacaaaaacaccgcgacgcgacccgccgaacccgcgaccgcaatcataactttcgctcgacgttaccaaaaaaccgaaaataaccactcaaccattatataaatcacataactccgacgcccaaaaaaacgaatcccgtcgccgccacgataaatacgaacaaaaaaccgctaatactaacgccgccgccgccattttaaatacgaatcaaaaacctctaacgcaactaacgaaatattaaaaaaaaaaacaacgaactttttcttatcgctcgcgtatctataatcaactactaaatttcacatatacttactacta

SEQ ID NO: 15101 - DNA, 714 bp, Artificial Sequence
  chemically treated genomic DNA (Homo sapiens) CpG-island No: 15101
gttatagttattttcgtttgttttttttcgtcgggttcgttagtgttatgggagggggcggtagtcgtaagggcgttttttggtcgttatttcgtcggtcggcggcgcgaggggtaggttcgggatttatcgggtggaggtgttttttcgtatatcgtatattatgtatttgaaggtttcggcgttgtttcggaaggtgtagacgttatagttttagtaatttttattcgaggacggtttcggttgtcgtttcggtttgtaggatataattcggatacgacgcggcgcggggttattagtaggtcgcgttcggtgttcgggtttcgcggtcgttttcgtttcgtttttcgttttaattttgcgattttcgtttcgcgggttttcggcgcgtcgcgtttcggttgagggggaagggagttaggaagaggtagggcgcgagcgcggtcgtagtcgtcgtcgttatagtcgttttgatattcgggcggtcgtttcggtcgtcgtcgttatcgcggttttattgtggggcggtcggcgtcggtttttttaagcggtagtattcgtatattagcggcgttgttttcgtgttcgtttcggtgttcgggcggttagcgaggcggttattcgaagttttgtacgagggttttgtcgttcgtatagttcgggtttcggggttcgggcgttgttatttggtggggttttttttgttttttatgg

SEQ ID NO: 15102 - DNA, 714 bp, Artificial Sequence
  chemically treated genomic DNA (Homo sapiens) CpG-island No: 15102
ccataaaaaacaaaaaaaaccccaccaaataacaacgcccgaaccccgaaacccgaactatacgaacgacaaaaccctcgtacaaaacttcgaataaccgcctcgctaaccgcccgaacaccgaaacgaacacgaaaacaacgccgctaatatacgaatactaccgcttaaaaaaaccgacgccgaccgccccacaataaaaccgcgataacgacgacgaccgaaacgaccgcccgaatatcaaaacgactataacgacgacgactacgaccgcgctcgcgccctacctcttcctaactcccttccccctcaaccgaaacgcgacgcgccgaaaacccgcgaaacgaaaatcgcaaaattaaaacgaaaaacgaaacgaaaacgaccgcgaaacccgaacaccgaacgcgacctactaataaccccgcgccgcgtcgtatccgaattatatcctacaaaccgaaacgacaaccgaaaccgtcctcgaataaaaattactaaaactataacgtctacaccttccgaaacaacgccgaaaccttcaaatacataatatacgatatacgaaaaaacacctccacccgataaatcccgaacctacccctcgcgccgccgaccgacgaaataacgaccaaaaaacgcccttacgactaccgccccctcccataacactaacgaacccgacgaaaaaaaacaaacgaaaataactataac

SEQ ID NO: 15103 - DNA, 714 bp, Artificial Sequence
  chemically treated genomic DNA (Homo sapiens) CpG-island No: 15103
ttatgggagataagaagagttttattaggtaatagcgttcgggtttcggggttcggattgtgcgggcggtagggttttcgtgtagggtttcgggtggtcgtttcgttagtcgttcgggtatcggggcgagtacgggggtagcgtcgttggtgtgcgagtgttgtcgtttgagggggtcggcgtcggtcgttttataatggagtcgcgatggcggcggcgatcggagcggtcgttcgggtgttagagcggttgtggcggcggcgattgcggtcgcgttcgcgttttgtttttttttgattttttttttttttagtcggagcgcggcgcgtcgagggttcgcggggcgggggtcgtagaattggggcggggggcggggcgggggcggtcgcggggttcgggtatcgggcgcggtttgttggtgatttcgcgtcgcgtcgtgttcgggttgtgttttgtaggtcgaagcggtagtcgaagtcgttttcggatgagggttattgggattgtagcgtttgtatttttcggaatagcgtcgaggtttttaagtgtatgatgtgcgatgtgcggaagggtatttttattcggtgagtttcgggtttgtttttcgcgtcgtcggtcggcggggtggcgattagaggacgtttttgcggttgtcgtttttttttatgatattggcggattcggcgggaggaggtagacggaggtggttgtggt

SEQ ID NO: 15104 - DNA, 714 bp, Artificial Sequence
  chemically treated genomic DNA (Homo sapiens) CpG-island No: 15104
accacaaccacctccgtctacctcctcccgccgaatccgccaatatcataaaaaaaaacgacaaccgcaaaaacgtcctctaatcgccaccccgccgaccgacgacgcgaaaaacaaacccgaaactcaccgaataaaaatacccttccgcacatcgcacatcatacacttaaaaacctcgacgctattccgaaaaatacaaacgctacaatcccaataaccctcatccgaaaacgacttcgactaccgcttcgacctacaaaacacaacccgaacacgacgcgacgcgaaatcaccaacaaaccgcgcccgatacccgaaccccgcgaccgcccccgccccgccccccgccccaattctacgacccccgccccgcgaaccctcgacgcgccgcgctccgactaaaaaaaaaaaaaatcaaaaaaaaacaaaacgcgaacgcgaccgcaatcgccgccgccacaaccgctctaacacccgaacgaccgctccgatcgccgccgccatcgcgactccattataaaacgaccgacgccgaccccctcaaacgacaacactcgcacaccaacgacgctacccccgtactcgccccgatacccgaacgactaacgaaacgaccacccgaaaccctacacgaaaaccctaccgcccgcacaatccgaaccccgaaacccgaacgctattacctaataaaactcttcttatctcccataa

SEQ ID NO: 15105 - DNA, 1265 bp, Artificial Sequence
  chemically treated genomic DNA (Homo sapiens) CpG-island No: 15105
  misc_feature (702)..(702): n is either a, c, g or t
ttcgcggggcgtcgaggttggggttatggttaggtcgggggcggaggcggtttcgcgcggttgtgagtcgaggttcgggcggcgcggggggcggggaggtagcgggaggaggggatgcggagggtttttcggcggcggcgagcgggcgagaagggaggagcggcgcgagcggtcggagcggcgtagggttcgaagcgtgtatggcgcgttttgagtcgggttttcgcgggttttttcggagcgtttttcgggcgtcgcggtttttaggcgggtttttttgggtcggttgtttttgagtttcggcgttggatttttggatgttttatttttcgggagaagtttgtttgcgtcggggtagaatcgcggtagcgttgcgtcggatttcgtttttcgtttagtcgtttcgcgtcggtcgcggtgggttcgtagtcggcgacgaggagtttggggtttgcgaagcgggcgcgatagtttttcgggtcggtaggtttcggtcggtttcgtttcgtttgcgggaaagggagaggcgagaggggaagggtcgtatcgtaggagtttttttttgattcggatttcgttttttgcgcggacgcgtcgaaggttcggttcggttttcgtcggggttacgtatttattttcgtcgcgagaggtgggggatgcgggtaacgggttttttcgggttttaggattttttttttcggngtttcggagttgttgtttcgttcgtcgttttttttttcgttttttttattttttattttatttttttatttttcgtaagaaaataatgttggttggcgttcgtattttttagtcgtttttagttcgttgcgaggaaagcgtattcgtagtgttttttcgtcgggattttcgtcgagtcgttttcgtcgtcgtcgagtttcgagagtagttgggtttcgtttaggcggaattagcgagcgtcgcgttcgggtattgtcggttcgaggaggtatcgttcgtaaggatattatttcgtttcgtttcgttcgtaatttcggttttcgtcgagttcgacgcgagttaggatttcggacgttttttcgcgtgcggcgtagtagtagttagattagtttttgcgattttatttcggaggtaattttatttcggatttgggatttttgacgcggatttttagttattttttatttcggggttgtgtttttttttttcgtttaggacgggggtgttaagatgtttcgttgtagcgtagggtttcgggtcgttttcgacgtgtgattttagtt

SEQ ID NO: 15106 - DNA, 1265 bp, Artificial Sequence
  chemically treated genomic DNA (Homo sapiens) CpG-island No: 15106
  misc_feature (564)..(564): n is either a, c, g or t
aactaaaatcacacgtcgaaaacgacccgaaaccctacgctacaacgaaacatcttaacacccccgtcctaaacgaaaaaaaaaaacacaaccccgaaataaaaaataactaaaaatccgcgtcaaaaatcccaaatccgaaataaaattacctccgaaataaaatcgcaaaaactaatctaactactactacgccgcacgcgaaaaaacgtccgaaatcctaactcgcgtcgaactcgacgaaaaccgaaattacgaacgaaacgaaacgaaataatatccttacgaacgatacctcctcgaaccgacaatacccgaacgcgacgctcgctaattccgcctaaacgaaacccaactactctcgaaactcgacgacgacgaaaacgactcgacgaaaatcccgacgaaaaaacactacgaatacgctttcctcgcaacgaactaaaaacgactaaaaaatacgaacgccaaccaacattattttcttacgaaaaataaaaaaataaaataaaaaataaaaaaaacgaaaaaaaaaacgacgaacgaaacaacaactccgaaacnccgaaaaaaaaaatcctaaaacccgaaaaaacccgttacccgcatcccccacctctcgcgacgaaaataaatacgtaaccccgacgaaaaccgaaccgaaccttcgacgcgtccgcgcaaaaaacgaaatccgaatcaaaaaaaaactcctacgatacgacccttcccctctcgcctctccctttcccgcaaacgaaacgaaaccgaccgaaacctaccgacccgaaaaactatcgcgcccgcttcgcaaaccccaaactcctcgtcgccgactacgaacccaccgcgaccgacgcgaaacgactaaacgaaaaacgaaatccgacgcaacgctaccgcgattctaccccgacgcaaacaaacttctcccgaaaaataaaacatccaaaaatccaacgccgaaactcaaaaacaaccgacccaaaaaaacccgcctaaaaaccgcgacgcccgaaaaacgctccgaaaaaacccgcgaaaacccgactcaaaacgcgccatacacgcttcgaaccctacgccgctccgaccgctcgcgccgctcctcccttctcgcccgctcgccgccgccgaaaaaccctccgcatcccctcctcccgctacctccccgccccccgcgccgcccgaacctcgactcacaaccgcgcgaaaccgcctccgcccccgacctaaccataaccccaacctcgacgccccgcgaa

SEQ ID NO: 15107 - DNA, 1265 bp, Artificial Sequence
  chemically treated genomic DNA (Homo sapiens) CpG-island No: 15107
  misc_feature (564)..(564): n is either a, c, g or t
ggttagggttatacgtcgggggcggttcggggttttgcgttgtagcggggtattttggtattttcgttttgagcggaggaggagggtatagtttcgaggtgagaagtagttgaggattcgcgttagaagttttaggttcgaaatggagttgttttcgaggtggggtcgtagggattggtttggttgttgttgcgtcgtacgcggagagacgttcgggattttggttcgcgtcgagttcgacgagggtcggagttgcggacgagacgggacggagtggtgtttttgcgggcggtgttttttcgggtcggtagtgttcgggcgcggcgttcgttgatttcgtttaagcggagtttagttgttttcggggttcggcggcggcgagggcggttcggcgggggtttcggcgaagagatattgcgggtgcgtttttttcgtagcggattgggagcgattgggaggtgcgggcgttagttagtattatttttttacgaggggtggggaggtgggatgggaggtggagaggacgggggagggggcgacgggcggagtaatagtttcggagtntcgggggggagggttttggagttcgggggggttcgttgttcgtattttttatttttcgcggcgagagtggatgcgtggtttcggcgaaagtcgagtcgagttttcggcgcgttcgcgtagggggcggggttcgggttagggaagagtttttgcggtgcggttttttttttttcgtttttttttttttcgtaaacggagcggggtcggtcgggatttgtcggttcggagagttgtcgcgttcgtttcgtaagttttaagtttttcgtcgtcggttgcgggtttatcgcggtcggcgcggaacgattaggcggaggacggaattcggcgtagcgttgtcgcggttttgtttcgacgtaggtaggtttttttcggggagtaaggtatttagagatttagcgtcggggtttagaagtagtcggtttagaggggttcgtttgagagtcgcggcgttcgagaggcgtttcgggggggttcgcgggagttcggtttagggcgcgttatgtacgtttcgggttttgcgtcgtttcggtcgttcgcgtcgttttttttttttcgttcgttcgtcgtcgtcggagagtttttcgtatttttttttttcgttgttttttcgtttttcgcgtcgttcgggtttcggtttatagtcgcgcgaggtcgttttcgttttcggtttggttatggttttagtttcggcgtttcgcggg

SEQ ID NO: 15108 - DNA, 1265 bp, Artificial Sequence
  chemically treated genomic DNA (Homo sapiens) CpG-island No: 15108
  misc_feature (702)..(702): n is either a, c, g or t
cccgcgaaacgccgaaactaaaaccataaccaaaccgaaaacgaaaacgacctcgcgcgactataaaccgaaacccgaacgacgcgaaaaacgaaaaaacaacgaaaaaaaaaaatacgaaaaactctccgacgacgacgaacgaacgaaaaaaaaaaaacgacgcgaacgaccgaaacgacgcaaaacccgaaacgtacataacgcgccctaaaccgaactcccgcgaacccccccgaaacgcctctcgaacgccgcgactctcaaacgaacccctctaaaccgactacttctaaaccccgacgctaaatctctaaataccttactccccgaaaaaaacctacctacgtcgaaacaaaaccgcgacaacgctacgccgaattccgtcctccgcctaatcgttccgcgccgaccgcgataaacccgcaaccgacgacgaaaaacttaaaacttacgaaacgaacgcgacaactctccgaaccgacaaatcccgaccgaccccgctccgtttacgaaaaaaaaaaaaacgaaaaaaaaaaaaccgcaccgcaaaaactcttccctaacccgaaccccgccccctacgcgaacgcgccgaaaactcgactcgactttcgccgaaaccacgcatccactctcgccgcgaaaaataaaaaatacgaacaacgaacccccccgaactccaaaaccctcccccccganactccgaaactattactccgcccgtcgccccctcccccgtcctctccacctcccatcccacctccccacccctcgtaaaaaaataatactaactaacgcccgcacctcccaatcgctcccaatccgctacgaaaaaaacgcacccgcaatatctcttcgccgaaacccccgccgaaccgccctcgccgccgccgaaccccgaaaacaactaaactccgcttaaacgaaatcaacgaacgccgcgcccgaacactaccgacccgaaaaaacaccgcccgcaaaaacaccactccgtcccgtctcgtccgcaactccgaccctcgtcgaactcgacgcgaaccaaaatcccgaacgtctctccgcgtacgacgcaacaacaaccaaaccaatccctacgaccccacctcgaaaacaactccatttcgaacctaaaacttctaacgcgaatcctcaactacttctcacctcgaaactataccctcctcctccgctcaaaacgaaaataccaaaataccccgctacaacgcaaaaccccgaaccgcccccgacgtataaccctaacc

SEQ ID NO: 15109 - DNA, 546 bp, Artificial Sequence
  chemically treated genomic DNA (Homo sapiens) CpG-island No: 15109
gcgtagcgacgacgacgacgatttttcgttgagcggtgacgattttttggtcgggggtttcggttttagttttcgttttaagttcgtttggtaggagcgcggcggcgacgattgcggtcgcggtagtcgtcggtagcggcggggcgcggttagcgggggtagtattcgggcgttttttgcgggcggcggcggcggttcggcggcggcggttgtttcggcgggcgggacggaggtgcgttttcgttcggtggaggtgggtttggaggagcggcggggtaaggggcgcgcggtcgacgagttggaggtcggcgtcgtcgagggcggcgaggggttcggggatggcggtagttcggcggattcgggttcgggcgcggggttcggcgcggtgttgtttttgggcgtttgttgtttggcgttgttgtagatatttcgttttaagaagttttcgtcggataaattggagcggttgtattagcgttatttttttcgtttgaattagagtagttttattatgtttatggtcgtgttggtgttcgtgtgtttggt

SEQ ID NO: 15110 - DNA, 546 bp, Artificial Sequence
  chemically treated genomic DNA (Homo sapiens) CpG-island No: 15110
accaaacacacgaacaccaacacgaccataaacataataaaactactctaattcaaacgaaaaaaataacgctaatacaaccgctccaatttatccgacgaaaacttcttaaaacgaaatatctacaacaacgccaaacaacaaacgcccaaaaacaacaccgcgccgaaccccgcgcccgaacccgaatccgccgaactaccgccatccccgaacccctcgccgccctcgacgacgccgacctccaactcgtcgaccgcgcgccccttaccccgccgctcctccaaacccacctccaccgaacgaaaacgcacctccgtcccgcccgccgaaacaaccgccgccgccgaaccgccgccgccgcccgcaaaaaacgcccgaatactacccccgctaaccgcgccccgccgctaccgacgactaccgcgaccgcaatcgtcgccgccgcgctcctaccaaacgaacttaaaacgaaaactaaaaccgaaacccccgaccaaaaaatcgtcaccgctcaacgaaaaatcgtcgtcgtcgtcgctacgc

SEQ ID NO: 15111 - DNA, 546 bp, Artificial Sequence
  chemically treated genomic DNA (Homo sapiens) CpG-island No: 15111
attaggtatacgagtattagtacggttatgagtatggtgaggttgttttggtttaggcggaagaagtagcgttggtatagtcgttttagtttgttcgacgggaattttttggagcggaatatttgtagtaacgttaggtagtaggcgtttagggatagtatcgcgtcgggtttcgcgttcgagttcgagttcgtcgagttgtcgttattttcggatttttcgtcgttttcgacggcgtcggtttttagttcgtcggtcgcgcgttttttgtttcgtcgtttttttagatttatttttatcgagcgagggcgtattttcgtttcgttcgtcgaggtagtcgtcgtcgtcgagtcgtcgtcgtcgttcgtagggggcgttcgggtgttgttttcgttggtcgcgtttcgtcgttgtcggcggttgtcgcgatcgtagtcgtcgtcgtcgcgtttttgttaggcggatttggagcggaagttgaagtcgaagttttcggttagggggtcgttatcgtttagcggaggatcgtcgtcgtcgtcgttgcgt

SEQ ID NO: 15112 - DNA, 546 bp, Artificial Sequence
  chemically treated genomic DNA (Homo sapiens) CpG-island No: 15112
acgcaacgacgacgacgacgatcctccgctaaacgataacgaccccctaaccgaaaacttcgacttcaacttccgctccaaatccgcctaacaaaaacgcgacgacgacgactacgatcgcgacaaccgccgacaacgacgaaacgcgaccaacgaaaacaacacccgaacgccccctacgaacgacgacgacgactcgacgacgacgactacctcgacgaacgaaacgaaaatacgccctcgctcgataaaaataaatctaaaaaaacgacgaaacaaaaaacgcgcgaccgacgaactaaaaaccgacgccgtcgaaaacgacgaaaaatccgaaaataacgacaactcgacgaactcgaactcgaacgcgaaacccgacgcgatactatccctaaacgcctactacctaacgttactacaaatattccgctccaaaaaattcccgtcgaacaaactaaaacgactataccaacgctacttcttccgcctaaaccaaaacaacctcaccatactcataaccgtactaatactcgtatacctaat

SEQ ID NO: 15113 - DNA, 778 bp, Artificial Sequence
  chemically treated genomic DNA (Homo sapiens) CpG-island No: 15113
cgggttaaggcgggggtgtttgagattcgttttcggggcgtaattttagcgcgcggggtttcgcggcggcgtcgggtcgggggttggggttggagggcgagtcgcgttgcggggtcggggtgtcggggatttaggagcgcgcggggttcggcgggggcgcgggcgcgtttatagtattatggtcggtaggtggtgcgcggcggcggcggcggcggcggcggcggcggcggcgagcgcgggcgcgtgcgcgtgcggggcgggtagcgcgggcgagtgtgtttgtagcgcggtgttgggcggtcggtgtcgcgcgtttttttggtgggcgcgtaggtcggttagttgcgagtaggcgttttggtatatttggtatttgtaggggcgttcgttcgtgtgtaggcgtacgtggttgcgtagcgtggacgattggttgaagcggcggttgtagaagcggtatacgaagggtttgtttagcgtgtggatgcgtatgtgcgagcgtaggttgttgcgcgagttgaagtcgcggtggtagatgacgtatcgtatgcggttcgcggggttagtcgtcgagttcgtcgggtggaagttttttggtcgcggggcggggcggggcgggggaagggagacggagaaggggagagagtagtttcgttagaatcggcgtttcgtagttcgggtttttagcgtttttagttcggggtcggttcgtttttgagggtgggtgttgtttggacggtggtagacggattggagggatagcgaagggtatttcggttgg

SEQ ID NO: 15114 - DNA, 778 bp, Artificial Sequence
  chemically treated genomic DNA (Homo sapiens) CpG-island No: 15114
ccaaccgaaatacccttcgctatccctccaatccgtctaccaccgtccaaacaacacccaccctcaaaaacgaaccgaccccgaactaaaaacgctaaaaacccgaactacgaaacgccgattctaacgaaactactctctccccttctccgtctcccttcccccgccccgccccgccccgcgaccaaaaaacttccacccgacgaactcgacgactaaccccgcgaaccgcatacgatacgtcatctaccaccgcgacttcaactcgcgcaacaacctacgctcgcacatacgcatccacacgctaaacaaacccttcgtataccgcttctacaaccgccgcttcaaccaatcgtccacgctacgcaaccacgtacgcctacacacgaacgaacgcccctacaaataccaaatataccaaaacgcctactcgcaactaaccgacctacgcgcccaccaaaaaaacgcgcgacaccgaccgcccaacaccgcgctacaaacacactcgcccgcgctacccgccccgcacgcgcacgcgcccgcgctcgccgccgccgccgccgccgccgccgccgccgccgcgcaccacctaccgaccataatactataaacgcgcccgcgcccccgccgaaccccgcgcgctcctaaatccccgacaccccgaccccgcaacgcgactcgccctccaaccccaacccccgacccgacgccgccgcgaaaccccgcgcgctaaaattacgccccgaaaacgaatctcaaacacccccgccttaacccg

SEQ ID NO: 15115 - DNA, 778 bp, Artificial Sequence
  chemically treated genomic DNA (Homo sapiens) CpG-island No: 15115
ttagtcggggtatttttcgttgtttttttagttcgtttgttatcgtttaagtagtatttatttttaaggacggatcggtttcgggttgggggcgttgagggttcgggttgcggggcgtcggttttaacggggttgtttttttttttttttcgttttttttttttcgtttcgtttcgtttcgcggttagaggatttttattcggcggattcggcggttggtttcgcgggtcgtatgcgatgcgttatttgttatcgcggttttaattcgcgtagtaatttgcgttcgtatatgcgtatttatacgttggataagtttttcgtgtgtcgtttttgtaatcgtcgttttagttagtcgtttacgttgcgtaattacgtgcgtttgtatacgggcgagcgtttttataagtgttaggtgtgttagagcgtttattcgtagttggtcggtttgcgcgtttattagaagagcgcgcggtatcggtcgtttagtatcgcgttgtaggtatattcgttcgcgttgttcgtttcgtacgcgtacgcgttcgcgttcgtcgtcgtcgtcgtcgtcgtcgtcgtcgtcgtcgcgtattatttgtcggttatggtgttgtgagcgcgttcgcgttttcgtcgggtttcgcgcgtttttgggttttcggtatttcggtttcgtagcgcgattcgttttttagttttaattttcggttcggcgtcgtcgcggagtttcgcgcgttggggttgcgtttcggaggcggattttaggtattttcgttttggttcg

SEQ ID NO: 15116 - DNA, 778 bp, Artificial Sequence
  chemically treated genomic DNA (Homo sapiens) CpG-island No: 15116
cgaaccaaaacgaaaatacctaaaatccgcctccgaaacgcaaccccaacgcgcgaaactccgcgacgacgccgaaccgaaaattaaaactaaaaaacgaatcgcgctacgaaaccgaaataccgaaaacccaaaaacgcgcgaaacccgacgaaaacgcgaacgcgctcacaacaccataaccgacaaataatacgcgacgacgacgacgacgacgacgacgacgacgacgaacgcgaacgcgtacgcgtacgaaacgaacaacgcgaacgaatatacctacaacgcgatactaaacgaccgataccgcgcgctcttctaataaacgcgcaaaccgaccaactacgaataaacgctctaacacacctaacacttataaaaacgctcgcccgtatacaaacgcacgtaattacgcaacgtaaacgactaactaaaacgacgattacaaaaacgacacacgaaaaacttatccaacgtataaatacgcatatacgaacgcaaattactacgcgaattaaaaccgcgataacaaataacgcatcgcatacgacccgcgaaaccaaccgccgaatccgccgaataaaaatcctctaaccgcgaaacgaaacgaaacgaaaaaaaaaaaacgaaaaaaaaaaaaaaacaaccccgttaaaaccgacgccccgcaacccgaaccctcaacgcccccaacccgaaaccgatccgtccttaaaaataaatactacttaaacgataacaaacgaactaaaaaaacaacgaaaaataccccgactaa

SEQ ID NO: 15117 - DNA, 1112 bp, Artificial Sequence
  chemically treated genomic DNA (Homo sapiens) CpG-island No: 15117
gggaggggtcggcgggggcgtcggggtcgagcgacggggtcgtcggggtcggtttttgagtcgggtgggttgcggagttgtttggtggttcgcgttttggtttggtttatggggaaattgaggtgtatcgagcgtcgggagagtttaggttggcgcgagtagtagcgaggtcgggtattttagtcgcgtttcgcgtatcgttaggacgggaatgggggtcgtcgggaggagggattgcgtcgggtttcgacggttggatttatcgtcggagaaggattgcgttagtatttcggcggtgaaggttgttttggggttggcgtggtggtttttgttttcgaagagttgtttttcgagtacgttgcgttagcggtcgtataggaagttgtgtaggatgtcggaggtgataatttcggttagcgttagtttcggcgtttttagttcggttttgagtattagggttttagtcgggagtacggagtttattatgggcggttcggagtttttcggcgtcgggggacggtcgggtcgacgggggaggtgggcgggcgagaggggagtttaaggggcgagaggagagcgttgcgatggagaaggaattagagtagggggaggacggagaggaggaggacgtaggagggagcgggaggtgagggggcgattgggaggaaagcgaacgagggggagaggggaagagagatggtgaaatttgtagagatggtaaaggcggcgcggagggtggagagacgcgggtggaggcggaggcgggtgcggggggtgtagggtgggtgagaggcgggtggttgtagggaagcggtagtaaggggtttaggcgcgcgttagtttttcgtatattcggtcggggtcgttttttttttggtaaaattttagcgtttttataggagtcgtagtgatttttttaattggttattaatgattttttgacgtcggaggatagatttgttgtattcggttgggttcgaggagttttcgtcgcgagagcgcgaggggcgggggcgcgcggatcgttttaaatagtatttttttattttttttttttttttttggttttttttttttttttttgttttttttttttttttcgtgggaagcgt

SEQ ID NO: 15118 - DNA, 1112 bp, Artificial Sequence
  chemically treated genomic DNA (Homo sapiens) CpG-island No: 15118
acgcttcccacgaaaaaaaaaaaaaaaacaaaaaaaaaaaaaaaaaaccaaaaaaaaaaaaaaaaaataaaaaaatactatttaaaacgatccgcgcgcccccgcccctcgcgctctcgcgacgaaaactcctcgaacccaaccgaatacaacaaatctatcctccgacgtcaaaaaatcattaataaccaattaaaaaaatcactacgactcctataaaaacgctaaaattttaccaaaaaaaaaacgaccccgaccgaatatacgaaaaactaacgcgcgcctaaaccccttactaccgcttccctacaaccacccgcctctcacccaccctacaccccccgcacccgcctccgcctccacccgcgtctctccaccctccgcgccgcctttaccatctctacaaatttcaccatctctcttcccctctccccctcgttcgctttcctcccaatcgccccctcacctcccgctccctcctacgtcctcctcctctccgtcctccccctactctaattccttctccatcgcaacgctctcctctcgccccttaaactcccctctcgcccgcccacctcccccgtcgacccgaccgtcccccgacgccgaaaaactccgaaccgcccataataaactccgtactcccgactaaaaccctaatactcaaaaccgaactaaaaacgccgaaactaacgctaaccgaaattatcacctccgacatcctacacaacttcctatacgaccgctaacgcaacgtactcgaaaaacaactcttcgaaaacaaaaaccaccacgccaaccccaaaacaaccttcaccgccgaaatactaacgcaatccttctccgacgataaatccaaccgtcgaaacccgacgcaatccctcctcccgacgacccccattcccgtcctaacgatacgcgaaacgcgactaaaatacccgacctcgctactactcgcgccaacctaaactctcccgacgctcgatacacctcaatttccccataaaccaaaccaaaacgcgaaccaccaaacaactccgcaacccacccgactcaaaaaccgaccccgacgaccccgtcgctcgaccccgacgcccccgccgacccctccc

SEQ ID NO: 15119 - DNA, 1112 bp, Artificial Sequence
  chemically treated genomic DNA (Homo sapiens) CpG-island No: 15119
gcgttttttacggggagagaaggaaaaataggaggggggaggaaggattaggaaggggagagaggagtggaggggtattgtttggagcggttcgcgcgttttcgtttttcgcgttttcgcgacgaaggtttttcgagtttagtcgggtataataagtttgtttttcgacgttagggggttattaataattaattaggagggttattgcggtttttataaaggcgttgagattttgttaaggggaagacggtttcggtcgagtgtgcgagaggttagcgcgcgtttgagttttttgttgtcgtttttttgtaattattcgttttttatttattttgtatttttcgtattcgttttcgtttttattcgcgtttttttatttttcgcgtcgtttttgttatttttatagattttattatttttttttttttttttttttcgttcgttttttttttagtcgtttttttatttttcgtttttttttgcgtttttttttttttcgttttttttttgttttggttttttttttatcgtagcgtttttttttcgttttttgggtttttttttcgttcgtttatttttttcgtcggttcggtcgtttttcggcgtcggggagtttcgggtcgtttatgatgggtttcgtgttttcggttgaggttttggtgtttaagatcgggttgaaggcgtcgggattggcgttggtcgaggttattattttcgatattttgtatagttttttgtacggtcgttggcgtaacgtgttcggggagtagtttttcgaggataagagttattacgttagttttaagatagtttttatcgtcgaggtgttggcgtagttttttttcggcggtgagtttagtcgtcggagttcggcgtaattttttttttcggcgatttttattttcgttttggcgatgcgcgagacgcggttgggatattcggtttcgttgttattcgcgttaatttgggttttttcggcgttcggtgtattttagtttttttatgggttaaattaggacgcgagttattaagtagtttcgtagtttattcggtttaaggatcgatttcggcgatttcgtcgttcggtttcgacgttttcgtcggtttttttt

SEQ ID NO: 15120 - DNA, 1112 bp, Artificial Sequence
  chemically treated genomic DNA (Homo sapiens) CpG-island No: 15120
aaaaaaaaccgacgaaaacgtcgaaaccgaacgacgaaatcgccgaaatcgatccttaaaccgaataaactacgaaactacttaataactcgcgtcctaatttaacccataaaaaaactaaaatacaccgaacgccgaaaaaacccaaattaacgcgaataacaacgaaaccgaatatcccaaccgcgtctcgcgcatcgccaaaacgaaaataaaaatcgccgaaaaaaaaaattacgccgaactccgacgactaaactcaccgccgaaaaaaaactacgccaacacctcgacgataaaaactatcttaaaactaacgtaataactcttatcctcgaaaaactactccccgaacacgttacgccaacgaccgtacaaaaaactatacaaaatatcgaaaataataacctcgaccaacgccaatcccgacgccttcaacccgatcttaaacaccaaaacctcaaccgaaaacacgaaacccatcataaacgacccgaaactccccgacgccgaaaaacgaccgaaccgacgaaaaaaataaacgaacgaaaaaaaaacccaaaaaacgaaaaaaaaacgctacgataaaaaaaaaaccaaaacaaaaaaaaaacgaaaaaaaaaaaaacgcaaaaaaaaacgaaaaataaaaaaacgactaaaaaaaaaacgaacgaaaaaaaaaaaaaaaaaaaaataataaaatctataaaaataacaaaaacgacgcgaaaaataaaaaaacgcgaataaaaacgaaaacgaatacgaaaaatacaaaataaataaaaaacgaataattacaaaaaaacgacaacaaaaaactcaaacgcgcgctaacctctcgcacactcgaccgaaaccgtcttccccttaacaaaatctcaacgcctttataaaaaccgcaataaccctcctaattaattattaataaccccctaacgtcgaaaaacaaacttattatacccgactaaactcgaaaaaccttcgtcgcgaaaacgcgaaaaacgaaaacgcgcgaaccgctccaaacaatacccctccactcctctctccccttcctaatccttcctcccccctcctatttttccttctctccccgtaaaaaacgc

SEQ ID NO: 15121 - DNA, 577 bp, Artificial Sequence
  chemically treated genomic DNA (Homo sapiens) CpG-island No: 15121
ttcgtgttattttgttatttttcgcggggtttaggcgcggaatgtgttcgcgtaaaagtttttttttttcggtcgggtcggagtttttaggtttcgtcgtttttttcgttcgttggtcgttatttggcgatttttttaatatttatgggcgttaatagagaggtttttagtatatcggtttattgtgggcggttcgtaggatttgaataggtttcggtttttttttttcggcgcggtttttcgaggggtcgggttaggagtgaatggtttcgtttttcgtttcgcgtttttttttttttttagggagaatatttttattttttttttcgttgtcgtcgtcgttcgggtttttatttacgcggtttcggtttcgggcggaacgaattaatttgtcgcggtttttcggaggttattttcgtcgttcgggtgttttttttttttgagtttacgggagtggagagagggtcgtcgcggtaggtcgacggttttacggagggatattgaaggggaagtggaggagaagagtaggggcgattcggaggggtggttgggtcggggcgggtaagatagttttagg

SEQ ID NO: 15122 - DNA, 577 bp, Artificial Sequence
  chemically treated genomic DNA (Homo sapiens) CpG-island No: 15122
cctaaaactatcttacccgccccgacccaaccacccctccgaatcgcccctactcttctcctccacttccccttcaatatccctccgtaaaaccgtcgacctaccgcgacgaccctctctccactcccgtaaactcaaaaaaaaaaaacacccgaacgacgaaaataacctccgaaaaaccgcgacaaattaattcgttccgcccgaaaccgaaaccgcgtaaataaaaacccgaacgacgacgacaacgaaaaaaaaaataaaaatattctccctaaaaaaaaaaaaaaacgcgaaacgaaaaacgaaaccattcactcctaacccgacccctcgaaaaaccgcgccgaaaaaaaaaaaccgaaacctattcaaatcctacgaaccgcccacaataaaccgatatactaaaaacctctctattaacgcccataaatattaaaaaaatcgccaaataacgaccaacgaacgaaaaaaacgacgaaacctaaaaactccgacccgaccgaaaaaaaaaaacttttacgcgaacacattccgcgcctaaaccccgcgaaaaataacaaaataacacgaa

SEQ ID NO: 15123 - DNA, 577 bp, Artificial Sequence
  chemically treated genomic DNA (Homo sapiens) CpG-island No: 15123
tttgagattgttttgttcgtttcggtttagttattttttcgggtcgtttttgttttttttttttattttttttttaatgttttttcgtggggtcgtcggtttgtcgcggcggttttttttttattttcgtgggtttaggggaagagggtattcgggcggcgaggatgattttcgaagagtcgcggtaaattgattcgtttcgttcggagtcggggtcgcgtgaatgggggttcgggcggcggcggtagcggagaagaggataaagatgttttttttgaaagggggagggggcgcggagcgggaagcggggttatttatttttggttcggtttttcgggaagtcgcgtcgaagaaagggggtcgaggtttatttaagttttacgagtcgtttataatggatcgatatattgagggtttttttattaacgtttatgaatattaaagagatcgttaagtggcggttagcgggcgaggggggcgacggagtttgagagtttcggttcggtcgaggggagggggtttttgcgcgagtatatttcgcgtttgggtttcgcggaaaatgataaaataatacggg

SEQ ID NO: 15124 - DNA, 577 bp, Artificial Sequence
  chemically treated genomic DNA (Homo sapiens) CpG-island No: 15124
cccgtattattttatcattttccgcgaaacccaaacgcgaaatatactcgcgcaaaaaccccctcccctcgaccgaaccgaaactctcaaactccgtcgcccccctcgcccgctaaccgccacttaacgatctctttaatattcataaacgttaataaaaaaaccctcaatatatcgatccattataaacgactcgtaaaacttaaataaacctcgaccccctttcttcgacgcgacttcccgaaaaaccgaaccaaaaataaataaccccgcttcccgctccgcgccccctccccctttcaaaaaaaacatctttatcctcttctccgctaccgccgccgcccgaacccccattcacgcgaccccgactccgaacgaaacgaatcaatttaccgcgactcttcgaaaatcatcctcgccgcccgaataccctcttcccctaaacccacgaaaataaaaaaaaaaccgccgcgacaaaccgacgaccccacgaaaaaacattaaaaaaaaaataaaaaaaaaaaacaaaaacgacccgaaaaaataactaaaccgaaacgaacaaaacaatctcaaa

SEQ ID NO: 15125 - DNA, 860 bp, Artificial Sequence
  chemically treated genomic DNA (Homo sapiens) CpG-island No: 15125
tttttttcgggagtttcgcgcgtttttttttttcgaaatatttgtcgggggaaaatttattttggagggtagatcgcgttcgttttaagtttggcgaatttattaaaaagatattagcggcgggggtaggtttcgcgtaggtatcgatcggtcggaatgagttcgaggaagaaaaggcgaagaatgcgttcgcgtcgcgtttagacgtttattcgtttcgtttagtttttgcgttttagtttcgtatagggagaggggttttcgcgtcgtttcgtattgtttgtgagtttcgcggttcgcggtttagtcgtttttattcgggtttttcggtatagtttttcggtaatttttttttgtcggtgttgcgtttcgttttggttttttttgcgcgtaggttttcggtcgtttttttttttcgttcgttgtcgtcgcgcgtttagtattcgcgttttttttttttttttttttttttttttttttttttttagcgtttttttttttcgttggcgtttcgattttttttttagtttcgtatatttttttcgtttttttttcgtacgtttttttttggttttttgagttttaatttttcgtagtggtttaggaaatttttttttcgcgtggggttcgcgtcgtttttttttttttattttcgtttttcgtaagacggtttagggttttagggcgttttcgtcggcgcgtataaaggcgcggttggttgttaaggcgggtgggggcgaggtcgaaaaaaacggttttaatagacgtgattcggggttaggtttgcgcggggttgtcggcggagtggcggtttcggtttagtgaatggggatagcggtttttttttttattttattttt

SEQ ID NO: 15126 - DNA, 860 bp, Artificial Sequence
  chemically treated genomic DNA (Homo sapiens) CpG-island No: 15126
aaaaataaaataaaaaaaaaaaccgctatccccattcactaaaccgaaaccgccactccgccgacaaccccgcgcaaacctaaccccgaatcacgtctattaaaaccgtttttttcgacctcgcccccacccgccttaacaaccaaccgcgcctttatacgcgccgacgaaaacgccctaaaaccctaaaccgtcttacgaaaaacgaaaataaaaaaaaaaaaacgacgcgaaccccacgcgaaaaaaaaatttcctaaaccactacgaaaaattaaaactcaaaaaaccaaaaaaaaacgtacgaaaaaaaaacgaaaaaaatatacgaaactaaaaaaaaaatcgaaacgccaacgaaaaaaaaaaacgctaaaaaaaaaaaaaaaaaaaaaaaaaaaaaaaaaaaaaacgcgaatactaaacgcgcgacgacaacgaacgaaaaaaaaaaacgaccgaaaacctacgcgcaaaaaaaaccaaaacgaaacgcaacaccgacaaaaaaaaattaccgaaaaactataccgaaaaacccgaataaaaacgactaaaccgcgaaccgcgaaactcacaaacaatacgaaacgacgcgaaaacccctctccctatacgaaactaaaacgcaaaaactaaacgaaacgaataaacgtctaaacgcgacgcgaacgcattcttcgccttttcttcctcgaactcattccgaccgatcgatacctacgcgaaacctacccccgccgctaatatctttttaataaattcgccaaacttaaaacgaacgcgatctaccctccaaaataaattttcccccgacaaatatttcgaaaaaaaaaaacgcgcgaaactcccgaaaaaaa

SEQ ID NO: 15127 - DNA, 860 bp, Artificial Sequence
  chemically treated genomic DNA (Homo sapiens) CpG-island No: 15127
aggggtggggtgggagagggggtcgttgtttttatttattgagtcgaggtcgttatttcgtcggtagtttcgcgtaggtttggtttcgagttacgtttgttgaaatcgtttttttcggtttcgtttttattcgttttggtagttagtcgcgtttttgtacgcgtcggcgggggcgttttggaattttgaatcgttttacggggaacgggggtggggggaggggagcggcgcgggttttacgcgaggaaggaattttttgggttattgcgaaagattgaggtttagaaagttagagagagacgtgcgaggaggaagcggagagggtgtgcgaagttggagagggagtcggagcgttagcgaaagaggggagcgttggggaaggaggaagagaaggagagggggagaagagagacgcggatgttgggcgcgcgacggtagcgggcggaggaggggagcggtcgggaatttgcgcgtaggggaagttaggacggagcgtagtatcggtaggggagggttgtcgaggggttgtgtcgaggagttcgggtgggggcggttggatcgcgggtcgcgggatttatagatagtgcgaggcggcgcgggggtttttttttttatgcggggttggggcgtaggggttgggcggggcgggtgggcgtttgagcgcggcgcgggcgtatttttcgttttttttttttcgggtttatttcggtcgatcgatatttgcgcgggatttgttttcgtcgttaatatttttttaatgagttcgttaggtttaaagcgagcgcgatttgttttttagggtggattttttttcggtagatgtttcgggaggaggaggcgcgcggagttttcgggagggg

SEQ ID NO: 15128 - DNA, 860 bp, Artificial Sequence
  chemically treated genomic DNA (Homo sapiens) CpG-island No: 15128
cccctcccgaaaactccgcgcgcctcctcctcccgaaacatctaccgaaaaaaaatccaccctaaaaaacaaatcgcgctcgctttaaacctaacgaactcattaaaaaaatattaacgacgaaaacaaatcccgcgcaaatatcgatcgaccgaaataaacccgaaaaaaaaaaaacgaaaaatacgcccgcgccgcgctcaaacgcccacccgccccgcccaacccctacgccccaaccccgcataaaaaaaaaaacccccgcgccgcctcgcactatctataaatcccgcgacccgcgatccaaccgcccccacccgaactcctcgacacaacccctcgacaaccctcccctaccgatactacgctccgtcctaacttcccctacgcgcaaattcccgaccgctcccctcctccgcccgctaccgtcgcgcgcccaacatccgcgtctctcttctccccctctccttctcttcctccttccccaacgctcccctctttcgctaacgctccgactccctctccaacttcgcacaccctctccgcttcctcctcgcacgtctctctctaactttctaaacctcaatctttcgcaataacccaaaaaattccttcctcgcgtaaaacccgcgccgctcccctccccccacccccgttccccgtaaaacgattcaaaattccaaaacgcccccgccgacgcgtacaaaaacgcgactaactaccaaaacgaataaaaacgaaaccgaaaaaaacgatttcaacaaacgtaactcgaaaccaaacctacgcgaaactaccgacgaaataacgacctcgactcaataaataaaaacaacgaccccctctcccaccccacccct

SEQ ID NO: 15129 - DNA, 530 bp, Artificial Sequence
  chemically treated genomic DNA (Homo sapiens) CpG-island No: 15129
ggtgtcgtcgcggcgttgttttttcgtttttttcgttttttttttttgttttttagagttttattttggaggtcgttattttcgtttaggttttgagcgagcgcgttttaatacgtttgcgtcgttatcgtttaggttgttacgagatttagttagttgattttaattttttcgttttttgtttcgtttttttcgtttttttcgtttcgatcgttttttttttgaaattttgttttttttcggttagtttttagtagttatatatgcgtagagtaacgatatcggtcgtgggatttggattttacgtagcgcgttagggggttggcgtttcggtgggtgttgaaaaggatacgtttttgggcgcgcgcgggtgtttatgattacgttttttcggcgggtgtttatgattacgttttttcggcgtgtgttttagggtcgcgttttttcgtttatgttttgcggagagtagggtcgtaattcggtatttaagttttaagttcgaggaaattttgttttaaattatttttttt

SEQ ID NO: 15130 - DNA, 530 bp, Artificial Sequence
  chemically treated genomic DNA (Homo sapiens) CpG-island No: 15130
aaaaaaaataatttaaaacaaaatttcctcgaacttaaaacttaaataccgaattacgaccctactctccgcaaaacataaacgaaaaaacgcgaccctaaaacacacgccgaaaaaacgtaatcataaacacccgccgaaaaaacgtaatcataaacacccgcgcgcgcccaaaaacgtatccttttcaacacccaccgaaacgccaaccccctaacgcgctacgtaaaatccaaatcccacgaccgatatcgttactctacgcatatataactactaaaaactaaccgaaaaaaaacaaaatttcaaaaaaaaaacgatcgaaacgaaaaaaacgaaaaaaacgaaacaaaaaacgaaaaaattaaaatcaactaactaaatctcgtaacaacctaaacgataacgacgcaaacgtattaaaacgcgctcgctcaaaacctaaacgaaaataacgacctccaaaataaaactctaaaaaacaaaaaaaaaaaacgaaaaaaacgaaaaaacaacgccgcgacgacacc

SEQ ID NO: 15131 - DNA, 530 bp, Artificial Sequence
  chemically treated genomic DNA (Homo sapiens) CpG-island No: 15131
aaaagaggtgatttaaaataagattttttcggatttaaagtttaagtatcgggttgcgattttatttttcgtaggatataagcggaggggcgcggttttaaggtatacgtcggaggggcgtggttatgggtattcgtcggaggggcgtggttatgggtattcgcgcgcgtttaggggcgtgttttttttagtatttatcgaggcgttagttttttgacgcgttgcgtggaatttaaattttacggtcggtgtcgttattttgcgtatgtgtagttgttgggggttggtcggaggaaagtagaattttagggaaagaacgatcgggacggggaggacggggagggcggggtagaagacggaagagttgaaattagttgattgggtttcgtgatagtttgggcggtggcgacgtaggcgtattagagcgcgttcgtttaaagtttgagcgaagatggcggtttttagagtgaaattttgagaggtagagggaggaggcggagggggcggggaggtagcgtcgcggcggtatt

SEQ ID NO: 15132 - DNA, 530 bp, Artificial Sequence
  chemically treated genomic DNA (Homo sapiens) CpG-island No: 15132
aataccgccgcgacgctacctccccgccccctccgcctcctccctctacctctcaaaatttcactctaaaaaccgccatcttcgctcaaactttaaacgaacgcgctctaatacgcctacgtcgccaccgcccaaactatcacgaaacccaatcaactaatttcaactcttccgtcttctaccccgccctccccgtcctccccgtcccgatcgttctttccctaaaattctactttcctccgaccaacccccaacaactacacatacgcaaaataacgacaccgaccgtaaaatttaaattccacgcaacgcgtcaaaaaactaacgcctcgataaatactaaaaaaaacacgcccctaaacgcgcgcgaatacccataaccacgcccctccgacgaatacccataaccacgcccctccgacgtataccttaaaaccgcgcccctccgcttatatcctacgaaaaataaaatcgcaacccgatacttaaactttaaatccgaaaaaatcttattttaaatcacctctttt

SEQ ID NO: 15133 - DNA, 665 bp, Artificial Sequence
  chemically treated genomic DNA (Homo sapiens) CpG-island No: 15133
agggataacgttttcgtcgtgtagaagtagtatcggtttattttgtgcgtcgtttacgggtcgggtcgggtcgtattcgttagggatttaattgtaaggagggaggagtcgtcgtagaggcgtcgaagattcgggatttttcggcgttacgtttacgttttttcggcgtacggttcgtgcgcgtagttttgggtttcgcggtttggcgagcgcggtttcgggtgtatcgggcggatggggtcgcggagggacgggttcggattcggtttcggtttttttcgtcgggtagtcgtggcgttcgtttagcgtagttcgggagagtgtagggagcgcgtagggacgtgacgttcgcgggtcgggttcgtcgtaatttcgcgaggtaatcgtcggcgattgcgcggggaggcgggcgggggcggaggtcgtagttatgtgttttgcggcggcggtagtgattcggttcgcgtttttttcggtcggttttcggtggttttgagtggttgcggcgtttgagttaggttcggtttggtcgtttttagcgttttgtatcgtaggtttagcgttcgttttatcgaaattgtcgaatttggtttatatatttatttatttatttcgtagataggtttgagggttttttatgggttacgcgttggggatttaaggtg

SEQ ID NO: 15134 - DNA, 665 bp, Artificial Sequence
  chemically treated genomic DNA (Homo sapiens) CpG-island No: 15134
caccttaaatccccaacgcgtaacccataaaaaaccctcaaacctatctacgaaataaataaataaatatataaaccaaattcgacaatttcgataaaacgaacgctaaacctacgatacaaaacgctaaaaacgaccaaaccgaacctaactcaaacgccgcaaccactcaaaaccaccgaaaaccgaccgaaaaaaacgcgaaccgaatcactaccgccgccgcaaaacacataactacgacctccgcccccgcccgcctccccgcgcaatcgccgacgattacctcgcgaaattacgacgaacccgacccgcgaacgtcacgtccctacgcgctccctacactctcccgaactacgctaaacgaacgccacgactacccgacgaaaaaaaccgaaaccgaatccgaacccgtccctccgcgaccccatccgcccgatacacccgaaaccgcgctcgccaaaccgcgaaacccaaaactacgcgcacgaaccgtacgccgaaaaaacgtaaacgtaacgccgaaaaatcccgaatcttcgacgcctctacgacgactcctccctccttacaattaaatccctaacgaatacgacccgacccgacccgtaaacgacgcacaaaataaaccgatactacttctacacgacgaaaacgttatccct

SEQ ID NO: 15135 - DNA, 665 bp, Artificial Sequence
  chemically treated genomic DNA (Homo sapiens) CpG-island No: 15135
tattttgaatttttagcgcgtggtttatgggaggtttttagatttatttgcggaatgagtaaatgagtgtgtgaattaggttcggtaatttcggtggggcgagcgttgggtttgcggtgtagggcgttgggagcggttaggtcgggtttggtttaggcgtcgtagttatttagggttatcggggatcggtcggggagggcgcgggtcgaattattgtcgtcgtcgtagggtatatgattgcggttttcgttttcgttcgttttttcgcgtagtcgtcggcggttgtttcgcggggttgcggcgagttcggttcgcgaacgttacgtttttgcgcgttttttgtattttttcgagttgcgttaggcgggcgttacggttgttcggcgaaggaaatcgaaatcgagttcgggttcgttttttcgcggttttattcgttcggtgtattcggggtcgcgttcgttaggtcgcggagtttagagttgcgcgtacgaatcgtgcgtcgggagggcgtgggcgtggcgtcgaagggtttcgggttttcgacgtttttgcggcggtttttttttttttgtagttggatttttggcgggtgcggttcggttcggttcgtgagcggcgtatagaatgggtcgatgttgtttttatacggcggggacgttgttttt

SEQ ID NO: 15136 - DNA, 665 bp, Artificial Sequence
  chemically treated genomic DNA (Homo sapiens) CpG-island No: 15136
aaaaacaacgtccccgccgtataaaaacaacatcgacccattctatacgccgctcacgaaccgaaccgaaccgcacccgccaaaaatccaactacaaaaaaaaaaaaaccgccgcaaaaacgtcgaaaacccgaaacccttcgacgccacgcccacgccctcccgacgcacgattcgtacgcgcaactctaaactccgcgacctaacgaacgcgaccccgaatacaccgaacgaataaaaccgcgaaaaaacgaacccgaactcgatttcgatttccttcgccgaacaaccgtaacgcccgcctaacgcaactcgaaaaaatacaaaaaacgcgcaaaaacgtaacgttcgcgaaccgaactcgccgcaaccccgcgaaacaaccgccgacgactacgcgaaaaaacgaacgaaaacgaaaaccgcaatcatataccctacgacgacgacaataattcgacccgcgccctccccgaccgatccccgataaccctaaataactacgacgcctaaaccaaacccgacctaaccgctcccaacgccctacaccgcaaacccaacgctcgccccaccgaaattaccgaacctaattcacacactcatttactcattccgcaaataaatctaaaaacctcccataaaccacgcgctaaaaattcaaaata

SEQ ID NO: 15137 - DNA, 567 bp, Artificial Sequence
  chemically treated genomic DNA (Homo sapiens) CpG-island No: 15137
cgttcgaagttggaggggtcgtcggagtttgcgattggttgtttcgggtatatcgtttcgtttcgatttgtagttttttttaggttttcgttgttaaggacgcgtcgtcggttgttgttaagatggcggttgtagggttgttgtcgttttatttgttattgttcggcgaggtcgtcgttgttttagttgttatcgtcgttataggtattagtgtcgttgcgcgggagttagggttgtcgaggttaattttttcgcgttcgtgacgcggggtttgagagacggagtgtagggaggggtcgagtaggaggaggaggaagtcggagttgttatgagggaggttttgggggcgagtagataggcggcgttgaagtgaaggatgttggcggggaggttcggaattcggagcgcggtcggggaattgggtattgaattatcggataatttcgatagagtttttttcggttttcgggagagcggcgggtattatcgatttggtttttatttgtattttttttagtttgtggttgttagggtagcgatgttgaaaacggggtttattttttttta

SEQ ID NO: 15138 - DNA, 567 bp, Artificial Sequence
  chemically treated genomic DNA (Homo sapiens) CpG-island No: 15138
taaaaaaaaataaaccccgttttcaacatcgctaccctaacaaccacaaactaaaaaaaatacaaataaaaaccaaatcgataatacccgccgctctcccgaaaaccgaaaaaaactctatcgaaattatccgataattcaatacccaattccccgaccgcgctccgaattccgaacctccccgccaacatccttcacttcaacgccgcctatctactcgcccccaaaacctccctcataacaactccgacttcctcctcctcctactcgacccctccctacactccgtctctcaaaccccgcgtcacgaacgcgaaaaaattaacctcgacaaccctaactcccgcgcaacgacactaatacctataacgacgataacaactaaaacaacgacgacctcgccgaacaataacaaataaaacgacaacaaccctacaaccgccatcttaacaacaaccgacgacgcgtccttaacaacgaaaacctaaaaaaaactacaaatcgaaacgaaacgatatacccgaaacaaccaatcgcaaactccgacgacccctccaacttcgaacg

SEQ ID NO: 15139 - DNA, 567 bp, Artificial Sequence
  chemically treated genomic DNA (Homo sapiens) CpG-island No: 15139
tggaaaaagatgggtttcgtttttaatatcgttattttggtagttataggttgggaaggatataggtaagagttaggtcggtgatgttcgtcgttttttcgagggtcgaggggggttttgtcgaggttgttcgatgatttagtgtttagtttttcgatcgcgtttcgggtttcgggttttttcgttagtattttttattttagcgtcgtttgtttgttcgtttttagaattttttttatggtagtttcggtttttttttttttttgttcggtttttttttatatttcgttttttaggtttcgcgttacgggcgcggaagggttggtttcgatagttttagttttcgcgtagcggtattggtgtttgtagcggcgatggtagttgaggtagcggcgatttcgtcgggtaatagtagatggggcggtagtaattttgtagtcgttattttgataataatcgacggcgcgtttttgataacggaaatttgggaggagttataggtcggggcgggacgatgtgttcgaagtagttaatcgtaggtttcggcggtttttttagtttcgagcg

SEQ ID NO: 15140 - DNA, 567 bp, Artificial Sequence
  chemically treated genomic DNA (Homo sapiens) CpG-island No: 15140
cgctcgaaactaaaaaaaccgccgaaacctacgattaactacttcgaacacatcgtcccgccccgacctataactcctcccaaatttccgttatcaaaaacgcgccgtcgattattatcaaaataacgactacaaaattactaccgccccatctactattacccgacgaaatcgccgctacctcaactaccatcgccgctacaaacaccaataccgctacgcgaaaactaaaactatcgaaaccaacccttccgcgcccgtaacgcgaaacctaaaaaacgaaatataaaaaaaaaccgaacaaaaaaaaaaaaaaaccgaaactaccataaaaaaaattctaaaaacgaacaaacaaacgacgctaaaataaaaaatactaacgaaaaaacccgaaacccgaaacgcgatcgaaaaactaaacactaaatcatcgaacaacctcgacaaaacccccctcgaccctcgaaaaaacgacgaacatcaccgacctaactcttacctatatccttcccaacctataactaccaaaataacgatattaaaaacgaaacccatctttttcca

SEQ ID NO: 15141 - DNA, 513 bp, Artificial Sequence
  chemically treated genomic DNA (Homo sapiens) CpG-island No: 15141
atttatcgcgcgttttcgtgtttttatttacggttatgtcgcgcgtttcgtaggcggttgtattgtacgcgtaattatatttatatgtatttgtttttgttttttatgttgcgcgtcgtgagtattttcgttaaggacgttgtgttttattttggcgttacgtttgatgaggttgagcgttttatcgaggaggagttgcgcgttatcgtttaggcgttttcgtcgtttgttatcgtcgttgtcggttacgtgagtatttttttgttcgttcgttttcggtgtcgttattggtttcgtggggtttcgtttcgtttcgttttagttcggttttcgttttgttcgttttttgttagcgttattggttttagttatttaaattcgttttatagggtttttcgtaatttttagttttgtcgtcgattttgttgttaagggtttcgagtgttttatacgtttcgcgttgttattaaggtttttattttaatttagtattttttagttattttatttttt

SEQ ID NO: 15142 - DNA, 513 bp, Artificial Sequence
  chemically treated genomic DNA (Homo sapiens) CpG-island No: 15142
aaaaaataaaataactaaaaaatactaaattaaaataaaaaccttaataacaacgcgaaacgtataaaacactcgaaacccttaacaacaaaatcgacgacaaaactaaaaattacgaaaaaccctataaaacgaatttaaataactaaaaccaataacgctaacaaaaaacgaacaaaacgaaaaccgaactaaaacgaaacgaaacgaaaccccacgaaaccaataacgacaccgaaaacgaacgaacaaaaaaatactcacgtaaccgacaacgacgataacaaacgacgaaaacgcctaaacgataacgcgcaactcctcctcgataaaacgctcaacctcatcaaacgtaacgccaaaataaaacacaacgtccttaacgaaaatactcacgacgcgcaacataaaaaacaaaaacaaatacatataaatataattacgcgtacaatacaaccgcctacgaaacgcgcgacataaccgtaaataaaaacacgaaaacgcgcgataaat

SEQ ID NO: 15143 - DNA, 513 bp, Artificial Sequence
  chemically treated genomic DNA (Homo sapiens) CpG-island No: 15143
aagaggtagagtggttagagggtattgggttgaggtaggagttttgatggtagcgcggggcgtgtgggatattcggagtttttggtagtagggtcggcggtagagttgagggttgcgagggattttataagacgggtttgagtggttgaagttagtggcgttggtaggaggcgggtagggcgagggtcgggttggagcggggcggggcggggttttacgaggttagtggcggtatcgggagcgggcgggtagaggggtatttacgtagtcggtagcggcggtggtaggcggcgggggcgtttgggcgatggcgcgtagttttttttcggtgaggcgtttagttttattaagcgtggcgttagagtagagtatagcgtttttgacgaagatgtttacggcgcgtagtatgaaggataggaataggtgtatgtggatgtagttgcgcgtgtagtgtagtcgtttgcggggcgcgcgatatgatcgtgggtgggggtacggggacgcgcggtgggt

SEQ ID NO: 15144 - DNA, 513 bp, Artificial Sequence
  chemically treated genomic DNA (Homo sapiens) CpG-island No: 15144
acccaccgcgcgtccccgtacccccacccacgatcatatcgcgcgccccgcaaacgactacactacacgcgcaactacatccacatacacctattcctatccttcatactacgcgccgtaaacatcttcgtcaaaaacgctatactctactctaacgccacgcttaataaaactaaacgcctcaccgaaaaaaaactacgcgccatcgcccaaacgcccccgccgcctaccaccgccgctaccgactacgtaaatacccctctacccgcccgctcccgataccgccactaacctcgtaaaaccccgccccgccccgctccaacccgaccctcgccctacccgcctcctaccaacgccactaacttcaaccactcaaacccgtcttataaaatccctcgcaaccctcaactctaccgccgaccctactaccaaaaactccgaatatcccacacgccccgcgctaccatcaaaactcctacctcaacccaataccctctaaccactctacctctt

SEQ ID NO: 15145 - DNA, 576 bp, Artificial Sequence
  chemically treated genomic DNA (Homo sapiens) CpG-island No: 15145
ttgtttcggagtgttggcggcgggggatttattagcgcgtacgcggagttgagtacggggtagtagagtaggagcgttaggtcgggtgcgattcgggcggtttttatcgttatcgtttagggtcgcgtttttcggggtagtcgtcgtcgtcggttttggtggtggtagggggtgtagagttgcgttaggttggtcgtttcgtttacgtttcggtttatgggatttcggcgtttcggcggttcgaggtttcggggttcggcgcggggtttatgcgttgagggcgagcgagcgagcgagcgagcgagtagcgtaaaggagggagggagggagggataggagggagggagggagagtcggaggtcgggcgggcggcgggcgggcgtcgagcgttgcggagcggttcgtttgtttcggagcgaagaaattatatttatatggtcgggttcgtttttttcggttcgttattcgtttttttttcgcgtcgtttttttttttttttttttttttttttttttttttttttttttttggggaaatgggagttgtggtttcgttttacgtttagtggggggaggg

SEQ ID NO: 15146 - DNA, 576 bp, Artificial Sequence
  chemically treated genomic DNA (Homo sapiens) CpG-island No: 15146
ccctccccccactaaacgtaaaacgaaaccacaactcccatttccccaaaaaaaaaaaaaaaaaaaaaaaaaaaaaaaaaaaaaaaaaaaaacgacgcgaaaaaaaaacgaataacgaaccgaaaaaaacgaacccgaccatataaatataatttcttcgctccgaaacaaacgaaccgctccgcaacgctcgacgcccgcccgccgcccgcccgacctccgactctccctccctccctcctatccctccctccctccctcctttacgctactcgctcgctcgctcgctcgctcgccctcaacgcataaaccccgcgccgaaccccgaaacctcgaaccgccgaaacgccgaaatcccataaaccgaaacgtaaacgaaacgaccaacctaacgcaactctacaccccctaccaccaccaaaaccgacgacgacgactaccccgaaaaacgcgaccctaaacgataacgataaaaaccgcccgaatcgcacccgacctaacgctcctactctactaccccgtactcaactccgcgtacgcgctaataaatcccccgccgccaacactccgaaacaa

SEQ ID NO: 15147 - DNA, 576 bp, Artificial Sequence
  chemically treated genomic DNA (Homo sapiens) CpG-island No: 15147
ttttttttttattgggcgtggggcgaagttatagtttttatttttttaaaagaaaaaaaaagaaagaaagaaagaaagaaagaaagaaaaggcggcgcgggaggggggcgggtggcgggtcgggggaggcgggttcggttatatggatgtgattttttcgtttcgaggtagacgggtcgtttcgtagcgttcggcgttcgttcgtcgttcgttcggttttcggtttttttttttttttttttgttttttttttttttttttttttgcgttgttcgttcgttcgttcgttcgttcgtttttagcgtatgggtttcgcgtcgggtttcggggtttcgggtcgtcgggacgtcggggttttataggtcggggcgtgggcggggcggttagtttgacgtagttttgtattttttattattattagggtcggcggcggcggttgtttcgagggacgcggttttaggcggtggcgatggggatcgttcggatcgtattcggtttggcgtttttgttttgttgtttcgtgtttagtttcgcgtacgcgttggtgagtttttcgtcgttaatatttcgggatag

SEQ ID NO: 15148 - DNA, 576 bp, Artificial Sequence
  chemically treated genomic DNA (Homo sapiens) CpG-island No: 15148
ctatcccgaaatattaacgacgaaaaactcaccaacgcgtacgcgaaactaaacacgaaacaacaaaacaaaaacgccaaaccgaatacgatccgaacgatccccatcgccaccgcctaaaaccgcgtccctcgaaacaaccgccgccgccgaccctaataataataaaaaatacaaaactacgtcaaactaaccgccccgcccacgccccgacctataaaaccccgacgtcccgacgacccgaaaccccgaaacccgacgcgaaacccatacgctaaaaacgaacgaacgaacgaacgaacgaacaacgcaaaaaaaaaaaaaaaaaaaaaacaaaaaaaaaaaaaaaaaaaccgaaaaccgaacgaacgacgaacgaacgccgaacgctacgaaacgacccgtctacctcgaaacgaaaaaatcacatccatataaccgaacccgcctcccccgacccgccacccgcccccctcccgcgccgccttttctttctttctttctttctttctttctttttttttcttttaaaaaaataaaaactataacttcgccccacgcccaataaaaaaaaaa

SEQ ID NO: 15149 - DNA, 1371 bp, Artificial Sequence
  chemically treated genomic DNA (Homo sapiens) CpG-island No: 15149
ggggtcgcggtttgcggggggcgcgtaggattgttatttttagtttcgcgattttcggcgtagggagttagggtcgggtagggggcgcgttttgagtcgcgcggggcgtgtagttagggggtgcgattttaattttgtagttatattgagtttttaggtgtttcggtcgttagttttcggtcgttcggttttttgagattttagattttcggtagtcgtttttcgtattttttttttatttttggttaaagtttcgtttgcgtttgtgcggttcgggcgcgtagcggtttcgacgttttgtcggtttgtttgtttgttagttcgtttttagttttttcggttttggttttagtttttttagcggttttaagtttcgtttcggttattttttcgtttttttttttttttttttttttttacgaaaatatttgtaagtttttaaaaaagttatcgagtcgagcggcgcggggttggcgattttttcgggtttcgaggaggcgtcgtcgattgatatcgagatagagtagtttggttgtttcggttaggttcggagtcgttttttttcgatttcggttattttttttcggcgcgggtttttagtttcgatttatttcgagcgcgtcgtcgcggttttcgttttgttatggatgtcggggttttttcgatagtttttttaagttagcgtttcgttcgcggtttcggggggattttatggagttttcgggatatttttcgttggtcggtttggtttttagcgtttttcgttcggtcgtcgttcggagttatcgttcgtcgcgcgtatttttcgtttcggcgtttgtcgtttttttttttttcggtcgggcgttttttttttttttcgcgttttttcgggtttttttcgtttttatttttttcgtagtcgtcgacgcgggagtgtggagaggtcgagaggagtttttcgtttttcgtttcgggatattgcgttagaggtcgaggttcggagttttacggcggcgggatgtgagtgttggggagacggggcgggggtagttgtaatatcgagattcgagtagggaattcgggacgtcgtcgtcgttttatttttttttggaaagtacgggtttttaaatttttttttttttgattattcggttttcgttggcgaatagagattttgagtcgagaagcgagtttttttttattatgggcgaattttttgaggaggttgttcggtattttcgcgcgttttcggtcgcgacgttgttagtttattgggttttcgttcgggtcgggtcggggtttttggggaggtcgttcggttgttagtttcgagttcggtttggttgttgtcgtttttttttacgtttagttttattttcgtttcgtttt

SEQ ID NO: 15150 - DNA, 1371 bp, Artificial Sequence
  chemically treated genomic DNA (Homo sapiens) CpG-island No: 15150
aaaacgaaacgaaaataaaactaaacgtaaaaaaaaacgacaacaaccaaaccgaactcgaaactaacaaccgaacgacctccccaaaaaccccgacccgacccgaacgaaaacccaataaactaacaacgtcgcgaccgaaaacgcgcgaaaataccgaacaacctcctcaaaaaattcgcccataataaaaaaaaactcgcttctcgactcaaaatctctattcgccaacgaaaaccgaataatcaaaaaaaaaaaaatttaaaaacccgtactttccaaaaaaaaataaaacgacgacgacgtcccgaattccctactcgaatctcgatattacaactacccccgccccgtctccccaacactcacatcccgccgccgtaaaactccgaacctcgacctctaacgcaatatcccgaaacgaaaaacgaaaaactcctctcgacctctccacactcccgcgtcgacgactacgaaaaaaataaaaacgaaaaaaacccgaaaaaacgcgaaaaaaaaaaaaaacgcccgaccgaaaaaaaaaaaaacgacaaacgccgaaacgaaaaatacgcgcgacgaacgataactccgaacgacgaccgaacgaaaaacgctaaaaaccaaaccgaccaacgaaaaatatcccgaaaactccataaaatccccccgaaaccgcgaacgaaacgctaacttaaaaaaactatcgaaaaaaccccgacatccataacaaaacgaaaaccgcgacgacgcgctcgaaataaatcgaaactaaaaacccgcgccgaaaaaaaataaccgaaatcgaaaaaaaacgactccgaacctaaccgaaacaaccaaactactctatctcgatatcaatcgacgacgcctcctcgaaacccgaaaaaatcgccaaccccgcgccgctcgactcgataacttttttaaaaacttacaaatattttcgtaaaaaaaaaaaaaaaaaaaaaaaaacgaaaaaataaccgaaacgaaacttaaaaccgctaaaaaaactaaaaccaaaaccgaaaaaactaaaaacgaactaacaaacaaacaaaccgacaaaacgtcgaaaccgctacgcgcccgaaccgcacaaacgcaaacgaaactttaaccaaaaataaaaaaaaaatacgaaaaacgactaccgaaaatctaaaatctcaaaaaaccgaacgaccgaaaactaacgaccgaaacacctaaaaactcaatataactacaaaattaaaatcgcaccccctaactacacgccccgcgcgactcaaaacgcgccccctacccgaccctaactccctacgccgaaaatcgcgaaactaaaaataacaatcctacgcgccccccgcaaaccgcgacccc

SEQ ID NO: 15151 - DNA, 1371 bp, Artificial Sequence
  chemically treated genomic DNA (Homo sapiens) CpG-island No: 15151
gggacgaggcgagggtggggttggacgtgggggagggcggtagtagttaagtcgggttcggggttggtagtcgagcggtttttttagggatttcgattcggttcgaacgggagtttagtggattgatagcgtcgcggtcgggggcgcgcgggggtatcgggtagtttttttaggggattcgtttatgatgaaagagggttcgtttttcggtttagggtttttattcgttagcgggggtcggatgattaagggaaaaaaaatttaaaagttcgtgttttttagaagagaatgaagcggcggcggcgtttcgggttttttgttcgggtttcgatgttatagttgttttcgtttcgtttttttagtatttatatttcgtcgtcgtaagatttcgggtttcggtttttagcgtaatgtttcggggcggggggcggaaggtttttttcggtttttttatattttcgcgtcggcggttgcggagggggtgggggcgggagaggttcgggagggcgcgggggagggaagaggcgttcggtcggggagaaggggagcggtagacgtcgaggcgagggatgcgcgcggcgggcggtggtttcgagcggcggtcgggcggggggcgttggaggttaggtcggttagcggggggtatttcgagagttttatgaagttttttcggggtcgcggacggggcgttggtttggggaggttgtcgggggggtttcgatatttatggtaaggcgggggtcgcggcggcgcgttcggagtaagtcggggttggggattcgcgtcgaggggaagtggtcggagtcggggaggagcgatttcgggtttggtcggagtagttaggttgttttgtttcggtgttagtcggcggcgttttttcggaattcgggggagtcgttagtttcgcgtcgttcggttcggtggtttttttggaaatttgtaaatgttttcgtagagagaaaagggggagggagggagcgagggagtgatcgaaacggagtttggggtcgttggaagaattgaggttaaggtcgggggagttagagacggattgatagataggtagatcgatagagcgtcggggtcgttgcgcgttcgagtcgtataggcgtaagcggggttttggttaaggatggggaaggggtgcgggaggcggttgtcgagggtttgggattttaggaggtcgaacggtcgggggttggcggtcggaatatttaagggtttagtgtggttgtaaagttgagatcgtattttttaattgtacgtttcgcgcggtttagaacgcgttttttgttcggttttgattttttacgtcgaaagtcgcggagttaaaaataatagttttgcgcgtttttcgtagatcgcgatttt

SEQ ID NO: 15152 - DNA, 1371 bp, Artificial Sequence
  chemically treated genomic DNA (Homo sapiens) CpG-island No: 15152
aaaatcgcgatctacgaaaaacgcgcaaaactattatttttaactccgcgactttcgacgtaaaaaatcaaaaccgaacaaaaaacgcgttctaaaccgcgcgaaacgtacaattaaaaaatacgatctcaactttacaaccacactaaacccttaaatattccgaccgccaacccccgaccgttcgacctcctaaaatcccaaaccctcgacaaccgcctcccgcaccccttccccatccttaaccaaaaccccgcttacgcctatacgactcgaacgcgcaacgaccccgacgctctatcgatctacctatctatcaatccgtctctaactcccccgaccttaacctcaattcttccaacgaccccaaactccgtttcgatcactccctcgctccctccctcccccttttctctctacgaaaacatttacaaatttccaaaaaaaccaccgaaccgaacgacgcgaaactaacgactcccccgaattccgaaaaaacgccgccgactaacaccgaaacaaaacaacctaactactccgaccaaacccgaaatcgctcctccccgactccgaccacttcccctcgacgcgaatccccaaccccgacttactccgaacgcgccgccgcgacccccgccttaccataaatatcgaaacccccccgacaacctccccaaaccaacgccccgtccgcgaccccgaaaaaacttcataaaactctcgaaataccccccgctaaccgacctaacctccaacgccccccgcccgaccgccgctcgaaaccaccgcccgccgcgcgcatccctcgcctcgacgtctaccgctccccttctccccgaccgaacgcctcttccctcccccgcgccctcccgaacctctcccgcccccaccccctccgcaaccgccgacgcgaaaatataaaaaaaccgaaaaaaaccttccgccccccgccccgaaacattacgctaaaaaccgaaacccgaaatcttacgacgacgaaatataaatactaaaaaaacgaaacgaaaacaactataacatcgaaacccgaacaaaaaacccgaaacgccgccgccgcttcattctcttctaaaaaacacgaacttttaaattttttttcccttaatcatccgacccccgctaacgaataaaaaccctaaaccgaaaaacgaaccctctttcatcataaacgaatcccctaaaaaaactacccgatacccccgcgcgcccccgaccgcgacgctatcaatccactaaactcccgttcgaaccgaatcgaaatccctaaaaaaaccgctcgactaccaaccccgaacccgacttaactactaccgccctcccccacgtccaaccccaccctcgcctcgtccc

SEQ ID NO: 15153 - DNA, 591 bp, Artificial Sequence
  chemically treated genomic DNA (Homo sapiens) CpG-island No: 15153
cgcgggggtgggttgttatgaagtgtacgatcgcgagttttgtttttaaggtataagtgttagaggtattcggcgggttgggggtatatacgtgtgtgcggagtcggagtatgttttgcgcgcgcgcgttcgcgcgcgcggttacgcggttttagcggcgcggggcgttaggtgtagtaggcgcggggcgcgcgaagttgggggtatcgcgggtgcgggtgcgggcgcggggcggggcgggtttatttgcgcgtagtagagtagttataattcgtatagtcgtttcgaggcggttatggttcggttcggtttcggttttgttgcgcgttatttgtcgtcgtttttttcgcgtcgttcgtcggttgttttcggttaggtttatgggcggagggcgttatttcggggcggagcggcgcggtattattggggaagtttgcggttgtggttttcgcggcgtagagttatttaagtttgttcgttttttttttttattgtcggtcgtcgtttagttttttgtatttcgttgtagttatcgtcgtttcgttttttttgggattatgtaaagggcggagagtttggtaggaggagggg

SEQ ID NO: 15154 - DNA, 591 bp, Artificial Sequence
  chemically treated genomic DNA (Homo sapiens) CpG-island No: 15154
cccctcctcctaccaaactctccgccctttacataatcccaaaaaaaacgaaacgacgataactacaacgaaatacaaaaaactaaacgacgaccgacaataaaaaaaaaaaacgaacaaacttaaataactctacgccgcgaaaaccacaaccgcaaacttccccaataataccgcgccgctccgccccgaaataacgccctccgcccataaacctaaccgaaaacaaccgacgaacgacgcgaaaaaaacgacgacaaataacgcgcaacaaaaccgaaaccgaaccgaaccataaccgcctcgaaacgactatacgaattataactactctactacgcgcaaataaacccgccccgccccgcgcccgcacccgcacccgcgatacccccaacttcgcgcgccccgcgcctactacacctaacgccccgcgccgctaaaaccgcgtaaccgcgcgcgcgaacgcgcgcgcgcaaaacatactccgactccgcacacacgtatatacccccaacccgccgaatacctctaacacttataccttaaaaacaaaactcgcgatcgtacacttcataacaacccacccccgcg

SEQ ID NO: 15155 - DNA, 591 bp, Artificial Sequence
  chemically treated genomic DNA (Homo sapiens) CpG-island No: 15155
tttttttttttgttaggtttttcgttttttatatggttttaggagaggcggggcggcggtgattgtagcgaagtgtaggaagttgggcggcggtcggtagtgaggaggaggagcgagtagatttgggtggttttgcgtcgcggaggttatagtcgtagatttttttagtagtatcgcgtcgtttcgtttcggagtgacgtttttcgtttatgggtttggtcgagggtaatcggcgggcggcgcggaggaggcggcgataggtggcgcgtagtagggtcggagtcgggtcgggttatggtcgtttcggagcggttgtacgagttgtggttgttttattacgcgtaggtgagttcgtttcgtttcgcgttcgtattcgtattcgcggtgtttttagtttcgcgcgtttcgcgtttgttgtatttggcgtttcgcgtcgttggggtcgcgtagtcgcgcgcgcgggcgcgcgcgcgtagggtatgtttcggtttcgtatatacgtgtgtgtttttagttcgtcgggtgtttttggtatttatgttttggggatagagttcgcggtcgtgtattttatagtaatttattttcgcg

SEQ ID NO: 15156 - DNA, 591 bp, Artificial Sequence
  chemically treated genomic DNA (Homo sapiens) CpG-island No: 15156
cgcgaaaataaattactataaaatacacgaccgcgaactctatccccaaaacataaataccaaaaacacccgacgaactaaaaacacacacgtatatacgaaaccgaaacataccctacgcgcgcgcgcccgcgcgcgcgactacgcgaccccaacgacgcgaaacgccaaatacaacaaacgcgaaacgcgcgaaactaaaaacaccgcgaatacgaatacgaacgcgaaacgaaacgaactcacctacgcgtaataaaacaaccacaactcgtacaaccgctccgaaacgaccataacccgacccgactccgaccctactacgcgccacctatcgccgcctcctccgcgccgcccgccgattaccctcgaccaaacccataaacgaaaaacgtcactccgaaacgaaacgacgcgatactactaaaaaaatctacgactataacctccgcgacgcaaaaccacccaaatctactcgctcctcctcctcactaccgaccgccgcccaacttcctacacttcgctacaatcaccgccgccccgcctctcctaaaaccatataaaaaacgaaaaacctaacaaaaaaaaaaa

SEQ ID NO: 15157 - DNA, 574 bp, Artificial Sequence
  chemically treated genomic DNA (Homo sapiens) CpG-island No: 15157
gcgtatgcgcgacgatcgtattagcgttagaggagttttacgttaagtagttttagatatcgtgggagggcgtcgttttttcgcgtatgcgttagcgttcgcgtatgcgcgttttcggtagttgtttttttttattagttttttgttttttttaagcgcgattcggatttcgaacgttggacgttttaattgcgatttttattttatattttttattttgcgttcggttttttttcgtagggtttttagtcgtttttttcgtcgtaacgtttttttttttagtcggtttatattagtcgtagttgtttttattttgttcgcgtacgtttttttttttttttcgttttgtatcgcgtaggtttaaggagagtggataaatgtttcgcggttaatttaaggacgagaatgagagattgggaggttttgaaagttaattaatgcggggttattatgggcgagttttttttcgttttgtttcgtttcgtttcgtttcgtttttattttttcggataatttgtttagtgggtggggagttagtaaaaaaaaaaaagaaaaaaaaaaaagttaaggttcg

SEQ ID NO: 15158 - DNA, 574 bp, Artificial Sequence
  chemically treated genomic DNA (Homo sapiens) CpG-island No: 15158
cgaaccttaacttttttttttttcttttttttttttactaactccccacccactaaacaaattatccgaaaaaataaaaacgaaacgaaacgaaacgaaacaaaacgaaaaaaaactcgcccataataaccccgcattaattaactttcaaaacctcccaatctctcattctcgtccttaaattaaccgcgaaacatttatccactctccttaaacctacgcgatacaaaacgaaaaaaaaaaaaaaacgtacgcgaacaaaataaaaacaactacgactaatataaaccgactaaaaaaaaaaacgttacgacgaaaaaaacgactaaaaaccctacgaaaaaaaaccgaacgcaaaataaaaaatataaaataaaaatcgcaattaaaacgtccaacgttcgaaatccgaatcgcgcttaaaaaaaacaaaaaactaataaaaaaaaacaactaccgaaaacgcgcatacgcgaacgctaacgcatacgcgaaaaaacgacgccctcccacgatatctaaaactacttaacgtaaaactcctctaacgctaatacgatcgtcgcgcatacgc

SEQ ID NO: 15159 - DNA, 574 bp, Artificial Sequence
  chemically treated genomic DNA (Homo sapiens) CpG-island No: 15159
cgagttttagttttttttttttttttttttttttttgttggttttttatttattaggtaagttgttcggaagaataagggcggggcggggcggggcggggtaaggcggggaggggttcgtttataataatttcgtattgattggtttttaggattttttagttttttattttcgtttttggattggtcgcgagatatttatttattttttttaggtttgcgcgatgtaagacgggagaaaaggaggggcgtacgcgggtaagatggaggtaattacggttggtgtgggtcggttagaggaagaggcgttgcggcgaaaggaacggttgaaggttttacgggagaaaatcgggcgtaaggtgagaagtgtggagtgagggtcgtagttgaggcgtttagcgttcggggttcgggtcgcgtttgaggagagtaaagggttaataaggaaagatagttgtcgagggcgcgtatgcgcgggcgttaacgtatgcgcgagaagacggcgtttttttacgatgtttggggttgtttggcgtgggatttttttggcgttggtgcggtcgtcgcgtatgcgt

SEQ ID NO: 15160 - DNA, 574 bp, Artificial Sequence
  chemically treated genomic DNA (Homo sapiens) CpG-island No: 15160
acgcatacgcgacgaccgcaccaacgccaaaaaaatcccacgccaaacaaccccaaacatcgtaaaaaaacgccgtcttctcgcgcatacgttaacgcccgcgcatacgcgccctcgacaactatctttccttattaaccctttactctcctcaaacgcgacccgaaccccgaacgctaaacgcctcaactacgaccctcactccacacttctcaccttacgcccgattttctcccgtaaaaccttcaaccgttcctttcgccgcaacgcctcttcctctaaccgacccacaccaaccgtaattacctccatcttacccgcgtacgcccctccttttctcccgtcttacatcgcgcaaacctaaaaaaaataaataaatatctcgcgaccaatccaaaaacgaaaataaaaaactaaaaaatcctaaaaaccaatcaatacgaaattattataaacgaacccctccccgccttaccccgccccgccccgccccgcccttattcttccgaacaacttacctaataaataaaaaaccaacaaaaaaaaaaaaaaaaaaaaaaaaaactaaaactcg

SEQ ID NO: 15161 - DNA, 507 bp, Artificial Sequence
  chemically treated genomic DNA (Homo sapiens) CpG-island No: 15161
tttcgtcggcgcgtgttcgttgggttggtagaagttttcgggtggttcgcgcgtggttcggtcgcggcgggggtggtttcgcggttagttttggagttcgtcgtcgtcgtattaaggacggagtcggttttagacgcgttttggttcggttttttttcgtcggggagcgttttcggtttatatttaggttgcgtcggggtttggtaggttcggtcggaggaggcgtttttgaagtttcggttggtcgatcgggagggagatggatgatcgggtaggggtagggacgttggggtttcgtttggtttttacgattaggttagcgtaaggggttatcgtgcggcgcgggcgggtttcggggtagaaggggacgagcgtgcgtcggcgcgatcgagggagaattggcggtcgtttaatacgaaattggagtgggtgtgagataggagatggtgggagttagagaatagtgtgtgtgcgatagggggtgtgatagaagacgtagtgtgagtg

SEQ ID NO: 15162 - DNA, 507 bp, Artificial Sequence
  chemically treated genomic DNA (Homo sapiens) CpG-island No: 15162
cactcacactacgtcttctatcacaccccctatcgcacacacactattctctaactcccaccatctcctatctcacacccactccaatttcgtattaaacgaccgccaattctccctcgatcgcgccgacgcacgctcgtccccttctaccccgaaacccgcccgcgccgcacgataaccccttacgctaacctaatcgtaaaaaccaaacgaaaccccaacgtccctacccctacccgatcatccatctccctcccgatcgaccaaccgaaacttcaaaaacgcctcctccgaccgaacctaccaaaccccgacgcaacctaaatataaaccgaaaacgctccccgacgaaaaaaaaccgaaccaaaacgcgtctaaaaccgactccgtccttaatacgacgacgacgaactccaaaactaaccgcgaaaccacccccgccgcgaccgaaccacgcgcgaaccacccgaaaacttctaccaacccaacgaacacgcgccgacgaaa

SEQ ID NO: 15163 - DNA, 507 bp, Artificial Sequence
  chemically treated genomic DNA (Homo sapiens) CpG-island No: 15163
tatttatattgcgttttttgttatattttttgtcgtatatatattgttttttgatttttattattttttgttttatatttattttagtttcgtgttgagcggtcgttagttttttttcggtcgcgtcggcgtacgttcgtttttttttgtttcggagttcgttcgcgtcgtacggtggttttttgcgttggtttgatcgtgggaattaggcggggttttagcgtttttgtttttgttcggttatttatttttttttcggtcggttagtcgagattttaaaggcgtttttttcggtcgggtttgttaaatttcgacgtagtttggatgtgggtcgggggcgtttttcggcggggggaggtcgggttagggcgcgtttggggtcggtttcgtttttagtgcggcggcggcggattttagagttgatcgcggggttattttcgtcgcggtcgggttacgcgcgggttattcgggagtttttattagtttagcgagtacgcgtcggcggga

SEQ ID NO: 15164 - DNA, 507 bp, Artificial Sequence
  chemically treated genomic DNA (Homo sapiens) CpG-island No: 15164
tcccgccgacgcgtactcgctaaactaataaaaactcccgaataacccgcgcgtaacccgaccgcgacgaaaataaccccgcgatcaactctaaaatccgccgccgccgcactaaaaacgaaaccgaccccaaacgcgccctaacccgacctccccccgccgaaaaacgcccccgacccacatccaaactacgtcgaaatttaacaaacccgaccgaaaaaaacgcctttaaaatctcgactaaccgaccgaaaaaaaaataaataaccgaacaaaaacaaaaacgctaaaaccccgcctaattcccacgatcaaaccaacgcaaaaaaccaccgtacgacgcgaacgaactccgaaacaaaaaaaaacgaacgtacgccgacgcgaccgaaaaaaaactaacgaccgctcaacacgaaactaaaataaatataaaacaaaaaataataaaaatcaaaaaacaatatatatacgacaaaaaatataacaaaaaacgcaatataaata

SEQ ID NO: 15165 - DNA, 1021 bp, Artificial Sequence
  chemically treated genomic DNA (Homo sapiens) CpG-island No: 15165
tcgttttgcggggaattaggtttttcgtagtttttgtttcgggtttttttcggcggtcgtcgtatatttaaagagtttaaaaaggattaggtagtcgggtttttatgcgttttttgtcgggagggcgcgagttttgggttatcgagagtttggaggagggcgttaagggggcggttgcggcgcgttagttttcgattcgcgagtagtttcgggaggcgggagaaagagttttcggtttttaagattttagtttttttagtttagatcggtcgaagcgttcgggttttcggtattttttttttttcgggtagttgtaaaagtaattcggaaagcgtttgcgagttcgggtttgtcggatttcggtcgtttttagttattgggcgatatcgcgttattcggggtcgtgtataatagcgaaagttcgaggacgcgtttcgttcgattttatttttcgtttttttcgggtcgttcgtcgcggttttttattttttcgttcggagggttgttggcgtttcggggtcgcgcggcgtattcgtggggtttgcgtcgtttttttcggtcggtcggcgggtagtgtgcgacggtcgcggcgattgggttttcgtatttcggtcgtttcgcgcgtgtttgggtttcggtagtggggacggggtgggttggtgtttttatcgcgttttcgtattgatttgttgttgttttttggggcggtcgcgtttttttttttgaggcgttggggcggtaggttgtttttgggttgaagtggacggttgtttcgcgtttttatcgcgtgcgtttattttgtttttcgtcgtcgttatcgtcgttgtagtcgtttcgtttcgatcgtttcggagttgtttagtatttttcgggagatgaggtgatagggttggggacgtcggcggggcgagcgcgagttggcgggttgcgagggttgttgttgtttaggttgtcgtcgttgttattattaatatcggacgtttagcggttgttaaaaagagaagaggggaggaggaggagg

SEQ ID NO: 15166 - DNA, 1021 bp, Artificial Sequence
  chemically treated genomic DNA (Homo sapiens) CpG-island No: 15166
cctcctcctcctcccctcttctctttttaacaaccgctaaacgtccgatattaataataacaacgacgacaacctaaacaacaacaaccctcgcaacccgccaactcgcgctcgccccgccgacgtccccaaccctatcacctcatctcccgaaaaatactaaacaactccgaaacgatcgaaacgaaacgactacaacgacgataacgacgacgaaaaacaaaataaacgcacgcgataaaaacgcgaaacaaccgtccacttcaacccaaaaacaacctaccgccccaacgcctcaaaaaaaaaaacgcgaccgccccaaaaaacaacaacaaatcaatacgaaaacgcgataaaaacaccaacccaccccgtccccactaccgaaacccaaacacgcgcgaaacgaccgaaatacgaaaacccaatcgccgcgaccgtcgcacactacccgccgaccgaccgaaaaaaacgacgcaaaccccacgaatacgccgcgcgaccccgaaacgccaacaaccctccgaacgaaaaaataaaaaaccgcgacgaacgacccgaaaaaaacgaaaaataaaatcgaacgaaacgcgtcctcgaactttcgctattatacacgaccccgaataacgcgatatcgcccaataactaaaaacgaccgaaatccgacaaacccgaactcgcaaacgctttccgaattacttttacaactacccgaaaaaaaaaaaataccgaaaacccgaacgcttcgaccgatctaaactaaaaaaactaaaatcttaaaaaccgaaaactctttctcccgcctcccgaaactactcgcgaatcgaaaactaacgcgccgcaaccgcccccttaacgccctcctccaaactctcgataacccaaaactcgcgccctcccgacaaaaaacgcataaaaacccgactacctaatcctttttaaactctttaaatatacgacgaccgccgaaaaaaacccgaaacaaaaactacgaaaaacctaattccccgcaaaacga

SEQ ID NO: 15167 - DNA, 1021 bp, Artificial Sequence
  chemically treated genomic DNA (Homo sapiens) CpG-island No: 15167
ttttttttttttttttttttttttttttggtagtcgttggacgttcggtgttgatggtggtagcggcggtagtttaagtaatagtagttttcgtagttcgttagttcgcgttcgtttcgtcggcgtttttagttttattattttatttttcgaaaggtgttgggtagtttcggggcggtcgaggcgaagcggttgtagcggcggtagcggcggcgggaggtaggatgagcgtacgcggtgagggcgcggggtagtcgtttattttagtttagggataatttgtcgttttagcgttttagaagagaggacgcggtcgttttaggaagtagtagtaagttagtacgagggcgcggtgggggtattagtttatttcgtttttattgtcggggtttagatacgcgcggggcggtcggagtgcgggagtttagtcgtcgcggtcgtcgtatattgttcgtcggtcggtcggggggagcggcgtagattttacgagtgcgtcgcgcggtttcggggcgttagtaatttttcgggcggggaggtggggagtcgcggcgggcggttcggggaaggcgggaggtggggtcgggcgaagcgcgttttcggattttcgttattgtgtacggtttcgagtggcgcggtgtcgtttagtgattggaagcgatcgggattcgataaattcgggttcgtaggcgtttttcgagttgtttttgtaattgttcgggaggaaggaggtgtcggggattcgggcgtttcggtcgatttgggttgaaggggttagagttttgggggtcggaggttttttttttcgtttttcggggttgttcgcgggtcgggggttggcgcgtcgtagtcgtttttttggcgtttttttttaagttttcggtggtttaagattcgcgttttttcgataaagaacgtatggagattcggttgtttggttttttttgggttttttaaatatgcggcggtcgtcggagggagttcggggtaggggttacggggagtttggtttttcgtaggacgg

SEQ ID NO: 15168 - DNA, 1021 bp, Artificial Sequence
  chemically treated genomic DNA (Homo sapiens) CpG-island No: 15168
ccgtcctacgaaaaaccaaactccccgtaacccctaccccgaactccctccgacgaccgccgcatatttaaaaaacccaaaaaaaaccaaacaaccgaatctccatacgttctttatcgaaaaaacgcgaatcttaaaccaccgaaaacttaaaaaaaaacgccaaaaaaacgactacgacgcgccaacccccgacccgcgaacaaccccgaaaaacgaaaaaaaaaacctccgacccccaaaactctaaccccttcaacccaaatcgaccgaaacgcccgaatccccgacacctccttcctcccgaacaattacaaaaacaactcgaaaaacgcctacgaacccgaatttatcgaatcccgatcgcttccaatcactaaacgacaccgcgccactcgaaaccgtacacaataacgaaaatccgaaaacgcgcttcgcccgaccccacctcccgccttccccgaaccgcccgccgcgactccccacctccccgcccgaaaaattactaacgccccgaaaccgcgcgacgcactcgtaaaatctacgccgctccccccgaccgaccgacgaacaatatacgacgaccgcgacgactaaactcccgcactccgaccgccccgcgcgtatctaaaccccgacaataaaaacgaaataaactaatacccccaccgcgccctcgtactaacttactactacttcctaaaacgaccgcgtcctctcttctaaaacgctaaaacgacaaattatccctaaactaaaataaacgactaccccgcgccctcaccgcgtacgctcatcctacctcccgccgccgctaccgccgctacaaccgcttcgcctcgaccgccccgaaactacccaacacctttcgaaaaataaaataataaaactaaaaacgccgacgaaacgaacgcgaactaacgaactacgaaaactactattacttaaactaccgccgctaccaccatcaacaccgaacgtccaacgactaccaaaaaaaaaaaaaaaaaaaaaaaaaaaa

SEQ ID NO: 15169 - DNA, 801 bp, Artificial Sequence
  chemically treated genomic DNA (Homo sapiens) CpG-island No: 15169
gagcgatgggttggtggaagtcggagaggagcgttaggagtcgcggcggcggcgcgaggtgtagaaggaggcgaacgcgttcgtagtggcggtgatgggcggaggaggaggaagaggaggaggaggaagaggaggagggggaaaacgatgataggagttggggtcggggggggaaattggggggacgcgggcggaggcgcggtgcgcgtcggcggtggcgggtacgagtttcgcgtttggaggaggaggagttaggtcgggtaggagggttaaggaggttttcgggaaggtagggttttttttacggtcgataggttatgattcgcgttagtaatgtattcgggatatcgttaatacgtgggttaaaatcgataaacggcgttacgttttgtagtttttttagttattttattaataattcgtcgtagggcgaggttagttgataatcggaaaaatagagtaggttgttaggcgtaacggttaatcgcgttagttattggcgattttattgatttttaatatcgttgaatgatataaaagtgcgttcgttttttttttttttttatatatatatatttttttgtttcgatttttcgatttttggtaattgatcgtcgttcgtttggtattagtagcggcgtagattcgggcggcgtcgggcgtttgggtgcgttcggagcgtcgtttttttcgtttatatttcgtcggaggagcggagtttacgcgtagtttcgggttgtttttcgaggtcgtttgttggggttttcgagaggttttaaggtttttgatagagttgttgtt

SEQ ID NO: 15170 - DNA, 801 bp, Artificial Sequence
  chemically treated genomic DNA (Homo sapiens) CpG-island No: 15170
aacaacaactctatcaaaaaccttaaaacctctcgaaaaccccaacaaacgacctcgaaaaacaacccgaaactacgcgtaaactccgctcctccgacgaaatataaacgaaaaaaacgacgctccgaacgcacccaaacgcccgacgccgcccgaatctacgccgctactaataccaaacgaacgacgatcaattaccaaaaatcgaaaaatcgaaacaaaaaaatatatatatataaaaaaaaaaaaaaaacgaacgcacttttatatcattcaacgatattaaaaatcaataaaatcgccaataactaacgcgattaaccgttacgcctaacaacctactctatttttccgattatcaactaacctcgccctacgacgaattattaataaaataactaaaaaaactacaaaacgtaacgccgtttatcgattttaacccacgtattaacgatatcccgaatacattactaacgcgaatcataacctatcgaccgtaaaaaaaaccctaccttcccgaaaacctccttaaccctcctacccgacctaactcctcctcctccaaacgcgaaactcgtacccgccaccgccgacgcgcaccgcgcctccgcccgcgtccccccaatttccccccccgaccccaactcctatcatcgttttccccctcctcctcttcctcctcctcctcttcctcctcctccgcccatcaccgccactacgaacgcgttcgcctccttctacacctcgcgccgccgccgcgactcctaacgctcctctccgacttccaccaacccatcgctc

SEQ ID NO: 15171 - DNA, 801 bp, Artificial Sequence
  chemically treated genomic DNA (Homo sapiens) CpG-island No: 15171
aatagtagttttgttaggaattttggggtttttcgggagttttagtaagcggtttcggggagtagttcgaggttgcgcgtgggtttcgttttttcggcgaggtgtgggcgaggggagcggcgtttcgagcgtatttaggcgttcgacgtcgttcgggtttgcgtcgttgttagtgttaggcgggcgacggttagttattagggatcgagggatcgaggtaggggagtgtgtgtgtgtggggggggggggagggcgaacgtatttttatgttatttagcggtgttgaaaattagtggaatcgttagtggttggcgcgattaatcgttgcgtttggtagtttgttttattttttcggttattaattggtttcgttttgcggcgaattgttagtggaatggttggaagagttgtaagacgtgacgtcgtttatcgattttggtttacgtattggcgatatttcggatgtattattggcgcggattatggtttgtcgatcgtaaggggggttttgttttttcgggaatttttttagtttttttattcggtttgatttttttttttttaggcgcggggttcgtgttcgttatcgtcggcgcgtatcgcgttttcgttcgcgtttttttaattttttttttcggttttagtttttgttatcgttttttttttttttttttttttttttttttttttttttttttttcgtttattatcgttattacgaacgcgttcgtttttttttatatttcgcgtcgtcgtcgcggtttttagcgttttttttcggtttttattagtttatcgttt

SEQ ID NO: 15172 - DNA, 801 bp, Artificial Sequence
  chemically treated genomic DNA (Homo sapiens) CpG-island No: 15172
aaacgataaactaataaaaaccgaaaaaaaacgctaaaaaccgcgacgacgacgcgaaatataaaaaaaaacgaacgcgttcgtaataacgataataaacgaaaaaaaaaaaaaaaaaaaaaaaaaaaaaaaaaaaaaaaaaaaacgataacaaaaactaaaaccgaaaaaaaaaattaaaaaaacgcgaacgaaaacgcgatacgcgccgacgataacgaacacgaaccccgcgcctaaaaaaaaaaaaatcaaaccgaataaaaaaactaaaaaaattcccgaaaaaacaaaaccccccttacgatcgacaaaccataatccgcgccaataatacatccgaaatatcgccaatacgtaaaccaaaatcgataaacgacgtcacgtcttacaactcttccaaccattccactaacaattcgccgcaaaacgaaaccaattaataaccgaaaaaataaaacaaactaccaaacgcaacgattaatcgcgccaaccactaacgattccactaattttcaacaccgctaaataacataaaaatacgttcgccctccccccccccccacacacacacactcccctacctcgatccctcgatccctaataactaaccgtcgcccgcctaacactaacaacgacgcaaacccgaacgacgtcgaacgcctaaatacgctcgaaacgccgctcccctcgcccacacctcgccgaaaaaacgaaacccacgcgcaacctcgaactactccccgaaaccgcttactaaaactcccgaaaaaccccaaaattcctaacaaaactactatt

SEQ ID NO: 15173 - DNA, 523 bp, Artificial Sequence
  chemically treated genomic DNA (Homo sapiens) CpG-island No: 15173
ttcgagatcgtgcggacgcgggttcggatattagattcggattttagttcgataagtgaattttaatttttaacgttttcgatatcggaattcgaattttcgaattttcgatttttagtttcggttttcggattcggttttttttttttgattcgaattcggattttcgttacgtatttgtttttagttttttcggtggagtttagttttcgttcgcggggtagtcgcgtcgatagtaagtataaggcgaaggtgtagtcggcgaagattagaaggaggtcgagaagcgggcgtatgtcggtttcgtatttcggttcgcggggtagtcgagaagtttatttgtatttcgggacgtagcggcgggcggattgagttcgcggagtacgtttattgacggattagggaggggttcgcgtcgagattcgttttcgaattaggttttattttttgagttaggttttcgttttcgattttgatttcgttttttttgtttttcggtggagatttcgggaaaaatttgttt

SEQ ID NO: 15174 - DNA, 523 bp, Artificial Sequence
  chemically treated genomic DNA (Homo sapiens) CpG-island No: 15174
aaacaaatttttcccgaaatctccaccgaaaaacaaaaaaaacgaaatcaaaatcgaaaacgaaaacctaactcaaaaaataaaacctaattcgaaaacgaatctcgacgcgaacccctccctaatccgtcaataaacgtactccgcgaactcaatccgcccgccgctacgtcccgaaatacaaataaacttctcgactaccccgcgaaccgaaatacgaaaccgacatacgcccgcttctcgacctccttctaatcttcgccgactacaccttcgccttatacttactatcgacgcgactaccccgcgaacgaaaactaaactccaccgaaaaaactaaaaacaaatacgtaacgaaaatccgaattcgaatcaaaaaaaaaaaaccgaatccgaaaaccgaaactaaaaatcgaaaattcgaaaattcgaattccgatatcgaaaacgttaaaaattaaaattcacttatcgaactaaaatccgaatctaatatccgaacccgcgtccgcacgatctcgaa

SEQ ID NO: 15175 - DNA, 523 bp, Artificial Sequence
  chemically treated genomic DNA (Homo sapiens) CpG-island No: 15175
aggtaggtttttttcggagtttttatcgaaggatagagagggcggagttagaatcgggggcgggggtttggtttaggaggtggggtttggttcggaggcgggtttcggcgcggatttttttttggttcgttagtgaacgtgtttcgcgggtttagttcgttcgtcgttgcgtttcggagtgtaagtgagtttttcggttgtttcgcgggtcggggtgcggagtcgatatgcgttcgtttttcggtttttttttggttttcgtcggttgtattttcgttttgtatttgttgtcgacgcgattgtttcgcgggcggagattgggttttatcgaggaggttggaggtaggtgcgtggcgggaattcgggttcgggttagaggaagggagtcgggttcgaggatcggggttgggaatcggagattcggagattcgggtttcggtatcggaggcgttgggaattgaggtttatttatcggattggaattcgggtttggtattcgggttcgcgttcgtacggtttcgga

SEQ ID NO: 15176 - DNA, 523 bp, Artificial Sequence
  chemically treated genomic DNA (Homo sapiens) CpG-island No: 15176
tccgaaaccgtacgaacgcgaacccgaataccaaacccgaattccaatccgataaataaacctcaattcccaacgcctccgataccgaaacccgaatctccgaatctccgattcccaaccccgatcctcgaacccgactcccttcctctaacccgaacccgaattcccgccacgcacctacctccaacctcctcgataaaacccaatctccgcccgcgaaacaatcgcgtcgacaacaaatacaaaacgaaaatacaaccgacgaaaaccaaaaaaaaaccgaaaaacgaacgcatatcgactccgcaccccgacccgcgaaacaaccgaaaaactcacttacactccgaaacgcaacgacgaacgaactaaacccgcgaaacacgttcactaacgaaccaaaaaaaaatccgcgccgaaacccgcctccgaaccaaaccccacctcctaaaccaaacccccgcccccgattctaactccgccctctctatccttcgataaaaactccgaaaaaaacctacct

SEQ ID NO: 15177 - DNA, 577 bp, Artificial Sequence
  chemically treated genomic DNA (Homo sapiens) CpG-island No: 15177
gaggaggtcgttgtgagtcggcgacgcgaggttgggggagtgggaggtaaattcgttaatttgtcgtcgaatggttatttttagtttttcgtttacgagggtggaaaggtagaaggtttgaaggtaaggcgtgagggagcgtttaggacgttttcggaggggtcgggtcggggtttgcgttgtagttcgtacgtattttattttcgcgtcgcggcgttcggtcgttcgtttttttttttgggttttttttggtcgtcgtcgtttttttttttttagttttttttttttttttttttttcggtttttcgtttttatcgttgatttgttagcgtttttgttcgtttttttttcggcgttcgttgttttttttgtagcgtgtttttcgtttttatttcggatggggatggggtagggggcgcggggtgagttattaattttagtcgtttgtttggtcgcgtaaggcgggaaagtgggggcgtttttgcgttttacgttaagtttagggttacgagtatttttgtggagatcgggagcggttgggttagggatgatgtttttttttttttttttttttttt

SEQ ID NO: 15178 - DNA, 577 bp, Artificial Sequence
  chemically treated genomic DNA (Homo sapiens) CpG-island No: 15178
aaaaaaaaaaaaaaaaaaaaaaaacatcatccctaacccaaccgctcccgatctccacaaaaatactcgtaaccctaaacttaacgtaaaacgcaaaaacgcccccactttcccgccttacgcgaccaaacaaacgactaaaattaataactcaccccgcgccccctaccccatccccatccgaaataaaaacgaaaaacacgctacaaaaaaaacaacgaacgccgaaaaaaaaacgaacaaaaacgctaacaaatcaacgataaaaacgaaaaaccgaaaaaaaaaaaaaaaaaaaaaactaaaaaaaaaaaaacgacgacgaccaaaaaaaacccaaaaaaaaaaacgaacgaccgaacgccgcgacgcgaaaataaaatacgtacgaactacaacgcaaaccccgacccgacccctccgaaaacgtcctaaacgctccctcacgccttaccttcaaaccttctacctttccaccctcgtaaacgaaaaactaaaaataaccattcgacgacaaattaacgaatttacctcccactcccccaacctcgcgtcgccgactcacaacgacctcctc

SEQ ID NO: 15179 - DNA, 577 bp, Artificial Sequence
  chemically treated genomic DNA (Homo sapiens) CpG-island No: 15179
gggggaaggggaaagaggaagaggtattatttttagtttaatcgttttcgatttttataagagtgttcgtgattttaaatttaacgtgaggcgtaaaagcgtttttattttttcgttttgcgcggttaggtaggcggttggagttgatggtttatttcgcgttttttgttttatttttattcgagatagggacgaggagtacgttgtagggaaagtagcgagcgtcgggagaggggcgggtagaagcgttgataaattagcggtgggggcggagagtcgaggagaaggagaaggaggaggattaggaggaggaggacggcgacgattagaaggggtttaagagagggggcgagcgatcgagcgtcgcgacgcggaagtgaggtgcgtgcgggttgtagcgtagatttcggttcggttttttcgagagcgttttgggcgtttttttacgttttgtttttaagttttttgtttttttattttcgtgagcggagaattgggagtggttattcgacgataggttagcgggtttgttttttatttttttagtttcgcgtcgtcggtttatagcggttttttt

SEQ ID NO: 15180 - DNA, 577 bp, Artificial Sequence
  chemically treated genomic DNA (Homo sapiens) CpG-island No: 15180
aaaaaaaccgctataaaccgacgacgcgaaactaaaaaaataaaaaacaaacccgctaacctatcgtcgaataaccactcccaattctccgctcacgaaaataaaaaaacaaaaaacttaaaaacaaaacgtaaaaaaacgcccaaaacgctctcgaaaaaaccgaaccgaaatctacgctacaacccgcacgcacctcacttccgcgtcgcgacgctcgatcgctcgccccctctcttaaaccccttctaatcgtcgccgtcctcctcctcctaatcctcctccttctccttctcctcgactctccgcccccaccgctaatttatcaacgcttctacccgcccctctcccgacgctcgctactttccctacaacgtactcctcgtccctatctcgaataaaaataaaacaaaaaacgcgaaataaaccatcaactccaaccgcctacctaaccgcgcaaaacgaaaaaataaaaacgcttttacgcctcacgttaaatttaaaatcacgaacactcttataaaaatcgaaaacgattaaactaaaaataatacctcttcctctttccccttccccc

SEQ ID NO: 15181 - DNA, 664 bp, Artificial Sequence
  chemically treated genomic DNA (Homo sapiens) CpG-island No: 15181
cgtagtttaggtagaagaaggcggcgcgtagacgtagcgataggtagttgaatacgtgcgtcgtgtagtttatggcgaaggttagtagtattttcgacgcgtagtattataacggtagtagttacgggtggtggaagggtacgtcgtcgtcgtttaggaagaatagacggtagaatttgtttaggaatagtagtagcgggatgaagtgcgtttagaagttgagcgtttcgttggtaggttttagtatcgaggttaggtatttttgggtcgtgtacggtagacgtcggtagttcgataggatgaagtattttacgaagtcgtcgggtatttcgttttagcgtagtagcggtttggtagacgttggggggtttcgggaggcggtagagtgggagtttcgggcggttttcgaagttgtcggggtcggggtcggagggttttttgtgttcgcgtttcggggttgtaggcgtcgcggtatggtgttcggggttcggttagggcgcgcgtaggcgatttttggcgtcggttttcgggcgttgggtagttttcgtcggtcgtcgtcggagtttttgtgtttacgtcgggggcgtcgttgtaggtttaggagaagattcgtgttttcgagtagtcgtttttaaaaattaaataaattaataagagaattaat

SEQ ID NO: 15182 - DNA, 664 bp, Artificial Sequence
  chemically treated genomic DNA (Homo sapiens) CpG-island No: 15182
attaattctcttattaatttatttaatttttaaaaacgactactcgaaaacacgaatcttctcctaaacctacaacgacgcccccgacgtaaacacaaaaactccgacgacgaccgacgaaaactacccaacgcccgaaaaccgacgccaaaaatcgcctacgcgcgccctaaccgaaccccgaacaccataccgcgacgcctacaaccccgaaacgcgaacacaaaaaaccctccgaccccgaccccgacaacttcgaaaaccgcccgaaactcccactctaccgcctcccgaaaccccccaacgtctaccaaaccgctactacgctaaaacgaaatacccgacgacttcgtaaaatacttcatcctatcgaactaccgacgtctaccgtacacgacccaaaaatacctaacctcgatactaaaacctaccaacgaaacgctcaacttctaaacgcacttcatcccgctactactattcctaaacaaattctaccgtctattcttcctaaacgacgacgacgtacccttccaccacccgtaactactaccgttataatactacgcgtcgaaaatactactaaccttcgccataaactacacgacgcacgtattcaactacctatcgctacgtctacgcgccgccttcttctacctaaactacg

SEQ ID NO: 15183 - DNA, 664 bp, Artificial Sequence
  chemically treated genomic DNA (Homo sapiens) CpG-island No: 15183
attgatttttttattgatttatttaatttttaggagcggttgttcggaggtacgggtttttttttaaatttgtagcgacgttttcggcgtgggtataaaggtttcgacggcggtcggcgggggttgtttagcgttcgggagtcggcgttagaggtcgtttgcgcgcgttttagtcgagtttcgggtattatgtcgcggcgtttgtagtttcggggcgcgggtataaaaggtttttcggtttcggtttcggtagtttcgggggtcgttcggaatttttattttgtcgtttttcgggattttttagcgtttgttaagtcgttgttgcgttgggacgaggtgttcgacgatttcgtggagtgttttattttgtcgggttatcggcgtttgtcgtgtacggtttaggagtgtttagtttcggtgttgaagtttattaacgagacgtttaatttttggacgtattttatttcgttgttgttgtttttgagtaagttttgtcgtttgttttttttgagcggcggcgacgtgtttttttattattcgtggttgttatcgttgtggtgttacgcgtcgggagtgttgttgattttcgttatgagttgtacggcgtacgtgtttagttgtttgtcgttgcgtttgcgcgtcgtttttttttatttggattacg

SEQ ID NO: 15184 - DNA, 664 bp, Artificial Sequence
  chemically treated genomic DNA (Homo sapiens) CpG-island No: 15184
cgtaatccaaataaaaaaaaacgacgcgcaaacgcaacgacaaacaactaaacacgtacgccgtacaactcataacgaaaatcaacaacactcccgacgcgtaacaccacaacgataacaaccacgaataataaaaaaacacgtcgccgccgctcaaaaaaaacaaacgacaaaacttactcaaaaacaacaacaacgaaataaaatacgtccaaaaattaaacgtctcgttaataaacttcaacaccgaaactaaacactcctaaaccgtacacgacaaacgccgataacccgacaaaataaaacactccacgaaatcgtcgaacacctcgtcccaacgcaacaacgacttaacaaacgctaaaaaatcccgaaaaacgacaaaataaaaattccgaacgacccccgaaactaccgaaaccgaaaccgaaaaaccttttatacccgcgccccgaaactacaaacgccgcgacataatacccgaaactcgactaaaacgcgcgcaaacgacctctaacgccgactcccgaacgctaaacaacccccgccgaccgccgtcgaaacctttatacccacgccgaaaacgtcgctacaaatttaaaaaaaaacccgtacctccgaacaaccgctcctaaaaattaaataaatcaataaaaaaatcaat

SEQ ID NO: 15185 - DNA, 745 bp, Artificial Sequence
  chemically treated genomic DNA (Homo sapiens) CpG-island No: 15185
agttcgacgttattttttttttttttatttattttataggttttgcgttttacgcgcgttacgcgttcgtgaggtttatacgtttttcggttatatttgttacgttattagttttatattttttacgttattttttttttattacgattattcgtaatattttcgagagttatttttttagaaggtatcgcgtaatagcggtagcgttttcgcgattatcgtttattcgaatcgcgtattttttttttttttcgtttatttttatttttatcgttttattattttaattttttttttattttttatagcgaaacgaatgtattcgtttgtttttttagtagcgttatttttttttgtttcgtatcgtttatttttcgggttatttttttattttcgttacgtttcggttttgtcgcgtatttttttttttattcgtatttcgttcgtttttttttttttttcgcgttttttattttttgtttttatttatttatttattttttattttattttattttaatttacgttgttcgcgatatttttatatataatttttcgttgtatttttcgtttaacgttaatttgtaattttatcgcgtaaacgataatttatttatagcgtattttttattcgaatacgcgttatttttattgttatttttttttttattatttttattttattcgtattattttattcgacgacgtatatttattttgtttttagtttatatcgtacgattat

SEQ ID NO: 15186 - DNA, 745 bp, Artificial Sequence
  chemically treated genomic DNA (Homo sapiens) CpG-island No: 15186
ataatcgtacgatataaactaaaaacaaaataaatatacgtcgtcgaataaaataatacgaataaaataaaaataataaaaaaaaaaataacaataaaaataacgcgtattcgaataaaaaatacgctataaataaattatcgtttacgcgataaaattacaaattaacgttaaacgaaaaatacaacgaaaaattatatataaaaatatcgcgaacaacgtaaattaaaataaaataaaataaaaaataaataaataaataaaaacaaaaaataaaaaacgcgaaaaaaaaaaaaaaacgaacgaaatacgaataaaaaaaaaaatacgcgacaaaaccgaaacgtaacgaaaataaaaaaataacccgaaaaataaacgatacgaaacaaaaaaaaataacgctactaaaaaaacaaacgaatacattcgtttcgctataaaaaataaaaaaaaaattaaaataataaaacgataaaaataaaaataaacgaaaaaaaaaaaaaatacgcgattcgaataaacgataatcgcgaaaacgctaccgctattacgcgataccttctaaaaaaataactctcgaaaatattacgaataatcgtaataaaaaaaaaataacgtaaaaaatataaaactaataacgtaacaaatataaccgaaaaacgtataaacctcacgaacgcgtaacgcgcgtaaaacgcaaaacctataaaataaataaaaaaaaaaaaaataacgtcgaact

SEQ ID NO: 15187 - DNA, 745 bp, Artificial Sequence
  chemically treated genomic DNA (Homo sapiens) CpG-island No: 15187
ataatcgtgcgatgtaggttggagatagagtagatgtgcgtcgtcgaatggggtgatgcggatggagtgaaagtagtaagaggaggagtaatagtgagggtagcgcgtgttcgggtagagggtgcgttatagatgggttgtcgtttgcgcggtagagttgtagattggcgttggacgagaggtatagcgggaggttgtatatggaggtgtcgcgagtagcgtggattaaggtggggtgaggtggaaagtgagtgagtgagtgagggtagagggtgagaggcgcggggagggaagaggagcgggcggggtgcgggtgggggagggagtgcgcgatagggtcgaagcgtagcgagggtgggggagtggttcggggagtaggcggtgcggagtagagagaaatagcgttgttgaagggatagacgagtgtattcgtttcgttatgggggatggggggggggttgaggtgatgaagcggtgggggtaagagtaagcgggaagagggggaggtacgcgattcgggtagacggtggtcgcgagagcgttgtcgttgttacgcggtgttttttgggagggtagttttcgagggtgttacgaatggtcgtggtgggggaaagatggcgtgaggagtatgaagttagtggcgtgataagtgtgatcggggagcgtgtaggttttacggacgcgtggcgcgcgtaaggcgtagggtttataaggtaggtgaggaagaggaaggtgacgtcgagtt

SEQ ID NO: 15188 - DNA, 745 bp, Artificial Sequence
  chemically treated genomic DNA (Homo sapiens) CpG-island No: 15188
aactcgacgtcaccttcctcttcctcacctaccttataaaccctacgccttacgcgcgccacgcgtccgtaaaacctacacgctccccgatcacacttatcacgccactaacttcatactcctcacgccatctttcccccaccacgaccattcgtaacaccctcgaaaactaccctcccaaaaaacaccgcgtaacaacgacaacgctctcgcgaccaccgtctacccgaatcgcgtacctccccctcttcccgcttactcttacccccaccgcttcatcacctcaaccccccccccatcccccataacgaaacgaatacactcgtctatcccttcaacaacgctatttctctctactccgcaccgcctactccccgaaccactcccccaccctcgctacgcttcgaccctatcgcgcactccctcccccacccgcaccccgcccgctcctcttccctccccgcgcctctcaccctctaccctcactcactcactcactttccacctcaccccaccttaatccacgctactcgcgacacctccatatacaacctcccgctatacctctcgtccaacgccaatctacaactctaccgcgcaaacgacaacccatctataacgcaccctctacccgaacacgcgctaccctcactattactcctcctcttactactttcactccatccgcatcaccccattcgacgacgcacatctactctatctccaacctacatcgcacgattat

SEQ ID NO: 15189 - DNA, 796 bp, Artificial Sequence
  chemically treated genomic DNA (Homo sapiens) CpG-island No: 15189
ttaaaggcgtcgtcgggcggcgtagtttagtttttcgagacggcgggttcgggtttttcggtttttacgggacgtcgggattcggatttttgggaaagttcgcgggtatagttcgaggttttattttttgtcgagagtgataggttttttttacgtttgtcggttttagtttagtcgcgggtattagacggttcgcgcggttttttttggtcgtttcggggcgtagatttcgttcgttcgttttattttcggtcgaggcgtttttcggggtgatcgattgatcggagtttcgttggtttatatatcgggtcgttcgttttttttcgtcgcgtttcgttttttcgttcgagtttttagtcgtcggttcgttaagttcggtcgcggtcgtcggttatcgtttttagttcggggggagttcggggggtaggacggggaggaggacgtggcgtgttcggaggtggttagtagcggggcggggagtgtttcggagaggtttagtcggggacgggggggttaggtcggcgcgggttcgggatttttttcgcgagtattttcgggttcgaggttttcgatcgttttcgtcggcgcggagaggcggttttaatttttagttttatttcgtattttcgtttttttttttttattatatggaaatttatagttttagaaagtgatacgtcgaagatttttcggtttcgtcgttcgtttttttttttttgggtagcgtttttgtcgcggagatttcgggagggggagcggatttttcggataaaatttgttgggaaggttgggggtg

SEQ ID NO: 15190 - DNA, 796 bp, Artificial Sequence
  chemically treated genomic DNA (Homo sapiens) CpG-island No: 15190
cacccccaaccttcccaacaaattttatccgaaaaatccgctccccctcccgaaatctccgcgacaaaaacgctacccaaaaaaaaaaaaacgaacgacgaaaccgaaaaatcttcgacgtatcactttctaaaactataaatttccatataataaaaaaaaaaaaacgaaaatacgaaataaaactaaaaattaaaaccgcctctccgcgccgacgaaaacgatcgaaaacctcgaacccgaaaatactcgcgaaaaaaatcccgaacccgcgccgacctaacccccccgtccccgactaaacctctccgaaacactccccgccccgctactaaccacctccgaacacgccacgtcctcctccccgtcctaccccccgaactccccccgaactaaaaacgataaccgacgaccgcgaccgaacttaacgaaccgacgactaaaaactcgaacgaaaaaacgaaacgcgacgaaaaaaaacgaacgacccgatatataaaccaacgaaactccgatcaatcgatcaccccgaaaaacgcctcgaccgaaaataaaacgaacgaacgaaatctacgccccgaaacgaccaaaaaaaaccgcgcgaaccgtctaatacccgcgactaaactaaaaccgacaaacgtaaaaaaaacctatcactctcgacaaaaaataaaacctcgaactatacccgcgaactttcccaaaaatccgaatcccgacgtcccgtaaaaaccgaaaaacccgaacccgccgtctcgaaaaactaaactacgccgcccgacgacgcctttaa

SEQ ID NO: 15191 - DNA, 796 bp, Artificial Sequence
  chemically treated genomic DNA (Homo sapiens) CpG-island No: 15191
tatttttagtttttttagtagattttgttcgaggaattcgttttttttttcggaattttcgcggtaggaacgttgtttaggagggggagggcgggcggcgaggtcgaggaattttcgacgtgttattttttgaggttgtagatttttatatggtggagggaagagggcgggagtgcgaagtggggttggaagttggggtcgttttttcgcgtcggcgggggcggtcgggggtttcgaattcggggatgttcgcggggagggtttcgagttcgcgtcggtttggttttttcgttttcggttgggttttttcgggatatttttcgtttcgttgttggttattttcgagtacgttacgttttttttttcgttttgtttttcgggtttttttcgggttgggggcggtaatcggcggtcgcggtcggatttggcgagtcggcggttggaagttcgggcgggggagcggggcgcggcgggaaggagcgggcgattcggtgtgtgggttagcggagtttcggttagtcggttatttcgaggggcgtttcggtcggggatagggcgggcgggcggaatttgcgtttcgaggcggttaggaggggtcgcgcggatcgtttggtgttcgcggttgggttggggtcggtaggcgtgggaagggtttgttattttcggtagaaagtggggtttcgggttgtgttcgcgaatttttttagaggttcgggtttcggcgtttcgtgggaatcggaggattcgggttcgtcgtttcgggagattgggttgcgtcgttcggcggcgtttttgg

SEQ ID NO: 15192 - DNA, 796 bp, Artificial Sequence
  chemically treated genomic DNA (Homo sapiens) CpG-island No: 15192
ccaaaaacgccgccgaacgacgcaacccaatctcccgaaacgacgaacccgaatcctccgattcccacgaaacgccgaaacccgaacctctaaaaaaattcgcgaacacaacccgaaaccccactttctaccgaaaataacaaacccttcccacgcctaccgaccccaacccaaccgcgaacaccaaacgatccgcgcgacccctcctaaccgcctcgaaacgcaaattccgcccgcccgccctatccccgaccgaaacgcccctcgaaataaccgactaaccgaaactccgctaacccacacaccgaatcgcccgctccttcccgccgcgccccgctcccccgcccgaacttccaaccgccgactcgccaaatccgaccgcgaccgccgattaccgcccccaacccgaaaaaaacccgaaaaacaaaacgaaaaaaaaaacgtaacgtactcgaaaataaccaacaacgaaacgaaaaatatcccgaaaaaacccaaccgaaaacgaaaaaaccaaaccgacgcgaactcgaaaccctccccgcgaacatccccgaattcgaaacccccgaccgcccccgccgacgcgaaaaaacgaccccaacttccaaccccacttcgcactcccgccctcttccctccaccatataaaaatctacaacctcaaaaaataacacgtcgaaaattcctcgacctcgccgcccgccctccccctcctaaacaacgttcctaccgcgaaaattccgaaaaaaaaaacgaattcctcgaacaaaatctactaaaaaaactaaaaata

SEQ ID NO: 15193 - DNA, 508 bp, Artificial Sequence
  chemically treated genomic DNA (Homo sapiens) CpG-island No: 15193
ttcggcgttaagtttttgtcgggaagtttagggcgttttcgggatagggacgtattttggcggattcggcgttaggtcggggttttttagtgtatcgggattcggcgatcgcgttcggggtttcggttttttttagttttcggtttttgtacgttttattttttttagggttgaaacgcggggttttgggcgcgttatatatcgggtcgtttacgtttttttagtcggtagtttggaggatttttgtcgtttttttcgttgttttcgtcgtcgtcgttttttttttttagtcgtcgtcgtcgtcgtttaaataattattaggagggtttgatgggggatttcgttatgttaatgatgtcgggattatatggggatttggggttcgtttattatcgtaaatcgtcgaatatatcggtcgttataatcgtagattcgtagaagttgttgtttttcggttttgtttagttaagtagaaattttttttggtttagttagattaaagaaattt

SEQ ID NO: 15194 - DNA, 508 bp, Artificial Sequence
  chemically treated genomic DNA (Homo sapiens) CpG-island No: 15194
aaatttctttaatctaactaaaccaaaaaaaatttctacttaactaaacaaaaccgaaaaacaacaacttctacgaatctacgattataacgaccgatatattcgacgatttacgataataaacgaaccccaaatccccatataatcccgacatcattaacataacgaaatcccccatcaaaccctcctaataattatttaaacgacgacgacgacgactaaaaaaaaaaaacgacgacgacgaaaacaacgaaaaaaacgacaaaaatcctccaaactaccgactaaaaaaacgtaaacgacccgatatataacgcgcccaaaaccccgcgtttcaaccctaaaaaaaataaaacgtacaaaaaccgaaaactaaaaaaaaccgaaaccccgaacgcgatcgccgaatcccgatacactaaaaaaccccgacctaacgccgaatccgccaaaatacgtccctatcccgaaaacgccctaaacttcccgacaaaaacttaacgccgaa

SEQ ID NO: 15195 - DNA, 508 bp, Artificial Sequence
  chemically treated genomic DNA (Homo sapiens) CpG-island No: 15195
aggtttttttagtttggttgaattaaaaggagtttttgtttagttaggtagggtcgggggataatagtttttgcgagtttgcgattgtggcggtcggtatattcggcggtttacggtaatgggcgggttttaaatttttatgtggtttcgatattattgatatggcggaattttttattaaatttttttggtagttatttgagcggcggcggcggcggttggaggaggagagcggcggcggcgggagtagcgaagggggcggtagggattttttaggttgtcggttgggaaggcgtgggcgattcggtgtgtggcgcgtttagagtttcgcgttttagttttagggaaggtaaggcgtgtaagagtcggggattagaggagatcgggatttcgagcgcgatcgtcgggtttcggtgtattggaaagtttcggtttgacgtcgagttcgttaaagtgcgtttttgtttcgggagcgttttgggtttttcggtaaaaatttggcgtcgga

SEQ ID NO: 15196 - DNA, 508 bp, Artificial Sequence
  chemically treated genomic DNA (Homo sapiens) CpG-island No: 15196
tccgacgccaaatttttaccgaaaaacccaaaacgctcccgaaacaaaaacgcactttaacgaactcgacgtcaaaccgaaactttccaatacaccgaaacccgacgatcgcgctcgaaatcccgatctcctctaatccccgactcttacacgccttaccttccctaaaactaaaacgcgaaactctaaacgcgccacacaccgaatcgcccacgccttcccaaccgacaacctaaaaaatccctaccgcccccttcgctactcccgccgccgccgctctcctcctccaaccgccgccgccgccgctcaaataactaccaaaaaaatttaataaaaaattccgccatatcaataatatcgaaaccacataaaaatttaaaacccgcccattaccgtaaaccgccgaatataccgaccgccacaatcgcaaactcgcaaaaactattatcccccgaccctacctaactaaacaaaaactccttttaattcaaccaaactaaaaaaacct

SEQ ID NO: 15197 - DNA, 530 bp, Artificial Sequence
  chemically treated genomic DNA (Homo sapiens) CpG-island No: 15197
ggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagaaaatatacgttcgtgttaggaggttagttaggtataatggggttttatttttttgcggcgtagaattcgggttcgggggttgagaattagatatagttcggtttg

SEQ ID NO: 15198 - DNA, 530 bp, Artificial Sequence
  chemically treated genomic DNA (Homo sapiens) CpG-island No: 15198
caaaccgaactatatctaattctcaacccccgaacccgaattctacgccgcaaaaaaataaaaccccattatacctaactaacctcctaacacgaacgtatattttcttttactaaaaaccgacaatacgcttcgcctccctacccaaccgcaacctaccgtcccctaaacaaaaaacgacgaccgcgacccgaccacccgaaccccgccgcgctacgcctttattaaacgatccacaaataatacccaacacgaaaccgcgccgaaaacgaaaacgaaaaaccgcgaaaaaaatcgaacgaaaaaaaaaaaaacgacgaaacaaccaatccgcgcgcgacccatcaactaaccgcctttacttacaccaaatacacgccgactacgaaaaacacaaaacgaaacgcaccgcgaacgccgacaacgaaccgataaacgaaacgaaacccgtacgcccgcgactacaaacgcccgcctaacgaaaaaaaaaaccgacgacgtcaacccgaacgacgacatccctaaacgcc

SEQ ID NO: 15199 - DNA, 530 bp, Artificial Sequence
  chemically treated genomic DNA (Homo sapiens) CpG-island No: 15199
taggtcgaattgtgtttggtttttagttttcgagttcgagttttacgtcgtaaagagatggggttttattgtgtttagttggttttttagtacggacgtgtatttttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcggcggcgttagttcgggcggcggtatttttaggcgtt

SEQ ID NO: 15200 - DNA, 530 bp, Artificial Sequence
  chemically treated genomic DNA (Homo sapiens) CpG-island No: 15200
aacgcctaaaaataccgccgcccgaactaacgccgccgacccctctccccgccaaacgaacgcttacaaccgcgaacgcacgaacctcgcctcgttcaccgactcgttaccgacgcccgcgatacgccccgctttatactccccgcaaccgacgtacacctaatataaacaaaaacgatcaactaataaaccgcgcgcgaattaactactccgccgtctcctcccctcccgcccgaccctcttcgcgacctcccgcccccgccctcgacgcgaccccgtactaaacaccatctataaaccgcccaacaaaaacgcaacgcgacgaaactcgaataaccgaaccgcgatcgccgctttttatctaaaaaacgacaaactacgactaaacaaaaaaacgaaacgcactaccgatttttaacaaaaaaaaatacacgtccgtactaaaaaaccaactaaacacaataaaaccccatctctttacgacgtaaaactcgaactcgaaaactaaaaaccaaacacaattcgaccta

SEQ ID NO: 15201 - DNA, 717 bp, Artificial Sequence
  chemically treated genomic DNA (Homo sapiens) CpG-island No: 15201
  misc_feature (470)..(470): n is either a, c, g or t
  misc_feature (613)..(613): n is either a, c, g or t
  misc_feature (676)..(676): n is either a, c, g or t
gcgtcgcgcgtttttttttcgggcgtttaggttcggcgggggtttagagggtagggatggttcgggcgagggacggggtttcggaggcgggaggcgggaggcgggaggcgggaagcgggaggttggaagtcgcgcgttgtcggggtttttcggtgaagggtaggtaaataatcggtcggtttgggcggagtcgggcgggcggggcgagggcggagggcggagggcgtattgttttattttgtatattttattggaaatcggacgtattcggaggaggggttgggaggcggttcgggtatcgttaatggtcgggtcgggcgtcggggaggtcggcgagcgttgcggttcgttaaatattttggtagtttcgcgtcgcgttcgtattggttcgcgtcgttcgttcgtcgatagttttttgagttagttcgggaggtagtcgcgcgtagcgagtcggtggcgtaggtgtcggngttttcgagcgtttagtttgggagtatgattgtggataagttgttggacgatagttcgcgcggaaaggggttgcgggacgcggtcgggcggttggggttttatggattagttcgtttaatttgagttatttttacggggcgtnggcggtcgtcgtcggtttcgggcggttgggaagttagtttggttgggttttgggtttttcggngttcgggtgggtcggtttcgattttttcgatttttttttgg

SEQ ID NO: 15202 - DNA, 717 bp, Artificial Sequence
  chemically treated genomic DNA (Homo sapiens) CpG-island No: 15202
  misc_feature (42)..(42): n is either a, c, g or t
  misc_feature (105)..(105): n is either a, c, g or t
  misc_feature (248)..(248): n is either a, c, g or t
ccaaaaaaaaatcgaaaaaatcgaaaccgacccacccgaacnccgaaaaacccaaaacccaaccaaactaacttcccaaccgcccgaaaccgacgacgaccgccnacgccccgtaaaaataactcaaattaaacgaactaatccataaaaccccaaccgcccgaccgcgtcccgcaacccctttccgcgcgaactatcgtccaacaacttatccacaatcatactcccaaactaaacgctcgaaaacnccgacacctacgccaccgactcgctacgcgcgactacctcccgaactaactcaaaaaactatcgacgaacgaacgacgcgaaccaatacgaacgcgacgcgaaactaccaaaatatttaacgaaccgcaacgctcgccgacctccccgacgcccgacccgaccattaacgatacccgaaccgcctcccaacccctcctccgaatacgtccgatttccaataaaatatacaaaataaaacaatacgccctccgccctccgccctcgccccgcccgcccgactccgcccaaaccgaccgattatttacctacccttcaccgaaaaaccccgacaacgcgcgacttccaacctcccgcttcccgcctcccgcctcccgcctcccgcctccgaaaccccgtccctcgcccgaaccatccctaccctctaaacccccgccgaacctaaacgcccgaaaaaaaaacgcgcgacgc

SEQ ID NO: 15203 - DNA, 717 bp, Artificial Sequence
  chemically treated genomic DNA (Homo sapiens) CpG-island No: 15203
  misc_feature (42)..(42): n is either a, c, g or t
  misc_feature (105)..(105): n is either a, c, g or t
  misc_feature (248)..(248): n is either a, c, g or t
ttaaggaaaaatcggaagagtcggaatcggtttattcgggtntcgaggggtttaagatttaattaagttggttttttagtcgttcggggtcggcggcggtcgttnacgtttcgtagaagtagtttaggttgagcgggttggtttatgaggttttagtcgttcggtcgcgtttcgtagttttttttcgcgcgggttgtcgtttagtagtttgtttataattatgtttttaggttgggcgttcgaggatntcgatatttgcgttatcggttcgttgcgcgcggttgtttttcgggttggtttagggagttgtcggcgggcggacggcgcgggttagtacgggcgcggcgcgggattgttagggtatttaacgggtcgtagcgttcgtcgattttttcggcgttcggttcggttattggcggtgttcgggtcgttttttagtttttttttcggatgcgttcgatttttagtaaaatgtataggatgaggtaatgcgtttttcgtttttcgttttcgtttcgttcgttcggtttcgtttagatcgatcggttgtttgtttgttttttatcgggaaatttcgatagcgcgcggtttttagtttttcgtttttcgtttttcgtttttcgtttttcgttttcgggatttcgtttttcgttcgggttatttttgttttttaggttttcgtcgggtttgggcgttcggggagagggcgcgcggcgt

SEQ ID NO: 15204 - DNA, 717 bp, Artificial Sequence
  chemically treated genomic DNA (Homo sapiens) CpG-island No: 15204
  misc_feature (470)..(470): n is either a, c, g or t
  misc_feature (613)..(613): n is either a, c, g or t
  misc_feature (676)..(676): n is either a, c, g or t
acgccgcgcgccctctccccgaacgcccaaacccgacgaaaacctaaaaaacaaaaataacccgaacgaaaaacgaaatcccgaaaacgaaaaacgaaaaacgaaaaacgaaaaacgaaaaactaaaaaccgcgcgctatcgaaatttcccgataaaaaacaaacaaacaaccgatcgatctaaacgaaaccgaacgaacgaaacgaaaacgaaaaacgaaaaacgcattacctcatcctatacattttactaaaaatcgaacgcatccgaaaaaaaaactaaaaaacgacccgaacaccgccaataaccgaaccgaacgccgaaaaaatcgacgaacgctacgacccgttaaataccctaacaatcccgcgccgcgcccgtactaacccgcgccgtccgcccgccgacaactccctaaaccaacccgaaaaacaaccgcgcgcaacgaaccgataacgcaaatatcganatcctcgaacgcccaacctaaaaacataattataaacaaactactaaacgacaacccgcgcgaaaaaaaactacgaaacgcgaccgaacgactaaaacctcataaaccaacccgctcaacctaaactacttctacgaaacgtnaacgaccgccgccgaccccgaacgactaaaaaaccaacttaattaaatcttaaacccctcganacccgaataaaccgattccgactcttccgatttttccttaa

SEQ ID NO: 15205 - DNA, 524 bp, Artificial Sequence
  chemically treated genomic DNA (Homo sapiens) CpG-island No: 15205
gtaattcgttcgcgggattttttaatcgtttcgggaattcggaatcggtattttatcggcgatcgatatcggattcgcgatcgtatcgtttttcggatggtagtttattggagacgtaatttatttttaatcgtacgggtttttcgcgaattttatcggattgaattggaatttaagggatcgtatcggaattaaatcgattgatttttatatcggttcggaattgtttcgattcggttcggtacggttttgtacgcgacgtttttcgatttgttacgttatcgattcgcgaagcgattcgtatgcgttttcgttttcgtatcgttatcgaaattggtatttttatcgcggttttttcgtttcgtttcgcgattatgtaattacggatacggcgtttttggttattgcggatgttgaatttttcggatttttcgtttacgggatttttgatatgtttgaatttcggtttttattttcgtttttacgtcgtttattatcggggtatcgttcgttttcgcgttacg

SEQ ID NO: 15206 - DNA, 524 bp, Artificial Sequence
  chemically treated genomic DNA (Homo sapiens) CpG-island No: 15206
cgtaacgcgaaaacgaacgataccccgataataaacgacgtaaaaacgaaaataaaaaccgaaattcaaacatatcaaaaatcccgtaaacgaaaaatccgaaaaattcaacatccgcaataaccaaaaacgccgtatccgtaattacataatcgcgaaacgaaacgaaaaaaccgcgataaaaataccaatttcgataacgatacgaaaacgaaaacgcatacgaatcgcttcgcgaatcgataacgtaacaaatcgaaaaacgtcgcgtacaaaaccgtaccgaaccgaatcgaaacaattccgaaccgatataaaaatcaatcgatttaattccgatacgatcccttaaattccaattcaatccgataaaattcgcgaaaaacccgtacgattaaaaataaattacgtctccaataaactaccatccgaaaaacgatacgatcgcgaatccgatatcgatcgccgataaaataccgattccgaattcccgaaacgattaaaaaatcccgcgaacgaattac

SEQ ID NO: 15207 - DNA, 524 bp, Artificial Sequence
  chemically treated genomic DNA (Homo sapiens) CpG-island No: 15207
cgtagcgcgaggacgagcggtgtttcgataatggacgacgtgggggcgagggtgaaggtcggggtttagatatattaggagtttcgtggacggagaattcggagagtttagtattcgtagtgattaagaacgtcgtattcgtgattgtatgatcgcggagcggaacgggagagtcgcgatgggagtgttagtttcgatagcggtacggaggcggaagcgtatacgagtcgtttcgcgggtcgatggcgtggtagatcgaggggcgtcgcgtatagaatcgtgtcgaatcgagtcggagtagtttcggatcgatgtggaagttagtcggtttgatttcgatgcggttttttgggttttagtttagttcggtaaaattcgcgggaggttcgtgcggttggaagtaggttgcgtttttagtgggttattattcggggagcgatgcggtcgcgagttcgatgtcggtcgtcggtagagtatcgatttcgaattttcgaggcgattgggagatttcgcgagcggattgt

SEQ ID NO: 15208 - DNA, 524 bp, Artificial Sequence
  chemically treated genomic DNA (Homo sapiens) CpG-island No: 15208
acaatccgctcgcgaaatctcccaatcgcctcgaaaattcgaaatcgatactctaccgacgaccgacatcgaactcgcgaccgcatcgctccccgaataataacccactaaaaacgcaacctacttccaaccgcacgaacctcccgcgaattttaccgaactaaactaaaacccaaaaaaccgcatcgaaatcaaaccgactaacttccacatcgatccgaaactactccgactcgattcgacacgattctatacgcgacgcccctcgatctaccacgccatcgacccgcgaaacgactcgtatacgcttccgcctccgtaccgctatcgaaactaacactcccatcgcgactctcccgttccgctccgcgatcatacaatcacgaatacgacgttcttaatcactacgaatactaaactctccgaattctccgtccacgaaactcctaatatatctaaaccccgaccttcaccctcgcccccacgtcgtccattatcgaaacaccgctcgtcctcgcgctacg

SEQ ID NO: 15209 - DNA, 611 bp, Artificial Sequence
  chemically treated genomic DNA (Homo sapiens) CpG-island No: 15209
gttttttttaaacgggggttttgtttataaggaggtcgtagtagttttcgagtgatttcggtgtaaatttgtagagaaaaattattttattttacggaagcgggtggaggagtcgcgtttttcggtaggttacgtggggcggaaagatttatttagttttttcgtattttcgtttcgatttaggaaaacgttttggggaattttagttttgaaaaggcgcgttttattttttacgtcgggtgttggcgataaggtttagtgaaaaagcgtttcggggtcgttcgcgcggaggggaaagtgttgagggaagttaaggaattcgcgtttgcggtcgtcggaaacgtggcggggatacgattttcgcgtcggggttattttgtttattgttgaggaggtttttcgttacgtttcgttttcgtttttttcgaggatcgggcgcggtggcgtttttggtttatagtaggaaggaaggggtagtaatttacgttattaattttgtttttatgagcggcgcgcgttcgtttatcggtttcgttattgtcgtagtcgttacgtagttacgcgtattttcgggttggtagacgttaatagaatattggattaattgtggt

SEQ ID NO: 15210 - DNA, 611 bp, Artificial Sequence
  chemically treated genomic DNA (Homo sapiens) CpG-island No: 15210
accacaattaatccaatattctattaacgtctaccaacccgaaaatacgcgtaactacgtaacgactacgacaataacgaaaccgataaacgaacgcgcgccgctcataaaaacaaaattaataacgtaaattactaccccttccttcctactataaaccaaaaacgccaccgcgcccgatcctcgaaaaaaacgaaaacgaaacgtaacgaaaaacctcctcaacaataaacaaaataaccccgacgcgaaaatcgtatccccgccacgtttccgacgaccgcaaacgcgaattccttaacttccctcaacactttcccctccgcgcgaacgaccccgaaacgctttttcactaaaccttatcgccaacacccgacgtaaaaaataaaacgcgccttttcaaaactaaaattccccaaaacgttttcctaaatcgaaacgaaaatacgaaaaaactaaataaatctttccgccccacgtaacctaccgaaaaacgcgactcctccacccgcttccgtaaaataaaataatttttctctacaaatttacaccgaaatcactcgaaaactactacgacctccttataaacaaaacccccgtttaaaaaaaac

SEQ ID NO: 15211 - DNA, 611 bp, Artificial Sequence
  chemically treated genomic DNA (Homo sapiens) CpG-island No: 15211
gttatagttggtttaatgttttattgacgtttattagttcggaagtgcgcgtggttgcgtggcggttgcggtaatagcggggtcggtaagcgggcgcgcgtcgtttataggggtagagttggtggcgtgagttgttgtttttttttttttgttgtgggttagaggcgttatcgcgttcggttttcgaggaagacgggagcgggacgtggcgagaggtttttttagtagtgggtaaaatagtttcgacgcggaggtcgtgttttcgttacgttttcggcgatcgtaggcgcggattttttggttttttttagtattttttttttcgcgcggacggtttcgagacgtttttttattgggttttgtcgttagtattcggcgtggggggtgagacgcgtttttttagggttggggttttttagagcgtttttttaagtcgaggcggaggtgcgaggaaattgagtgggttttttcgttttacgtggtttgtcgggaagcgcggtttttttattcgttttcgtggaatggaatggtttttttttgtaggtttatatcggggttattcgagagttgttgcggtttttttatgggtaggattttcgtttggggagaat

SEQ ID NO: 15212 - DNA, 611 bp, Artificial Sequence
  chemically treated genomic DNA (Homo sapiens) CpG-island No: 15212
attctccccaaacgaaaatcctacccataaaaaaaccgcaacaactctcgaataaccccgatataaacctacaaaaaaaaaccattccattccacgaaaacgaataaaaaaaccgcgcttcccgacaaaccacgtaaaacgaaaaaacccactcaatttcctcgcacctccgcctcgacttaaaaaaacgctctaaaaaaccccaaccctaaaaaaacgcgtctcaccccccacgccgaatactaacgacaaaacccaataaaaaaacgtctcgaaaccgtccgcgcgaaaaaaaaaatactaaaaaaaaccaaaaaatccgcgcctacgatcgccgaaaacgtaacgaaaacacgacctccgcgtcgaaactattttacccactactaaaaaaacctctcgccacgtcccgctcccgtcttcctcgaaaaccgaacgcgataacgcctctaacccacaacaaaaaaaaaaaaacaacaactcacgccaccaactctacccctataaacgacgcgcgcccgcttaccgaccccgctattaccgcaaccgccacgcaaccacgcgcacttccgaactaataaacgtcaataaaacattaaaccaactataac

SEQ ID NO: 15213 - DNA, 558 bp, Artificial Sequence
  chemically treated genomic DNA (Homo sapiens) CpG-island No: 15213
gatggtaggggacggcgttttgttttcgggacggagcgtaggtttgtaattgtttttttcgtttaggttattatttttaggtttgggtacgcgtcgtcgtttgtttttttggggtcgttagggggcgttgtggtttcggtgcgcggtagtcgcgcgatacgggttttttttcggagttttcggtatcgttttgttttagttttttttgcgggtaaatagatatggtcggcgaaggagattagtaggacgttgcgtataatatgggtaattatttgtcgtttttgtttggtaatcgttcggagtagttttttgtagtcgggagtggggcgaggttcggagtcgttagcggtgtagttgggtttgggaggcgggcgtgggggcgttaagtttggcgagttagtttagtagggtcgtatcggaaagttgttttacgtcggttttcggttagcgatggagtcgcggcgtttttttcgttgttttgttgtttcgagtcgtgagttagggtgtcggggggagtatttgttattaagaataggaaatttattttttttatttttt

SEQ ID NO: 15214 - DNA, 558 bp, Artificial Sequence
  chemically treated genomic DNA (Homo sapiens) CpG-island No: 15214
aaaaaataaaaaaaataaatttcctattcttaataacaaatactccccccgacaccctaactcacgactcgaaacaacaaaacaacgaaaaaaacgccgcgactccatcgctaaccgaaaaccgacgtaaaacaactttccgatacgaccctactaaactaactcgccaaacttaacgcccccacgcccgcctcccaaacccaactacaccgctaacgactccgaacctcgccccactcccgactacaaaaaactactccgaacgattaccaaacaaaaacgacaaataattacccatattatacgcaacgtcctactaatctccttcgccgaccatatctatttacccgcaaaaaaaactaaaacaaaacgataccgaaaactccgaaaaaaaacccgtatcgcgcgactaccgcgcaccgaaaccacaacgccccctaacgaccccaaaaaaacaaacgacgacgcgtacccaaacctaaaaataataacctaaacgaaaaaaacaattacaaacctacgctccgtcccgaaaacaaaacgccgtcccctaccatc

SEQ ID NO: 15215 - DNA, 558 bp, Artificial Sequence
  chemically treated genomic DNA (Homo sapiens) CpG-island No: 15215
ggaggatggagaggatgggttttttgtttttaatagtaaatgtttttttcgatattttggtttacggttcggggtaatagagtagcgaagaaagcgtcgcgattttatcgttggtcgagggtcgacgtgaagtagtttttcggtgcggttttgttgggttggttcgttaggtttggcgtttttacgttcgttttttaggtttagttgtatcgttagcggtttcgagtttcgttttattttcgattatagggaattatttcgggcggttattaggtaggagcggtaggtggttgtttatgttgtgcgtagcgttttgttgatttttttcgtcggttatgtttgtttattcgtaaaggaggttgggatagggcggtgtcgaagatttcgagggagggttcgtgtcgcgcggttgtcgcgtatcggggttatagcgttttttggcggttttaggggagtagacggcggcgcgtatttaagtttgaaagtgatggtttaggcgggagggataattataggtttgcgtttcgtttcggggatagaacgtcgttttttgttatt

SEQ ID NO: 15216 - DNA, 558 bp, Artificial Sequence
  chemically treated genomic DNA (Homo sapiens) CpG-island No: 15216
aataacaaaaaacgacgttctatccccgaaacgaaacgcaaacctataattatccctcccgcctaaaccatcactttcaaacttaaatacgcgccgccgtctactcccctaaaaccgccaaaaaacgctataaccccgatacgcgacaaccgcgcgacacgaaccctccctcgaaatcttcgacaccgccctatcccaacctcctttacgaataaacaaacataaccgacgaaaaaaatcaacaaaacgctacgcacaacataaacaaccacctaccgctcctacctaataaccgcccgaaataattccctataatcgaaaataaaacgaaactcgaaaccgctaacgatacaactaaacctaaaaaacgaacgtaaaaacgccaaacctaacgaaccaacccaacaaaaccgcaccgaaaaactacttcacgtcgaccctcgaccaacgataaaatcgcgacgctttcttcgctactctattaccccgaaccgtaaaccaaaatatcgaaaaaaacatttactattaaaaacaaaaaacccatcctctccatcctcc

SEQ ID NO: 15217 - DNA, 504 bp, Artificial Sequence
  chemically treated genomic DNA (Homo sapiens) CpG-island No: 15217
tcgggtttcgttttaggttattcgggttttgcgcgtacgtgtagttttttggagtttcggaagcggatcgcggtgtgtgaaggtgatatcgtcgagtaagagtgtgtttaggtgtagattaagttttcgattcgtcgtttcgtttttttatattcgttttgttgattttaaaattttcgtatcgcgttttttattcgaggtaaatacggatttcgttatgtgggtaaaattcgttttgagattagtttttgttttttgttattcgcgtttttttttcgtataaaatttttttttgattttttttttcgtttcgcgttttttaaagtttttatttgcgaggtggattttcgttttgagcgttttttagttttttcgtcgtcggttttggagcgtagcgtcgtagatcgcgtttttcgtttggttttaggtttttgtagattttattttgttttaaggcgtcgtcgttttttatttttttttttttcgtgtcgggttttgttgttt

SEQ ID NO: 15218 - DNA, 504 bp, Artificial Sequence
  chemically treated genomic DNA (Homo sapiens) CpG-island No: 15218
aaacaacaaaacccgacacgaaaaaaaaaaaaataaaaaacgacgacgccttaaaacaaaataaaatctacaaaaacctaaaaccaaacgaaaaacgcgatctacgacgctacgctccaaaaccgacgacgaaaaaactaaaaaacgctcaaaacgaaaatccacctcgcaaataaaaactttaaaaaacgcgaaacgaaaaaaaaaatcaaaaaaaaattttatacgaaaaaaaaacgcgaataacaaaaaacaaaaactaatctcaaaacgaattttacccacataacgaaatccgtatttacctcgaataaaaaacgcgatacgaaaattttaaaatcaacaaaacgaatataaaaaaacgaaacgacgaatcgaaaacttaatctacacctaaacacactcttactcgacgatatcaccttcacacaccgcgatccgcttccgaaactccaaaaaactacacgtacgcgcaaaacccgaataacctaaaacgaaacccga

SEQ ID NO: 15219 - DNA, 504 bp, Artificial Sequence
  chemically treated genomic DNA (Homo sapiens) CpG-island No: 15219
gagtagtagggttcggtacgaggaggagggaggtggggggcgacggcgttttaggatagggtagggtttgtaggagtttaggattaggcggaggacgcggtttgcggcgttgcgttttagggtcgacgacggagaggttgggaggcgtttaggacgggaatttatttcgtaggtgaggattttaaaaagcgcggggcgggaggaggggttaggaaagggttttatgcgggaagaagacgcgaatggtaggggatagggattggttttagagcgagttttatttatatggcgaggttcgtatttatttcgggtgaagggcgcgatgcggggattttaaggttagtagagcgggtgtggaaaagcgggacggcgaatcgaaggtttaatttatatttaggtatatttttgttcggcggtgttatttttatatatcgcgattcgttttcgggattttaagaaattgtacgtgcgcgtagagttcgggtagtttggggcggagttcgg

SEQ ID NO: 15220 - DNA, 504 bp, Artificial Sequence
  chemically treated genomic DNA (Homo sapiens) CpG-island No: 15220
ccgaactccgccccaaactacccgaactctacgcgcacgtacaatttcttaaaatcccgaaaacgaatcgcgatatataaaaataacaccgccgaacaaaaatatacctaaatataaattaaaccttcgattcgccgtcccgcttttccacacccgctctactaaccttaaaatccccgcatcgcgcccttcacccgaaataaatacgaacctcgccatataaataaaactcgctctaaaaccaatccctatcccctaccattcgcgtcttcttcccgcataaaaccctttcctaacccctcctcccgccccgcgctttttaaaatcctcacctacgaaataaattcccgtcctaaacgcctcccaacctctccgtcgtcgaccctaaaacgcaacgccgcaaaccgcgtcctccgcctaatcctaaactcctacaaaccctaccctatcctaaaacgccgtcgccccccacctccctcctcctcgtaccgaaccctactactc

SEQ ID NO: 15221 - DNA, 530 bp, Artificial Sequence
  chemically treated genomic DNA (Homo sapiens) CpG-island No: 15221
gtttcgtatatagtattagaaggacggtttgtgaggcgacgttaacggcgttaacggatgtgagaagttgtcgttgcgtttcggttttttcgttcgagttagggtatttaatgttttcgattttttttttttttttttttcgttgttgtttttttgttttcgcggtcgtcgatgcgacgtaggtttggcggagaatcgattttttttcgttgtaggttttcgtttttttcgattttcgttagtttttttttttttttttcgattgtggtttgtaggttcgtgttttttttttttaatcgattttcgttcgcgcgtcgttttgcggtagcggtcggtttaaggtgtttaaaatcggggggaagtggaagagttttacgtttgtcgagttgtttgtgtcgttttcgaggggagtaaaagttggtcggcgtgttcgttgtgaagtagtaagtatcggcgtttattaggtcgtttatttttggtagtttggttgtttgtgtgttcgttttgtcggtttttcgggttagatagtg

SEQ ID NO: 15222 - DNA, 530 bp, Artificial Sequence
  chemically treated genomic DNA (Homo sapiens) CpG-island No: 15222
cactatctaacccgaaaaaccgacaaaacgaacacacaaacaaccaaactaccaaaaataaacgacctaataaacgccgatacttactacttcacaacgaacacgccgaccaacttttactcccctcgaaaacgacacaaacaactcgacaaacgtaaaactcttccacttccccccgattttaaacaccttaaaccgaccgctaccgcaaaacgacgcgcgaacgaaaatcgattaaaaaaaaaaaacacgaacctacaaaccacaatcgaaaaaaaaaaaaaaaaactaacgaaaatcgaaaaaaacgaaaacctacaacgaaaaaaaatcgattctccgccaaacctacgtcgcatcgacgaccgcgaaaacaaaaaaacaacaacgaaaaaaaaaaaaaaaaaaaatcgaaaacattaaataccctaactcgaacgaaaaaaccgaaacgcaacgacaacttctcacatccgttaacgccgttaacgtcgcctcacaaaccgtccttctaatactatatacgaaac

SEQ ID NO: 15223 - DNA, 530 bp, Artificial Sequence
  chemically treated genomic DNA (Homo sapiens) CpG-island No: 15223
tattgtttgattcgagaggtcgataggacgagtatataggtagttagattgttaaagatgggcggtttgatgggcgtcgatgtttgttgttttatagcgagtacgtcggttagtttttatttttttcgaggacgatatagatagttcgataggcgtggagtttttttattttttttcgattttgagtattttgaatcgatcgttgtcgtaagacgacgcgcggacgagaatcgattggggggggggggtacgggtttgtaagttatagtcgaaaggggaggaggggggttggcgagaatcggggaggacgggagtttgtagcggaggggaatcgatttttcgttaggtttgcgtcgtatcgacgatcgcggaagtaagagagtaatagcgagaggaggaagaaagagggatcgagagtattggatgttttgattcggacggaaaagtcgaggcgtaacggtaattttttatattcgttaacgtcgttaacgtcgttttataagtcgtttttttggtattgtgtgcgggat

SEQ ID NO: 15224 - DNA, 530 bp, Artificial Sequence
  chemically treated genomic DNA (Homo sapiens) CpG-island No: 15224
atcccgcacacaataccaaaaaaacgacttataaaacgacgttaacgacgttaacgaatataaaaaattaccgttacgcctcgacttttccgtccgaatcaaaacatccaatactctcgatccctctttcttcctcctctcgctattactctcttacttccgcgatcgtcgatacgacgcaaacctaacgaaaaatcgattcccctccgctacaaactcccgtcctccccgattctcgccaacccccctcctcccctttcgactataacttacaaacccgtaccccccccccccaatcgattctcgtccgcgcgtcgtcttacgacaacgatcgattcaaaatactcaaaatcgaaaaaaaataaaaaaactccacgcctatcgaactatctatatcgtcctcgaaaaaaataaaaactaaccgacgtactcgctataaaacaacaaacatcgacgcccatcaaaccgcccatctttaacaatctaactacctatatactcgtcctatcgacctctcgaatcaaacaata

SEQ ID NO: 15225 - DNA, 536 bp, Artificial Sequence
  chemically treated genomic DNA (Homo sapiens) CpG-island No: 15225
ttcgtaagtcgttgtgtttattcgcgtttgttaggtgtgatttatttacgttttagttttgttcggatagcgttatcgtcgatcgatttcgtttgtcgcgtcgttatggttatgttagagtttgtttaaattttgcgtgtttaattaggtttatttttttcgcggtcgtgtcgtttttaagttcgttcgcgtgtattgttttcggttttttttagatgcgttatttttaagtttatttaatttatgaacgttcgaagtgttattgtttagttcgtcgtcggtattgtcgggttcgtacggaagtaaagttttttagattattgtcggcgtttttgagtttttttaaatatgttgttttcgatcgagtttatttatcggtttttaaattcgtttcgaagtattattttcgcgttcgttgcgggttcgtttgagtgtcgattcgtttttttttgttttggattcgttgtttatcgatttaagagtcgtcgtttttagtatgttagaattagttgttattatttaaggttttaatttgt

SEQ ID NO: 15226 - DNA, 536 bp, Artificial Sequence
  chemically treated genomic DNA (Homo sapiens) CpG-island No: 15226
acaaattaaaaccttaaataataacaactaattctaacatactaaaaacgacgactcttaaatcgataaacaacgaatccaaaacaaaaaaaaacgaatcgacactcaaacgaacccgcaacgaacgcgaaaataatacttcgaaacgaatttaaaaaccgataaataaactcgatcgaaaacaacatatttaaaaaaactcaaaaacgccgacaataatctaaaaaactttacttccgtacgaacccgacaataccgacgacgaactaaacaataacacttcgaacgttcataaattaaataaacttaaaaataacgcatctaaaaaaaaccgaaaacaatacacgcgaacgaacttaaaaacgacacgaccgcgaaaaaaataaacctaattaaacacgcaaaatttaaacaaactctaacataaccataacgacgcgacaaacgaaatcgatcgacgataacgctatccgaacaaaactaaaacgtaaataaatcacacctaacaaacgcgaataaacacaacgacttacgaa

SEQ ID NO: 15227 - DNA, 536 bp, Artificial Sequence
  chemically treated genomic DNA (Homo sapiens) CpG-island No: 15227
gtaagttggagttttggatggtggtagttggttttggtatgttagaggcggcggtttttgggtcggtagataacggatttagggtaaggaggagcgggtcggtatttaggcgagttcgtaacgagcgcgagggtggtgtttcggggcgaatttgagggtcgatggatgagttcgatcgagggtagtatgtttgagagagtttaagggcgtcgataataatttggagggttttgttttcgtgcggattcgataatgtcggcgacgagttggataatgatatttcgggcgtttatggattggatgagtttgaggatgacgtatttaggggagatcgagggtagtgtacgcggacgaatttggaagcggtacggtcgcggaggaaatggatttggttgagtacgtaagatttgaataagttttagtatggttatggcggcgcggtagacgagatcgatcgacgatggcgttgttcgggtaaagttagaacgtggatagattatatttagtaagcgcggatgaatatagcggtttgcgga

SEQ ID NO: 15228 - DNA, 536 bp, Artificial Sequence
  chemically treated genomic DNA (Homo sapiens) CpG-island No: 15228
tccgcaaaccgctatattcatccgcgcttactaaatataatctatccacgttctaactttacccgaacaacgccatcgtcgatcgatctcgtctaccgcgccgccataaccatactaaaacttattcaaatcttacgtactcaaccaaatccatttcctccgcgaccgtaccgcttccaaattcgtccgcgtacactaccctcgatctcccctaaatacgtcatcctcaaactcatccaatccataaacgcccgaaatatcattatccaactcgtcgccgacattatcgaatccgcacgaaaacaaaaccctccaaattattatcgacgcccttaaactctctcaaacatactaccctcgatcgaactcatccatcgaccctcaaattcgccccgaaacaccaccctcgcgctcgttacgaactcgcctaaataccgacccgctcctccttaccctaaatccgttatctaccgacccaaaaaccgccgcctctaacataccaaaaccaactaccaccatccaaaactccaacttac

SEQ ID NO: 15229 - DNA, 604 bp, Artificial Sequence
  chemically treated genomic DNA (Homo sapiens) CpG-island No: 15229
cgttcggtgttagagacggggttagcgcggtttatagaggttgaattatcggttcggcgattcggcgtcgggcggcggggcgggcgtttatttcgatgagagagtagttgatttttacgttcgatttgacgaagttatcgtagtttattacgatgtttttcgagtcgtgcgtcggttttacgtcgtttagtagtagtattatcgcggcggtgattatcgcgggttttagcggtttcgcgttttggtttattagtatggttcgattttttttagttagatttatcgtcggtagtcgggtttcgttttttatattgtacgtcgtaggtttttttttttttttaggtcggttgatagtttatgtttcgttttatcgtcgtcgttagagtcgtcgcgtacgcgcgtttcgattttacgtttatagttttagaagagagaattaatgcgtatgttcggtaaggaaacgagattatttttgttttttagaggtttggaggatttcgcgcgatatttggtaggcgtaacgtaaggtgtatgtttatagggagaagttttaaagatgaattttattttagaattttttatcgtagttggaaaggacgggaga

SEQ ID NO: 15230 - DNA, 604 bp, Artificial Sequence
  chemically treated genomic DNA (Homo sapiens) CpG-island No: 15230
tctcccgtcctttccaactacgataaaaaattctaaaataaaattcatctttaaaacttctccctataaacatacaccttacgttacgcctaccaaatatcgcgcgaaatcctccaaacctctaaaaaacaaaaataatctcgtttccttaccgaacatacgcattaattctctcttctaaaactataaacgtaaaatcgaaacgcgcgtacgcgacgactctaacgacgacgataaaacgaaacataaactatcaaccgacctaaaaaaaaaaaaaaacctacgacgtacaatataaaaaacgaaacccgactaccgacgataaatctaactaaaaaaaatcgaaccatactaataaaccaaaacgcgaaaccgctaaaacccgcgataatcaccgccgcgataatactactactaaacgacgtaaaaccgacgcacgactcgaaaaacatcgtaataaactacgataacttcgtcaaatcgaacgtaaaaatcaactactctctcatcgaaataaacgcccgccccgccgcccgacgccgaatcgccgaaccgataattcaacctctataaaccgcgctaaccccgtctctaacaccgaacg

SEQ ID NO: 15231 - DNA, 604 bp, Artificial Sequence
  chemically treated genomic DNA (Homo sapiens) CpG-island No: 15231
tttttcgttttttttagttgcgatggagaattttaaagtagaatttatttttggagtttttttttgtaggtatgtattttgcgttgcgtttgttagatgtcgcgcggagttttttaggtttttagaaggtagagatggtttcgtttttttgtcgagtatgcgtattagtttttttttttggggttgtgaacgtggggtcgaagcgcgcgtgcgcggcggttttggcgacggcggtggggcggggtatgggttgttagtcggtttaggaggaggaaggagtttgcggcgtgtagtgtgaggggcgggattcggttgtcggcggtgggtttagttgggggaggtcgggttatgttggtgggttagggcgcggggtcgttggggttcgcggtggttatcgtcgcggtggtgttgttgttgagcggcgtggggtcggcgtacggttcggaggatatcgtggtgggttgcggtggtttcgttaagtcggacgtggagattaattatttttttatcgaggtgagcgttcgtttcgtcgttcggcgtcgagtcgtcgggtcggtggtttagtttttatgggtcgcgttggtttcgtttttgatatcgggcg

SEQ ID NO: 15232 - DNA, 604 bp, Artificial Sequence
  chemically treated genomic DNA (Homo sapiens) CpG-island No: 15232
cgcccgatatcaaaaacgaaaccaacgcgacccataaaaactaaaccaccgacccgacgactcgacgccgaacgacgaaacgaacgctcacctcgataaaaaaataattaatctccacgtccgacttaacgaaaccaccgcaacccaccacgatatcctccgaaccgtacgccgaccccacgccgctcaacaacaacaccaccgcgacgataaccaccgcgaaccccaacgaccccgcgccctaacccaccaacataacccgacctcccccaactaaacccaccgccgacaaccgaatcccgcccctcacactacacgccgcaaactccttcctcctcctaaaccgactaacaacccataccccgccccaccgccgtcgccaaaaccgccgcgcacgcgcgcttcgaccccacgttcacaaccccaaaaaaaaaaactaatacgcatactcgacaaaaaaacgaaaccatctctaccttctaaaaacctaaaaaactccgcgcgacatctaacaaacgcaacgcaaaatacatacctacaaaaaaaaactccaaaaataaattctactttaaaattctccatcgcaactaaaaaaaacgaaaaa

SEQ ID NO: 15233 - DNA, 920 bp, Artificial Sequence
  chemically treated genomic DNA (Homo sapiens) CpG-island No: 15233
tatcgttggcgattttttcgagatggacgtcgttggcgtttttcgtttttttttattgcgtcgtgatgatagtacgttgtcggtacgtttttgcggtttgttttaaggtaagtcgttagacgttattaggattgggttgttttgaaggaatcgaggatgttttttagtttgttttcgatttcgtcgttgtagttatcggtttggttgattttttgtattaacggagcgtgattacggtcgacgtaagttagtagagcggtttcgaagttgttaattttcgatagtttaatattcgttaggtaattacgttttgttgcgaatagaattagagattgttgcgtaacggatatcggcgtatattgtttttgttttagtagttcggttattttttgatcgtggttaagttgtttacgtgttgtatcgttaaggtcggatgtaaattgagagaacgttgttagtttacgatattgtgttagagcggtacggatattatcggatagtttttttatgattttggtttgtgttgtattattaatacgggatacggaaatattcgggttaatcgtaggacgaatatcggcgttgaataggttggtttttaggaagatttgattatcggtaatggagattacgttggtcggaacgaacgtagaaacgttattcgtttgagtttcgataatcggtagtgcggttagagaatcggtttttttttttattttatttttggtgaaggttttaacgtattcggcgttaatacgtgtagtacgttttagtagacgagagtggaggtagaaaacgtcgttcgggaatgttttacgttttggcggacgagcgtagtagtattgcggtaaaaggtttaatcggcgaaggttataaaggttacgttttttgggatatagaagtatttttgttatcgtttt

SEQ ID NO: 15234 - DNA, 920 bp, Artificial Sequence
  chemically treated genomic DNA (Homo sapiens) CpG-island No: 15234
aaaacgataacaaaaatacttctatatcccaaaaaacgtaacctttataaccttcgccgattaaaccttttaccgcaatactactacgctcgtccgccaaaacgtaaaacattcccgaacgacgttttctacctccactctcgtctactaaaacgtactacacgtattaacgccgaatacgttaaaaccttcaccaaaaataaaataaaaaaaaaaaccgattctctaaccgcactaccgattatcgaaactcaaacgaataacgtttctacgttcgttccgaccaacgtaatctccattaccgataatcaaatcttcctaaaaaccaacctattcaacgccgatattcgtcctacgattaacccgaatatttccgtatcccgtattaataatacaacacaaaccaaaatcataaaaaaactatccgataatatccgtaccgctctaacacaatatcgtaaactaacaacgttctctcaatttacatccgaccttaacgatacaacacgtaaacaacttaaccacgatcaaaaaataaccgaactactaaaacaaaaacaatatacgccgatatccgttacgcaacaatctctaattctattcgcaacaaaacgtaattacctaacgaatattaaactatcgaaaattaacaacttcgaaaccgctctactaacttacgtcgaccgtaatcacgctccgttaatacaaaaaatcaaccaaaccgataactacaacgacgaaatcgaaaacaaactaaaaaacatcctcgattccttcaaaacaacccaatcctaataacgtctaacgacttaccttaaaacaaaccgcaaaaacgtaccgacaacgtactatcatcacgacgcaataaaaaaaaacgaaaaacgccaacgacgtccatctcgaaaaaatcgccaacgata

SEQ ID NO: 15235 - DNA, 920 bp, Artificial Sequence
  chemically treated genomic DNA (Homo sapiens) CpG-island No: 15235
gaaacggtaataaaaatatttttgtattttagaaaacgtggtttttgtagttttcgtcggttaagttttttgtcgtaatgttgttgcgttcgttcgttaggacgtgaagtattttcgggcgacgttttttatttttattttcgtttgttggagcgtgttgtacgtgttaacgtcgaatacgttgaagtttttattaaaggtgaagtgaaagggaaaatcggttttttgatcgtattgtcgattatcgaaatttaggcgggtgacgtttttgcgttcgtttcgattaacgtaatttttattatcgatggttagatttttttggaaattaatttgtttaacgtcggtattcgttttgcggttaattcgggtattttcgtatttcgtgttggtggtgtagtatagattaagattatgaaaaaattgttcggtggtattcgtatcgttttggtatagtatcgtgaattggtagcgtttttttagtttgtattcgattttgacgatgtaatacgtaagtagtttgattacggttagaaagtgatcgaattgttgaaatagaaatagtatgcgtcgatgttcgttgcgtagtagtttttggttttgttcgtagtagaacgtggttatttggcggatgttgaattgtcgaaaattggtagtttcgaagtcgttttgttggtttacgtcgatcgtgattacgtttcgttgatgtaagagattaattagatcggtggttataacgacgaaatcgaaggtaagttgaaaggtattttcgatttttttaaagtaatttaattttggtaacgtttggcggtttgttttagggtaggtcgtaaggacgtgtcgatagcgtgttattattacgacgtaatggagaaagacggagagcgttaacggcgtttatttcgaaggagtcgttagcgata

SEQ ID NO: 15236 - DNA, 920 bp, Artificial Sequence
  chemically treated genomic DNA (Homo sapiens) CpG-island No: 15236
tatcgctaacgactccttcgaaataaacgccgttaacgctctccgtctttctccattacgtcgtaataataacacgctatcgacacgtccttacgacctaccctaaaacaaaccgccaaacgttaccaaaattaaattactttaaaaaaatcgaaaatacctttcaacttaccttcgatttcgtcgttataaccaccgatctaattaatctcttacatcaacgaaacgtaatcacgatcgacgtaaaccaacaaaacgacttcgaaactaccaattttcgacaattcaacatccgccaaataaccacgttctactacgaacaaaaccaaaaactactacgcaacgaacatcgacgcatactatttctatttcaacaattcgatcactttctaaccgtaatcaaactacttacgtattacatcgtcaaaatcgaatacaaactaaaaaaacgctaccaattcacgatactataccaaaacgatacgaataccaccgaacaattttttcataatcttaatctatactacaccaccaacacgaaatacgaaaatacccgaattaaccgcaaaacgaataccgacgttaaacaaattaatttccaaaaaaatctaaccatcgataataaaaattacgttaatcgaaacgaacgcaaaaacgtcacccgcctaaatttcgataatcgacaatacgatcaaaaaaccgattttccctttcacttcacctttaataaaaacttcaacgtattcgacgttaacacgtacaacacgctccaacaaacgaaaataaaaataaaaaacgtcgcccgaaaatacttcacgtcctaacgaacgaacgcaacaacattacgacaaaaaacttaaccgacgaaaactacaaaaaccacgttttctaaaatacaaaaatatttttattaccgtttc

SEQ ID NO: 15237 - DNA, 602 bp, Artificial Sequence
  chemically treated genomic DNA (Homo sapiens) CpG-island No: 15237
ggcggtgcggagcggggaattacgtatttattcgtcgagttcgacgggttcggtaggggtgggtaaggtattgggaatagtcgttagttttagagggcgtgaggcggggcgtacggggagggggtgcggttaacgcgcgcgtgcgcggtttatgtgtgggttcgcgggggcgcgcgcgcggttagcgggtagcgagggttatttgggcggtgcgtagtacggcgggaatatggcgcgcggaatcggcgcgcgcgtttagttggcgggatcgttagatcgaggcggatgcggttcggatttcgtggatatggagtaatcgtcgtcgttggcgtcggagtttatttaagggttaattattataaggagttgaaggcggcgggagttcgagtcgtcgtcggcgtcggtgtcggtgagtgcgtgaggggttcgggtcgggagattttttttgtgaaatttcggcggtgggagttaggtcgggtttgaggttgaggagcgtttgtgaggcggaaggcgtttcgtagttcgggttttattttagttgcgagtttttaggcggcgggatttggtttaaagtttgtttgttttagtttttattagagtgg

SEQ ID NO: 15238 - DNA, 602 bp, Artificial Sequence
  chemically treated genomic DNA (Homo sapiens) CpG-island No: 15238
ccactctaataaaaactaaaacaaacaaactttaaaccaaatcccgccgcctaaaaactcgcaactaaaataaaacccgaactacgaaacgccttccgcctcacaaacgctcctcaacctcaaacccgacctaactcccaccgccgaaatttcacaaaaaaaatctcccgacccgaacccctcacgcactcaccgacaccgacgccgacgacgactcgaactcccgccgccttcaactccttataataattaacccttaaataaactccgacgccaacgacgacgattactccatatccacgaaatccgaaccgcatccgcctcgatctaacgatcccgccaactaaacgcgcgcgccgattccgcgcgccatattcccgccgtactacgcaccgcccaaataaccctcgctacccgctaaccgcgcgcgcgcccccgcgaacccacacataaaccgcgcacgcgcgcgttaaccgcaccccctccccgtacgccccgcctcacgccctctaaaactaacgactattcccaataccttacccacccctaccgaacccgtcgaactcgacgaataaatacgtaattccccgctccgcaccgcc

SEQ ID NO: 15239 - DNA, 602 bp, Artificial Sequence
  chemically treated genomic DNA (Homo sapiens) CpG-island No: 15239
ttattttagtggaaattgaggtaggtaggttttggattaggtttcgtcgtttgaaggttcgtagttgggatggaattcggattgcgagacgtttttcgttttataggcgttttttagttttaggttcggtttggtttttatcgtcggagttttataaagaaagtttttcggttcgagttttttacgtatttatcggtatcgacgtcggcggcgattcgggttttcgtcgtttttagttttttgtggtggttggtttttgggtgggtttcggcgttagcggcggcgattgttttatatttacggggttcgggtcgtattcgtttcgatttaacggtttcgttagttaggcgcgcgcgtcggtttcgcgcgttatgttttcgtcgtgttgcgtatcgtttaggtgattttcgttgttcgttaatcgcgcgcgcgttttcgcgggtttatatatgaatcgcgtacgcgcgcgttagtcgtatttttttttcgtgcgtttcgttttacgttttttagagttggcggttgtttttaatgttttgtttatttttgtcgggttcgtcggattcggcgggtgagtgcgtggtttttcgtttcgtatcgtt

SEQ ID NO: 15240 - DNA, 602 bp, Artificial Sequence
  chemically treated genomic DNA (Homo sapiens) CpG-island No: 15240
aacgatacgaaacgaaaaaccacgcactcacccgccgaatccgacgaacccgacaaaaataaacaaaacattaaaaacaaccgccaactctaaaaaacgtaaaacgaaacgcacgaaaaaaaaatacgactaacgcgcgcgtacgcgattcatatataaacccgcgaaaacgcgcgcgcgattaacgaacaacgaaaatcacctaaacgatacgcaacacgacgaaaacataacgcgcgaaaccgacgcgcgcgcctaactaacgaaaccgttaaatcgaaacgaatacgacccgaaccccgtaaatataaaacaatcgccgccgctaacgccgaaacccacccaaaaaccaaccaccacaaaaaactaaaaacgacgaaaacccgaatcgccgccgacgtcgataccgataaatacgtaaaaaactcgaaccgaaaaactttctttataaaactccgacgataaaaaccaaaccgaacctaaaactaaaaaacgcctataaaacgaaaaacgtctcgcaatccgaattccatcccaactacgaaccttcaaacgacgaaacctaatccaaaacctacctacctcaatttccactaaaataa

SEQ ID NO: 15241 - DNA, 549 bp, Artificial Sequence
  chemically treated genomic DNA (Homo sapiens) CpG-island No: 15241
  misc_feature (388)..(388): n is either a, c, g or t
  misc_feature (498)..(498): n is either a, c, g or t
  misc_feature (508)..(508): n is either a, c, g or t
  misc_feature (530)..(530): n is either a, c, g or t
  misc_feature (533)..(533): n is either a, c, g or t
cgggagaggaggcgtattgggggacgcgtagaataggcgaggagcgttttacgaagttagagtgtgtaaagatattttgagatcgtgataatacgcgcgagagcgtgcgcgcgagtatgataacgagtatataagagacgtatgagtgaggaaagaatcgacgcgcgcgtgggagatacgagcgagggtacgcgataggcgtatagacgagcgagagatacggagttatagttacgatagttacgagtggatatcgtagatagatacgtgatagataggaatgaacgcgaacgagataaacgggcgagacgttaggtgcgagcgacgattgacgtacgatagtcgaagagtaagatttttaatacgtatagatgacgtgtcggcgcgngatatcgtattattatcgagcgttacgaagagacgcgtagatatagcgcgagaaacgagaagacgttagtatacgttttacgttcgttattttagtttttttttataatnattttttttnttttttttcgtttttttgtatnttntgtaggttttcgaatt

SEQ ID NO: 15242 - DNA, 549 bp, Artificial Sequence
  chemically treated genomic DNA (Homo sapiens) CpG-island No: 15242
  misc_feature (17)..(17): n is either a, c, g or t
  misc_feature (20)..(20): n is either a, c, g or t
  misc_feature (42)..(42): n is either a, c, g or t
  misc_feature (52)..(52): n is either a, c, g or t
  misc_feature (162)..(162): n is either a, c, g or t
aattcgaaaacctacanaanatacaaaaaaacgaaaaaaaanaaaaaaaatnattataaaaaaaaactaaaataacgaacgtaaaacgtatactaacgtcttctcgtttctcgcgctatatctacgcgtctcttcgtaacgctcgataataatacgatatcncgcgccgacacgtcatctatacgtattaaaaatcttactcttcgactatcgtacgtcaatcgtcgctcgcacctaacgtctcgcccgtttatctcgttcgcgttcattcctatctatcacgtatctatctacgatatccactcgtaactatcgtaactataactccgtatctctcgctcgtctatacgcctatcgcgtaccctcgctcgtatctcccacgcgcgcgtcgattctttcctcactcatacgtctcttatatactcgttatcatactcgcgcgcacgctctcgcgcgtattatcacgatctcaaaatatctttacacactctaacttcgtaaaacgctcctcgcctattctacgcgtcccccaatacgcctcctctcccg

SEQ ID NO: 15243 - DNA, 549 bp, Artificial Sequence
  chemically treated genomic DNA (Homo sapiens) CpG-island No: 15243
  misc_feature (17)..(17): n is either a, c, g or t
  misc_feature (20)..(20): n is either a, c, g or t
  misc_feature (42)..(42): n is either a, c, g or t
  misc_feature (52)..(52): n is either a, c, g or t
  misc_feature (162)..(162): n is either a, c, g or t
agttcggaaatttatanaangtgtaagggggcgagaggaganaaagagggtngttataagaaagggttagagtggcgagcgtgggacgtatgttagcgttttttcgtttttcgcgttgtatttacgcgttttttcgtgacgttcgatgatagtacggtgttncgcgtcgatacgttatttgtacgtattagagattttgtttttcggttatcgtgcgttagtcgtcgttcgtatttgacgtttcgttcgtttgtttcgttcgcgtttatttttgtttgttacgtgtttgtttgcgatgtttattcgtggttgtcgtggttgtgatttcgtgtttttcgttcgtttgtgcgtttgtcgcgtgttttcgttcgtgttttttacgcgcgcgtcggttttttttttatttatgcgttttttgtgtgttcgttgttatgttcgcgcgtacgttttcgcgcgtgttgttacggttttagggtgtttttgtatattttggtttcgtggggcgtttttcgtttgttttgcgcgttttttagtgcgttttttttttcg

SEQ ID NO: 15244 - DNA, 549 bp, Artificial Sequence
  chemically treated genomic DNA (Homo sapiens) CpG-island No: 15244
  misc_feature (388)..(388): n is either a, c, g or t
  misc_feature (498)..(498): n is either a, c, g or t
  misc_feature (508)..(508): n is either a, c, g or t
  misc_feature (530)..(530): n is either a, c, g or t
  misc_feature (533)..(533): n is either a, c, g or t
cgaaaaaaaaaacgcactaaaaaacgcgcaaaacaaacgaaaaacgccccacgaaaccaaaatatacaaaaacaccctaaaaccgtaacaacacgcgcgaaaacgtacgcgcgaacataacaacgaacacacaaaaaacgcataaataaaaaaaaaaccgacgcgcgcgtaaaaaacacgaacgaaaacacgcgacaaacgcacaaacgaacgaaaaacacgaaatcacaaccacgacaaccacgaataaacatcgcaaacaaacacgtaacaaacaaaaataaacgcgaacgaaacaaacgaacgaaacgtcaaatacgaacgacgactaacgcacgataaccgaaaaacaaaatctctaatacgtacaaataacgtatcgacgcgnaacaccgtactatcatcgaacgtcacgaaaaaacgcgtaaatacaacgcgaaaaacgaaaaaacgctaacatacgtcccacgctcgccactctaaccctttcttataacnaccctctttntctcctctcgcccccttacacnttntataaatttccgaact

SEQ ID NO: 15245 - DNA, 501 bp, Artificial Sequence
  chemically treated genomic DNA (Homo sapiens) CpG-island No: 15245
atcgcgcgagtcgtatacggacgggaaagggttaatttcggtttgtttttggcgaattttggagaggcggtgttatggtaatcggtataatttaagttgttgacgattttcggatcgtcgcgcgtttatttatcgtggaagtagttattttcgtcgtttttttggattagacgcgttatattcgggtttttataattttagtatgttatcggtagcggattatttttagcgtttttcggcgtatcggtacgtagggttttacgtatatcggttatagtaaaagtatgtttacgcggtttgttgtaatcgcgcgagaagggatatttcgtttataggattattagtcgtggatttttcgttagggcgttaatacgttttgattgtttcgaggtggttttttaggagagatattgatcgggatgttgcggggtaaaggttttatttttcgtttttatagttataggttttgcgggagtagtcgtttgtttagcgtgaatagaa

SEQ ID NO: 15246 - DNA, 501 bp, Artificial Sequence
  chemically treated genomic DNA (Homo sapiens) CpG-island No: 15246
ttctattcacgctaaacaaacgactactcccgcaaaacctataactataaaaacgaaaaataaaacctttaccccgcaacatcccgatcaatatctctcctaaaaaaccacctcgaaacaatcaaaacgtattaacgccctaacgaaaaatccacgactaataatcctataaacgaaatatcccttctcgcgcgattacaacaaaccgcgtaaacatacttttactataaccgatatacgtaaaaccctacgtaccgatacgccgaaaaacgctaaaaataatccgctaccgataacatactaaaattataaaaacccgaatataacgcgtctaatccaaaaaaacgacgaaaataactacttccacgataaataaacgcgcgacgatccgaaaatcgtcaacaacttaaattataccgattaccataacaccgcctctccaaaattcgccaaaaacaaaccgaaattaaccctttcccgtccgtatacgactcgcgcgat

SEQ ID NO: 15247 - DNA, 501 bp, Artificial Sequence
  chemically treated genomic DNA (Homo sapiens) CpG-island No: 15247
ttttgtttacgttgaataaacggttgttttcgtaaaatttgtaattgtggaagcgaagaatgaaatttttgtttcgtagtatttcgattaatattttttttggaaagttatttcggaatagttagagcgtgttgacgttttggcggaagatttacggttggtgattttgtgggcggggtattttttttcgcgcgattataataagtcgcgtggatatgtttttgttgtgatcgatgtgcgtgaaattttgcgtatcggtgcgtcgaaaaacgttgaagatggttcgttatcgatggtatgttggagttgtaaaagttcggatgtggcgcgtttgatttagaaagacggcgaagatggttatttttacggtaaatgggcgcgcggcggttcggaaatcgttaataatttaggttgtgtcgattgttataatatcgtttttttagagttcgttaaaggtaaatcggagttaattttttttcgttcgtatgcggttcgcgcgat

SEQ ID NO: 15248 - DNA, 501 bp, Artificial Sequence
  chemically treated genomic DNA (Homo sapiens) CpG-island No: 15248
atcgcgcgaaccgcatacgaacgaaaaaaaattaactccgatttacctttaacgaactctaaaaaaacgatattataacaatcgacacaacctaaattattaacgatttccgaaccgccgcgcgcccatttaccgtaaaaataaccatcttcgccgtctttctaaatcaaacgcgccacatccgaacttttacaactccaacataccatcgataacgaaccatcttcaacgtttttcgacgcaccgatacgcaaaatttcacgcacatcgatcacaacaaaaacatatccacgcgacttattataatcgcgcgaaaaaaaataccccgcccacaaaatcaccaaccgtaaatcttccgccaaaacgtcaacacgctctaactattccgaaataactttccaaaaaaaatattaatcgaaatactacgaaacaaaaatttcattcttcgcttccacaattacaaattttacgaaaacaaccgtttattcaacgtaaacaaaa

SEQ ID NO: 15249 - DNA, 839 bp, Artificial Sequence
  chemically treated genomic DNA (Homo sapiens) CpG-island No: 15249
  misc_feature (123)..(123): n is either a, c, g or t
  misc_feature (165)..(165): n is either a, c, g or t
  misc_feature (277)..(277): n is either a, c, g or t
ggagtaatcggtatcgtaaattcgatattcgttttttttagtagtaggtggatagttagtacgtttgacggcgttttcgttatcgagattacgtatgtcgtaatggagttttgcggtgttttngtaattattttgtaggtatcgagtatttcgcgtcgtttcgtnttttggttgtagttgcgcggtagaaatcgatcgttgggagttaattcgcggattaaggacgtttgtttggtcgtttttgataatttttttaagtttcgattattaggtaatnggttattttgtttacggtttcgtttgattcgtgtttttttgatcggttttaatttcggattatcgttttttcgaaatattttacggcggggtagggggattacgttaggatcggtaagcgtcgaggtatcgtttaggttgttggtatcgttcgtcgtaattttgcgtagaatacggcgtataattttgtcggagcgggttttaggtagggagtcggtttagtgtagtacgtttggcgtcgttagcgggttaatttttttacgtatttagttgcggatttttgcgtatagttttggtgacggttttttttcgtgattaagcgtgacgtaggcgtagatcgtttgatttttaatattgtgcggaatatttattacggcggtttcggtaattttcggatgcgttattagcgtcgatttaatttttgtcgtttttagacggtgatcggagacgtttagtacgtcgtttatacgtttcgttatttagtaatagttatttttatcgcgacgcgcgtcgtcgtcgttgaaatatatatttttgaaggtggagaagtaggtttgtttaaa

SEQ ID NO: 15250 - DNA, 839 bp, Artificial Sequence
  chemically treated genomic DNA (Homo sapiens) CpG-island No: 15250
  misc_feature (563)..(563): n is either a, c, g or t
  misc_feature (675)..(675): n is either a, c, g or t
  misc_feature (717)..(717): n is either a, c, g or t
tttaaacaaacctacttctccaccttcaaaaatatatatttcaacgacgacgacgcgcgtcgcgataaaaataactattactaaataacgaaacgtataaacgacgtactaaacgtctccgatcaccgtctaaaaacgacaaaaattaaatcgacgctaataacgcatccgaaaattaccgaaaccgccgtaataaatattccgcacaatattaaaaatcaaacgatctacgcctacgtcacgcttaatcacgaaaaaaaaccgtcaccaaaactatacgcaaaaatccgcaactaaatacgtaaaaaaattaacccgctaacgacgccaaacgtactacactaaaccgactccctacctaaaacccgctccgacaaaattatacgccgtattctacgcaaaattacgacgaacgataccaacaacctaaacgatacctcgacgcttaccgatcctaacgtaatccccctaccccgccgtaaaatatttcgaaaaaacgataatccgaaattaaaaccgatcaaaaaaacacgaatcaaacgaaaccgtaaacaaaataaccnattacctaataatcgaaacttaaaaaaattatcaaaaacgaccaaacaaacgtccttaatccgcgaattaactcccaacgatcgatttctaccgcgcaactacaaccaaaanacgaaacgacgcgaaatactcgatacctacaaaataattacnaaaacaccgcaaaactccattacgacatacgtaatctcgataacgaaaacgccgtcaaacgtactaactatccacctactactaaaaaaaacgaatatcgaatttacgataccgattactcc

SEQ ID NO: 15251 - DNA, 839 bp, Artificial Sequence
  chemically treated genomic DNA (Homo sapiens) CpG-island No: 15251
  misc_feature (563)..(563): n is either a, c, g or t
  misc_feature (675)..(675): n is either a, c, g or t
  misc_feature (717)..(717): n is either a, c, g or t
tttgaatagatttatttttttatttttaaaaatatgtattttagcggcgacggcgcgcgtcgcgatgaagatggttattattggataacggggcgtgtggacgacgtgttgaacgttttcggttatcgtttggggacggtagagattgagtcggcgttggtggcgtattcgaagattgtcgaagtcgtcgtagtaggtatttcgtataatattaaaggttaggcgatttacgtttacgttacgtttaattacggggaggaatcgttattagaattgtacgtagaagttcgtaattgggtgcgtaaagagattggttcgttggcgacgttagacgtgttgtattggatcgattttttgtttaaaattcgtttcggtaaaattatgcgtcgtattttgcgtaaaattgcggcgggcgatattagtaatttgggcgatatttcgacgtttgtcgattttggcgtagtttttttgtttcgtcgtaaaatgtttcgggggaacggtggttcggaattgaaatcggttagaaaagtacgggttaaacgaagtcgtgggtaaggtgattngttatttggtaatcgggatttagaaaagttgttaaaggcggttaaataggcgtttttgattcgcgaattgatttttaacggtcggtttttgtcgcgtaattgtaattaaagngcggaacggcgcgaagtgttcgatatttgtaaggtgattgtnaaagtatcgtagggttttattgcggtatacgtgatttcgatggcgaaaacgtcgttagacgtattggttgtttatttgttgttgaaagaagcgggtatcgggtttgcgatgtcggttgtttt

SEQ ID NO: 15252 - DNA, 839 bp, Artificial Sequence
  chemically treated genomic DNA (Homo sapiens) CpG-island No: 15252
  misc_feature (123)..(123): n is either a, c, g or t
  misc_feature (165)..(165): n is either a, c, g or t
  misc_feature (277)..(277): n is either a, c, g or t
aaaacaaccgacatcgcaaacccgatacccgcttctttcaacaacaaataaacaaccaatacgtctaacgacgttttcgccatcgaaatcacgtataccgcaataaaaccctacgatactttnacaatcaccttacaaatatcgaacacttcgcgccgttccgcnctttaattacaattacgcgacaaaaaccgaccgttaaaaatcaattcgcgaatcaaaaacgcctatttaaccgcctttaacaacttttctaaatcccgattaccaaataacnaatcaccttacccacgacttcgtttaacccgtacttttctaaccgatttcaattccgaaccaccgttcccccgaaacattttacgacgaaacaaaaaaactacgccaaaatcgacaaacgtcgaaatatcgcccaaattactaatatcgcccgccgcaattttacgcaaaatacgacgcataattttaccgaaacgaattttaaacaaaaaatcgatccaatacaacacgtctaacgtcgccaacgaaccaatctctttacgcacccaattacgaacttctacgtacaattctaataacgattcctccccgtaattaaacgtaacgtaaacgtaaatcgcctaacctttaatattatacgaaatacctactacgacgacttcgacaatcttcgaatacgccaccaacgccgactcaatctctaccgtccccaaacgataaccgaaaacgttcaacacgtcgtccacacgccccgttatccaataataaccatcttcatcgcgacgcgcgccgtcgccgctaaaatacatatttttaaaaataaaaaaataaatctattcaaa

SEQ ID NO: 15253 - DNA, 560 bp, Artificial Sequence
  chemically treated genomic DNA (Homo sapiens) CpG-island No: 15253
agcgtacgcgtttgattcggttaggagtcggtgattattaggttattttcggtggttttttttagcgggttattttcgttatcgattagcgtcggttgtacgtcgaagaacggacgtgttgtcgaatcggtttttagttcggtagcgttaggtagcggggtgattatgaaatcgtcggtttcggtttgttattaggtatcgattatcggatatttttcgttgtcgatttttttttagtattatttttacgttttcgggttaattggttcgtttacggaatcgagaatgcgtagcgacgaacggtcggtgttttcgatcgttttatcgtttttcgttattagcgcgcggatcgtcgtgggtgcggtatagagaatattgatttgatgtttgtttattatttgcgttatacgggtaggcgtcggttagttgggtacgtttttaaatattagcgtggtcgtatcgtaggttaacgggtcgtatagtaagttattgtgttcggttatttaatttatatcgggggtgtattagtagatattattcggatgataatttaagatata

SEQ ID NO: 15254 - DNA, 560 bp, Artificial Sequence
  chemically treated genomic DNA (Homo sapiens) CpG-island No: 15254
tatatcttaaattatcatccgaataatatctactaatacacccccgatataaattaaataaccgaacacaataacttactatacgacccgttaacctacgatacgaccacgctaatatttaaaaacgtacccaactaaccgacgcctacccgtataacgcaaataataaacaaacatcaaatcaatattctctataccgcacccacgacgatccgcgcgctaataacgaaaaacgataaaacgatcgaaaacaccgaccgttcgtcgctacgcattctcgattccgtaaacgaaccaattaacccgaaaacgtaaaaataatactaaaaaaaaatcgacaacgaaaaatatccgataatcgatacctaataacaaaccgaaaccgacgatttcataatcaccccgctacctaacgctaccgaactaaaaaccgattcgacaacacgtccgttcttcgacgtacaaccgacgctaatcgataacgaaaataacccgctaaaaaaaaccaccgaaaataacctaataatcaccgactcctaaccgaatcaaacgcgtacgct

SEQ ID NO: 15255 - DNA, 560 bp, Artificial Sequence
  chemically treated genomic DNA (Homo sapiens) CpG-island No: 15255
tatgttttgaattattattcgggtaatatttattggtgtattttcgatgtgggttgggtgatcgaatatagtaatttgttgtacggttcgttggtttgcggtgcgattacgttgatgtttgaaggcgtatttaattggtcgacgtttgttcgtatggcgtaggtggtggataagtattaggttaatattttttatatcgtatttacggcgattcgcgcgttgatggcggaaggcgataaagcgatcgaaggtatcgatcgttcgtcgttgcgtattttcggtttcgtgggcgagttaattaattcggaagcgtgggagtggtattggaaaaaaatcggtaacgagaaatgttcggtggtcgatatttggtggtagatcgaaatcggcggttttatgattatttcgttgtttggcgttatcgagttgaaagtcggttcggtaatacgttcgtttttcggcgtgtaatcggcgttggtcgataacgaaggtaattcgttggagggggttatcgaaggtagtttggtaattatcgatttttggtcgggttaggcgcgtacgtt

SEQ ID NO: 15256 - DNA, 560 bp, Artificial Sequence
  chemically treated genomic DNA (Homo sapiens) CpG-island No: 15256
aacgtacgcgcctaacccgaccaaaaatcgataattaccaaactaccttcgataaccccctccaacgaattaccttcgttatcgaccaacgccgattacacgccgaaaaacgaacgtattaccgaaccgactttcaactcgataacgccaaacaacgaaataatcataaaaccgccgatttcgatctaccaccaaatatcgaccaccgaacatttctcgttaccgatttttttccaataccactcccacgcttccgaattaattaactcgcccacgaaaccgaaaatacgcaacgacgaacgatcgataccttcgatcgctttatcgccttccgccatcaacgcgcgaatcgccgtaaatacgatataaaaaatattaacctaatacttatccaccacctacgccatacgaacaaacgtcgaccaattaaatacgccttcaaacatcaacgtaatcgcaccgcaaaccaacgaaccgtacaacaaattactatattcgatcacccaacccacatcgaaaatacaccaataaatattacccgaataataattcaaaacata

SEQ ID NO: 15257 - DNA, 622 bp, Artificial Sequence
  chemically treated genomic DNA (Homo sapiens) CpG-island No: 15257
aaatcggcgtcgcgcgtacggataaaggcgttgaaagttttttgagtttgagttttgtagtattcgtttggtttgagttttgttagtcgttttttgcggcgtttgcgttcgttttttttagtttttttttgttttttgatgcgtttagtcgcggtttttatttttttttttttgcgtttttttattgcgaggattgcgttatgtttcgggttgtattatcggattcggatgtcgtggaatttcggtacgaagtatttatcgtatattttgtatttacggcgggatggtttacgtatgggtattattttgaatttgtattagcgtgaggttttcgtagaatacggtattagtatcgatgtatatttggttggtatattttaggggttggcgcgtaggggtgtggtcgaagataaatagattagtattagttattattttgtcgcgtatggtggcgttcgttagtttttttagttttataatgatgtttagtttgttgagattggattgtgtcgttagagtaataggtttttagttcggatcgttatcggagtagagaaacgttaggttggtgggtttgttcgttattttattttattcggttttggttttcgtttcgttatgg

SEQ ID NO: 15258 - DNA, 622 bp, Artificial Sequence
  chemically treated genomic DNA (Homo sapiens) CpG-island No: 15258
ccataacgaaacgaaaaccaaaaccgaataaaataaaataacgaacaaacccaccaacctaacgtttctctactccgataacgatccgaactaaaaacctattactctaacgacacaatccaatctcaacaaactaaacatcattataaaactaaaaaaactaacgaacgccaccatacgcgacaaaataataactaatactaatctatttatcttcgaccacacccctacgcgccaacccctaaaatataccaaccaaatatacatcgatactaataccgtattctacgaaaacctcacgctaatacaaattcaaaataatacccatacgtaaaccatcccgccgtaaatacaaaatatacgataaatacttcgtaccgaaattccacgacatccgaatccgataatacaacccgaaacataacgcaatcctcgcaataaaaaaacgcaaaaaaaaaaaaataaaaaccgcgactaaacgcatcaaaaaacaaaaaaaaactaaaaaaaacgaacgcaaacgccgcaaaaaacgactaacaaaactcaaaccaaacgaatactacaaaactcaaactcaaaaaactttcaacgcctttatccgtacgcgcgacgccgattt

SEQ ID NO: 15259 - DNA, 622 bp, Artificial Sequence
  chemically treated genomic DNA (Homo sapiens) CpG-island No: 15259
ttatgacgaaacgaaagttaaagtcgaatgggataaagtgacgagtaaatttattagtttgacgtttttttatttcgataacgattcgaattgggagtttattgttttggcgatataatttagttttaataagttgggtattattgtgaagttggaaaagttggcgaacgttattatgcgcgatagagtggtagttggtgttgatttgtttattttcggttatatttttgcgcgttagtttttgaagtatgttaattagatgtatatcgatattggtgtcgtgttttgcggaaattttacgttggtataggtttaaggtggtgtttatgcgtaaattatttcgtcgtaagtgtaaagtatgcggtgaatatttcgtgtcgaaattttacgatattcggattcggtggtgtagttcggagtatggcgtaattttcgtaatggaagaacgtaagaaggagaaggtgaaagtcgcggttaagcgtattaaggagtaaaaagaggttgaaaaggacgggcgtaaacgtcgtaaggagcggttggtagagtttaggttagacggatattataaggtttaggtttagaaagtttttaacgtttttattcgtgcgcgcgacgtcgattt

SEQ ID NO: 15260 - DNA, 622 bp, Artificial Sequence
  chemically treated genomic DNA (Homo sapiens) CpG-island No: 15260
aaatcgacgtcgcgcgcacgaataaaaacgttaaaaactttctaaacctaaaccttataatatccgtctaacctaaactctaccaaccgctccttacgacgtttacgcccgtccttttcaacctctttttactccttaatacgcttaaccgcgactttcaccttctccttcttacgttcttccattacgaaaattacgccatactccgaactacaccaccgaatccgaatatcgtaaaatttcgacacgaaatattcaccgcatactttacacttacgacgaaataatttacgcataaacaccaccttaaacctataccaacgtaaaatttccgcaaaacacgacaccaatatcgatatacatctaattaacatacttcaaaaactaacgcgcaaaaatataaccgaaaataaacaaatcaacaccaactaccactctatcgcgcataataacgttcgccaacttttccaacttcacaataatacccaacttattaaaactaaattatatcgccaaaacaataaactcccaattcgaatcgttatcgaaataaaaaaacgtcaaactaataaatttactcgtcactttatcccattcgactttaactttcgtttcgtcataa

SEQ ID NO: 15261 - DNA, 607 bp, Artificial Sequence
  chemically treated genomic DNA (Homo sapiens) CpG-island No: 15261
tagtcggtattgttgtcggatgcggcgtaaacgttttattcggtttacggagggtgcgggaatttgtaggtttgataagacgcgtaagcgtcgtattaggtattgatgtcggatgcggcgtaaacgttttattcgatttataaaattacgttaaattaggttattgcgttgtttggcgtaggtttgataagacgcgttaagcgtcgtattaggcgttgatgtcggatgcggtataaacgttttattcgatttataaaattacgttaaattaggttattgcgttgtttggcgtaggtttgataagacgcggtaagcgtcgtattaggcgttgatgtcggatgcggcgtaaacgttttattcgatttataaaattacgttaaattaggttattgcgttgtttggcgtaggtttgataagacgcgttaagcgtcgtattaggcgttgatgtcggatgcggtataaacgttttattcgatttataaaaattcgttaaattaggttattgcgttgtttggcgtaggtttgataaaacgcggtaagcgtcgtataaggtatttatatattgtcggggggatattcgcggaaattttaattattgattcgtatt

SEQ ID NO: 15262 - DNA, 607 bp, Artificial Sequence
  chemically treated genomic DNA (Homo sapiens) CpG-island No: 15262
aatacgaatcaataattaaaatttccgcgaatatccccccgacaatatataaataccttatacgacgcttaccgcgttttatcaaacctacgccaaacaacgcaataacctaatttaacgaatttttataaatcgaataaaacgtttataccgcatccgacatcaacgcctaatacgacgcttaacgcgtcttatcaaacctacgccaaacaacgcaataacctaatttaacgtaattttataaatcgaataaaacgtttacgccgcatccgacatcaacgcctaatacgacgcttaccgcgtcttatcaaacctacgccaaacaacgcaataacctaatttaacgtaattttataaatcgaataaaacgtttataccgcatccgacatcaacgcctaatacgacgcttaacgcgtcttatcaaacctacgccaaacaacgcaataacctaatttaacgtaattttataaatcgaataaaacgtttacgccgcatccgacatcaatacctaatacgacgcttacgcgtcttatcaaacctacaaattcccgcaccctccgtaaaccgaataaaacgtttacgccgcatccgacaacaataccgacta

SEQ ID NO: 15263 - DNA, 607 bp, Artificial Sequence
  chemically treated genomic DNA (Homo sapiens) CpG-island No: 15263
aatgcggattaataattgagattttcgcggatattttttcggtaatgtgtgaatgttttatgcgacgtttgtcgcgttttattaggtttacgttagatagcgtaatagtttgatttagcggatttttgtaggtcggataaggcgtttatgtcgtattcgatattaacgtttgatgcgacgtttaacgcgttttattaggtttacgttagatagcgtaatagtttgatttagcgtgattttgtaggtcggataaggcgtttacgtcgtattcgatattaacgtttgatgcgacgtttgtcgcgttttattaggtttacgttagatagcgtaatagtttgatttagcgtgattttgtaggtcggataaggcgtttatgtcgtattcgatattaacgtttgatgcgacgtttaacgcgttttattaggtttacgttagatagcgtaatagtttgatttagcgtgattttgtaggtcggataaggcgtttacgtcgtattcgatattaatgtttgatgcgacgtttgcgcgttttattaggtttataaattttcgtatttttcgtaggtcggataaggcgtttacgtcgtattcggtaatagtgtcgattg

SEQ ID NO: 15264 - DNA, 607 bp, Artificial Sequence
  chemically treated genomic DNA (Homo sapiens) CpG-island No: 15264
caatcgacactattaccgaatacgacgtaaacgccttatccgacctacgaaaaatacgaaaatttataaacctaataaaacgcgcaaacgtcgcatcaaacattaatatcgaatacgacgtaaacgccttatccgacctacaaaatcacgctaaatcaaactattacgctatctaacgtaaacctaataaaacgcgttaaacgtcgcatcaaacgttaatatcgaatacgacataaacgccttatccgacctacaaaatcacgctaaatcaaactattacgctatctaacgtaaacctaataaaacgcgacaaacgtcgcatcaaacgttaatatcgaatacgacgtaaacgccttatccgacctacaaaatcacgctaaatcaaactattacgctatctaacgtaaacctaataaaacgcgttaaacgtcgcatcaaacgttaatatcgaatacgacataaacgccttatccgacctacaaaaatccgctaaatcaaactattacgctatctaacgtaaacctaataaaacgcgacaaacgtcgcataaaacattcacacattaccgaaaaaatatccgcgaaaatctcaattattaatccgcatt

SEQ ID NO: 15265 - DNA, 1023 bp, Artificial Sequence
  chemically treated genomic DNA (Homo sapiens) CpG-island No: 15265
  misc_feature (639)..(639): n is either a, c, g or t
  misc_feature (649)..(649): n is either a, c, g or t
  misc_feature (686)..(686): n is either a, c, g or t
ggcgaagcgacgttcgattttattttttagtttcgttttgatttcggtattttggggataagcggtatcgatagcgacggttcgttgttggagttcgattattacgaagttcgtattaaacgcgttattattgagaattcgcgttacgttatgttggttgtcgattattcgaaatttggtcgtaacgcgatggttaatatgggtagtattagtatggtagatgtcgtttatatcgacgtttcgtcgttagtaagcgtgatgtaggtgttgacggattattatatttaattggagttgtgttgattttgtacggttttttacgttagattaaaacgcgttaggtatttgcgtagtcgattcgcgttattgacgttggttttgttttggcgcgaaacgttaaaaagttggcgttcggttgcggaaagcgattttgtttggcggtagatagcgataacgtgttttagttgtatacggtcgaagagatcgatgttttttgtttttgcgtttagtaacgtcgtaagcgcggaggggcggtttttttgttagttatagcgtagacggtttattttatttttaattacgtttagagtgatgcgttcgttagtggtaaaggtggttattcgcgtgacgttggtaganagttcgcganagttatcgcgttatgttgtttggggagaggtcgtaanagttaattaggcgcgtcgcgtttcggtgttaaaacgtacgttgtcgttagtgagtgaggcgtggcgttttattttataatttaggttcggtttaatatttttttggcgttggcgtagattcggtagggtgaaggtttagagattgattcgcgcgtatagattttcgcgaaatttgttttcggtaattagttggcgtaaatcgcgtatcgtttcggcgataagttgaaaattattgtttatttggcgatcgttgttaaacgggtaaaaggttttttttttaatggtttttagtagtattgtttgttcgtttgcgtttagttcgttaattttattaaga

SEQ ID NO: 15266 - DNA, 1023 bp, Artificial Sequence
  chemically treated genomic DNA (Homo sapiens) CpG-island No: 15266
  misc_feature (338)..(338): n is either a, c, g or t
  misc_feature (375)..(375): n is either a, c, g or t
  misc_feature (385)..(385): n is either a, c, g or t
tcttaataaaattaacgaactaaacgcaaacgaacaaacaatactactaaaaaccattaaaaaaaaaaccttttacccgtttaacaacgatcgccaaataaacaataattttcaacttatcgccgaaacgatacgcgatttacgccaactaattaccgaaaacaaatttcgcgaaaatctatacgcgcgaatcaatctctaaaccttcaccctaccgaatctacgccaacgccaaaaaaatattaaaccgaacctaaattataaaataaaacgccacgcctcactcactaacgacaacgtacgttttaacaccgaaacgcgacgcgcctaattaactnttacgacctctccccaaacaacataacgcgataactntcgcgaactntctaccaacgtcacgcgaataaccacctttaccactaacgaacgcatcactctaaacgtaattaaaaataaaataaaccgtctacgctataactaacaaaaaaaccgcccctccgcgcttacgacgttactaaacgcaaaaacaaaaaacatcgatctcttcgaccgtatacaactaaaacacgttatcgctatctaccgccaaacaaaatcgctttccgcaaccgaacgccaactttttaacgtttcgcgccaaaacaaaaccaacgtcaataacgcgaatcgactacgcaaatacctaacgcgttttaatctaacgtaaaaaaccgtacaaaatcaacacaactccaattaaatataataatccgtcaacacctacatcacgcttactaacgacgaaacgtcgatataaacgacatctaccatactaatactacccatattaaccatcgcgttacgaccaaatttcgaataatcgacaaccaacataacgtaacgcgaattctcaataataacgcgtttaatacgaacttcgtaataatcgaactccaacaacgaaccgtcgctatcgataccgcttatccccaaaataccgaaatcaaaacgaaactaaaaaataaaatcgaacgtcgcttcgcc

SEQ ID NO: 15267 - DNA, 1023 bp, Artificial Sequence
  chemically treated genomic DNA (Homo sapiens) CpG-island No: 15267
  misc_feature (338)..(338): n is either a, c, g or t
  misc_feature (375)..(375): n is either a, c, g or t
  misc_feature (385)..(385): n is either a, c, g or t
ttttgatgagattggcgaattgggcgtagacgaataggtaatgttgttgaaagttattgaagagaaaattttttattcgtttggtagcgatcgttaggtgagtagtgatttttagtttatcgtcggaacggtgcgcgatttgcgttagttggttgtcgaaggtaaatttcgcgaagatttgtacgcgcggattaatttttggatttttattttgtcgggtttacgttagcgttaggaagatattgaatcgaatttggattatgaagtggagcgttacgttttatttattggcgatagcgtgcgttttaatatcgaagcgcggcgcgtttggttggttnttgcgatttttttttaggtaatatggcgcggtaattntcgcgaattntttgttagcgttacgcggatggttatttttgttattagcggacgtattattttggacgtggttgaagatgagataaatcgtttgcgttataattggtaggagagtcgttttttcgcgtttacggcgttgttgggcgtagaggtagaaaatatcgattttttcgatcgtatgtaattggaatacgttatcgttatttgtcgttaggtaaagtcgtttttcgtagtcggacgttagttttttgacgtttcgcgttagggtaaagttagcgttaatgacgcggatcggttacgtaaatatttggcgcgttttggtttgacgtgggaagtcgtgtaggattagtatagttttagttgaatatggtggttcgttagtatttgtattacgtttattggcggcggggcgtcggtgtagacggtatttattatgttgatgttgtttatattgattatcgcgttacggttaaatttcgagtgatcgataattagtataacgtggcgcgagtttttaataatggcgcgtttggtgcgaatttcgtggtaatcgaattttagtagcgagtcgtcgttatcgatgtcgtttatttttagaatgtcgaaattaaggcggaattgggagataaaatcgagcgtcgtttcgtt

SEQ ID NO: 15268 - DNA, 1023 bp, Artificial Sequence
  chemically treated genomic DNA (Homo sapiens) CpG-island No: 15268
  misc_feature (639)..(639): n is either a, c, g or t
  misc_feature (649)..(649): n is either a, c, g or t
  misc_feature (686)..(686): n is either a, c, g or t
aacgaaacgacgctcgattttatctcccaattccgccttaatttcgacattctaaaaataaacgacatcgataacgacgactcgctactaaaattcgattaccacgaaattcgcaccaaacgcgccattattaaaaactcgcgccacgttatactaattatcgatcactcgaaatttaaccgtaacgcgataatcaatataaacaacatcaacataataaataccgtctacaccgacgccccgccgccaataaacgtaatacaaatactaacgaaccaccatattcaactaaaactatactaatcctacacgacttcccacgtcaaaccaaaacgcgccaaatatttacgtaaccgatccgcgtcattaacgctaactttaccctaacgcgaaacgtcaaaaaactaacgtccgactacgaaaaacgactttacctaacgacaaataacgataacgtattccaattacatacgatcgaaaaaatcgatattttctacctctacgcccaacaacgccgtaaacgcgaaaaaacgactctcctaccaattataacgcaaacgatttatctcatcttcaaccacgtccaaaataatacgtccgctaataacaaaaataaccatccgcgtaacgctaacaaanaattcgcganaattaccgcgccatattacctaaaaaaaaatcgcaanaaccaaccaaacgcgccgcgcttcgatattaaaacgcacgctatcgccaataaataaaacgtaacgctccacttcataatccaaattcgattcaatatcttcctaacgctaacgtaaacccgacaaaataaaaatccaaaaattaatccgcgcgtacaaatcttcgcgaaatttaccttcgacaaccaactaacgcaaatcgcgcaccgttccgacgataaactaaaaatcactactcacctaacgatcgctaccaaacgaataaaaaattttctcttcaataactttcaacaacattacctattcgtctacgcccaattcgccaatctcatcaaaa

SEQ ID NO: 15269 - DNA, 707 bp, Artificial Sequence
  chemically treated genomic DNA (Homo sapiens) CpG-island No: 15269
  misc_feature (515)..(515): n is either a, c, g or t
  misc_feature (704)..(704): n is either a, c, g or t
  misc_feature (706)..(706): n is either a, c, g or t
tttatatacgtcgattgtttacgtttttcgtttttttttatcgtagttttcgttttacgttatttttcgtttatattttcgattttttgtttttttcgcgttttttcgttttttcgtttgtaatttatgaaaatttttgttttttaataaaatttttcgaattaattcgttatgatttttcgtttttttcgttttatttttcgtttatttcggattttagttcgttatttttcggatttttatttcgttagttattttatatattttcgttttatttttttatgtagtcgattatagatttcgtgaattatttttgtattatttcgtcgggaattttcgtttcgagttcgtgttaataatttttttatttattgtttcgtaaaatcgcgcgtatataattcgtgatatatttacgcgtttttcgtcgttatattattttttgtatttattgcgtaaattttatacgtcgaattattttttatatattttttcgtatatttcgcgcgaattttcgngttataattttcgttacgataatttttcgtgtaattttcgttttgaatttcgtttttatcgtttttttcgttttattacgtcgcgttttattattttgcgtttaaacgtatcgttatgttataacgtcgcgcgagtaatttacgcggagattatatagttttttggatgaatatttggagcgtttatantnt

SEQ ID NO: 15270 - DNA, 707 bp, Artificial Sequence
  chemically treated genomic DNA (Homo sapiens) CpG-island No: 15270
  misc_feature (2)..(2): n is either a, c, g or t
  misc_feature (4)..(4): n is either a, c, g or t
  misc_feature (193)..(193): n is either a, c, g or t
anantataaacgctccaaatattcatccaaaaaactatataatctccgcgtaaattactcgcgcgacgttataacataacgatacgtttaaacgcaaaataataaaacgcgacgtaataaaacgaaaaaaacgataaaaacgaaattcaaaacgaaaattacacgaaaaattatcgtaacgaaaattataacncgaaaattcgcgcgaaatatacgaaaaaatatataaaaaataattcgacgtataaaatttacgcaataaatacaaaaaataatataacgacgaaaaacgcgtaaatatatcacgaattatatacgcgcgattttacgaaacaataaataaaaaaattattaacacgaactcgaaacgaaaattcccgacgaaataatacaaaaataattcacgaaatctataatcgactacataaaaaaataaaacgaaaatatataaaataactaacgaaataaaaatccgaaaaataacgaactaaaatccgaaataaacgaaaaataaaacgaaaaaaacgaaaaatcataacgaattaattcgaaaaattttattaaaaaacaaaaattttcataaattacaaacgaaaaaacgaaaaaacgcgaaaaaaacaaaaaatcgaaaatataaacgaaaaataacgtaaaacgaaaactacgataaaaaaaaacgaaaaacgtaaacaatcgacgtatataaa

SEQ ID NO: 15271 - DNA, 707 bp, Artificial Sequence
  chemically treated genomic DNA (Homo sapiens) CpG-island No: 15271
  misc_feature (2)..(2): n is either a, c, g or t
  misc_feature (4)..(4): n is either a, c, g or t
  misc_feature (193)..(193): n is either a, c, g or t
anantatggacgttttagatatttatttagagaattgtatagttttcgcgtaggttgttcgcgcggcgttgtgatatggcgatacgtttgagcgtaggatggtgaagcgcggcgtagtagagcggagaaaacgatggaggcggaatttagggcgagaattgtacgagaggttgtcgtggcggaggttgtgatncgggagttcgcgcgggatgtgcgagaagatatgtgagagatggttcggcgtgtgagatttacgtagtgaatgtagagggtggtatgacgacggagaacgcgtgaatgtgttacgggttatgtgcgcgcggttttgcggagtagtaggtgaggaggttgttggtacgagttcgggacgagagttttcgacggagtggtgtagaggtggtttacggggtttgtagtcgattatatgggaggatggggcgaggatgtgtggggtaattggcggggtaagagttcgaggggtggcgggttaggattcgagatggacggaggatgggacggaagggacggaggattatggcggattagttcgagagattttgttggagagtaaggatttttataggttgtaggcgagagggcgagaggacgcggaggggataggggatcgggggtgtgagcggagaatgacgtagagcgagggttacgatgaagggggacggagagcgtgggtagtcggcgtatatggg

SEQ ID NO: 15272 - DNA, 707 bp, Artificial Sequence
  chemically treated genomic DNA (Homo sapiens) CpG-island No: 15272
  misc_feature (515)..(515): n is either a, c, g or t
  misc_feature (704)..(704): n is either a, c, g or t
  misc_feature (706)..(706): n is either a, c, g or t
cccatatacgccgactacccacgctctccgtcccccttcatcgtaaccctcgctctacgtcattctccgctcacacccccgatcccctatcccctccgcgtcctctcgccctctcgcctacaacctataaaaatccttactctccaacaaaatctctcgaactaatccgccataatcctccgtcccttccgtcccatcctccgtccatctcgaatcctaacccgccacccctcgaactcttaccccgccaattaccccacacatcctcgccccatcctcccatataatcgactacaaaccccgtaaaccacctctacaccactccgtcgaaaactctcgtcccgaactcgtaccaacaacctcctcacctactactccgcaaaaccgcgcgcacataacccgtaacacattcacgcgttctccgtcgtcataccaccctctacattcactacgtaaatctcacacgccgaaccatctctcacatatcttctcgcacatcccgcgcgaactcccgnatcacaacctccgccacgacaacctctcgtacaattctcgccctaaattccgcctccatcgttttctccgctctactacgccgcgcttcaccatcctacgctcaaacgtatcgccatatcacaacgccgcgcgaacaacctacgcgaaaactatacaattctctaaataaatatctaaaacgtccatantnt

SEQ ID NO: 15273 - DNA, 543 bp, Artificial Sequence
  chemically treated genomic DNA (Homo sapiens) CpG-island No: 15273
acgagttgggtgtgttcggggcgtttaatcgtttatgagttcggggagtaggtaggtgtaagtgtcggttgttgtaacgtagtaattgttggaggttggcgaggttcggaggcggtgtaggaagttttcgattacgcgggtttttgatcgcgggcgtttatagcgcggatatggcgggttggtggtcggcgttgtcgcgtacggttcggcgttattcgtggtttattaacgtgttgttttacgttgttcgagtaacgtagttgtacgttttacgagcgtgtcgtagttcgttcgttttcgtcggggacgtgttgtaataacggttgtacggtcgttaggtcgattggcgttagacgcggcgcgtggttacgttggtggtgattttttacgttaattttaattacgtgtggttgggtttgttggagcgcgcgtttgtcggtcgagcgtcgtgcgttatgttgggtaaatttgttgtgcgattaagtggggcggtgtttttatcgcgggttttggttttttatttttagtgaaggggtcgggggg

SEQ ID NO: 15274 - DNA, 543 bp, Artificial Sequence
  chemically treated genomic DNA (Homo sapiens) CpG-island No: 15274
ccccccgaccccttcactaaaaataaaaaaccaaaacccgcgataaaaacaccgccccacttaatcgcacaacaaatttacccaacataacgcacgacgctcgaccgacaaacgcgcgctccaacaaacccaaccacacgtaattaaaattaacgtaaaaaatcaccaccaacgtaaccacgcgccgcgtctaacgccaatcgacctaacgaccgtacaaccgttattacaacacgtccccgacgaaaacgaacgaactacgacacgctcgtaaaacgtacaactacgttactcgaacaacgtaaaacaacacgttaataaaccacgaataacgccgaaccgtacgcgacaacgccgaccaccaacccgccatatccgcgctataaacgcccgcgatcaaaaacccgcgtaatcgaaaacttcctacaccgcctccgaacctcgccaacctccaacaattactacgttacaacaaccgacacttacacctacctactccccgaactcataaacgattaaacgccccgaacacacccaactcgt

SEQ ID NO: 15275 - DNA, 543 bp, Artificial Sequence
  chemically treated genomic DNA (Homo sapiens) CpG-island No: 15275
tttttcggtttttttattgggggtaaaaggttaagattcgcgatgggggtatcgttttatttggtcgtatagtaaatttgtttagtatggcgtacggcgttcggtcggtaagcgcgcgttttagtaggtttagttatacgtagttgaagttggcgtgaaaggttattattaacgtggttacgcgtcgcgtttggcgttagtcggtttagcggtcgtgtagtcgttgttatagtacgttttcggcggagacgagcgagttacggtacgttcgtagagcgtatagttacgttgttcgagtaacgtagagtagtacgttggtgggttacgggtggcgtcgggtcgtgcgcgataacgtcggttattagttcgttatgttcgcgttgtgggcgttcgcgattaggagttcgcgtggtcgaaggttttttgtatcgttttcgggtttcgttagtttttagtagttattgcgttgtagtagtcggtatttgtatttgtttatttttcgagtttatgagcggttgggcgtttcgagtatatttagttcgt

SEQ ID NO: 15276 - DNA, 543 bp, Artificial Sequence
  chemically treated genomic DNA (Homo sapiens) CpG-island No: 15276
acgaactaaatatactcgaaacgcccaaccgctcataaactcgaaaaataaacaaatacaaataccgactactacaacgcaataactactaaaaactaacgaaacccgaaaacgatacaaaaaaccttcgaccacgcgaactcctaatcgcgaacgcccacaacgcgaacataacgaactaataaccgacgttatcgcgcacgacccgacgccacccgtaacccaccaacgtactactctacgttactcgaacaacgtaactatacgctctacgaacgtaccgtaactcgctcgtctccgccgaaaacgtactataacaacgactacacgaccgctaaaccgactaacgccaaacgcgacgcgtaaccacgttaataataacctttcacgccaacttcaactacgtataactaaacctactaaaacgcgcgcttaccgaccgaacgccgtacgccatactaaacaaatttactatacgaccaaataaaacgatacccccatcgcgaatcttaaccttttacccccaataaaaaaaccgaaaaa

SEQ ID NO: 15277 - DNA, 850 bp, Artificial Sequence
  chemically treated genomic DNA (Homo sapiens) CpG-island No: 15277
tgcgaggggtagcggtcgtcgcgagggttttttacggtcgttcgcggagcgaggggatttcgatcggcggagggacggttgcgttttgtaggtcgttgcgtttaggtaggtttttgcgttcgggtaggtttcggttttttgtcgcgttttcggttcgcgataatttcggtaggatgggcggtaggacgcggaggggtatttgcggagttcgtcgggaacgtttttttggttttcggtgtcgggtagcggcgggcgcggcgtttatagcgtttttagtttcgggatttggttttagttcgtttttaggcgaacggtttttttcgttcggagcgcgtcggtttagttttcgcgtacgcgcgtatttttagttttttattttcgttcgtttttttcgtagtcgttgtcgtcgaggtcgaggggtcgtatcgggtgcggcggggcggggcgttttttttattaggcggggagaatcgggggcggagtttgcgtcgcgcgagagaggtttaggtcggggcggaggcgaggtcggggtcgaggcgggggcgggggcggggtcgggcgttaggggtcgcgggtttgcggcgtttatagggattattttgggcggaaacgtttggtgagttttttcgtttgtagtttcgtatcgtcgggtaagttaggttttttttgtacgtacgaaggaggattttataggaacgaattacgatttttaaggtttcgtagttgtaagatcgtagcgtaggatcgaaatttcgattcggttgtagagtttttttgcggtttggtcgggttttaaaggtttgaaatttttgatttatcgtttagttagaacgaggggacgttttatgtt

SEQ ID NO: 15278 - DNA, 850 bp, Artificial Sequence
  chemically treated genomic DNA (Homo sapiens) CpG-island No: 15278
aacataaaacgtcccctcgttctaactaaacgataaatcaaaaatttcaaacctttaaaacccgaccaaaccgcaaaaaaactctacaaccgaatcgaaatttcgatcctacgctacgatcttacaactacgaaaccttaaaaatcgtaattcgttcctataaaatcctccttcgtacgtacaaaaaaaacctaacttacccgacgatacgaaactacaaacgaaaaaactcaccaaacgtttccgcccaaaataatccctataaacgccgcaaacccgcgacccctaacgcccgaccccgcccccgcccccgcctcgaccccgacctcgcctccgccccgacctaaacctctctcgcgcgacgcaaactccgcccccgattctccccgcctaataaaaaaaacgccccgccccgccgcacccgatacgacccctcgacctcgacgacaacgactacgaaaaaaacgaacgaaaataaaaaactaaaaatacgcgcgtacgcgaaaactaaaccgacgcgctccgaacgaaaaaaaccgttcgcctaaaaacgaactaaaaccaaatcccgaaactaaaaacgctataaacgccgcgcccgccgctacccgacaccgaaaaccaaaaaaacgttcccgacgaactccgcaaatacccctccgcgtcctaccgcccatcctaccgaaattatcgcgaaccgaaaacgcgacaaaaaaccgaaacctacccgaacgcaaaaacctacctaaacgcaacgacctacaaaacgcaaccgtccctccgccgatcgaaatcccctcgctccgcgaacgaccgtaaaaaaccctcgcgacgaccgctacccctcgca

SEQ ID NO: 15279 - DNA, 850 bp, Artificial Sequence
  chemically treated genomic DNA (Homo sapiens) CpG-island No: 15279
ggtatgaaacgttttttcgttttggttgggcgatgggttaggagttttaggtttttgaggttcggttaaatcgtagggggattttgtagtcgggtcggggtttcgattttgcgttgcggttttataattgcgaaattttgggggtcgtggttcgtttttgtggaattttttttcgtgcgtgtaggaggagtttagtttgttcggcggtgcgaggttgtaagcgggagggtttattaggcgttttcgtttagggtggtttttgtaagcgtcgtagattcgcggtttttggcgttcggtttcgttttcgttttcgtttcggtttcggtttcgttttcgtttcggtttgagtttttttcgcgcggcgtaggtttcgttttcggtttttttcgtttagtggaagggacgtttcgtttcgtcgtattcggtgcggtttttcggtttcggcggtagcggttgcggagaaggcgagcgaaggtaggaggttgggggtgcgcgcgtgcgcgggggttggatcgacgcgtttcgggcgaaggaggtcgttcgtttgggggcgggttggagttaagtttcggggttaggggcgttgtgggcgtcgcgttcgtcgttgttcggtatcggaagttaagagggcgttttcgacgggtttcgtagatgttttttcgcgttttgtcgtttattttgtcgggattgtcgcgggtcgggggcgcgataggaggtcgaggtttgttcgggcgtagaggtttgtttgggcgtagcggtttgtagggcgtagtcgttttttcgtcggtcggggttttttcgtttcgcgggcggtcgtgggaggttttcgcgacggtcgttatttttcgta

SEQ ID NO: 15280 - DNA, 850 bp, Artificial Sequence
  chemically treated genomic DNA (Homo sapiens) CpG-island No: 15280
tacgaaaaataacgaccgtcgcgaaaacctcccacgaccgcccgcgaaacgaaaaaaccccgaccgacgaaaaaacgactacgccctacaaaccgctacgcccaaacaaacctctacgcccgaacaaacctcgacctcctatcgcgcccccgacccgcgacaatcccgacaaaataaacgacaaaacgcgaaaaaacatctacgaaacccgtcgaaaacgccctcttaacttccgataccgaacaacgacgaacgcgacgcccacaacgcccctaaccccgaaacttaactccaacccgcccccaaacgaacgacctccttcgcccgaaacgcgtcgatccaacccccgcgcacgcgcgcacccccaacctcctaccttcgctcgccttctccgcaaccgctaccgccgaaaccgaaaaaccgcaccgaatacgacgaaacgaaacgtcccttccactaaacgaaaaaaaccgaaaacgaaacctacgccgcgcgaaaaaaactcaaaccgaaacgaaaacgaaaccgaaaccgaaacgaaaacgaaaacgaaaccgaacgccaaaaaccgcgaatctacgacgcttacaaaaaccaccctaaacgaaaacgcctaataaaccctcccgcttacaacctcgcaccgccgaacaaactaaactcctcctacacgcacgaaaaaaaattccacaaaaacgaaccacgacccccaaaatttcgcaattataaaaccgcaacgcaaaatcgaaaccccgacccgactacaaaatccccctacgatttaaccgaacctcaaaaacctaaaactcctaacccatcgcccaaccaaaacgaaaaaacgtttcatacc

SEQ ID NO: 15281 - DNA, 516 bp, Artificial Sequence
  chemically treated genomic DNA (Homo sapiens) CpG-island No: 15281
tatagcgttaagtacgttggtatataggtatttacgagcgataataaataagagttatagaatacgagatagtaagtgtagttatatatattattatattattagattacgatattattacgtacgatgttaaattattatacgatatttatgttttataatatacgaatacgatatttcgtatggcgcgttgttatttttagacgtttatgttatttaggagattacgttttacggtagtcgcgattatcgcgtaggatacggatcgagcggaggaggacgtattgtcgtcgtcgtatattacggggggtacgatcgacgacgcggcgtatagcgtttatcgatagcgaggtcgggtaaagggataattagaagtagatagagtaatacgtacgggttagtatacgggcgaacgatcggtaggggcgcgtcgcgtagcgcggtgtgacgtaggtataagttatcgcgtcgtttttgtttcgttgttatagatttatgaacgtatgtatgatataa

SEQ ID NO: 15282 - DNA, 516 bp, Artificial Sequence
  chemically treated genomic DNA (Homo sapiens) CpG-island No: 15282
ttatatcatacatacgttcataaatctataacaacgaaacaaaaacgacgcgataacttatacctacgtcacaccgcgctacgcgacgcgcccctaccgatcgttcgcccgtatactaacccgtacgtattactctatctacttctaattatccctttacccgacctcgctatcgataaacgctatacgccgcgtcgtcgatcgtaccccccgtaatatacgacgacgacaatacgtcctcctccgctcgatccgtatcctacgcgataatcgcgactaccgtaaaacgtaatctcctaaataacataaacgtctaaaaataacaacgcgccatacgaaatatcgtattcgtatattataaaacataaatatcgtataataatttaacatcgtacgtaataatatcgtaatctaataatataataatatatataactacacttactatctcgtattctataactcttatttattatcgctcgtaaatacctatataccaacgtacttaacgctata

SEQ ID NO: 15283 - DNA, 516 bp, Artificial Sequence
  chemically treated genomic DNA (Homo sapiens) CpG-island No: 15283
ttgtgttatgtatgcgtttatgagtttgtagtagcgaagtagaggcgacgcggtggtttgtgtttgcgttatatcgcgttgcgcggcgcgtttttgtcggtcgttcgttcgtgtgttggttcgtgcgtgttgttttgtttgtttttggttgtttttttgttcggtttcgttgtcggtaggcgttgtgcgtcgcgtcgtcggtcgtgtttttcgtggtgtgcggcggcggtagtgcgttttttttcgttcgattcgtgttttgcgcggtggtcgcggttgtcgtggagcgtggttttttaggtgatataagcgtttggaagtggtagcgcgttatgcgaggtgtcgtgttcgtgtgttgtgaggtatgggtgtcgtgtggtggtttggtatcgtgcgtggtggtgtcgtggtttggtggtgtggtggtgtgtgtggttgtatttgttgtttcgtgttttgtagtttttgtttgttgtcgttcgtaggtgtttgtgtgttagcgtgtttggcgttatg

SEQ ID NO: 15284 - DNA, 516 bp, Artificial Sequence
  chemically treated genomic DNA (Homo sapiens) CpG-island No: 15284
cataacgccaaacacgctaacacacaaacacctacgaacgacaacaaacaaaaactacaaaacacgaaacaacaaatacaaccacacacaccaccacaccaccaaaccacgacaccaccacgcacgataccaaaccaccacacgacacccatacctcacaacacacgaacacgacacctcgcataacgcgctaccacttccaaacgcttatatcacctaaaaaaccacgctccacgacaaccgcgaccaccgcgcaaaacacgaatcgaacgaaaaaaaacgcactaccgccgccgcacaccacgaaaaacacgaccgacgacgcgacgcacaacgcctaccgacaacgaaaccgaacaaaaaaacaaccaaaaacaaacaaaacaacacgcacgaaccaacacacgaacgaacgaccgacaaaaacgcgccgcgcaacgcgatataacgcaaacacaaaccaccgcgtcgcctctacttcgctactacaaactcataaacgcatacataacacaa

SEQ ID NO: 15285 - DNA, 1216 bp, Artificial Sequence
  chemically treated genomic DNA (Homo sapiens) CpG-island No: 15285
tcgtcgttttatttttagttcgcgggggaggtttcgcgcgttaatcgagtttagcgttttttagtaagttaggagcgaagtcgtcgttttcgcgattttagttttttcgggttttcgggcggcgttttcgttatttttgcgggcggattcgggggggcgcgtagagttggagaaatttttttcgttttagggtggggggtatcggtgtagatatttacgtcggggttagcgttcggagttattttttcgttttcggtttcgtcgtttaggggcgtgggaagcgggcgttcgttgtcgtttttgtcgtcggcgtcgtcgtttgtttgtttttagtttcggtttcgggttggtttcgagtttttcgtttcgacgtcgcgcgttcgttttatataattttattcgagcgcgttcggttttatgtaaaggttggcggaggttcgtagttaatggcgcggtagttggagtcgggggttcggggtggggggcgtcggcgcggttaatcgcggtttcgagagttcggagagtcgggcgtggggagggagcgttttttcgcgttgatttaggagtcgggattgcggtggtagtagtcggtagttaggttggttcggcgcggcgcggcggttattggggtgggcggcggcgaaggcggcggcgagggcgggcgtttttcgcgtttcgttattgcgtcgcgtaatttttaggcggtagcgaggtttggcgaggaggggagagggcgtttggttgggcgttgggggttttaggtcggagggaagcgagggtttttcgggaggtagcgtagggaaggaacgcgaagggggaggggagggcggcgagttttaggatttcgcggttatttttgcgcgtaggatcgagggtggaggcgggagcggttgtattgtttttttatttttttttaggatagcgatttggcgtcgtcgggtcgggttaaagcggttaagcgagtcgcgttgatggcgagatttcgattacggagttagcgtcgagtcgatttttatttagtttggggacgtgttcgagtatttttcggggattgtttagtatggagagtagggtttcgcgacggttttcgtaggcggggagcgggcgagcgtagttcggagattaggcgcgtagaggtttaggcggttgcgggtagcgtcgtttttattttatttcgtttttattagtagtgtttttattttattttatttagttt

SEQ ID NO: 15286 - DNA, 1216 bp, Artificial Sequence
  chemically treated genomic DNA (Homo sapiens) CpG-island No: 15286
aaactaaataaaataaaataaaaacactactaataaaaacgaaataaaataaaaacgacgctacccgcaaccgcctaaacctctacgcgcctaatctccgaactacgctcgcccgctccccgcctacgaaaaccgtcgcgaaaccctactctccatactaaacaatccccgaaaaatactcgaacacgtccccaaactaaataaaaatcgactcgacgctaactccgtaatcgaaatctcgccatcaacgcgactcgcttaaccgctttaacccgacccgacgacgccaaatcgctatcctaaaaaaaaataaaaaaacaatacaaccgctcccgcctccaccctcgatcctacgcgcaaaaataaccgcgaaatcctaaaactcgccgccctcccctcccccttcgcgttccttccctacgctacctcccgaaaaaccctcgcttccctccgacctaaaacccccaacgcccaaccaaacgccctctcccctcctcgccaaacctcgctaccgcctaaaaattacgcgacgcaataacgaaacgcgaaaaacgcccgccctcgccgccgccttcgccgccgcccaccccaataaccgccgcgccgcgccgaaccaacctaactaccgactactaccaccgcaatcccgactcctaaatcaacgcgaaaaaacgctccctccccacgcccgactctccgaactctcgaaaccgcgattaaccgcgccgacgccccccaccccgaacccccgactccaactaccgcgccattaactacgaacctccgccaacctttacataaaaccgaacgcgctcgaataaaattatataaaacgaacgcgcgacgtcgaaacgaaaaactcgaaaccaacccgaaaccgaaactaaaaacaaacaaacgacgacgccgacgacaaaaacgacaacgaacgcccgcttcccacgcccctaaacgacgaaaccgaaaacgaaaaaataactccgaacgctaaccccgacgtaaatatctacaccgataccccccaccctaaaacgaaaaaaatttctccaactctacgcgcccccccgaatccgcccgcaaaaataacgaaaacgccgcccgaaaacccgaaaaaactaaaatcgcgaaaacgacgacttcgctcctaacttactaaaaaacgctaaactcgattaacgcgcgaaacctcccccgcgaactaaaaataaaacgacga

SEQ ID NO: 15287 - DNA, 1216 bp, Artificial Sequence
  chemically treated genomic DNA (Homo sapiens) CpG-island No: 15287
ggattaggtgggatggggtgggggtattgttggtggggacggggtggggtagaagcggcgttgttcgtagtcgtttgggtttttgcgcgtttgattttcgagttgcgttcgttcgtttttcgtttgcgggggtcgtcgcggagttttgttttttatattgagtagttttcgggaggtgttcggatacgtttttaggttggataaagatcggttcggcgttagtttcgtagtcgaaatttcgttattagcgcggttcgtttggtcgttttggttcggttcggcgacgttagatcgttattttggggggaaatgggaaggtagtgtagtcgttttcgtttttattttcggttttgcgcgtaggggtggtcgcggggttttggggttcgtcgttttttttttttttttcgcgttttttttttgcgttgtttttcgagggattttcgttttttttcggtttggggtttttagcgtttagttaggcgttttttttttttttcgttaggtttcgttgtcgtttgaaggttacgcgacgtagtggcggggcgcggggggcgttcgttttcgtcgtcgttttcgtcgtcgtttattttagtggtcgtcgcgtcgcgtcgggttagtttggttgtcggttgttgttatcgtaatttcggtttttaaattagcgcggggaggcgttttttttttacgttcggtttttcgggttttcggggtcgcgattggtcgcgtcggcgttttttatttcgggttttcggttttagttgtcgcgttattggttgcgggttttcgttagtttttatataagatcgggcgcgttcgagtggagttgtataaagcgagcgcgcggcgtcggggcgggaggttcgaggttagttcgggatcggggttgggagtaagtaggcggcggcgtcggcggtagaggcggtagcgagcgttcgttttttacgtttttaggcggcggggtcgagagcgggaggatggtttcgagcgttgatttcggcgtgagtatttgtatcggtgttttttattttaaggcggagaaagtttttttagttttgcgcgttttttcggattcgttcgtaagggtggcggggacgtcgttcgggaattcgggaagattgggatcgcgaaggcggcggtttcgtttttaatttgttgggaggcgttggattcgattggcgcgcggagtttttttcgcgggttgggggtgaggcggcgg

SEQ ID NO: 15288 - DNA, 1216 bp, Artificial Sequence
  chemically treated genomic DNA (Homo sapiens) CpG-island No: 15288
ccgccgcctcacccccaacccgcgaaaaaaactccgcgcgccaatcgaatccaacgcctcccaacaaattaaaaacgaaaccgccgccttcgcgatcccaatcttcccgaattcccgaacgacgtccccgccacccttacgaacgaatccgaaaaaacgcgcaaaactaaaaaaactttctccgccttaaaataaaaaacaccgatacaaatactcacgccgaaatcaacgctcgaaaccatcctcccgctctcgaccccgccgcctaaaaacgtaaaaaacgaacgctcgctaccgcctctaccgccgacgccgccgcctacttactcccaaccccgatcccgaactaacctcgaacctcccgccccgacgccgcgcgctcgctttatacaactccactcgaacgcgcccgatcttatataaaaactaacgaaaacccgcaaccaataacgcgacaactaaaaccgaaaacccgaaataaaaaacgccgacgcgaccaatcgcgaccccgaaaacccgaaaaaccgaacgtaaaaaaaaaacgcctccccgcgctaatttaaaaaccgaaattacgataacaacaaccgacaaccaaactaacccgacgcgacgcgacgaccactaaaataaacgacgacgaaaacgacgacgaaaacgaacgccccccgcgccccgccactacgtcgcgtaaccttcaaacgacaacgaaacctaacgaaaaaaaaaaaaaacgcctaactaaacgctaaaaaccccaaaccgaaaaaaaacgaaaatccctcgaaaaacaacgcaaaaaaaaaacgcgaaaaaaaaaaaaaaaacgacgaaccccaaaaccccgcgaccacccctacgcgcaaaaccgaaaataaaaacgaaaacgactacactaccttcccatttccccccaaaataacgatctaacgtcgccgaaccgaaccaaaacgaccaaacgaaccgcgctaataacgaaatttcgactacgaaactaacgccgaaccgatctttatccaacctaaaaacgtatccgaacacctcccgaaaactactcaatataaaaaacaaaactccgcgacgacccccgcaaacgaaaaacgaacgaacgcaactcgaaaatcaaacgcgcaaaaacccaaacgactacgaacaacgccgcttctaccccaccccgtccccaccaacaatacccccaccccatcccacctaatcc

SEQ ID NO: 15289 - DNA, 718 bp, Artificial Sequence
  chemically treated genomic DNA (Homo sapiens) CpG-island No: 15289
tgcgtggagattcggcggatggtatcgttataggttagtaatgttagcgtcgtagttagttagtaaattattgtcgaggttggttacgcgttagcgtattggttatttcgcgttagtttgcgcgtcgtcgttttttttagttttttatattagtaattacgaacgacgaattgcgttagaatgacgtgtataattgttgttttgttatcgggaattaaatataggtcgttagttaggcgtaattaacgtttattagtatttagatcgttgcggttatagttgttagagatgacgttttttattcgaaattaatacgtatttagcgtcgcgtatttgtatttaatacggtagtcgtcgttgtcgtatgttcgttagttaatagtaagttagcgttagtatatagcgattaatacggtaatatatagttacggtttatatttattttcgtttaatttattatagatttaaggatatatcgcgtacgttatattttttacggtttatataatatattatttaataataaatgtacggtttattatatattgtaaagtatttagtattcgtaggtttgttatataacggtcgtagttaacggcgttattagacgtaatattttttaaatatataatttagataatatataatagataacggatatttataataacgtagttaatatttagcgcgtattttaattagcgagatagttttattt

SEQ ID NO: 15290 - DNA, 718 bp, Artificial Sequence
  chemically treated genomic DNA (Homo sapiens) CpG-island No: 15290
aaataaaactatctcgctaattaaaatacgcgctaaatattaactacgttattataaatatccgttatctattatatattatctaaattatatatttaaaaaatattacgtctaataacgccgttaactacgaccgttatataacaaacctacgaatactaaatactttacaatatataataaaccgtacatttattattaaataatatattatataaaccgtaaaaaatataacgtacgcgatatatccttaaatctataataaattaaacgaaaataaatataaaccgtaactatatattaccgtattaatcgctatatactaacgctaacttactattaactaacgaacatacgacaacgacgactaccgtattaaatacaaatacgcgacgctaaatacgtattaatttcgaataaaaaacgtcatctctaacaactataaccgcaacgatctaaatactaataaacgttaattacgcctaactaacgacctatatttaattcccgataacaaaacaacaattatacacgtcattctaacgcaattcgtcgttcgtaattactaatataaaaaactaaaaaaaacgacgacgcgcaaactaacgcgaaataaccaatacgctaacgcgtaaccaacctcgacaataatttactaactaactacgacgctaacattactaacctataacgataccatccgccgaatctccacgca

SEQ ID NO: 15291 - DNA, 718 bp, Artificial Sequence
  chemically treated genomic DNA (Homo sapiens) CpG-island No: 15291
gggtggggttgtttcgttggttggggtgcgcgttgggtgttggttgcgttgttgtgggtgttcgttgtttgttgtgtgttgtttgggttgtgtgtttgaggggtgttgcgtttggtggcgtcgttggttacggtcgttgtgtggtaagtttgcggatgttgggtgttttgtagtgtgtggtaggtcgtgtatttgttgttggatggtatgttgtatgggtcgtggggagtgtggcgtgcgcgatgtatttttgggtttgtaatgggttggacgagggtgagtgtgggtcgtgattgtatgttgtcgtgttgatcgttgtgtgttggcgttggtttgttgttggttggcgggtatgcggtagcggcggttgtcgtgttgagtgtaggtacgcggcgttgggtgcgtgttagtttcgggtgaggggcgttatttttggtagttgtggtcgtagcgatttggatgttggtgggcgttggttgcgtttggttggcggtttgtgtttagttttcggtggtaaggtagtagttgtgtacgttattttggcgtaattcgtcgttcgtagttgttggtgtggggagttggagaaggcggcgacgcgtaagttggcgcggaatggttagtgcgttggcgcgtagttagtttcggtagtggtttgttggttggttgcggcgttggtattgttggtttgtagcgatgttattcgtcgaatttttacgta

SEQ ID NO: 15292 - DNA, 718 bp, Artificial Sequence
  chemically treated genomic DNA (Homo sapiens) CpG-island No: 15292
tacgtaaaaattcgacgaataacatcgctacaaaccaacaataccaacgccgcaaccaaccaacaaaccactaccgaaactaactacgcgccaacgcactaaccattccgcgccaacttacgcgtcgccgccttctccaactccccacaccaacaactacgaacgacgaattacgccaaaataacgtacacaactactaccttaccaccgaaaactaaacacaaaccgccaaccaaacgcaaccaacgcccaccaacatccaaatcgctacgaccacaactaccaaaaataacgcccctcacccgaaactaacacgcacccaacgccgcgtacctacactcaacacgacaaccgccgctaccgcatacccgccaaccaacaacaaaccaacgccaacacacaacgatcaacacgacaacatacaatcacgacccacactcaccctcgtccaacccattacaaacccaaaaatacatcgcgcacgccacactccccacgacccatacaacataccatccaacaacaaatacacgacctaccacacactacaaaacacccaacatccgcaaacttaccacacaacgaccgtaaccaacgacgccaccaaacgcaacacccctcaaacacacaacccaaacaacacacaacaaacaacgaacacccacaacaacgcaaccaacacccaacgcgcaccccaaccaacgaaacaaccccaccc

SEQ ID NO: 15293 - DNA, 690 bp, Artificial Sequence
  chemically treated genomic DNA (Homo sapiens) CpG-island No: 15293
ggattagttttagacgggtatcgttacgatattgttagcgtggataatacggttttttagttcgtttatcgtcgtagtgagcggcggttcgttttttagtaacgaaaattatttagttatttgcgtattggcgatttgcgttagttgtttatcgtttagtttacgggagaataattgcgttagttaggcgtaaatataggtaatttgttgtgttgttagcgtggttatgattttatttgcgacgcgggaatatattcgtattgcgttattatttttacggggtcgttaaacgtcgttatttgttttattgtttcgttgtattttttaatttttattagcgtagtgtgcgtattggtcgtttgcgttagttgcgatgtatcgatgtcgatggttaatacgttggggttatcgtatttgtatagcgtattaggttcgtcgtttttatttggatcgtattatgttttttcgtgaattcgtgttacgtcgggtgtatagcggttagaaattattgattttgataatatttgatcgcgagcgttaaagacgcgtattatattatcgttacgaatatcgcgcgcgttggtatattgcgggttattgaataattggttttttattcgttatcgtatattgttgacgtaagcgttttcgatttatataattgcgagtgaacgtcggaattcggatgta

SEQ ID NO: 15294 - DNA, 690 bp, Artificial Sequence
  chemically treated genomic DNA (Homo sapiens) CpG-island No: 15294
tacatccgaattccgacgttcactcgcaattatataaatcgaaaacgcttacgtcaacaatatacgataacgaataaaaaaccaattattcaataacccgcaatataccaacgcgcgcgatattcgtaacgataatataatacgcgtctttaacgctcgcgatcaaatattatcaaaatcaataatttctaaccgctatacacccgacgtaacacgaattcacgaaaaaacataatacgatccaaataaaaacgacgaacctaatacgctatacaaatacgataaccccaacgtattaaccatcgacatcgatacatcgcaactaacgcaaacgaccaatacgcacactacgctaataaaaattaaaaaatacaacgaaacaataaaacaaataacgacgtttaacgaccccgtaaaaataataacgcaatacgaatatattcccgcgtcgcaaataaaatcataaccacgctaacaacacaacaaattacctatatttacgcctaactaacgcaattattctcccgtaaactaaacgataaacaactaacgcaaatcgccaatacgcaaataactaaataattttcgttactaaaaaacgaaccgccgctcactacgacgataaacgaactaaaaaaccgtattatccacgctaacaatatcgtaacgatacccgtctaaaactaatcc

SEQ ID NO: 15295 - DNA, 690 bp, Artificial Sequence
  chemically treated genomic DNA (Homo sapiens) CpG-island No: 15295
tgtattcggatttcgacgtttattcgtagttatgtgagtcggaaacgtttgcgttagtaatatacggtagcgggtaaagagttagttatttagtaattcgtagtatgttagcgcgcgcggtattcgtaacggtgatgtggtacgcgtttttaacgttcgcggttaggtgttgttagggttagtggtttttgatcgttatgtattcggcgtggtacgaatttacgaaggggtatggtacgatttagataaaggcggcgagtttggtgcgttgtgtaaatacggtaattttaacgtgttgattatcgatatcggtatatcgtagttggcgtaggcgattagtgcgtatattacgttggtggaaattgagaagtataacggaatagtggagtaggtgacggcgtttaacggtttcgtggagatggtggcgtagtgcgaatatgttttcgcgtcgtaggtgaaattatgattacgttgatagtataatagattgtttgtgtttacgtttggttagcgtagttgttttttcgtgagttggacgatgaataattgacgtaaatcgttagtgcgtagatggttgaatggttttcgttgttgaaaaacgaatcgtcgtttattgcggcggtgaacgagttggaaaatcgtattgtttacgttgatagtatcgtgacgatgttcgtttggaattggttt

SEQ ID NO: 15296 - DNA, 690 bp, Artificial Sequence
  chemically treated genomic DNA (Homo sapiens) CpG-island No: 15296
aaaccaattccaaacgaacatcgtcacgatactatcaacgtaaacaatacgattttccaactcgttcaccgccgcaataaacgacgattcgtttttcaacaacgaaaaccattcaaccatctacgcactaacgatttacgtcaattattcatcgtccaactcacgaaaaaacaactacgctaaccaaacgtaaacacaaacaatctattatactatcaacgtaatcataatttcacctacgacgcgaaaacatattcgcactacgccaccatctccacgaaaccgttaaacgccgtcacctactccactattccgttatacttctcaatttccaccaacgtaatatacgcactaatcgcctacgccaactacgatataccgatatcgataatcaacacgttaaaattaccgtatttacacaacgcaccaaactcgccgcctttatctaaatcgtaccataccccttcgtaaattcgtaccacgccgaatacataacgatcaaaaaccactaaccctaacaacacctaaccgcgaacgttaaaaacgcgtaccacatcaccgttacgaataccgcgcgcgctaacatactacgaattactaaataactaactctttacccgctaccgtatattactaacgcaaacgtttccgactcacataactacgaataaacgtcgaaatccgaataca

SEQ ID NO: 15297 - DNA, 1057 bp, Artificial Sequence
  chemically treated genomic DNA (Homo sapiens) CpG-island No: 15297
cgcgtgttttttttcgggcggggttcggaaattggttattgtagtcgtgtttttgggttggggacgtattttagcgaaacgaatttagtcgtatttttcggttggtattcgcgcgttttaatttagggaaaatagatcggaacgcgtatgcgtcgcggcgcgtcgtatcgtttattagttttttaggttatatttttcgaaaattaaggtaagaaaggcggtaattgcgtttgcgggtagagaagtcggaggggcgggggcggagtcggaggaagggggtggaggcgcgtttgcgcggtgatttcgttagtaggaagtaggcgcgcgggggcgggggcgcgcggcggtaggaggcggggttttcggggtcgttgtcgtcgtcgtcgtcgcgtattgtgtagtaggcgggttttcgcgcggtagggttttggattcgcgcggttttcggggatggtgagtaaggcgttgttgcgtttcgtgtttgtcgttaatcgtaggaggatgaagttgttgttgggtatcgttttgttggtttacgtcgtttgtgagtgcgcgttcgttgttagttggggagttttatttatttttcggcgtcgcggtgggtcgggcggcggtggttcggggtttcgaggcggttttgtagtttcgcgttgtttttcgtttcgggcggggtcggcgttttttgtttttatttttttttatttttgtagtaaagcgggttaatttgggcgtatattttttatcgtttaggttcgggcgcggatttcgggcggaggggtttttagtagttttcgggcggttttaggtttttgttttttgttcgggcgcgggggattcggcggcggcgttgtcgtttatgtcgcgttgggagtcggcgagggtttcggtcggggatttcggagcgtgtcgcgtggggatatttttggggatagtcgaggtcgcgtcgcggtgtcggttaagtcggataaaaatattgtggttattggtagagttttcgtttcgattgtttgttttttaggaaaattatttagcgtttaatttttggggagttaagtgt

SEQ ID NO: 15298 - DNA, 1057 bp, Artificial Sequence
  chemically treated genomic DNA (Homo sapiens) CpG-island No: 15298
acacttaactccccaaaaattaaacgctaaataattttcctaaaaaacaaacaatcgaaacgaaaactctaccaataaccacaatatttttatccgacttaaccgacaccgcgacgcgacctcgactatccccaaaaatatccccacgcgacacgctccgaaatccccgaccgaaaccctcgccgactcccaacgcgacataaacgacaacgccgccgccgaatcccccgcgcccgaacaaaaaacaaaaacctaaaaccgcccgaaaactactaaaaacccctccgcccgaaatccgcgcccgaacctaaacgataaaaaatatacgcccaaattaacccgctttactacaaaaataaaaaaaaataaaaacaaaaaacgccgaccccgcccgaaacgaaaaacaacgcgaaactacaaaaccgcctcgaaaccccgaaccaccgccgcccgacccaccgcgacgccgaaaaataaataaaactccccaactaacaacgaacgcgcactcacaaacgacgtaaaccaacaaaacgatacccaacaacaacttcatcctcctacgattaacgacaaacacgaaacgcaacaacgccttactcaccatccccgaaaaccgcgcgaatccaaaaccctaccgcgcgaaaacccgcctactacacaatacgcgacgacgacgacgacaacgaccccgaaaaccccgcctcctaccgccgcgcgcccccgcccccgcgcgcctacttcctactaacgaaatcaccgcgcaaacgcgcctccacccccttcctccgactccgcccccgcccctccgacttctctacccgcaaacgcaattaccgcctttcttaccttaattttcgaaaaatataacctaaaaaactaataaacgatacgacgcgccgcgacgcatacgcgttccgatctattttccctaaattaaaacgcgcgaataccaaccgaaaaatacgactaaattcgtttcgctaaaatacgtccccaacccaaaaacacgactacaataaccaatttccgaaccccgcccgaaaaaaaacacgcg

SEQ ID NO: 15299 - DNA, 1057 bp, Artificial Sequence
  chemically treated genomic DNA (Homo sapiens) CpG-island No: 15299
atatttggttttttaagagttaaacgttgagtaatttttttgaggagtaaatagtcggagcgggggttttgttaatggttatagtatttttattcgatttaatcgatatcgcggcgcgatttcggttgtttttaagggtatttttacgcggtacgtttcggagttttcgatcgggattttcgtcggtttttagcgcgatatggacgatagcgtcgtcgtcgagtttttcgcgttcgggtaggaggtagagatttggggtcgttcgaggattgttaggggttttttcgttcggggttcgcgttcgggtttaagcggtagggggtgtgcgtttaagttggttcgttttgttgtaagagtggaaaggggtgggagtagaaagcgtcggtttcgttcggggcggggagtaacgcggggttgtagggtcgtttcggggtttcgaattatcgtcgttcggtttatcgcggcgtcggggaatgaatggggttttttagttggtagcgggcgcgtatttataggcgacgtaggttagtaaggcgatgtttagtagtagttttatttttttgcggttgacggtagatacgaggcgtagtagcgttttgtttattattttcgggagtcgcgcgggtttagggttttatcgcgcgggggttcgtttgttgtataatgcgcggcggcggcggcggtagcggtttcgagagtttcgttttttgtcgtcgcgcgttttcgttttcgcgcgtttgttttttgttggcgggattatcgcgtaggcgcgtttttatttttttttttcggtttcgttttcgttttttcggtttttttattcgtaggcgtagttgtcgttttttttgttttggttttcgaagaatgtgatttggagggttggtgggcggtgcggcgcgtcgcggcgtatgcgcgtttcggtttgttttttttgagttaaagcgcgcgggtgttagtcgggaggtgcggttggattcgtttcgttgaggtgcgtttttaatttaagggtacgattgtagtggttagttttcgagtttcgttcggaggggggtacgcg

SEQ ID NO: 15300 - DNA, 1057 bp, Artificial Sequence
  chemically treated genomic DNA (Homo sapiens) CpG-island No: 15300
cgcgtacccccctccgaacgaaactcgaaaactaaccactacaatcgtacccttaaattaaaaacgcacctcaacgaaacgaatccaaccgcacctcccgactaacacccgcgcgctttaactcaaaaaaaacaaaccgaaacgcgcatacgccgcgacgcgccgcaccgcccaccaaccctccaaatcacattcttcgaaaaccaaaacaaaaaaaacgacaactacgcctacgaataaaaaaaccgaaaaaacgaaaacgaaaccgaaaaaaaaaaataaaaacgcgcctacgcgataatcccgccaacaaaaaacaaacgcgcgaaaacgaaaacgcgcgacgacaaaaaacgaaactctcgaaaccgctaccgccgccgccgccgcgcattatacaacaaacgaacccccgcgcgataaaaccctaaacccgcgcgactcccgaaaataataaacaaaacgctactacgcctcgtatctaccgtcaaccgcaaaaaaataaaactactactaaacatcgccttactaacctacgtcgcctataaatacgcgcccgctaccaactaaaaaaccccattcattccccgacgccgcgataaaccgaacgacgataattcgaaaccccgaaacgaccctacaaccccgcgttactccccgccccgaacgaaaccgacgctttctactcccacccctttccactcttacaacaaaacgaaccaacttaaacgcacaccccctaccgcttaaacccgaacgcgaaccccgaacgaaaaaacccctaacaatcctcgaacgaccccaaatctctacctcctacccgaacgcgaaaaactcgacgacgacgctatcgtccatatcgcgctaaaaaccgacgaaaatcccgatcgaaaactccgaaacgtaccgcgtaaaaatacccttaaaaacaaccgaaatcgcgccgcgatatcgattaaatcgaataaaaatactataaccattaacaaaacccccgctccgactatttactcctcaaaaaaattactcaacgtttaactcttaaaaaaccaaatat

SEQ ID NO: 15301 - DNA, 636 bp, Artificial Sequence
  chemically treated genomic DNA (Homo sapiens) CpG-island No: 15301
gcgcgttagcgtaatgttgtaatttagagtcggggagaaagtatcgtatggtgataatgtttttatgttggttgttttgcgtatcggtaaagcgtatcggtagtttattacgtagtacgtttttttcggttattattagattaattagtttttttgtattatgtttacgttgtatttttagggttttacgatcgataaagttacgatttgtcggtttttaggcgatggtttagtttatgttggcggttaaaggagagatggtttcgtttattttttgattataaagatttatgttcgtttttagacgtagcgtgttacgcgcgtttaagttatatggtttaatattcgtttttattagcgtacgttagaaatcggttcgtttttttattgggtagtcgtaattttatagttcgttttatcggtataattagtggtggtaataaatagatcgttcgtttgtacgtttaaagaacggttttattttttttatcgtttgacgttgggcgttattaaatagtgtggtagtttttgtttgcgtattcggtttttgtacggtaattatggaaaggttattacgaacggtaatttcgatgtcgaataggtttagcgtgttgggtaatttaggagatggttttt

SEQ ID NO: 15302 - DNA, 636 bp, Artificial Sequence
  chemically treated genomic DNA (Homo sapiens) CpG-island No: 15302
aaaaaccatctcctaaattacccaacacgctaaacctattcgacatcgaaattaccgttcgtaataacctttccataattaccgtacaaaaaccgaatacgcaaacaaaaactaccacactatttaataacgcccaacgtcaaacgataaaaaaaataaaaccgttctttaaacgtacaaacgaacgatctatttattaccaccactaattataccgataaaacgaactataaaattacgactacccaataaaaaaacgaaccgatttctaacgtacgctaataaaaacgaatattaaaccatataacttaaacgcgcgtaacacgctacgtctaaaaacgaacataaatctttataatcaaaaaataaacgaaaccatctctcctttaaccgccaacataaactaaaccatcgcctaaaaaccgacaaatcgtaactttatcgatcgtaaaaccctaaaaatacaacgtaaacataatacaaaaaaactaattaatctaataataaccgaaaaaaacgtactacgtaataaactaccgatacgctttaccgatacgcaaaacaaccaacataaaaacattatcaccatacgatactttctccccgactctaaattacaacattacgctaacgcgc

SEQ ID NO: 15303 - DNA, 636 bp, Artificial Sequence
  chemically treated genomic DNA (Homo sapiens) CpG-island No: 15303
aaagattattttttggattatttaatacgttgaatttattcggtatcgaaattatcgttcgtgatgatttttttatgattgtcgtgtaagggtcgaatgcgtaggtaaaagttgttatattgtttaatgacgtttagcgttaggcggtggaagggatgaaatcgttttttggacgtgtaggcgggcgatttgtttattgttattattggttatatcggtgaagcgggttatgaaattgcgattgtttaatgaaaaagcggatcgatttttggcgtgcgttggtggaagcgggtgttaagttatgtggtttgggcgcgcgtgatacgttgcgtttggaagcgggtatgaatttttatggttaggagatggacgaaattattttttttttagtcgttaatatgggttggattatcgtttgggaatcggtagatcgtgattttatcggtcgtgaagttttggaagtgtagcgtgagtatggtatagaaaaattggttggtttggtgatgatcgaaaaaggcgtgttgcgtaatgaattgtcggtacgttttatcgatgcgtagggtaattagtatgaaggtattattattatgcggtatttttttttcgattttgggttatagtattgcgttggcgcgt

SEQ ID NO: 15304 - DNA, 636 bp, Artificial Sequence
  chemically treated genomic DNA (Homo sapiens) CpG-island No: 15304
acgcgccaacgcaatactataacccaaaatcgaaaaaaaaataccgcataataataataccttcatactaattaccctacgcatcgataaaacgtaccgacaattcattacgcaacacgcctttttcgatcatcaccaaaccaaccaatttttctataccatactcacgctacacttccaaaacttcacgaccgataaaatcacgatctaccgattcccaaacgataatccaacccatattaacgactaaaaaaaaaataatttcgtccatctcctaaccataaaaattcatacccgcttccaaacgcaacgtatcacgcgcgcccaaaccacataacttaacacccgcttccaccaacgcacgccaaaaatcgatccgctttttcattaaacaatcgcaatttcataacccgcttcaccgatataaccaataataacaataaacaaatcgcccgcctacacgtccaaaaaacgatttcatcccttccaccgcctaacgctaaacgtcattaaacaatataacaacttttacctacgcattcgacccttacacgacaatcataaaaaaatcatcacgaacgataatttcgataccgaataaattcaacgtattaaataatccaaaaaataatcttt

SEQ ID NO: 15305 - DNA, 848 bp, Artificial Sequence
  chemically treated genomic DNA (Homo sapiens) CpG-island No: 15305
gttcggtattaatttgtttagtgttcgtagttgacggttatttagttttttgagttgttttttagttatcggtaattttgtcggaatttgcggatcgcggttgtttttacgtataaaacgttttataatacggttttttagcgagtggaagttgatgatcgaaagtcgtttattcggggttagtacgttgagcgagttttttagcgtttgttttattttttttagtttattgtttatttaaatgcgtatcgtttggaaggtacgggtcgcgggatgtttaaatttattttttatcggcgttgtagtagttacgattttcgttagttttttggtgcgggttatcggttgttcgcggttacgttcgataatggcgcgggtaatgcgtttggtaaaacgttttttattataggtttttaatatttaggcgatatcggttttttttgcggtttgtagttatttagcggttgattgtttacgggttgggtttatacgtatgtttagcggattatcgcgtataaaggaaaagtcgcgtttagtattattaagttgcggtgaagagacgttaagatcgaggagaatgtcgtcgattttgtcgataagatcgcgttcggtaacgtattcgtttagcgcggagaaaggttcgtggatgatggagaagcgcggattattaatagttttcgtaacggcgatagtttgcgggtcgcgatcgatcgttagtaaacgttttttttcgttaagttgcgagaggattagacgtgagtgattatcgtgattaaaagttttattaatgtagatgttattaggacggatattgaggttattaacggttttatttagtagtatcgtag

SEQ ID NO: 15306 - DNA, 848 bp, Artificial Sequence
  chemically treated genomic DNA (Homo sapiens) CpG-island No: 15306
ctacgatactactaaataaaaccgttaataacctcaatatccgtcctaataacatctacattaataaaacttttaatcacgataatcactcacgtctaatcctctcgcaacttaacgaaaaaaaacgtttactaacgatcgatcgcgacccgcaaactatcgccgttacgaaaactattaataatccgcgcttctccatcatccacgaacctttctccgcgctaaacgaatacgttaccgaacgcgatcttatcgacaaaatcgacgacattctcctcgatcttaacgtctcttcaccgcaacttaataatactaaacgcgacttttcctttatacgcgataatccgctaaacatacgtataaacccaacccgtaaacaatcaaccgctaaataactacaaaccgcaaaaaaaaccgatatcgcctaaatattaaaaacctataataaaaaacgttttaccaaacgcattacccgcgccattatcgaacgtaaccgcgaacaaccgataacccgcaccaaaaaactaacgaaaatcgtaactactacaacgccgataaaaaataaatttaaacatcccgcgacccgtaccttccaaacgatacgcatttaaataaacaataaactaaaaaaaataaaacaaacgctaaaaaactcgctcaacgtactaaccccgaataaacgactttcgatcatcaacttccactcgctaaaaaaccgtattataaaacgttttatacgtaaaaacaaccgcgatccgcaaattccgacaaaattaccgataactaaaaaacaactcaaaaaactaaataaccgtcaactacgaacactaaacaaattaataccgaac

SEQ ID NO: 15307 - DNA, 848 bp, Artificial Sequence
  chemically treated genomic DNA (Homo sapiens) CpG-island No: 15307
ttacggtgttgttggatgaagtcgttaatggttttaatattcgttttgatggtatttatattgatgggatttttggttacggtggttatttacgtttgattttttcgtagtttggcgaagaggggcgtttgttggcgatcgatcgcgattcgtaggttatcgtcgttgcgaagattattgatgattcgcgtttttttattatttacggattttttttcgcgttgggcgaatacgttgtcgagcgcgattttatcggtaagatcgacggtatttttttcgattttggcgtttttttatcgtaatttgatgatgttgagcgcggttttttttttatgcgcgatggttcgttggatatgcgtatggatttaattcgtgggtagttagtcgttgaatggttataaatcgtagaagaagtcgatatcgtttgggtattgaaaatttatggtgaagagcgttttgttaaacgtattgttcgcgttattgtcgagcgtaatcgcgaatagtcgatgattcgtattaaagaattggcggaagtcgtggttgttgtaacgtcggtgaaagataagtttaaatatttcgcgattcgtattttttaggcggtgcgtatttgggtaaatagtgaattggaggagatagagtaggcgttaaaaagttcgtttaacgtgttggtttcgggtgggcggttttcgattattagtttttattcgttggaagatcgtattgtgaaacgttttatgcgtgaaaatagtcgcggttcgtaagtttcggtagggttatcgatgattgaagagtagtttaaaaaattgggtggtcgttagttgcgagtattaggtaagttaatgtcgggt

SEQ ID NO: 15308 - DNA, 848 bp, Artificial Sequence
  chemically treated genomic DNA (Homo sapiens) CpG-island No: 15308
acccgacattaacttacctaatactcgcaactaacgaccacccaattttttaaactactcttcaatcatcgataaccctaccgaaacttacgaaccgcgactattttcacgcataaaacgtttcacaatacgatcttccaacgaataaaaactaataatcgaaaaccgcccacccgaaaccaacacgttaaacgaactttttaacgcctactctatctcctccaattcactatttacccaaatacgcaccgcctaaaaaatacgaatcgcgaaatatttaaacttatctttcaccgacgttacaacaaccacgacttccgccaattctttaatacgaatcatcgactattcgcgattacgctcgacaataacgcgaacaatacgtttaacaaaacgctcttcaccataaattttcaatacccaaacgatatcgacttcttctacgatttataaccattcaacgactaactacccacgaattaaatccatacgcatatccaacgaaccatcgcgcataaaaaaaaaaccgcgctcaacatcatcaaattacgataaaaaaacgccaaaatcgaaaaaaataccgtcgatcttaccgataaaatcgcgctcgacaacgtattcgcccaacgcgaaaaaaaatccgtaaataataaaaaaacgcgaatcatcaataatcttcgcaacgacgataacctacgaatcgcgatcgatcgccaacaaacgcccctcttcgccaaactacgaaaaaatcaaacgtaaataaccaccgtaaccaaaaatcccatcaatataaataccatcaaaacgaatattaaaaccattaacgacttcatccaacaacaccgtaa

SEQ ID NO: 15309 - DNA, 597 bp, Artificial Sequence
  chemically treated genomic DNA (Homo sapiens) CpG-island No: 15309
cgcgttagcgtcgtattaggtaatcggtttgggcgttagatgtcggatgcggcgtaatcgttttattcgatttacggggtggagtattttatagcggtgtaggtttgataagacgcgcgagcgtcgtattaggtaatcggttcggacgttggatgtcggatgcggcgtaatcgttttatttaatttacggggtggagtattttatagcggtgtaggtttgataagacgcgttagcgtcgtattaggtaattcggtttgggcgttagatgtcggatgcggcgtaatcgttttattcgatttacggggtggagtattttatagcggtgtaggtttgataagacgcgttagcgtcgtattaggtaatcggttcgggcgttggatgtcggatgcggcgtgatcgttttgtttgatttacggggtgtcgtattttatagcggtgtaggtttgtataagacgttgttagcgtcgtatttaggtaatcggttcgggcgttggatgtcggattgcggcgtgatcgttttgtttgatttattggggtgtcgtattttacggtatgtttagcgaattatcgcgttgtcgattttttttttcgttttt

SEQ ID NO: 15310 - DNA, 597 bp, Artificial Sequence
  chemically treated genomic DNA (Homo sapiens) CpG-island No: 15310
aaaaacgaaaaaaaaaatcgacaacgcgataattcgctaaacataccgtaaaatacgacaccccaataaatcaaacaaaacgatcacgccgcaatccgacatccaacgcccgaaccgattacctaaatacgacgctaacaacgtcttatacaaacctacaccgctataaaatacgacaccccgtaaatcaaacaaaacgatcacgccgcatccgacatccaacgcccgaaccgattacctaatacgacgctaacgcgtcttatcaaacctacaccgctataaaatactccaccccgtaaatcgaataaaacgattacgccgcatccgacatctaacgcccaaaccgaattacctaatacgacgctaacgcgtcttatcaaacctacaccgctataaaatactccaccccgtaaattaaataaaacgattacgccgcatccgacatccaacgtccgaaccgattacctaatacgacgctcgcgcgtcttatcaaacctacaccgctataaaatactccaccccgtaaatcgaataaaacgattacgccgcatccgacatctaacgcccaaaccgattacctaatacgacgctaacgcg

SEQ ID NO: 15311 - DNA, 597 bp, Artificial Sequence
  chemically treated genomic DNA (Homo sapiens) CpG-island No: 15311
gaaggcggaagagaaaatcgataacgcggtagttcgttaaatatgtcgtgaagtgcggtattttagtaggttagataaggcggttacgtcgtagttcgatatttaacgttcgagtcggttgtttagatgcgacgttggtagcgttttatataggtttatatcgttgtgaagtgcggtatttcgtaggttagataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgatatttaacgtttaagtcggattgtttgatgcgacgttggcgcgttttattaggtttatatcgttgtgaagtgttttatttcgtaggttggataaggcggttacgtcgtattcgatatttaacgttcgagtcggttgtttgatgcgacgttcgcgcgttttattaggtttatatcgttgtgaagtgttttatttcgtaggtcggataaggcggttacgtcgtattcgatatttaacgtttaagtcggttgtttgatgcgacgttggcgcg

SEQ ID NO: 15312 - DNA, 597 bp, Artificial Sequence
  chemically treated genomic DNA (Homo sapiens) CpG-island No: 15312
cgcgccaacgtcgcatcaaacaaccgacttaaacgttaaatatcgaatacgacgtaaccgccttatccgacctacgaaataaaacacttcacaacgatataaacctaataaaacgcgcgaacgtcgcatcaaacaaccgactcgaacgttaaatatcgaatacgacgtaaccgccttatccaacctacgaaataaaacacttcacaacgatataaacctaataaaacgcgccaacgtcgcatcaaacaatccgacttaaacgttaaatatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatctaacctacgaaataccgcacttcacaacgatataaacctatataaaacgctaccaacgtcgcatctaaacaaccgactcgaacgttaaatatcgaactacgacgtaaccgccttatctaacctactaaaataccgcacttcacgacatatttaacgaactaccgcgttatcgattttctcttccgccttc

SEQ ID NO: 15313 - DNA, 833 bp, Artificial Sequence
  chemically treated genomic DNA (Homo sapiens) CpG-island No: 15313
atggtatagtttggcgtaatacgtttggtggatttgattggtcgtatcgatttgttgaaagagttggacggttttatcgttaaatagtagaagttggcgttgtcgaagttgttggagattgtcgaatcgtatttaggtaaggtattttattgtatcgaaaataattcgtcgtttgataacggtttgttgaacgcgtagttgttgtaataggcgaaatcgtattgtcgatgagcgttagagtaaaattttttggttcgatattcgtaatatcgatcgttttgtcggcgcgtcgtttttaggttatatcgtttagacgtacggcgattaggggttggtagtcgattttattaaagcgtattttaacggtatcgtaggttagagtttcggcgtgtggaacgcgggcggcgtggaattgtatttgatcggtgatgttaacgattatgtcggtaaaggtatggcgggcggtttaatcgttattcgtttttcggttggtttcgtttttcgtagttatgaagtaagtattatcggtaatatttgtttgtatggcgcgatcggtggtcgtttgtatgtcgtaggtcgcgcgggtgaacgtttcggcgtgcgtaatttcggtgttattatcgtggtagaaggtattggcgataacggttgtgaatatatgacgggtggtatcgtttgtattttgggtaaaatcggcgttaatttcggtgcgggtatgatcggcggtttcgtttacgttttcgatgaaagcggcgattttcgtaaacgcgttaattcggaattggtcgaggttttaagcgttgacgttttggcgatttatgaagagtatttgt

SEQ ID NO: 15314 - DNA, 833 bp, Artificial Sequence
  chemically treated genomic DNA (Homo sapiens) CpG-island No: 15314
acaaatactcttcataaatcgccaaaacgtcaacgcttaaaacctcgaccaattccgaattaacgcgtttacgaaaatcgccgctttcatcgaaaacgtaaacgaaaccgccgatcatacccgcaccgaaattaacgccgattttacccaaaatacaaacgataccacccgtcatatattcacaaccgttatcgccaataccttctaccacgataataacaccgaaattacgcacgccgaaacgttcacccgcgcgacctacgacatacaaacgaccaccgatcgcgccatacaaacaaatattaccgataatacttacttcataactacgaaaaacgaaaccaaccgaaaaacgaataacgattaaaccgcccgccatacctttaccgacataatcgttaacatcaccgatcaaatacaattccacgccgcccgcgttccacacgccgaaactctaacctacgataccgttaaaatacgctttaataaaatcgactaccaacccctaatcgccgtacgtctaaacgatataacctaaaaacgacgcgccgacaaaacgatcgatattacgaatatcgaaccaaaaaattttactctaacgctcatcgacaatacgatttcgcctattacaacaactacgcgttcaacaaaccgttatcaaacgacgaattattttcgatacaataaaataccttacctaaatacgattcgacaatctccaacaacttcgacaacgccaacttctactatttaacgataaaaccgtccaactctttcaacaaatcgatacgaccaatcaaatccaccaaacgtattacgccaaactataccat

SEQ ID NO: 15315 - DNA, 833 bp, Artificial Sequence
  chemically treated genomic DNA (Homo sapiens) CpG-island No: 15315
gtagatgttttttatggatcgttagagcgttaacgtttaagatttcgattagtttcgggttaacgcgtttgcggaaatcgtcgtttttatcgagaacgtaagcgaaatcgtcggttatgttcgtatcgaagttaacgtcggttttatttagaatgtagacgatattattcgttatatatttataatcgttgtcgttaatgttttttattacggtgatagtatcggagttacgtacgtcgaaacgtttattcgcgcggtttgcggtatatagacgattatcggtcgcgttatataggtaggtgttgtcgataatgtttgttttatggttgcggaaggcggaattaatcggaggacgaatggcgattaagtcgttcgttatgtttttatcgatatagtcgttggtattatcggttaggtatagttttacgtcgttcgcgttttatacgtcgaagttttggtttgcggtgtcgttgaagtacgttttgataggatcggttgttagtttttgatcgtcgtgcgtttgggcgatatagtttgaaagcgacgcgtcgatagaacggtcggtgttgcgaatatcgaattagaaggttttgttttggcgtttatcgataatacggtttcgtttgttgtagtaattgcgcgtttagtaggtcgttattaaacggcgggttgttttcggtgtagtagagtgttttatttggatgcggttcggtagtttttagtagtttcgatagcgttagtttttgttgtttggcggtgaaatcgtttagtttttttagtaggtcggtgcgattaattagatttattagacgtgttacgttaagttgtgttat

SEQ ID NO: 15316 - DNA, 833 bp, Artificial Sequence
  chemically treated genomic DNA (Homo sapiens) CpG-island No: 15316
ataacacaacttaacgtaacacgtctaataaatctaattaatcgcaccgacctactaaaaaaactaaacgatttcaccgccaaacaacaaaaactaacgctatcgaaactactaaaaactaccgaaccgcatccaaataaaacactctactacaccgaaaacaacccgccgtttaataacgacctactaaacgcgcaattactacaacaaacgaaaccgtattatcgataaacgccaaaacaaaaccttctaattcgatattcgcaacaccgaccgttctatcgacgcgtcgctttcaaactatatcgcccaaacgcacgacgatcaaaaactaacaaccgatcctatcaaaacgtacttcaacgacaccgcaaaccaaaacttcgacgtataaaacgcgaacgacgtaaaactatacctaaccgataataccaacgactatatcgataaaaacataacgaacgacttaatcgccattcgtcctccgattaattccgccttccgcaaccataaaacaaacattatcgacaacacctacctatataacgcgaccgataatcgtctatataccgcaaaccgcgcgaataaacgtttcgacgtacgtaactccgatactatcaccgtaataaaaaacattaacgacaacgattataaatatataacgaataatatcgtctacattctaaataaaaccgacgttaacttcgatacgaacataaccgacgatttcgcttacgttctcgataaaaacgacgatttccgcaaacgcgttaacccgaaactaatcgaaatcttaaacgttaacgctctaacgatccataaaaaacatctac

SEQ ID NO: 15317 - DNA, 763 bp, Artificial Sequence
  chemically treated genomic DNA (Homo sapiens) CpG-island No: 15317
tacgtcggtgtggttttttattttattaaataacgatatcgttaattagagtttgcgtttttatattaacgcgtcgttggttagttagtcggaataggcgattttcgcggtgacggatgaggcgatttttagcgaatagtttaacgttttttttatcggtatcgtcgttgcgtcggaagcgggtgcgacgttgattttataggtcgttagtttgagcggcggacgtatgttgcgttttattggtgcgggtattgtcgaagaacgaatgatcgtttcgtagttgtcggagtgtattttgtacgaatttatcgagcgttcgtattcgttttcgttcggtatcgatttgattttgatttgtggcgagcgtttgttggttatttcgcgaattatttatgtggaggtgtgttgatgtaacgttgtcgtgaaagggggcgagaaggcgatcgacgtcgattacgattttgtaaagagagcgacgtcgaggcgatatcgatttgttcgaattgagcgtcgtttagattgaatagtagtttaatttcgcggtagatcgcgtgatgatcgaaggcggtattgtcgatcgcgaattggcggcgttggcgttgaaataggttagcggtagataacgatagaagcgatttatttatgttgcgcgttatatcgtattatagtaggtagatagttggtagataagcgtagttagatacgaaatatatcggagaatgtagttatacgaatagttagagagttattatagagtagaata

SEQ ID NO: 15318 - DNA, 763 bp, Artificial Sequence
  chemically treated genomic DNA (Homo sapiens) CpG-island No: 15318
tattctactctataataactctctaactattcgtataactacattctccgatatatttcgtatctaactacgcttatctaccaactatctacctactataatacgatataacgcgcaacataaataaatcgcttctatcgttatctaccgctaacctatttcaacgccaacgccgccaattcgcgatcgacaataccgccttcgatcatcacgcgatctaccgcgaaattaaactactattcaatctaaacgacgctcaattcgaacaaatcgatatcgcctcgacgtcgctctctttacaaaatcgtaatcgacgtcgatcgccttctcgccccctttcacgacaacgttacatcaacacacctccacataaataattcgcgaaataaccaacaaacgctcgccacaaatcaaaatcaaatcgataccgaacgaaaacgaatacgaacgctcgataaattcgtacaaaatacactccgacaactacgaaacgatcattcgttcttcgacaatacccgcaccaataaaacgcaacatacgtccgccgctcaaactaacgacctataaaatcaacgtcgcacccgcttccgacgcaacgacgataccgataaaaaaaacgttaaactattcgctaaaaatcgcctcatccgtcaccgcgaaaatcgcctattccgactaactaaccaacgacgcgttaatataaaaacgcaaactctaattaacgatatcgttatttaataaaataaaaaaccacaccgacgta

SEQ ID NO: 15319 - DNA, 763 bp, Artificial Sequence
  chemically treated genomic DNA (Homo sapiens) CpG-island No: 15319
tattttgttttgtgatgattttttggttgttcgtatgattgtatttttcggtgtgtttcgtatttggttgcgtttatttgttagttgtttgtttattgtggtgcggtatggcgcgtagtatggataaatcgtttttatcgttatttgtcgttggtttgttttagcgttagcgtcgttagttcgcggtcggtaatgtcgttttcggttattacgcgatttatcgcgaggttaagttgttgtttaatttgggcgacgtttagttcgggtaaatcggtatcgtttcggcgtcgttttttttgtagggtcgtggtcggcgtcgatcgttttttcgtttttttttacggtaacgttatattagtatatttttatatgagtggttcgcggaatagttagtaggcgttcgttataggttaggattaggtcgatgtcgagcgggaacggatgcgggcgttcggtgagttcgtgtagaatgtatttcggtagttgcggagcgattattcgtttttcggtaatattcgtattagtaaggcgtaatatgcgttcgtcgtttaggttggcgatttgtaaaattagcgtcgtattcgttttcggcgtaacggcggtgtcggtggaaagggcgttgagttgttcgttggaaatcgttttattcgttatcgcgaaggtcgtttgtttcggttggttgattagcggcgcgttggtatgaaaacgtaggttttggttgacgatatcgttatttaatggggtagaaagttatatcggcgtg

SEQ ID NO: 15320 - DNA, 763 bp, Artificial Sequence
  chemically treated genomic DNA (Homo sapiens) CpG-island No: 15320
cacgccgatataactttctaccccattaaataacgatatcgtcaaccaaaacctacgttttcataccaacgcgccgctaatcaaccaaccgaaacaaacgaccttcgcgataacgaataaaacgatttccaacgaacaactcaacgccctttccaccgacaccgccgttacgccgaaaacgaatacgacgctaattttacaaatcgccaacctaaacgacgaacgcatattacgccttactaatacgaatattaccgaaaaacgaataatcgctccgcaactaccgaaatacattctacacgaactcaccgaacgcccgcatccgttcccgctcgacatcgacctaatcctaacctataacgaacgcctactaactattccgcgaaccactcatataaaaatatactaatataacgttaccgtaaaaaaaaacgaaaaaacgatcgacgccgaccacgaccctacaaaaaaaacgacgccgaaacgataccgatttacccgaactaaacgtcgcccaaattaaacaacaacttaacctcgcgataaatcgcgtaataaccgaaaacgacattaccgaccgcgaactaacgacgctaacgctaaaacaaaccaacgacaaataacgataaaaacgatttatccatactacgcgccataccgcaccacaataaacaaacaactaacaaataaacgcaaccaaatacgaaacacaccgaaaaatacaatcatacgaacaaccaaaaaatcatcacaaaacaaaata

SEQ ID NO: 15321 - DNA, 930 bp, Artificial Sequence
  chemically treated genomic DNA (Homo sapiens) CpG-island No: 15321
gattagggtttttacgtttaatcgcgtagaagaaaacgcgacgttttgcgcgtggttattcgtagaagtagtgattacgtcgtgcgttttttgttttttcgttaggttcgttattatggcgtatgcgtcgcgtagtttaaagttgtgtattggttggcgattttcgcgttttattagaatgacgttattaagacgcgacgatagtttttttattttttgtagcggcgtaatttgcgtcgtttcgtaaatcggcgcgcgtagtattgtttttaaatattcggtatttttcggagtatcggataggggttgcgagttagttattattaattttttagtttcgatttattacgtatcgcgtttttgtcggcgttggttgttaggttggtataagtacgtagggtaaaggagatttgacgtttacgatttttcggcgtttaggttttgttatttcgagcgttttgcgttttacgacgcgtcgttagttcggtatcgtttatttgtaattgaatgttacggttcgggatgtcgatagcgattaggttattatttttaattaggttaatgttgtcgtcgtttgtcgttttcggtgagacgtggtcgatggaaagattagaggtgttattagagaaacgatcgtcggtgattagcgtataggtttagtcgagatttattgattttaggaagttggttgggtagagtattttttgtattttcggatcgtttttcgggtttttatagcgaattattattatattttcggcgataattttatcgtcgagaatcgtttttatcgtatcgttttggttttcgtatattttcgtcgggtcggtgaatttgaggatgttgttatcgacgtttgtcgtttttacgatgtagtcgtttttcgtaaagttatcgtagagtatcgttaggtcgtcgtttttgttgtag

SEQ ID NO: 15322 - DNA, 930 bp, Artificial Sequence
  chemically treated genomic DNA (Homo sapiens) CpG-island No: 15322
ctacaacaaaaacgacgacctaacgatactctacgataactttacgaaaaacgactacatcgtaaaaacgacaaacgtcgataacaacatcctcaaattcaccgacccgacgaaaatatacgaaaaccaaaacgatacgataaaaacgattctcgacgataaaattatcgccgaaaatataataataattcgctataaaaacccgaaaaacgatccgaaaatacaaaaaatactctacccaaccaacttcctaaaatcaataaatctcgactaaacctatacgctaatcaccgacgatcgtttctctaataacacctctaatctttccatcgaccacgtctcaccgaaaacgacaaacgacgacaacattaacctaattaaaaataataacctaatcgctatcgacatcccgaaccgtaacattcaattacaaataaacgataccgaactaacgacgcgtcgtaaaacgcaaaacgctcgaaataacaaaacctaaacgccgaaaaatcgtaaacgtcaaatctcctttaccctacgtacttataccaacctaacaaccaacgccgacaaaaacgcgatacgtaataaatcgaaactaaaaaattaataataactaactcgcaacccctatccgatactccgaaaaataccgaatatttaaaaacaatactacgcgcgccgatttacgaaacgacgcaaattacgccgctacaaaaaataaaaaaactatcgtcgcgtcttaataacgtcattctaataaaacgcgaaaatcgccaaccaatacacaactttaaactacgcgacgcatacgccataataacgaacctaacgaaaaaacaaaaaacgcacgacgtaatcactacttctacgaataaccacgcgcaaaacgtcgcgttttcttctacgcgattaaacgtaaaaaccctaatc

SEQ ID NO: 15323 - DNA, 930 bp, Artificial Sequence
  chemically treated genomic DNA (Homo sapiens) CpG-island No: 15323
ttatagtaaagacggcggtttggcggtgttttacggtaattttgcggaaaacggttgtatcgtgaaaacggtaggcgtcgatgatagtatttttaaatttatcggttcggcgaaagtgtacgaaagttaggacgatgcggtagaagcgattttcggcggtaaagttgtcgtcggagatgtggtagtaattcgttatgaaggttcgaaaggcggttcggggatgtaggaaatgttttatttaattagttttttgaaattaatgggtttcggttaagtttgtgcgttgattatcgacggtcgtttttttggtggtatttttggtttttttatcggttacgttttatcggaagcggtaagcggcggtagtattggtttgattgaagatggtgatttgatcgttatcgatatttcgaatcgtggtatttagttataggtaagcgatgtcgaattggcggcgcgtcgtgaagcgtaggacgttcgaggtgataaagtttggacgtcgaaaaatcgtgaacgttaggttttttttgttttgcgtgtttatgttagtttggtaattagcgtcgataaaggcgcggtgcgtgataaatcgaaattggggggttaataatggttgattcgtaatttttgttcggtgtttcggaaggtgtcgaatatttaagagtagtgttgcgcgcgtcggtttacgaggcggcgtaggttacgtcgttataaaaaatggaaaaattgtcgtcgcgttttgataacgttattttggtgaagcgcgaagatcgttagttagtgtatagttttaagttgcgcggcgtatacgttatgatggcgggtttgacggaagaatagaaagcgtacggcgtgattattgtttttgcgggtaattacgcgtagggcgtcgcgtttttttttgcgcggttaggcgtgaaggttttgatt

SEQ ID NO: 15324 - DNA, 930 bp, Artificial Sequence
  chemically treated genomic DNA (Homo sapiens) CpG-island No: 15324
aatcaaaaccttcacgcctaaccgcgcaaaaaaaaacgcgacgccctacgcgtaattacccgcaaaaacaataatcacgccgtacgctttctattcttccgtcaaacccgccatcataacgtatacgccgcgcaacttaaaactatacactaactaacgatcttcgcgcttcaccaaaataacgttatcaaaacgcgacgacaatttttccattttttataacgacgtaacctacgccgcctcgtaaaccgacgcgcgcaacactactcttaaatattcgacaccttccgaaacaccgaacaaaaattacgaatcaaccattattaaccccccaatttcgatttatcacgcaccgcgcctttatcgacgctaattaccaaactaacataaacacgcaaaacaaaaaaaacctaacgttcacgatttttcgacgtccaaactttatcacctcgaacgtcctacgcttcacgacgcgccgccaattcgacatcgcttacctataactaaataccacgattcgaaatatcgataacgatcaaatcaccatcttcaatcaaaccaatactaccgccgcttaccgcttccgataaaacgtaaccgataaaaaaaccaaaaataccaccaaaaaaacgaccgtcgataatcaacgcacaaacttaaccgaaacccattaatttcaaaaaactaattaaataaaacatttcctacatccccgaaccgcctttcgaaccttcataacgaattactaccacatctccgacgacaactttaccgccgaaaatcgcttctaccgcatcgtcctaactttcgtacactttcgccgaaccgataaatttaaaaatactatcatcgacgcctaccgttttcacgatacaaccgttttccgcaaaattaccgtaaaacaccgccaaaccgccgtctttactataa

SEQ ID NO: 15325 - DNA, 553 bp, Artificial Sequence
  chemically treated genomic DNA (Homo sapiens) CpG-island No: 15325
tcggagttatcgttcggtttggttcggttacgtcgacgagcgcgtgttggttcgttttttatttgtggtcgaagtcgaaattcggtttagcgttttgcgttcgatatttttgttcggtttgtttttcggtttggtcgtcgttttcgcgatcgtagcggggggattgtttcggatgtttttaggacgtagttagaatcgtagtttagttacgtcgcgtttttttttacgtagttttcgtcgttcgttacgtagaatgcgagcggttcgttagcgtttgcgcgtagtttgcggggcgggacgtaatttcggggaaagcgcgagatttttttttttttcgttcggttgaggcgaggtggggtttttgggaaaattatataattttcgtttttgggtcggaattgttttcgtttattttaatttttttatttaggatttcgttaagttgacgttatacggaatcggtgtttcggaagttaaaggtggttatgttgtgtgggattacgtggttagaggtaagagtgtcgttttagtagtatatgtaatagtttaaatt

SEQ ID NO: 15326 - DNA, 553 bp, Artificial Sequence
  chemically treated genomic DNA (Homo sapiens) CpG-island No: 15326
aatttaaactattacatatactactaaaacgacactcttacctctaaccacgtaatcccacacaacataaccacctttaacttccgaaacaccgattccgtataacgtcaacttaacgaaatcctaaataaaaaaattaaaataaacgaaaacaattccgacccaaaaacgaaaattatataattttcccaaaaaccccacctcgcctcaaccgaacgaaaaaaaaaaaaatctcgcgctttccccgaaattacgtcccgccccgcaaactacgcgcaaacgctaacgaaccgctcgcattctacgtaacgaacgacgaaaactacgtaaaaaaaaacgcgacgtaactaaactacgattctaactacgtcctaaaaacatccgaaacaatccccccgctacgatcgcgaaaacgacgaccaaaccgaaaaacaaaccgaacaaaaatatcgaacgcaaaacgctaaaccgaatttcgacttcgaccacaaataaaaaacgaaccaacacgcgctcgtcgacgtaaccgaaccaaaccgaacgataactccga

SEQ ID NO: 15327 - DNA, 553 bp, Artificial Sequence
  chemically treated genomic DNA (Homo sapiens) CpG-island No: 15327
agtttaaattgttgtatatattattagagcgatatttttgtttttggttacgtggttttatatagtatggttatttttagttttcggagtatcggtttcgtgtgacgttaatttgacggaattttaggtaggaggattgggataggcgagggtagtttcggtttaggggcggggattatgtaatttttttaaaagttttatttcgttttagtcgggcgggagagagggaggtttcgcgtttttttcggggttgcgtttcgtttcgtaggttgcgcgtaggcgttgacgagtcgttcgtattttacgtaacggacggcggaggttacgtgaagagaggcgcggcgtgattgagttacggttttggttgcgttttagaggtattcggggtagttttttcgttgcgatcgcggaggcggcggttaggtcgagaggtaggtcgggtaggggtgtcggacgtagggcgttgggtcgggtttcggtttcggttataggtaaggagcgggttagtacgcgttcgtcggcgtggtcgggttaggtcgagcggtgatttcga

SEQ ID NO: 15328 - DNA, 553 bp, Artificial Sequence
  chemically treated genomic DNA (Homo sapiens) CpG-island No: 15328
tcgaaatcaccgctcgacctaacccgaccacgccgacgaacgcgtactaacccgctccttacctataaccgaaaccgaaacccgacccaacgccctacgtccgacacccctacccgacctacctctcgacctaaccgccgcctccgcgatcgcaacgaaaaaactaccccgaatacctctaaaacgcaaccaaaaccgtaactcaatcacgccgcgcctctcttcacgtaacctccgccgtccgttacgtaaaatacgaacgactcgtcaacgcctacgcgcaacctacgaaacgaaacgcaaccccgaaaaaaacgcgaaacctccctctctcccgcccgactaaaacgaaataaaacttttaaaaaaattacataatccccgcccctaaaccgaaactaccctcgcctatcccaatcctcctacctaaaattccgtcaaattaacgtcacacgaaaccgatactccgaaaactaaaaataaccatactatataaaaccacgtaaccaaaaacaaaaatatcgctctaataatatatacaacaatttaaact

SEQ ID NO: 15329 - DNA, 582 bp, Artificial Sequence
  chemically treated genomic DNA (Homo sapiens) CpG-island No: 15329
gtattgcgtgaagtgttttataagttcgaggtgttagtattgacgaaggagttagcggaacggagttaaaggattggcgtttcgttttttgcgattcgtgggtcggttattttcgcgtttatcgttttttttatttatttcgtttttatcgcgttttttttttttagttttgttttgatttatcgagggcggcgttgatatagtagattcggtcgtaggtagcgtttagtatggattggtttaggtattttcgatttattcgacgtttttgtttcggttcgttttttatttagattacgttcgtttcgtatttagtttcgtaatttgtcgggtcgttattgtattcgttatatttgttttggttcgttaagcgttattttttttttttagtagagatcgtcggtattcgagtcgttttggcgcgtaagcgcggaagcggaggattgggatttgaagattaggtagagaagaatttcgggttaatgggcggggtgtgcggcgagattatattaagggaattatgatgggaggggcggttattcgagtttaggggttttggaaggggatgaggaaggagtagaa

SEQ ID NO: 15330 - DNA, 582 bp, Artificial Sequence
  chemically treated genomic DNA (Homo sapiens) CpG-island No: 15330
ttctactccttcctcatccccttccaaaacccctaaactcgaataaccgcccctcccatcataattcccttaatataatctcgccgcacaccccgcccattaacccgaaattcttctctacctaatcttcaaatcccaatcctccgcttccgcgcttacgcgccaaaacgactcgaataccgacgatctctactaaaaaaaaaaaataacgcttaacgaaccaaaacaaatataacgaatacaataacgacccgacaaattacgaaactaaatacgaaacgaacgtaatctaaataaaaaacgaaccgaaacaaaaacgtcgaataaatcgaaaatacctaaaccaatccatactaaacgctacctacgaccgaatctactatatcaacgccgccctcgataaatcaaaacaaaactaaaaaaaaaaaacgcgataaaaacgaaataaataaaaaaaacgataaacgcgaaaataaccgacccacgaatcgcaaaaaacgaaacgccaatcctttaactccgttccgctaactccttcgtcaatactaacacctcgaacttataaaacacttcacgcaatac

SEQ ID NO: 15331 - DNA, 582 bp, Artificial Sequence
  chemically treated genomic DNA (Homo sapiens) CpG-island No: 15331
ttttattttttttttatttttttttagagtttttgaattcgagtagtcgttttttttattatggtttttttagtgtggtttcgtcgtatatttcgtttattgattcggaatttttttttgtttggtttttaggttttaatttttcgttttcgcgtttgcgcgttaagacggttcggatgtcggcggtttttgttgaagagagaagatggcgtttgacggattagagtaggtatggcgggtgtagtggcggttcggtaggttacggggttgggtgcggagcgagcgtgatttgagtggagagcgggtcggggtaggagcgtcgggtgggtcggaggtgtttggattagtttatgttggacgttgtttgcgatcggatttgttgtgttagcgtcgttttcggtgagttagggtaaggttgggagaggaagacgcggtagaagcggagtgagtgagggaagcgatgggcgcgggaatggtcggtttacgggtcgtaggagacgggacgttagttttttggtttcgtttcgttggttttttcgttagtattgatatttcgggtttgtagagtattttacgtagtgt

SEQ ID NO: 15332 - DNA, 582 bp, Artificial Sequence
  chemically treated genomic DNA (Homo sapiens) CpG-island No: 15332
acactacgtaaaatactctacaaacccgaaatatcaatactaacgaaaaaaccaacgaaacgaaaccaaaaaactaacgtcccgtctcctacgacccgtaaaccgaccattcccgcgcccatcgcttccctcactcactccgcttctaccgcgtcttcctctcccaaccttaccctaactcaccgaaaacgacgctaacacaacaaatccgatcgcaaacaacgtccaacataaactaatccaaacacctccgacccacccgacgctcctaccccgacccgctctccactcaaatcacgctcgctccgcacccaaccccgtaacctaccgaaccgccactacacccgccatacctactctaatccgtcaaacgccatcttctctcttcaacaaaaaccgccgacatccgaaccgtcttaacgcgcaaacgcgaaaacgaaaaattaaaacctaaaaaccaaacaaaaaaaaattccgaatcaataaacgaaatatacgacgaaaccacactaaaaaaaccataataaaaaaaacgactactcgaattcaaaaactctaaaaaaaaataaaaaaaaaataaaa

SEQ ID NO: 15333 - DNA, 519 bp, Artificial Sequence
  chemically treated genomic DNA (Homo sapiens) CpG-island No: 15333
ttttcggaggtcggggacggaaggcgggttcgtagtagattttggattcggaatttttcgggtaggagcggaatttgtttcgaatcgggtttgtgaggaattcgcgaatttggattaggaaatttcggagttcggatcgataaatttcggaattcggaattaagatcgttaagtttcggatcgcggggtatagcgtacggagtgggattcgacgcggagttcggtagttcggatcgcggtattttcggggacgggacggagcgatgtcggttcgaggcgcggggcggggttttcgttgttttttcgttgagagtatttgagcgattggacgttagagattgacggtttttgggagcgtcgttttttttcgcggggattcggtatgtttgttcggagcggcgtttcggggaatcggttatcggatacgatgggcgttgtggggtgtttcgtgggcgatcgaatattaggggttggtgcggttttatttttttttttcgtttttatttgtgtttattttgt

SEQ ID NO: 15334 - DNA, 519 bp, Artificial Sequence
  chemically treated genomic DNA (Homo sapiens) CpG-island No: 15334
acaaaataaacacaaataaaaacgaaaaaaaaaaataaaaccgcaccaacccctaatattcgatcgcccacgaaacaccccacaacgcccatcgtatccgataaccgattccccgaaacgccgctccgaacaaacataccgaatccccgcgaaaaaaaacgacgctcccaaaaaccgtcaatctctaacgtccaatcgctcaaatactctcaacgaaaaaacaacgaaaaccccgccccgcgcctcgaaccgacatcgctccgtcccgtccccgaaaataccgcgatccgaactaccgaactccgcgtcgaatcccactccgtacgctataccccgcgatccgaaacttaacgatcttaattccgaattccgaaatttatcgatccgaactccgaaatttcctaatccaaattcgcgaattcctcacaaacccgattcgaaacaaattccgctcctacccgaaaaattccgaatccaaaatctactacgaacccgccttccgtccccgacctccgaaaa

SEQ ID NO: 15335 - DNA, 519 bp, Artificial Sequence
  chemically treated genomic DNA (Homo sapiens) CpG-island No: 15335
ataggatgggtataaatgggagcgggggaggggagtggggtcgtattagtttttaatgttcggtcgtttacggggtattttataacgtttatcgtgttcggtaatcggtttttcggagcgtcgtttcgggtaggtatgtcgggttttcgcggggggaggcggcgtttttaggagtcgttagtttttagcgtttagtcgtttaggtgtttttagcgggggggtagcgggaatttcgtttcgcgtttcgggtcgatatcgtttcgtttcgttttcgggggtgtcgcgattcggattgtcgggtttcgcgtcgagttttatttcgtgcgttgtgtttcgcgattcgggatttggcgattttaatttcgggtttcgggatttgtcgattcgggtttcgggattttttaatttaagttcgcgagttttttatagattcggttcgggatagatttcgtttttgttcgggagatttcggatttaggatttgttgcgggttcgtttttcgttttcggttttcggagg

SEQ ID NO: 15336 - DNA, 519 bp, Artificial Sequence
  chemically treated genomic DNA (Homo sapiens) CpG-island No: 15336
cctccgaaaaccgaaaacgaaaaacgaacccgcaacaaatcctaaatccgaaatctcccgaacaaaaacgaaatctatcccgaaccgaatctataaaaaactcgcgaacttaaattaaaaaatcccgaaacccgaatcgacaaatcccgaaacccgaaattaaaatcgccaaatcccgaatcgcgaaacacaacgcacgaaataaaactcgacgcgaaacccgacaatccgaatcgcgacacccccgaaaacgaaacgaaacgatatcgacccgaaacgcgaaacgaaattcccgctacccccccgctaaaaacacctaaacgactaaacgctaaaaactaacgactcctaaaaacgccgcctccccccgcgaaaacccgacatacctacccgaaacgacgctccgaaaaaccgattaccgaacacgataaacgttataaaataccccgtaaacgaccgaacattaaaaactaatacgaccccactcccctcccccgctcccatttatacccatcctat

SEQ ID NO: 15337 - DNA, 753 bp, Artificial Sequence
  chemically treated genomic DNA (Homo sapiens) CpG-island No: 15337
acggcggaattcgggtgttttaattaaatatgggtattaaggtaagtcggcgcgattacgtgatatgtatcgcgcgttcgcgttcgcgtttttttttacgtttcgtgttttcgaggtttttattgcgttcgcgttttttttttaggcgagttttagttatttatttcgcggcgtggttgtagtttgttacgttttttttgatttttttttacggaaggaaataaacgcgtttcggcgatttgattcgttgggttatcgtcgagttatagattttgtttatttgaatttatcgtacgttgtggcggttatcgtcgaaagtttaagttttaaattttaattcgtcgtttttgtttatttcgtatttcgtttgttcgttgattttttcgttttttaacgttttacgaacgttgttagtcgacgtgatgtcgtggatatagcggatgaacgtcgcggtcgtcgaagcgtcgttttcgttggcgaatttattagcgttcgggtagatttagtcgttttattttataatttttttgtatttcggggttgcgcgcgttagtcggaagcgtcgttcggggaattcggcggttttcgcgcggttgcggattttagttttcgggtttttggggttgtagttgatcgttttatcgttggatttttttcgggtatcggtttttttaaaaattcgtgaaaattgtatgttattcgtggtagtatttcgggttcgatttcgggttaagaatgtggggaaataatacg

SEQ ID NO: 15338 - DNA, 753 bp, Artificial Sequence
  chemically treated genomic DNA (Homo sapiens) CpG-island No: 15338
cgtattatttccccacattcttaacccgaaatcgaacccgaaatactaccacgaataacatacaattttcacgaatttttaaaaaaaccgatacccgaaaaaaatccaacgataaaacgatcaactacaaccccaaaaacccgaaaactaaaatccgcaaccgcgcgaaaaccgccgaattccccgaacgacgcttccgactaacgcgcgcaaccccgaaatacaaaaaaattataaaataaaacgactaaatctacccgaacgctaataaattcgccaacgaaaacgacgcttcgacgaccgcgacgttcatccgctatatccacgacatcacgtcgactaacaacgttcgtaaaacgttaaaaaacgaaaaaatcaacgaacaaacgaaatacgaaataaacaaaaacgacgaattaaaatttaaaacttaaactttcgacgataaccgccacaacgtacgataaattcaaataaacaaaatctataactcgacgataacccaacgaatcaaatcgccgaaacgcgtttatttccttccgtaaaaaaaaatcaaaaaaaacgtaacaaactacaaccacgccgcgaaataaataactaaaactcgcctaaaaaaaaaacgcgaacgcaataaaaacctcgaaaacacgaaacgtaaaaaaaaacgcgaacgcgaacgcgcgatacatatcacgtaatcgcgccgacttaccttaatacccatatttaattaaaacacccgaattccgccgt

SEQ ID NO: 15339 - DNA, 753 bp, Artificial Sequence
  chemically treated genomic DNA (Homo sapiens) CpG-island No: 15339
cgtgttgtttttttatatttttgattcgggatcggattcggggtattattacgggtgatatatagtttttacgaatttttgggggaatcggtattcgaaaaaaatttagcggtgaaacgattagttatagttttagggattcgggagttggagttcgtagtcgcgcgagaatcgtcgggtttttcgggcgacgttttcggttggcgcgcgtagtttcgggatgtaggggagttgtgaaatggggcggttagatttgttcggacgttgatgaattcgttagcgggagcgacgtttcgacggtcgcgacgtttattcgttgtatttacggtattacgtcgattgatagcgttcgtagaacgttggggagcgggaaggttaacggatagacgggatacgggatgaatagaggcggcggattgggatttgggatttaggttttcggcgatgatcgttataacgtacggtgagtttaggtgagtagaatttgtagttcggcggtgatttagcgagttagatcgtcggaacgcgtttattttttttcgtaggagaaaattagaggaggcgtagtaggttataattacgtcgcggagtaagtgattggagttcgtttgggggaggggcgcgggcgtaatagagatttcgggagtacgaggcgtggaggagagcgcggacgcgggcgcgcggtgtatgttacgtgatcgcgtcggtttattttggtgtttatatttgattagggtattcgggtttcgtcgt

SEQ ID NO: 15340 - DNA, 753 bp, Artificial Sequence
  chemically treated genomic DNA (Homo sapiens) CpG-island No: 15340
acgacgaaacccgaataccctaatcaaatataaacaccaaaataaaccgacgcgatcacgtaacatacaccgcgcgcccgcgtccgcgctctcctccacgcctcgtactcccgaaatctctattacgcccgcgcccctcccccaaacgaactccaatcacttactccgcgacgtaattataacctactacgcctcctctaattttctcctacgaaaaaaaataaacgcgttccgacgatctaactcgctaaatcaccgccgaactacaaattctactcacctaaactcaccgtacgttataacgatcatcgccgaaaacctaaatcccaaatcccaatccgccgcctctattcatcccgtatcccgtctatccgttaaccttcccgctccccaacgttctacgaacgctatcaatcgacgtaataccgtaaatacaacgaataaacgtcgcgaccgtcgaaacgtcgctcccgctaacgaattcatcaacgtccgaacaaatctaaccgccccatttcacaactcccctacatcccgaaactacgcgcgccaaccgaaaacgtcgcccgaaaaacccgacgattctcgcgcgactacgaactccaactcccgaatccctaaaactataactaatcgtttcaccgctaaatttttttcgaataccgattcccccaaaaattcgtaaaaactatatatcacccgtaataataccccgaatccgatcccgaatcaaaaatataaaaaaacaacacg

SEQ ID NO: 15341 - DNA, 609 bp, Artificial Sequence
  chemically treated genomic DNA (Homo sapiens) CpG-island No: 15341
gttatgtttatgtttagtttagcgtgttatcgaggttagacggatcggcgttattacggcgtgttatttggttgtttttcggcgtttagttatcggcgaaaatttagtagttataggaggttgtatcgttatcgcgtaattgggcgaacgaattaagttgttggttttttttgacgataatcgtatcggttgtcggatcggtaatatcggttagcgttttatcgttgttttttatcgttattttttttgaagatggtttatgcggaatggcgtagttttatgttatgtttagtatttggttcgggttcgcgttattttgttcggtatatattttgcgtaagcgtaggaagatatcggagaggatttcgtcgttagttagcgtaattttcggggcgttcgtatttttttagtgttattgtaattagcgatttgagttaacgatagaatcgttttttttcgcgaagtaggtcgatggtagacggaatatttcggtttggattttcgacgagttaatttcgtttagtttatcgtggttttgttagaagttagaggttttagtgtttagtgggtcgatggtgacgaggaattttagtttcgatagataatcga

SEQ ID NO: 15342 - DNA, 609 bp, Artificial Sequence
  chemically treated genomic DNA (Homo sapiens) CpG-island No: 15342
tcgattatctatcgaaactaaaattcctcgtcaccatcgacccactaaacactaaaacctctaacttctaacaaaaccacgataaactaaacgaaattaactcgtcgaaaatccaaaccgaaatattccgtctaccatcgacctacttcgcgaaaaaaaacgattctatcgttaactcaaatcgctaattacaataacactaaaaaaatacgaacgccccgaaaattacgctaactaacgacgaaatcctctccgatatcttcctacgcttacgcaaaatatataccgaacaaaataacgcgaacccgaaccaaatactaaacataacataaaactacgccattccgcataaaccatcttcaaaaaaaataacgataaaaaacaacgataaaacgctaaccgatattaccgatccgacaaccgatacgattatcgtcaaaaaaaaccaacaacttaattcgttcgcccaattacgcgataacgatacaacctcctataactactaaattttcgccgataactaaacgccgaaaaacaaccaaataacacgccgtaataacgccgatccgtctaacctcgataacacgctaaactaaacataaacataac

SEQ ID NO: 15343 - DNA, 609 bp, Artificial Sequence
  chemically treated genomic DNA (Homo sapiens) CpG-island No: 15343
tcggttgtttgtcgaaattgaagtttttcgttattatcgatttattgaatattgaaatttttaatttttggtagaattacggtgagttgaacgaagttgattcgtcgaagatttagatcgaagtgtttcgtttgttatcgatttgtttcgcggaagagaacggttttatcgttaatttaggtcgttggttatagtggtattggaaaggtgcggacgtttcggggattgcgttgattgacggcgagatttttttcggtatttttttgcgtttgcgtaagatgtatgtcgaatagggtggcgcgaattcggattaggtgttgaatatgatatggaattacgttatttcgtatgagttatttttagaagaagtggcgatggagagtaacggtaaggcgttggtcgatattatcgattcggtaatcggtgcggttatcgttaagaaaggttaataatttagttcgttcgtttaattgcgcgatgacggtataattttttgtggttgttggattttcgtcggtagttggacgtcggaaggtaattagatggtacgtcgtgataacgtcgattcgtttggtttcggtaatacgttgggttgggtatgggtatggt

SEQ ID NO: 15344 - DNA, 609 bp, Artificial Sequence
  chemically treated genomic DNA (Homo sapiens) CpG-island No: 15344
accatacccatacccaacccaacgtattaccgaaaccaaacgaatcgacgttatcacgacgtaccatctaattaccttccgacgtccaactaccgacgaaaatccaacaaccacaaaaaattataccgtcatcgcgcaattaaacgaacgaactaaattattaacctttcttaacgataaccgcaccgattaccgaatcgataatatcgaccaacgccttaccgttactctccatcgccacttcttctaaaaataactcatacgaaataacgtaattccatatcatattcaacacctaatccgaattcgcgccaccctattcgacatacatcttacgcaaacgcaaaaaaataccgaaaaaaatctcgccgtcaatcaacgcaatccccgaaacgtccgcacctttccaataccactataaccaacgacctaaattaacgataaaaccgttctcttccgcgaaacaaatcgataacaaacgaaacacttcgatctaaatcttcgacgaatcaacttcgttcaactcaccgtaattctaccaaaaattaaaaatttcaatattcaataaatcgataataacgaaaaacttcaatttcgacaaacaaccga

SEQ ID NO: 15345 - DNA, 872 bp, Artificial Sequence
  chemically treated genomic DNA (Homo sapiens) CpG-island No: 15345
ttaacggtaacgtagcggatacgttgatgttgtgtgttttttgggtcgtttagacggatttttcggagttttttaagaaatggaattcgggcgcgaatgtttattagttgtcgggggcgagcgagatgagtttcgagggcggtgtgagttagtcggtttataatacgttcgcgttattcgatttgtcgaaatcggaatagggatcggaaattattaattaggttatcgagtataagatgtttgtcgagtaagttcgtaggtcggataaggcgtttacgtcgtattcggtagtgttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggttttagtaacgtacgtagtagggttttttttatattgcgtgtattaatgatttacgcggtaatgcggttgatagaggtatcgaagaagttaaggtcgatatgtattcggttaaatagatcgtgacgtataattttattggtaattgtttgggttttattatttagtagtattacgtgatcgttgttttagcgaatcggacggttgacgtgtagtagtaattgcggtatatatagtatggcggcggaaattttgtcggaaattattttagtcgggtggaagtgttcggcgtttaggtatagcgtagtttggcggttggtggtatattttatgtaaaatttattggagttaatcgtgtagttttttgcgttaatgttaaataattt

SEQ ID NO: 15346 - DNA, 872 bp, Artificial Sequence
  chemically treated genomic DNA (Homo sapiens) CpG-island No: 15346
aaattatttaacattaacgcaaaaaactacacgattaactccaataaattttacataaaatataccaccaaccgccaaactacgctatacctaaacgccgaacacttccacccgactaaaataatttccgacaaaatttccgccgccatactatatataccgcaattactactacacgtcaaccgtccgattcgctaaaacaacgatcacgtaatactactaaataataaaacccaaacaattaccaataaaattatacgtcacgatctatttaaccgaatacatatcgaccttaacttcttcgatacctctatcaaccgcattaccgcgtaaatcattaatacacgcaatataaaaaaaaccctactacgtacgttactaaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataacactaccgaatacgacgtaaacgccttatccgacctacgaacttactcgacaaacatcttatactcgataacctaattaataatttccgatccctattccgatttcgacaaatcgaataacgcgaacgtattataaaccgactaactcacaccgccctcgaaactcatctcgctcgcccccgacaactaataaacattcgcgcccgaattccatttcttaaaaaactccgaaaaatccgtctaaacgacccaaaaaacacacaacatcaacgtatccgctacgttaccgttaa

SEQ ID NO: 15347 - DNA, 872 bp, Artificial Sequence
  chemically treated genomic DNA (Homo sapiens) CpG-island No: 15347
aaattgtttggtattggcgtagagagttatacggttggttttaatgagttttatatggggtatgttattagtcgttagattgcgttgtgtttggacgtcgggtatttttattcgattgaagtgattttcgataagattttcgtcgttatgttgtatgtgtcgtagttgttgttgtacgttagtcgttcggttcgttgggatagcgattacgtagtgttgttggatgatgaaatttaggtaattgttagtgagattgtgcgttacgatttgtttgatcgggtgtatatcggttttgattttttcgatgtttttattaatcgtattgtcgcgtgggttattggtatacgtaatatgaaaaaagttttgttgcgtgcgttgttggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaatattgtcggatgcggcgtaaacgttttattcggtttacgggtttattcggtagatattttatgttcggtaatttgattaatggttttcggtttttgtttcggtttcggtagatcgagtgacgcgagcgtgttgtaagtcgattggtttatatcgttttcgaagtttatttcgttcgttttcggtagttggtaagtattcgcgttcggattttattttttaaagaatttcgaaagattcgtttgggcgatttaggaggtatatagtattagcgtgttcgttgcgttatcgttgg

SEQ ID NO: 15348 - DNA, 872 bp, Artificial Sequence
  chemically treated genomic DNA (Homo sapiens) CpG-island No: 15348
ccaacgataacgcaacgaacacgctaatactatatacctcctaaatcgcccaaacgaatctttcgaaattctttaaaaaataaaatccgaacgcgaatacttaccaactaccgaaaacgaacgaaataaacttcgaaaacgatataaaccaatcgacttacaacacgctcgcgtcactcgatctaccgaaaccgaaacaaaaaccgaaaaccattaatcaaattaccgaacataaaatatctaccgaataaacccgtaaaccgaataaaacgtttacgccgcatccgacaatattacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattccaacaacgcacgcaacaaaacttttttcatattacgtataccaataacccacgcgacaatacgattaataaaaacatcgaaaaaatcaaaaccgatatacacccgatcaaacaaatcgtaacgcacaatctcactaacaattacctaaatttcatcatccaacaacactacgtaatcgctatcccaacgaaccgaacgactaacgtacaacaacaactacgacacatacaacataacgacgaaaatcttatcgaaaatcacttcaatcgaataaaaatacccgacgtccaaacacaacgcaatctaacgactaataacataccccatataaaactcattaaaaccaaccgtataactctctacgccaataccaaacaattt

SEQ ID NO: 15349 - DNA, 729 bp, Artificial Sequence
  chemically treated genomic DNA (Homo sapiens) CpG-island No: 15349
gatcgcgcgtttcgatggtaatttttgcgtttttaggttgatacggtgggattattatcgtttgatgcgtttggcgttgcgtttgcggtaatagatttataaatgttttttttagcgtagcgttttgcgtttgttgtcgtagtttttcggcgttgttagttgttagtattttttcggtatttatcgttattagttagtcgaagcgttcggttttttttatataggcggtggcgattagtacgtttatattgttttgtcgttggcgaatattgtcgattagattttagaattgggagcgggagagcgggttaattttcgttgttggtttattaaggattaatagtttcgggtcgtggattaacgcgtagtatagtttaagtttttgttttatttcgtcggagagtttttttgtcggacgatcgcgaaacggtgttaattcggtgttggttagtagtttattgattcgtatttttcgtttcgttttgtcgtgatcgaataggcgagcgaaaaaatcgacgtttttatatatcgataaggtgtggtagaggtttttgtttagtttttgcggtatttaggcgatgcgcgggtagacgtcgcggcgatgtttcgggtcgcgtatatcgtcgtttagtattattatattgttttgtttaatgacgcgggtatcggaaattaacgataataagttcgatttttcgacgtcgttcgggttaattagttcgattatat

SEQ ID NO: 15350 - DNA, 729 bp, Artificial Sequence
  chemically treated genomic DNA (Homo sapiens) CpG-island No: 15350
atataatcgaactaattaacccgaacgacgtcgaaaaatcgaacttattatcgttaatttccgatacccgcgtcattaaacaaaacaatataataatactaaacgacgatatacgcgacccgaaacatcgccgcgacgtctacccgcgcatcgcctaaataccgcaaaaactaaacaaaaacctctaccacaccttatcgatatataaaaacgtcgattttttcgctcgcctattcgatcacgacaaaacgaaacgaaaaatacgaatcaataaactactaaccaacaccgaattaacaccgtttcgcgatcgtccgacaaaaaaactctccgacgaaataaaacaaaaacttaaactatactacgcgttaatccacgacccgaaactattaatccttaataaaccaacaacgaaaattaacccgctctcccgctcccaattctaaaatctaatcgacaatattcgccaacgacaaaacaatataaacgtactaatcgccaccgcctatataaaaaaaaccgaacgcttcgactaactaataacgataaataccgaaaaaatactaacaactaacaacgccgaaaaactacgacaacaaacgcaaaacgctacgctaaaaaaaacatttataaatctattaccgcaaacgcaacgccaaacgcatcaaacgataataatcccaccgtatcaacctaaaaacgcaaaaattaccatcgaaacgcgcgatc

SEQ ID NO: 15351 - DNA, 729 bp, Artificial Sequence
  chemically treated genomic DNA (Homo sapiens) CpG-island No: 15351
gtatggtcgggttgattggttcggacggcgtcgggaagtcgagtttgttgtcgttgattttcggtgttcgcgttattgaatagggtaatgtgatggtgttgggcggcgatatgcgcgattcgaagtatcgtcgcgacgtttgttcgcgtatcgtttggatgtcgtaggggttgggtaaaaatttttattatattttgtcggtgtatgaaaacgtcgattttttcgttcgtttgttcggttacgataaagcggagcgggaagtgcgaattaatgagttgttgattagtatcgggttagtatcgtttcgcgatcgttcggtagggaaatttttcggcgggatgaagtaaaaatttgggttgtgttgcgcgttaatttacgattcggaattgttgatttttgatgagttaataacgggggttgattcgttttttcgtttttagttttgggatttgatcgatagtattcgttagcggtagagtaatatgagcgtgttggtcgttatcgtttatatggaagaggtcgaacgtttcgattggttggtagcgatgaatgtcggagaagtgttggtaattggtagcgtcgaagagttacggtagtaaacgtaaagcgttacgttggaagaagtatttataaatttgttatcgtaagcgtaacgttaggcgtattaggcggtagtgattttatcgtattaatttgaaaacgtagagattgttatcgaagcgcgcgatt

SEQ ID NO: 15352 - DNA, 729 bp, Artificial Sequence
  chemically treated genomic DNA (Homo sapiens) CpG-island No: 15352
aatcgcgcgcttcgataacaatctctacgttttcaaattaatacgataaaatcactaccgcctaatacgcctaacgttacgcttacgataacaaatttataaatacttcttccaacgtaacgctttacgtttactaccgtaactcttcgacgctaccaattaccaacacttctccgacattcatcgctaccaaccaatcgaaacgttcgacctcttccatataaacgataacgaccaacacgctcatattactctaccgctaacgaatactatcgatcaaatcccaaaactaaaaacgaaaaaacgaatcaacccccgttattaactcatcaaaaatcaacaattccgaatcgtaaattaacgcgcaacacaacccaaatttttacttcatcccgccgaaaaatttccctaccgaacgatcgcgaaacgatactaacccgatactaatcaacaactcattaattcgcacttcccgctccgctttatcgtaaccgaacaaacgaacgaaaaaatcgacgttttcatacaccgacaaaatataataaaaatttttacccaacccctacgacatccaaacgatacgcgaacaaacgtcgcgacgatacttcgaatcgcgcatatcgccgcccaacaccatcacattaccctattcaataacgcgaacaccgaaaatcaacgacaacaaactcgacttcccgacgccgtccgaaccaatcaacccgaccatac

SEQ ID NO: 15353 - DNA, 817 bp, Artificial Sequence
  chemically treated genomic DNA (Homo sapiens) CpG-island No: 15353
tcgtttggtagcgtggcgtaggtgcgtgaaacggcggtttatttgatacgtttcgttaaaacgcgcggtgtggcgattgttatggtggggtacgtaattaaagatggttcgttggttggttcgaaagtgttggaatattgtatcgattgttcggtgtttttggatggcgatgtcgattttcgttttcgtattttgcgtagttataaaaatcgtttcggcgcggtgaatgagttgggcgttttcgcgatgatcgaataggggttgcgtgaagttagtaatttttcggtaatttttttaagtcgcggcgatgaagtgattttcggtagtttagtgatggtggtatgggaaggaacgcgtttattgttggtggagatttaggcgttggtcgattattcgatgatggcgaatttacgtcgcgtggtagtggggttggaataaaatcgtttggtaattttgttggttgtgttgtatcgttacggtggtttgtaaatggtcgattaggatgtgtttgtgaacgtggtcggcggcgtgaaggtaatcgaaattagtgtcgatttagcgttattgttggcgatggtttttagtttgcgcgatagatcgttgtcgtaggatttggtggtgtttggtgaagtcgggttggtaggggagattcgttcggtgtttagcggttaggaacgaatttttgaagcggcgaaatacggttttcgtcgggcgattgtttcggcggttaacgtgtcgaaaaaagcgtcggaagggatgtagatttttggcgttaaaaaatttttcgacgcgtttagcgtgttcgacgatttataat

SEQ ID NO: 15354 - DNA, 817 bp, Artificial Sequence
  chemically treated genomic DNA (Homo sapiens) CpG-island No: 15354
attataaatcgtcgaacacgctaaacgcgtcgaaaaattttttaacgccaaaaatctacatcccttccgacgcttttttcgacacgttaaccgccgaaacaatcgcccgacgaaaaccgtatttcgccgcttcaaaaattcgttcctaaccgctaaacaccgaacgaatctcccctaccaacccgacttcaccaaacaccaccaaatcctacgacaacgatctatcgcgcaaactaaaaaccatcgccaacaataacgctaaatcgacactaatttcgattaccttcacgccgccgaccacgttcacaaacacatcctaatcgaccatttacaaaccaccgtaacgatacaacacaaccaacaaaattaccaaacgattttattccaaccccactaccacgcgacgtaaattcgccatcatcgaataatcgaccaacgcctaaatctccaccaacaataaacgcgttccttcccataccaccatcactaaactaccgaaaatcacttcatcgccgcgacttaaaaaaattaccgaaaaattactaacttcacgcaacccctattcgatcatcgcgaaaacgcccaactcattcaccgcgccgaaacgatttttataactacgcaaaatacgaaaacgaaaatcgacatcgccatccaaaaacaccgaacaatcgatacaatattccaacactttcgaaccaaccaacgaaccatctttaattacgtaccccaccataacaatcgccacaccgcgcgttttaacgaaacgtatcaaataaaccgccgtttcacgcacctacgccacgctaccaaacga

SEQ ID NO: 15355 - DNA, 817 bp, Artificial Sequence
  chemically treated genomic DNA (Homo sapiens) CpG-island No: 15355
attataagtcgtcgaatacgttaagcgcgtcggagagttttttaacgttaaaaatttgtatttttttcggcgtttttttcggtacgttagtcgtcggaataatcgttcggcgaaaatcgtgtttcgtcgttttagagattcgtttttgatcgttgggtatcgggcggattttttttgttagttcgattttattaaatattattagattttgcggtagcggtttgtcgcgtaggttggaaattatcgttagtagtaacgttaagtcggtattggtttcggttatttttacgtcgtcgattacgtttataaatatattttgatcggttatttgtagattatcgtgacggtgtaatatagttagtaggattgttagacggttttgttttagttttattgttacgcggcgtgggttcgttattatcgagtgatcgattagcgtttgaatttttattagtagtggacgcgtttttttttatattattattattgagttatcggaggttattttatcgtcgcgatttaagaaaattgtcgaagggttgttgattttacgtagtttttgttcggttatcgcgaagacgtttagtttatttatcgcgtcgaagcggtttttatggttgcgtaaggtgcgaaaacgggagtcggtatcgttatttaaaagtatcgaatagtcgatatagtgttttagtattttcgggttagttagcgaattatttttggttacgtgttttattatgataatcgttatatcgcgcgttttggcgaagcgtgttaaataagtcgtcgttttacgtatttgcgttacgttattaggcga

SEQ ID NO: 15356 - DNA, 817 bp, Artificial Sequence
  chemically treated genomic DNA (Homo sapiens) CpG-island No: 15356
tcgcctaataacgtaacgcaaatacgtaaaacgacgacttatttaacacgcttcgccaaaacgcgcgatataacgattatcataataaaacacgtaaccaaaaataattcgctaactaacccgaaaatactaaaacactatatcgactattcgatacttttaaataacgataccgactcccgttttcgcaccttacgcaaccataaaaaccgcttcgacgcgataaataaactaaacgtcttcgcgataaccgaacaaaaactacgtaaaatcaacaacccttcgacaattttcttaaatcgcgacgataaaataacctccgataactcaataataataatataaaaaaaaacgcgtccactactaataaaaattcaaacgctaatcgatcactcgataataacgaacccacgccgcgtaacaataaaactaaaacaaaaccgtctaacaatcctactaactatattacaccgtcacgataatctacaaataaccgatcaaaatatatttataaacgtaatcgacgacgtaaaaataaccgaaaccaataccgacttaacgttactactaacgataatttccaacctacgcgacaaaccgctaccgcaaaatctaataatatttaataaaatcgaactaacaaaaaaaatccgcccgatacccaacgatcaaaaacgaatctctaaaacgacgaaacacgattttcgccgaacgattattccgacgactaacgtaccgaaaaaaacgccgaaaaaaatacaaatttttaacgttaaaaaactctccgacgcgcttaacgtattcgacgacttataat

SEQ ID NO: 15357 - DNA, 522 bp, Artificial Sequence
  chemically treated genomic DNA (Homo sapiens) CpG-island No: 15357
cgatgtcgttggttagtttttttagtatcgtcgttagcgttacgttcgttagggttaaacgtatcggatttaattgttcgtcgttttgattgtcggtaaaggtaataattaatgaggttattagcgtttcggcgaaggttatcgttagttgtttttgcgcggaagagtaattaaatagcgtcgtatttagtataatggtaaagttggtttcggcgtttacgttaagtaagtcggggtcggtaagtgggtttcgggtgagggtttgtattaacgtttcggtaaggttaagcgcgtcgtttgttagtaaatcggtaagggtacgcggtagtcgcgcgtcgagtacgatggtgtagtcggcgttttggtaggtgtcggagaaggtttttagtattacggaagcggggagtgattttgttttaatgagtaggtttaatgtcgtcgcgataattagtaataatagtaattcgggtacggtaatggcgcgtgttacggtaatagaattagatatacgaatttttatga

SEQ ID NO: 15358 - DNA, 522 bp, Artificial Sequence
  chemically treated genomic DNA (Homo sapiens) CpG-island No: 15358
tcataaaaattcgtatatctaattctattaccgtaacacgcgccattaccgtacccgaattactattattactaattatcgcgacgacattaaacctactcattaaaacaaaatcactccccgcttccgtaatactaaaaaccttctccgacacctaccaaaacgccgactacaccatcgtactcgacgcgcgactaccgcgtacccttaccgatttactaacaaacgacgcgcttaaccttaccgaaacgttaatacaaaccctcacccgaaacccacttaccgaccccgacttacttaacgtaaacgccgaaaccaactttaccattatactaaatacgacgctatttaattactcttccgcgcaaaaacaactaacgataaccttcgccgaaacgctaataacctcattaattattacctttaccgacaatcaaaacgacgaacaattaaatccgatacgtttaaccctaacgaacgtaacgctaacgacgatactaaaaaaactaaccaacgacatcg

SEQ ID NO: 15359 - DNA, 522 bp, Artificial Sequence
  chemically treated genomic DNA (Homo sapiens) CpG-island No: 15359
ttatggaagttcgtatgtttggttttgttgtcgtgatacgcgttattgtcgtgttcggattgttgttattattgattatcgcgacggtattaagtttgtttattggggtaaaattatttttcgttttcgtagtgttggaggtttttttcggtatttgttagagcgtcgattgtattatcgtgttcgacgcgcggttgtcgcgtatttttgtcggtttattggtaggcggcgcgtttggttttgtcggggcgttaatgtaaatttttattcgaaatttatttgtcgatttcggtttgtttggcgtgaacgtcggagttagttttgttattgtgttgggtgcggcgttgtttggttattttttcgcgtaggaataattggcgatggttttcgtcggggcgttggtggttttattgattgttgtttttatcggtagttagggcggcgggtagttaagttcggtgcgtttaattttggcgggcgtggcgttggcggcggtgttggaaggattgattagcggtatcg

SEQ ID NO: 15360 - DNA, 522 bp, Artificial Sequence
  chemically treated genomic DNA (Homo sapiens) CpG-island No: 15360
cgataccgctaatcaatccttccaacaccgccgccaacgccacgcccgccaaaattaaacgcaccgaacttaactacccgccgccctaactaccgataaaaacaacaatcaataaaaccaccaacgccccgacgaaaaccatcgccaattattcctacgcgaaaaaataaccaaacaacgccgcacccaacacaataacaaaactaactccgacgttcacgccaaacaaaccgaaatcgacaaataaatttcgaataaaaatttacattaacgccccgacaaaaccaaacgcgccgcctaccaataaaccgacaaaaatacgcgacaaccgcgcgtcgaacacgataatacaatcgacgctctaacaaataccgaaaaaaacctccaacactacgaaaacgaaaaataattttaccccaataaacaaacttaataccgtcgcgataatcaataataacaacaatccgaacacgacaataacgcgtatcacgacaacaaaaccaaacatacgaacttccataa

SEQ ID NO: 15361 - DNA, 538 bp, Artificial Sequence
  chemically treated genomic DNA (Homo sapiens) CpG-island No: 15361
  misc_feature (408)..(408): n is either a, c, g or t
  misc_feature (413)..(413): n is either a, c, g or t
  misc_feature (416)..(416): n is either a, c, g or t
  misc_feature (425)..(425): n is either a, c, g or t
  misc_feature (490)..(491): n is either a, c, g or t
  misc_feature (500)..(500): n is either a, c, g or t
  misc_feature (525)..(525): n is either a, c, g or t
  misc_feature (535)..(535): n is either a, c, g or t
ggttgaggattttattgttacgttattatttgttgatgaagtggtttatttttagtttttcggtggtattatcggtatatcgaaattgatttcgcgtatttataacgattattattatagcgtgcgtcgtagcgtcgagatttgttagtttatataatagatacgttatttggtgcgcgatttcggcggtttataattacgttatgagttcgtttaggatcgttgggcgttttttttgtcggaggaatcggttgtttttggcggttcgatttttagcgtttacgttttggtttttttattgattgaaaaatattaggtaacgttatcgcgttggtgttattcgtagttagtttgtggttgtaggcgttgatcgaaggcgaaagtcgggcgtagttgtttcgttgaaanttttnggntttattaanggttgggggcggcgggtttttttaaaaaaaaaacgtttttttgttatttttgcggcggcgtaaannttttttttntcgttgagattgggttttttttgtntagttgtagntat

SEQ ID NO: 15362 - DNA, 538 bp, Artificial Sequence
  chemically treated genomic DNA (Homo sapiens) CpG-island No: 15362
  misc_feature (4)..(4): n is either a, c, g or t
  misc_feature (14)..(14): n is either a, c, g or t
  misc_feature (39)..(39): n is either a, c, g or t
  misc_feature (48)..(49): n is either a, c, g or t
  misc_feature (114)..(114): n is either a, c, g or t
  misc_feature (123)..(123): n is either a, c, g or t
  misc_feature (126)..(126): n is either a, c, g or t
  misc_feature (131)..(131): n is either a, c, g or t
atanctacaactanacaaaaaaaacccaatctcaacganaaaaaaaanntttacgccgccgcaaaaataacaaaaaaacgttttttttttaaaaaaacccgccgcccccaaccnttaataaanccnaaaantttcaacgaaacaactacgcccgactttcgccttcgatcaacgcctacaaccacaaactaactacgaataacaccaacgcgataacgttacctaatatttttcaatcaataaaaaaaccaaaacgtaaacgctaaaaatcgaaccgccaaaaacaaccgattcctccgacaaaaaaaacgcccaacgatcctaaacgaactcataacgtaattataaaccgccgaaatcgcgcaccaaataacgtatctattatataaactaacaaatctcgacgctacgacgcacgctataataataatcgttataaatacgcgaaatcaatttcgatataccgataataccaccgaaaaactaaaaataaaccacttcatcaacaaataataacgtaacaataaaatcctcaacc

SEQ ID NO: 15363 - DNA, 538 bp, Artificial Sequence
  chemically treated genomic DNA (Homo sapiens) CpG-island No: 15363
  misc_feature (4)..(4): n is either a, c, g or t
  misc_feature (14)..(14): n is either a, c, g or t
  misc_feature (39)..(39): n is either a, c, g or t
  misc_feature (48)..(49): n is either a, c, g or t
  misc_feature (114)..(114): n is either a, c, g or t
  misc_feature (123)..(123): n is either a, c, g or t
  misc_feature (126)..(126): n is either a, c, g or t
  misc_feature (131)..(131): n is either a, c, g or t
gtgnttgtaattgnataaaaggggtttaattttagcggngaaaaaaanntttacgtcgtcgtaagggtggtagaaagacgttttttttttgggggggttcgtcgtttttaattnttggtaaanttnagggnttttagcgaggtagttgcgttcggttttcgttttcgattagcgtttgtaattataggttgattgcgggtggtattagcgcggtaacgttatttgatgttttttaattaatggggaaattagagcgtgggcgttggggatcgggtcgttaggaataatcggttttttcggtaagaaagacgtttagcgattttgggcgaatttatggcgtagttatgagtcgtcgggatcgcgtattaggtagcgtgtttgttgtgtgaattgataaatttcgacgttacgacgtacgttgtagtagtagtcgttatgagtgcgcgggattagtttcggtgtgtcggtggtgttatcggaaagttggaaataggttattttattagtaggtgatggcgtggtagtaaaatttttagtt

SEQ ID NO: 15364 - DNA, 538 bp, Artificial Sequence
  chemically treated genomic DNA (Homo sapiens) CpG-island No: 15364
  misc_feature (408)..(408): n is either a, c, g or t
  misc_feature (413)..(413): n is either a, c, g or t
  misc_feature (416)..(416): n is either a, c, g or t
  misc_feature (425)..(425): n is either a, c, g or t
  misc_feature (490)..(491): n is either a, c, g or t
  misc_feature (500)..(500): n is either a, c, g or t
  misc_feature (525)..(525): n is either a, c, g or t
  misc_feature (535)..(535): n is either a, c, g or t
aactaaaaattttactaccacgccatcacctactaataaaataacctatttccaactttccgataacaccaccgacacaccgaaactaatcccgcgcactcataacgactactactacaacgtacgtcgtaacgtcgaaatttatcaattcacacaacaaacacgctacctaatacgcgatcccgacgactcataactacgccataaattcgcccaaaatcgctaaacgtctttcttaccgaaaaaaccgattattcctaacgacccgatccccaacgcccacgctctaatttccccattaattaaaaaacatcaaataacgttaccgcgctaataccacccgcaatcaacctataattacaaacgctaatcgaaaacgaaaaccgaacgcaactacctcgctaaaanccctnaantttaccaanaattaaaaacgacgaacccccccaaaaaaaaaacgtctttctaccacccttacgacgacgtaaanntttttttcnccgctaaaattaaaccccttttatncaattacaancac

SEQ ID NO: 15365 - DNA, 838 bp, Artificial Sequence
  chemically treated genomic DNA (Homo sapiens) CpG-island No: 15365
gtagagtgggaatatgtcgttttcgtttggtagttcggttattagcgttagtgttggtaggacggtggacgtaaaaattgcgttaaagattcggtttatcgtaagatggaaagcgatatgtataatttgtagtcgttagtcggtgaggtgaatggcgatcgcggtaattttatgtatagttagtggaatggcggtgaaggttagtacggttaatgcgttatgaaggtcgattttaaagaaaaagttgtcgaattattagcgcgtgtacgcggtgttattgcgcgtatttatttttatatgcgcgattaatataatttgatattttttcgttagtaaacgtagttgtttaacgtatggaataagatgtattcggttatcgattggaagtgcgagcgcgatgaacgtatcgcgaaggtgtaggataattataattcgtatgtgtaacgcgttggttaggcgcgaaagagttaatttatattagcgggatttttttgtgttaatttttattttacgcgtataatcgcgtggggagacgacgcggatttttaattatgcgtatttttcggtatttattattttgaattattgattagttatttttatatcgcgttttgcgaagatgtcgttaattatatcgggcgcgtattgcgtatggggtcggggtaggcgttgtaattgtttgacggtagtaattaggtttttgacgtcgaaattattagcgttagtaaaaaaagcgtggaagtgaaggtgttggaaggttagatcgacgatcgcgaattttcgttgtatatttatttcggttaggtgatgtcgcgtggtgaaaaaatggaatttatta

SEQ ID NO: 15366 - DNA, 838 bp, Artificial Sequence
  chemically treated genomic DNA (Homo sapiens) CpG-island No: 15366
taataaattccattttttcaccacgcgacatcacctaaccgaaataaatatacaacgaaaattcgcgatcgtcgatctaaccttccaacaccttcacttccacgctttttttactaacgctaataatttcgacgtcaaaaacctaattactaccgtcaaacaattacaacgcctaccccgaccccatacgcaatacgcgcccgatataattaacgacatcttcgcaaaacgcgatataaaaataactaatcaataattcaaaataataaataccgaaaaatacgcataattaaaaatccgcgtcgtctccccacgcgattatacgcgtaaaataaaaattaacacaaaaaaatcccgctaatataaattaactctttcgcgcctaaccaacgcgttacacatacgaattataattatcctacaccttcgcgatacgttcatcgcgctcgcacttccaatcgataaccgaatacatcttattccatacgttaaacaactacgtttactaacgaaaaaatatcaaattatattaatcgcgcatataaaaataaatacgcgcaataacaccgcgtacacgcgctaataattcgacaactttttctttaaaatcgaccttcataacgcattaaccgtactaaccttcaccgccattccactaactatacataaaattaccgcgatcgccattcacctcaccgactaacgactacaaattatacatatcgctttccatcttacgataaaccgaatctttaacgcaatttttacgtccaccgtcctaccaacactaacgctaataaccgaactaccaaacgaaaacgacatattcccactctac

SEQ ID NO: 15367 - DNA, 838 bp, Artificial Sequence
  chemically treated genomic DNA (Homo sapiens) CpG-island No: 15367
tagtaaattttatttttttattacgcgatattatttgatcgaggtgaatatgtagcggagattcgcgatcgtcgatttggttttttagtatttttatttttacgttttttttgttggcgttggtaatttcggcgttaaagatttggttgttatcgttaaataattgtaacgtttgtttcggttttatgcgtagtacgcgttcgatatggttggcggtattttcgtaaagcgcgatgtgagaatggttggttagtggtttaggatgataaatgtcgggggatacgtatagttaaaaattcgcgtcgtttttttacgcggttgtacgcgtggggtaggggttaatataaaagaatttcgttagtgtaggttagttttttcgcgtttggttagcgcgttgtatatacgggttatgattgttttgtattttcgcgatgcgtttatcgcgttcgtatttttagtcggtaatcggatatattttgttttatgcgttgaatagttgcgtttgttggcgagagagtgttaggttgtattggtcgcgtatatagaagtaggtgcgcgtaatggtatcgcgtgtacgcgttggtggttcggtagttttttttttgaaatcgatttttatggcgtattgatcgtattggtttttatcgttattttattggttgtatataaagttgtcgcgatcgttatttattttatcgattgacggttgtaggttatgtatatcgttttttattttgcgatagatcggatttttagcgtagtttttacgtttatcgttttgttagtattggcgttggtgatcgaattgttaggcgggaacgatatgtttttattttat

SEQ ID NO: 15368 - DNA, 838 bp, Artificial Sequence
  chemically treated genomic DNA (Homo sapiens) CpG-island No: 15368
ataaaataaaaacatatcgttcccgcctaacaattcgatcaccaacgccaatactaacaaaacgataaacgtaaaaactacgctaaaaatccgatctatcgcaaaataaaaaacgatatacataacctacaaccgtcaatcgataaaataaataacgatcgcgacaactttatatacaaccaataaaataacgataaaaaccaatacgatcaatacgccataaaaatcgatttcaaaaaaaaaactaccgaaccaccaacgcgtacacgcgataccattacgcgcacctacttctatatacgcgaccaatacaacctaacactctctcgccaacaaacgcaactattcaacgcataaaacaaaatatatccgattaccgactaaaaatacgaacgcgataaacgcatcgcgaaaatacaaaacaatcataacccgtatatacaacgcgctaaccaaacgcgaaaaaactaacctacactaacgaaattcttttatattaacccctaccccacgcgtacaaccgcgtaaaaaaacgacgcgaatttttaactatacgtatcccccgacatttatcatcctaaaccactaaccaaccattctcacatcgcgctttacgaaaataccgccaaccatatcgaacgcgtactacgcataaaaccgaaacaaacgttacaattatttaacgataacaaccaaatctttaacgccgaaattaccaacgccaacaaaaaaaacgtaaaaataaaaatactaaaaaaccaaatcgacgatcgcgaatctccgctacatattcacctcgatcaaataatatcgcgtaataaaaaaataaaatttacta

SEQ ID NO: 15369 - DNA, 1080 bp, Artificial Sequence
  chemically treated genomic DNA (Homo sapiens) CpG-island No: 15369
  misc_feature (933)..(934): n is either a, c, g or t
  misc_feature (951)..(952): n is either a, c, g or t
tttttgcgtcgagaatcgtcgttttgattattcgatattcgtttttaggtcgttatcgatttgtaaacggattttgtgacgtaagtcgttagtaattagcgtttgttgggttttaataagttttagtttttacggtatagtttgcgtattttatcgattaaagcggatttgtcgtcggtgtcgttcgttatagtttgcgatggtgattaatgttcgtataagttttttgttacgttagttcgcgatggtgtttattttcggttcggaaattagtttttatcggtagaattatttcgtttttcggcgttaatttggttttgatggtttgataattatgtaagttggcgattataggtttttttcgattacgtagttcgatatcgtggtgcggcgtgcgtgggagattagcgttaatttcgggtattcgaatagcgtagtttggcgatgtaaggcgtgatttattattcggtaattgatcgttttcgtttggtttcgcgttttgggcgattttaatttgaatgacgtcggtattgattagatacgtcggagtaattttaaagcgatcggaagttatttgtttgatgcgcgatattttgttggtgtcgtagcgcgtcgggttttcgtcgtttttatcggagttcgaattatcgtcgatgttgtttatcgttttcgttagcgtttcgtgggttttcgggtttaacgcgtcgatagatatcgcggcggtattaaagcgtttaaatagttcgtttgtcggtttaatattagtaatgttgatcgcgtttttattcggcgtaattgttagtagatcgcgtagcgtggttgtcggacgtttattaattagtttcgcgtatttttgatagtcgttgtattcgtcgttttgtatcgtttgttgtagcgtgcgtattacgttcgggttgtaggcgtggtattcgnntcgtcgtgggacgttannttttagtaagatcgttttggttgatgggtttacgcgttagttaggtacgtttcgatagatttagtagattttgttggaagtttttaaagtttgttttattaatgcggttgatcgttttttggaagtat

SEQ ID NO: 15370 - DNA, 1080 bp, Artificial Sequence
  chemically treated genomic DNA (Homo sapiens) CpG-island No: 15370
  misc_feature (129)..(130): n is either a, c, g or t
  misc_feature (147)..(148): n is either a, c, g or t
atacttccaaaaaacgatcaaccgcattaataaaacaaactttaaaaacttccaacaaaatctactaaatctatcgaaacgtacctaactaacgcgtaaacccatcaaccaaaacgatcttactaaaanntaacgtcccacgacganncgaataccacgcctacaacccgaacgtaatacgcacgctacaacaaacgatacaaaacgacgaatacaacgactatcaaaaatacgcgaaactaattaataaacgtccgacaaccacgctacgcgatctactaacaattacgccgaataaaaacgcgatcaacattactaatattaaaccgacaaacgaactatttaaacgctttaataccgccgcgatatctatcgacgcgttaaacccgaaaacccacgaaacgctaacgaaaacgataaacaacatcgacgataattcgaactccgataaaaacgacgaaaacccgacgcgctacgacaccaacaaaatatcgcgcatcaaacaaataacttccgatcgctttaaaattactccgacgtatctaatcaataccgacgtcattcaaattaaaatcgcccaaaacgcgaaaccaaacgaaaacgatcaattaccgaataataaatcacgccttacatcgccaaactacgctattcgaatacccgaaattaacgctaatctcccacgcacgccgcaccacgatatcgaactacgtaatcgaaaaaaacctataatcgccaacttacataattatcaaaccatcaaaaccaaattaacgccgaaaaacgaaataattctaccgataaaaactaatttccgaaccgaaaataaacaccatcgcgaactaacgtaacaaaaaacttatacgaacattaatcaccatcgcaaactataacgaacgacaccgacgacaaatccgctttaatcgataaaatacgcaaactataccgtaaaaactaaaacttattaaaacccaacaaacgctaattactaacgacttacgtcacaaaatccgtttacaaatcgataacgacctaaaaacgaatatcgaataatcaaaacgacgattctcgacgcaaaaa

SEQ ID NO: 15371 - DNA, 1080 bp, Artificial Sequence
  chemically treated genomic DNA (Homo sapiens) CpG-island No: 15371
  misc_feature (129)..(130): n is either a, c, g or t
  misc_feature (147)..(148): n is either a, c, g or t
gtgtttttagggggcggttagtcgtattggtggagtaagttttgaagatttttagtaggatttgttgaatttgtcgaaacgtgtttggttggcgcgtaagtttattagttagggcggttttgttgaaanntagcgttttacggcggnncgaatattacgtttataattcggacgtggtgcgtacgttgtaataagcggtataaagcggcgagtatagcgattattaggaatacgcgaagttggttaatgagcgttcggtaattacgttgcgcgatttgttggtaattacgtcgggtgaaaacgcggttaatattgttgatgttgaatcggtaagcgaattgtttaaacgttttgatatcgtcgcgatgtttatcggcgcgttaagttcggaagtttacgaggcgttggcggaagcgatgaatagtatcggcggtaattcgaatttcggtgaaggcggcgaagattcggcgcgttacggtattaataaagtgtcgcgtattaagtaggtggttttcggtcgttttggggttatttcggcgtatttggttaatgtcgacgttatttagattaaagtcgtttagggcgcgaagttaggcgaaggcggttagttgtcgggtgataagttacgttttatatcgttaaattgcgttattcgggtgttcggagttgacgttgattttttacgtacgtcgtattacgatatcggattacgtaatcggagggaatttgtagtcgttagtttgtatgattgttagattattaagattaggttaacgtcgaaagacggagtgattttatcgatgaagattggttttcgaatcgggagtaggtattatcgcgaattggcgtggtaaaagatttatgcggatattgattattatcgtaggttatgacggacggtatcggcgataagttcgttttaatcggtgaaatacgtaggttgtatcgtgggagttggggtttgttgaaatttagtaggcgttggttgttaacggtttgcgttataagattcgtttgtaggtcgatggcggtttgaaaacgggtgtcgaatagttaaggcggcgattttcggcgtagaaa

SEQ ID NO: 15372 - DNA, 1080 bp, Artificial Sequence
  chemically treated genomic DNA (Homo sapiens) CpG-island No: 15372
  misc_feature (933)..(934): n is either a, c, g or t
  misc_feature (951)..(952): n is either a, c, g or t
tttctacgccgaaaatcgccgccttaactattcgacacccgttttcaaaccgccatcgacctacaaacgaatcttataacgcaaaccgttaacaaccaacgcctactaaatttcaacaaaccccaactcccacgatacaacctacgtatttcaccgattaaaacgaacttatcgccgataccgtccgtcataacctacgataataatcaatatccgcataaatcttttaccacgccaattcgcgataatacctactcccgattcgaaaaccaatcttcatcgataaaatcactccgtctttcgacgttaacctaatcttaataatctaacaatcatacaaactaacgactacaaattccctccgattacgtaatccgatatcgtaatacgacgtacgtaaaaaatcaacgtcaactccgaacacccgaataacgcaatttaacgatataaaacgtaacttatcacccgacaactaaccgccttcgcctaacttcgcgccctaaacgactttaatctaaataacgtcgacattaaccaaatacgccgaaataaccccaaaacgaccgaaaaccacctacttaatacgcgacactttattaataccgtaacgcgccgaatcttcgccgccttcaccgaaattcgaattaccgccgatactattcatcgcttccgccaacgcctcgtaaacttccgaacttaacgcgccgataaacatcgcgacgatatcaaaacgtttaaacaattcgcttaccgattcaacatcaacaatattaaccgcgttttcacccgacgtaattaccaacaaatcgcgcaacgtaattaccgaacgctcattaaccaacttcgcgtattcctaataatcgctatactcgccgctttataccgcttattacaacgtacgcaccacgtccgaattataaacgtaatattcgnnccgccgtaaaacgctanntttcaacaaaaccgccctaactaataaacttacgcgccaaccaaacacgtttcgacaaattcaacaaatcctactaaaaatcttcaaaacttactccaccaatacgactaaccgccccctaaaaacac

SEQ ID NO: 15373 - DNA, 1391 bp, Artificial Sequence
  chemically treated genomic DNA (Homo sapiens) CpG-island No: 15373
aggttcgttaagtagtagaatggggtagtcgacgataaagtcgcgggcgatgtgacgcgttgttgttcgttatcggaaaatgtcgatggtgttaggtgttataggcgtttcggtacgtttaggcgggtgagaagacgcgcggtttagcggcgtaggttttacgcggaacgtcggtatcgagtagcggttgtattattatttttagtgttgagatacgcgggatgacgcgtagaaattggtttatttagtcgacggtggttttgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtggagtattacgtattcgttcgcgttgacggtgagcgaggcgcgattgaggacgggtaggcgtacgtcgttttgttggtgtaggatgaaggttttattgacgttttgtacgttaattatttttcgtttcgtggttcgggtgtcggatgcgacgttgacgcgttttattcgatttacggggagcgtatttgtaggtcggataaggcgtttacgtcgtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggtgataattattatcgcgaggtttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatatcgtcgtaatgacgtgtttcggtcgttattagtcgttcgtcgatattgtcgtttgtcgatatttggcggcgtaggtcgtcgagtggatgttgatgtattacgttttattcggtacgtagtaggcgacggcggtcggtttcgtttattgtatatagcgaacggttttcgtagtgaatttttttttgttgcggcgttaggcgcgcggagatcgattttagtagcgtggttttttcggagtcggatttttcgataatgtttagtatttttttcggttataaattaaaagagatatcgttaaagtttttgttcggcgcgtaaaggtgggttaggttattgatcgaaagtaacggttgat

SEQ ID NO: 15374 - DNA, 1391 bp, Artificial Sequence
  chemically treated genomic DNA (Homo sapiens) CpG-island No: 15374
atcaaccgttactttcgatcaataacctaacccacctttacgcgccgaacaaaaactttaacgatatctcttttaatttataaccgaaaaaaatactaaacattatcgaaaaatccgactccgaaaaaaccacgctactaaaatcgatctccgcgcgcctaacgccgcaacaaaaaaaaattcactacgaaaaccgttcgctatatacaataaacgaaaccgaccgccgtcgcctactacgtaccgaataaaacgtaatacatcaacatccactcgacgacctacgccgccaaatatcgacaaacgacaatatcgacgaacgactaataacgaccgaaacacgtcattacgacgatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaacctcgcgataataattatcacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatacgacgtaaacgccttatccgacctacaaatacgctccccgtaaatcgaataaaacgcgtcaacgtcgcatccgacacccgaaccacgaaacgaaaaataattaacgtacaaaacgtcaataaaaccttcatcctacaccaacaaaacgacgtacgcctacccgtcctcaatcgcgcctcgctcaccgtcaacgcgaacgaatacgtaatactccacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcaaaaccaccgtcgactaaataaaccaatttctacgcgtcatcccgcgtatctcaacactaaaaataataatacaaccgctactcgataccgacgttccgcgtaaaacctacgccgctaaaccgcgcgtcttctcacccgcctaaacgtaccgaaacgcctataacacctaacaccatcgacattttccgataacgaacaacaacgcgtcacatcgcccgcgactttatcgtcgactaccccattctactacttaacgaacct

SEQ ID NO: 15375 - DNA, 1391 bp, Artificial Sequence
  chemically treated genomic DNA (Homo sapiens) CpG-island No: 15375
attaatcgttattttcggttaataatttgatttatttttacgcgtcgggtaaaggttttagcgatgttttttttgatttatggtcgggggaagtgttgggtattgtcggggaattcggtttcgggaagattacgttgttgaagtcgattttcgcgcgtttgacgtcgtagtagggggaaatttattacgagaatcgttcgttgtatgtaatgagcgaggtcgatcgtcgtcgtttgttgcgtatcgaatggggcgtggtgtattagtatttattcgacggtttgcgtcgttaggtgtcggtaggcggtaatatcggcgagcggttgatggcgatcggggtacgttattacggcgatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaatttcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcggcgtaaacgttttattcggtttataaatgcgtttttcgtaggtcggataagacgcgttagcgtcgtattcgatattcgaattacgaggcgaaaaatgattaacgtataaaacgttagtaaaatttttattttgtattagtaaaacggcgtgcgtttgttcgtttttaatcgcgtttcgtttatcgttaacgcgggcgaatgcgtggtgttttacggttatttcggtagcggtaaattaattttgttacgttcgttgtacgttaattatttgttcgacgaaggttaaatttagattaaatacggtgacgagtgggtagatttggttatcgcgttagcgcgtaaagtggtggaaattcgtaaaattatcgtcggttgggtgagttagtttttgcgcgttatttcgcgtattttagtattggaagtggtgatgtagtcgttgttcgatatcggcgtttcgcgtgaagtttgcgtcgttaagtcgcgcgtttttttattcgtttgaacgtgtcggaacgtttgtggtatttggtattatcgatatttttcggtggcgaatagtagcgcgttatatcgttcgcggttttatcgtcgattattttattttgttgtttgacgaattt

SEQ ID NO: 15376 - DNA, 1391 bp, Artificial Sequence
  chemically treated genomic DNA (Homo sapiens) CpG-island No: 15376
aaattcgtcaaacaacaaaataaaataatcgacgataaaaccgcgaacgatataacgcgctactattcgccaccgaaaaatatcgataataccaaataccacaaacgttccgacacgttcaaacgaataaaaaaacgcgcgacttaacgacgcaaacttcacgcgaaacgccgatatcgaacaacgactacatcaccacttccaatactaaaatacgcgaaataacgcgcaaaaactaactcacccaaccgacgataattttacgaatttccaccactttacgcgctaacgcgataaccaaatctacccactcgtcaccgtatttaatctaaatttaaccttcgtcgaacaaataattaacgtacaacgaacgtaacaaaattaatttaccgctaccgaaataaccgtaaaacaccacgcattcgcccgcgttaacgataaacgaaacgcgattaaaaacgaacaaacgcacgccgttttactaatacaaaataaaaattttactaacgttttatacgttaatcatttttcgcctcgtaattcgaatatcgaatacgacgctaacgcgtcttatccgacctacgaaaaacgcatttataaaccgaataaaacgtttacgccgcatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaaattcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatatcgccgtaataacgtaccccgatcgccatcaaccgctcgccgatattaccgcctaccgacacctaacgacgcaaaccgtcgaataaatactaatacaccacgccccattcgatacgcaacaaacgacgacgatcgacctcgctcattacatacaacgaacgattctcgtaataaatttccccctactacgacgtcaaacgcgcgaaaatcgacttcaacaacgtaatcttcccgaaaccgaattccccgacaatacccaacacttcccccgaccataaatcaaaaaaaacatcgctaaaacctttacccgacgcgtaaaaataaatcaaattattaaccgaaaataacgattaat

SEQ ID NO: 15377 - DNA, 705 bp, Artificial Sequence
  chemically treated genomic DNA (Homo sapiens) CpG-island No: 15377
  misc_feature (472)..(472): n is either a, c, g or t
gaggttataagaatattttaaattatggtgttaagacgttttgattttaggaagcgattaattaggtacgtcggtatgtcgttcgttagcgtattggtaggtaattatttggtaacggagttgttagagcgtaaggaatagtcggttcggttgcgattgtggtatcgattataatggtattattggtagttttttttttttgtcgggtaaatagtttgggcgtaatgaacgtcgtaagattcgtcgcgacgggcggtattagcgcgataacgtcgacgatggcgtattagttataaatgtgtttttttagtagtgagaagtagaagaattaggcggttttattgatggggtcgtttatatcgaacgttagtatcgtatcgattagaaacgttgtcgtaaattttattgatggaggaatggtatttaggaagtggagtagttcgtttatgaggtcggatattatcggttcgantacgtagtaagtgagtacgtcgaaaattagtagagtaacgaacgggattagtattgaatcgagtagcggttgtaatgttttgttaaggcgtattttgcggaattagaagacgaaatagttaatcgttagttttagtattatcgcgtcgaggaatttcgtattcgattgggtgtcgagtagcgttttgtcgttcgttagatagtaaattagaaacgtcggagcgaaagtcggtt

SEQ ID NO: 15378 - DNA, 705 bp, Artificial Sequence
  chemically treated genomic DNA (Homo sapiens) CpG-island No: 15378
  misc_feature (234)..(234): n is either a, c, g or t
aaccgactttcgctccgacgtttctaatttactatctaacgaacgacaaaacgctactcgacacccaatcgaatacgaaattcctcgacgcgataatactaaaactaacgattaactatttcgtcttctaattccgcaaaatacgccttaacaaaacattacaaccgctactcgattcaatactaatcccgttcgttactctactaattttcgacgtactcacttactacgtantcgaaccgataatatccgacctcataaacgaactactccacttcctaaataccattcctccatcaataaaatttacgacaacgtttctaatcgatacgatactaacgttcgatataaacgaccccatcaataaaaccgcctaattcttctacttctcactactaaaaaaacacatttataactaatacgccatcgtcgacgttatcgcgctaataccgcccgtcgcgacgaatcttacgacgttcattacgcccaaactatttacccgacaaaaaaaaaaaactaccaataataccattataatcgataccacaatcgcaaccgaaccgactattccttacgctctaacaactccgttaccaaataattacctaccaatacgctaacgaacgacataccgacgtacctaattaatcgcttcctaaaatcaaaacgtcttaacaccataatttaaaatattcttataacctc

SEQ ID NO: 15379 - DNA, 705 bp, Artificial Sequence
  chemically treated genomic DNA (Homo sapiens) CpG-island No: 15379
  misc_feature (234)..(234): n is either a, c, g or t
aatcggttttcgtttcggcgtttttggtttgttatttggcgaacgataaagcgttgttcggtatttagtcgggtgcgggatttttcggcgcggtggtgttggggttggcgattggttatttcgttttttggtttcgtaaagtgcgttttggtaaagtattataatcgttgttcggtttaatgttgatttcgttcgttattttgttggttttcggcgtgtttatttattacgtantcgggtcggtgatgttcgattttatgggcgggttgttttattttttgaatattatttttttattaatgaagtttgcggtagcgtttttggtcggtgcgatgttggcgttcgatatgggcggttttattaataaaatcgtttggtttttttgttttttattgttggaaaaatatatttatgattggtacgttatcgtcggcgttgtcgcgttgatgtcgttcgtcgcggcgggttttgcgacgtttattgcgtttaaattgtttattcgataggaaaaagaggttgttagtagtgttattgtggtcggtgttatagtcgtaatcgaatcggttattttttacgttttggtagtttcgttgttagatgattatttgttaatacgttggcgggcggtatatcggcgtgtttggttgatcgttttttggaattaaagcgttttggtattatggtttagggtatttttgtgatttt

SEQ ID NO: 15380 - DNA, 705 bp, Artificial Sequence
  chemically treated genomic DNA (Homo sapiens) CpG-island No: 15380
  misc_feature (472)..(472): n is either a, c, g or t
aaaatcacaaaaataccctaaaccataataccaaaacgctttaattccaaaaaacgatcaaccaaacacgccgatataccgcccgccaacgtattaacaaataatcatctaacaacgaaactaccaaaacgtaaaaaataaccgattcgattacgactataacaccgaccacaataacactactaacaacctctttttcctatcgaataaacaatttaaacgcaataaacgtcgcaaaacccgccgcgacgaacgacatcaacgcgacaacgccgacgataacgtaccaatcataaatatatttttccaacaataaaaaacaaaaaaaccaaacgattttattaataaaaccgcccatatcgaacgccaacatcgcaccgaccaaaaacgctaccgcaaacttcattaataaaaaaataatattcaaaaaataaaacaacccgcccataaaatcgaacatcaccgacccgantacgtaataaataaacacgccgaaaaccaacaaaataacgaacgaaatcaacattaaaccgaacaacgattataatactttaccaaaacgcactttacgaaaccaaaaaacgaaataaccaatcgccaaccccaacaccaccgcgccgaaaaatcccgcacccgactaaataccgaacaacgctttatcgttcgccaaataacaaaccaaaaacgccgaaacgaaaaccgatt

SEQ ID NO: 15381 - DNA, 607 bp, Artificial Sequence
  chemically treated genomic DNA (Homo sapiens) CpG-island No: 15381
ttgatatattttttgttaggtttgttttatcggattatcgtagttttgaatatgatgcggacgtaggtttttatttttttggttgttgatgtattatattgtttgtcgcggcggttattgtttttcgtcgaggtttatggttttgattagacgtttaagtaggcgtagttggtttttattgtcgaggatttggaaattttgcggtagattggcgtttatatggtgcgtacgtagtaaacggtgcgttagttcgtggaaggtgtcgatttatatatcgttttggttcgtgtttattagttgttcgatacgatgacgtattttcgtcgtcgttttgttggtaaacgttatcgttataatcgagtatggcgagtagttttttacgtttattaattaggcgatacgatgtattagtacgcgcgttttattattgttcgcgttcgttagtattagaaggttgttgcgtggcgcggttatcgtttcgcgttgtttgttattaaggttgtcgagtaggtagaaacgtttattggtatcgtcgcgtaaaaataggttgggcggagaagcgtaacgtttttcgttaaaaagttgggtatatatatagatttgttga

SEQ ID NO: 15382 - DNA, 607 bp, Artificial Sequence
  chemically treated genomic DNA (Homo sapiens) CpG-island No: 15382
tcaacaaatctatatatatacccaactttttaacgaaaaacgttacgcttctccgcccaacctatttttacgcgacgataccaataaacgtttctacctactcgacaaccttaataacaaacaacgcgaaacgataaccgcgccacgcaacaaccttctaatactaacgaacgcgaacaataataaaacgcgcgtactaatacatcgtatcgcctaattaataaacgtaaaaaactactcgccatactcgattataacgataacgtttaccaacaaaacgacgacgaaaatacgtcatcgtatcgaacaactaataaacacgaaccaaaacgatatataaatcgacaccttccacgaactaacgcaccgtttactacgtacgcaccatataaacgccaatctaccgcaaaatttccaaatcctcgacaataaaaaccaactacgcctacttaaacgtctaatcaaaaccataaacctcgacgaaaaacaataaccgccgcgacaaacaatataatacatcaacaaccaaaaaaataaaaacctacgtccgcatcatattcaaaactacgataatccgataaaacaaacctaacaaaaaatatatcaa

SEQ ID NO: 15383 - DNA, 607 bp, Artificial Sequence
  chemically treated genomic DNA (Homo sapiens) CpG-island No: 15383
ttagtaaatttgtatatatatttagttttttggcggagggcgttgcgttttttcgtttaatttatttttacgcggcggtgttaatggacgtttttatttgttcgatagttttaatgataaatagcgcgaagcggtggtcgcgttacgtagtaattttttggtgttggcgggcgcgggtagtggtaagacgcgcgtattggtgtatcgtatcgtttggttgatgagcgtggaaaattgttcgttatattcgattatggcggtgacgtttattaataaagcggcggcggagatgcgttatcgtatcgggtaattgatgggtacgagttagggcggtatgtgggtcggtattttttacgggttggcgtatcgtttgttgcgtgcgtattatatggacgttaatttgtcgtaggatttttagattttcgatagtgaagattagttacgtttgtttaagcgtttgattaaagttatgaatttcgacgagaagtagtggtcgtcgcggtaggtaatgtggtatattaatagttagaaagatgaaggtttgcgttcgtattatatttaaagttacggtaattcggtggagtagatttggtagaaggtgtattag

SEQ ID NO: 15384 - DNA, 607 bp, Artificial Sequence
  chemically treated genomic DNA (Homo sapiens) CpG-island No: 15384
ctaatacaccttctaccaaatctactccaccgaattaccgtaactttaaatataatacgaacgcaaaccttcatctttctaactattaatataccacattacctaccgcgacgaccactacttctcgtcgaaattcataactttaatcaaacgcttaaacaaacgtaactaatcttcactatcgaaaatctaaaaatcctacgacaaattaacgtccatataatacgcacgcaacaaacgatacgccaacccgtaaaaaataccgacccacataccgccctaactcgtacccatcaattacccgatacgataacgcatctccgccgccgctttattaataaacgtcaccgccataatcgaatataacgaacaattttccacgctcatcaaccaaacgatacgatacaccaatacgcgcgtcttaccactacccgcgcccgccaacaccaaaaaattactacgtaacgcgaccaccgcttcgcgctatttatcattaaaactatcgaacaaataaaaacgtccattaacaccgccgcgtaaaaataaattaaacgaaaaaacgcaacgccctccgccaaaaaactaaatatatatacaaatttactaa

SEQ ID NO: 15385 - DNA, 559 bp, Artificial Sequence
  chemically treated genomic DNA (Homo sapiens) CpG-island No: 15385
ttcggtttgatttaataagtttgtatttcgttgcgaattgttttatttacgttagtggtgagatcgtttttaatatgtaagatttcgtcgatcggtacgttgagttttttcgtagttaaaaagtatatatcgttgaacggttttgagcgttcgtgcgggttagcgcgtagtataaatttaaaataattttttaaattaaatagtttcggttgggcgttatcgttggtgatcgttattagcggttattttttcgttagttgttttaaggtgtcgtgagtttgttgcgggacgtcgattcggttgcgttatttggtaaagttgattattgttgcgtgtgcgtttgtattggttttttcggtatttagttcggcgtcgagtatcgtttgtttaatcgaacgaaaacgttagcgcgttacgtcgtgataaatttcgggtttcgtttttcgtatcgtttggcgtaagcgttgtagatttttattttggaagttgcgtagcgtcgatgattatttttgtttaagggtaagcgttttttcgttcggggcgtaaaattatcggacgg

SEQ ID NO: 15386 - DNA, 559 bp, Artificial Sequence
  chemically treated genomic DNA (Homo sapiens) CpG-island No: 15386
ccgtccgataattttacgccccgaacgaaaaaacgcttacccttaaacaaaaataatcatcgacgctacgcaacttccaaaataaaaatctacaacgcttacgccaaacgatacgaaaaacgaaacccgaaatttatcacgacgtaacgcgctaacgttttcgttcgattaaacaaacgatactcgacgccgaactaaataccgaaaaaaccaatacaaacgcacacgcaacaataatcaactttaccaaataacgcaaccgaatcgacgtcccgcaacaaactcacgacaccttaaaacaactaacgaaaaaataaccgctaataacgatcaccaacgataacgcccaaccgaaactatttaatttaaaaaattattttaaatttatactacgcgctaacccgcacgaacgctcaaaaccgttcaacgatatatactttttaactacgaaaaaactcaacgtaccgatcgacgaaatcttacatattaaaaacgatctcaccactaacgtaaataaaacaattcgcaacgaaatacaaacttattaaatcaaaccgaa

SEQ ID NO: 15387 - DNA, 559 bp, Artificial Sequence
  chemically treated genomic DNA (Homo sapiens) CpG-island No: 15387
tcgttcggtgattttgcgtttcgaacgaaaaggcgtttatttttgggtaaaaataattatcggcgttgcgtagtttttagaatgaagatttgtaacgtttgcgttaggcggtacgggaagcggaattcgagatttattacgacgtgacgcgttggcgttttcgttcgattgaataagcgatgttcgacgtcgggttgagtgtcgaagaagttagtgtaggcgtatacgtagtaatgattaattttgttaaatggcgtagtcgaatcgacgtttcgtagtaaatttacgatattttaaaatagttggcgaagaaatggtcgttggtggcgattattaacggtaacgtttagtcggagttgtttggtttgggggattattttgagtttgtgttgcgcgttggttcgtacgggcgtttaaaatcgtttagcgatatgtattttttggttgcggaaaaatttaacgtgtcgatcggcgagattttatatgttggggacgattttattattgacgtgggtggggtaattcgtagcggaatgtaggtttgttggattagatcgga

SEQ ID NO: 15388 - DNA, 559 bp, Artificial Sequence
  chemically treated genomic DNA (Homo sapiens) CpG-island No: 15388
tccgatctaatccaacaaacctacattccgctacgaattaccccacccacgtcaataataaaatcgtccccaacatataaaatctcgccgatcgacacgttaaatttttccgcaaccaaaaaatacatatcgctaaacgattttaaacgcccgtacgaaccaacgcgcaacacaaactcaaaataatcccccaaaccaaacaactccgactaaacgttaccgttaataatcgccaccaacgaccatttcttcgccaactattttaaaatatcgtaaatttactacgaaacgtcgattcgactacgccatttaacaaaattaatcattactacgtatacgcctacactaacttcttcgacactcaacccgacgtcgaacatcgcttattcaatcgaacgaaaacgccaacgcgtcacgtcgtaataaatctcgaattccgcttcccgtaccgcctaacgcaaacgttacaaatcttcattctaaaaactacgcaacgccgataattatttttacccaaaaataaacgccttttcgttcgaaacgcaaaatcaccgaacga

SEQ ID NO: 15389 - DNA, 1052 bp, Artificial Sequence
  chemically treated genomic DNA (Homo sapiens) CpG-island No: 15389
ggagtaatcggtatcgtaaattcgatattcgttttttttagtagtaggtggatagttagtacgtcggacggcgttttcgttatcgagattacgtaggcggtaatggagttttgcggtgtttcggtaattatttggtaggtatcgagtatttcgcgcgtttcggcgtttggttgttagttgcgcggtagaagcggacgtttggagtttagttcgcggattaggaacgtttgtttgtcggtttttgattagttttcgtagtcgtcgatatcgaggtagcgggttagttcgtttagcgtttcggtatgacgcgtgtttttttgacggatattaatacggattagcggtacgtcgaaatattttacgcggcgtaggtgtcgagtagatcgtcgttggcgataatatttatgttatacgtttgaagtgattggtagtaagcgtagagcggtttttatagtttttcgttttgtgttagtaggttttttggttttggtagtttttcgttttttaggcgcgtttttagttatgtttgtgtcgttattaggcgagaacgtaggttttttattagatagcgatacggttttgcggtatttttttcgttaattagcgttagtagtttaggggtcgttttaattatcgatagtttagaaattagtatttgaatattttttaggaataaatcggtggttttttagcggttgagtagtaggacgtggcgggtgatatcggtagtgacgttcgggttgtcgtcgcggtcgtcgtttatttacgaagtaaaacggatcggaataaattcgacgggtagtttgtagtcgaggtttttttttagttgttcgtttagttcgcgtaggtatttggtacgttttgttataggttgttttttattacggtaaagttttatttggttttatttatcgggtttggacgtagtttacggattttatcggtatgttatgattgggcgattaattggcgtaggcgacgtattagttggttgtgttcgtagttagcgatatttttgttatcgagttgttttaaataggcgtttattttta

SEQ ID NO: 15390 - DNA, 1052 bp, Artificial Sequence
  chemically treated genomic DNA (Homo sapiens) CpG-island No: 15390
taaaaataaacgcctatttaaaacaactcgataacaaaaatatcgctaactacgaacacaaccaactaatacgtcgcctacgccaattaatcgcccaatcataacataccgataaaatccgtaaactacgtccaaacccgataaataaaaccaaataaaactttaccgtaataaaaaacaacctataacaaaacgtaccaaatacctacgcgaactaaacgaacaactaaaaaaaaacctcgactacaaactacccgtcgaatttattccgatccgttttacttcgtaaataaacgacgaccgcgacgacaacccgaacgtcactaccgatatcacccgccacgtcctactactcaaccgctaaaaaaccaccgatttattcctaaaaaatattcaaatactaatttctaaactatcgataattaaaacgacccctaaactactaacgctaattaacgaaaaaaataccgcaaaaccgtatcgctatctaataaaaaacctacgttctcgcctaataacgacacaaacataactaaaaacgcgcctaaaaaacgaaaaactaccaaaaccaaaaaacctactaacacaaaacgaaaaactataaaaaccgctctacgcttactaccaatcacttcaaacgtataacataaatattatcgccaacgacgatctactcgacacctacgccgcgtaaaatatttcgacgtaccgctaatccgtattaatatccgtcaaaaaaacacgcgtcataccgaaacgctaaacgaactaacccgctacctcgatatcgacgactacgaaaactaatcaaaaaccgacaaacaaacgttcctaatccgcgaactaaactccaaacgtccgcttctaccgcgcaactaacaaccaaacgccgaaacgcgcgaaatactcgatacctaccaaataattaccgaaacaccgcaaaactccattaccgcctacgtaatctcgataacgaaaacgccgtccgacgtactaactatccacctactactaaaaaaaacgaatatcgaatttacgataccgattactcc

SEQ ID NO: 15391 - DNA, 1052 bp, Artificial Sequence
  chemically treated genomic DNA (Homo sapiens) CpG-island No: 15391
tggaagtgaacgtttgtttaaaatagttcgataataaagatatcgttgattacgaatataattagttgatgcgtcgtttgcgttagttgatcgtttagttatggtatatcgatgaaattcgtaagttgcgtttaagttcggtagatgaagttaaatggggttttgtcgtagtggaaaatagtttgtggtaaggcgtattaaatatttgcgcgaattgaacgaataattggaagagaatttcggttataaattgttcgtcgaatttgtttcggttcgttttatttcgtggatgggcggcgatcgcgacggtaattcgaacgttattgtcgatattattcgttacgttttgttatttagtcgttggaaagttatcgatttgtttttgaaagatatttaggtgttggtttttgaattgtcgatggttgaagcgatttttgaattgttggcgttggttggcgaagaaggtgtcgtagaatcgtatcgttatttgatgaaaaatttgcgttttcgtttgatggcgatataggtatggttggaagcgcgtttgaaaggcgaagaattgttaaaattagaaggtttgttgatataaaacgaagaattgtgggaatcgttttacgtttgttattagttattttaggcgtgtggtatgggtattatcgttaacggcgatttgttcgatatttgcgtcgcgtgaaatgtttcggcgtatcgttggttcgtattgatattcgttaggagagtacgcgttatatcgaagcgttgggcgagttgattcgttatttcggtatcggcgattacgaaagttggttagaggtcgataaataggcgtttttgattcgcgaattgaattttaaacgttcgtttttgtcgcgtaattggtaattaagcgtcgaaacgcgcgaagtgttcgatatttgttaggtgattgtcgaagtatcgtaaggttttattgtcgtttacgtgatttcgatggcgaaaacgtcgttcgacgtattggttgtttatttgttgttgaaagaagcgggtatcgggtttgcgatgtcggttgtttt

SEQ ID NO: 15392 - DNA, 1052 bp, Artificial Sequence
  chemically treated genomic DNA (Homo sapiens) CpG-island No: 15392
aaaacaaccgacatcgcaaacccgatacccgcttctttcaacaacaaataaacaaccaatacgtcgaacgacgttttcgccatcgaaatcacgtaaacgacaataaaaccttacgatacttcgacaatcacctaacaaatatcgaacacttcgcgcgtttcgacgcttaattaccaattacgcgacaaaaacgaacgtttaaaattcaattcgcgaatcaaaaacgcctatttatcgacctctaaccaactttcgtaatcgccgataccgaaataacgaatcaactcgcccaacgcttcgatataacgcgtactctcctaacgaatatcaatacgaaccaacgatacgccgaaacatttcacgcgacgcaaatatcgaacaaatcgccgttaacgataatacccataccacacgcctaaaataactaataacaaacgtaaaacgattcccacaattcttcgttttatatcaacaaaccttctaattttaacaattcttcgcctttcaaacgcgcttccaaccatacctatatcgccatcaaacgaaaacgcaaatttttcatcaaataacgatacgattctacgacaccttcttcgccaaccaacgccaacaattcaaaaatcgcttcaaccatcgacaattcaaaaaccaacacctaaatatctttcaaaaacaaatcgataactttccaacgactaaataacaaaacgtaacgaataatatcgacaataacgttcgaattaccgtcgcgatcgccgcccatccacgaaataaaacgaaccgaaacaaattcgacgaacaatttataaccgaaattctcttccaattattcgttcaattcgcgcaaatatttaatacgccttaccacaaactattttccactacgacaaaaccccatttaacttcatctaccgaacttaaacgcaacttacgaatttcatcgatataccataactaaacgatcaactaacgcaaacgacgcatcaactaattatattcgtaatcaacgatatctttattatcgaactattttaaacaaacgttcacttcca

SEQ ID NO: 15393 - DNA, 718 bp, Artificial Sequence
  chemically treated genomic DNA (Homo sapiens) CpG-island No: 15393
ttcggttcgataatttttagcgggttatggcggaatttttcgtttttaattacgtagtcgtgcgtttaggtaaattttattagcgttataatgttttttttgtaatttagcggacgtagcggattcgtagtaacggtataaattatcggttattggttggttagtttattaagttggcggtttttttttttttaggtgcgtattagatgatcgagcgtattcggtaattgtttgagatcgtttttgattttgtcgattttcgcgttcggcgcgaggcgggtgattatttttagtattacgttgtagtagagtagtaggtgaattttttagatatagtcggtcgtgataattaatgttaaatttcgtcgtcgaggtaatcgggttattcgcgcgtttggtgaacgtcgtagtgagtgcgtcgtaggttcggtttagttttagcgttttgattattttttcggttttatcgtagttagaaacgttaattattgcgtaacgatcgtcgaggcgatacggggtgttatcgtagaatttttagtcggaaatggcgtagatttgaagatcggaaaagcgattcgttagatgtttcgtcgtttgcgtcgcgttgagtggcgattcgtaggtaacgaaataaatacgattaagtgtcgcgttttattattttttttacgatggcgtgtattagcggaacgttatggttgagaattttttttatttt

SEQ ID NO: 15394 - DNA, 718 bp, Artificial Sequence
  chemically treated genomic DNA (Homo sapiens) CpG-island No: 15394
aaaataaaaaaaattctcaaccataacgttccgctaatacacgccatcgtaaaaaaaataataaaacgcgacacttaatcgtatttatttcgttacctacgaatcgccactcaacgcgacgcaaacgacgaaacatctaacgaatcgcttttccgatcttcaaatctacgccatttccgactaaaaattctacgataacaccccgtatcgcctcgacgatcgttacgcaataattaacgtttctaactacgataaaaccgaaaaaataatcaaaacgctaaaactaaaccgaacctacgacgcactcactacgacgttcaccaaacgcgcgaataacccgattacctcgacgacgaaatttaacattaattatcacgaccgactatatctaaaaaattcacctactactctactacaacgtaatactaaaaataatcacccgcctcgcgccgaacgcgaaaatcgacaaaatcaaaaacgatctcaaacaattaccgaatacgctcgatcatctaatacgcacctaaaaaaaaaaaaaccgccaacttaataaactaaccaaccaataaccgataatttataccgttactacgaatccgctacgtccgctaaattacaaaaaaaacattataacgctaataaaatttacctaaacgcacgactacgtaattaaaaacgaaaaattccgccataacccgctaaaaattatcgaaccgaa

SEQ ID NO: 15395 - DNA, 718 bp, Artificial Sequence
  chemically treated genomic DNA (Homo sapiens) CpG-island No: 15395
gaagtggaaaaagtttttagttatgacgtttcgttggtgtacgttatcgtggaagagatggtgaagcgcgatatttgatcgtatttatttcgttgtttgcggatcgttatttaacgcggcgtaaacggcgaaatatttggcggatcgttttttcgatttttaggtttacgttattttcggttgggagttttgcgataatatttcgtatcgtttcgacgatcgttgcgtagtaattggcgtttttgattacggtaaaatcgaagaggtaattaaagcgttggagttgggtcgggtttgcggcgtatttattgcggcgtttattaaacgcgcggatagttcgattatttcggcggcggaatttagtattgattattacggtcgattgtatttgggaaatttatttgttgttttgttatagcgtggtgttggagatgattattcgtttcgcgtcgaacgcggaaatcggtaagattaaaaacgattttaagtagttgtcgaatgcgttcggttatttggtacgtatttgggaagaaaaaggtcgttagtttggtgaattggttagttagtggtcgatgatttatatcgttgttgcgggttcgttgcgttcgttgggttataaagaaggtattgtaacgttgatggaatttatttggacgtacggttgcgtgattgagagcggagagtttcgttatggttcgttggagattgtcgaatcggg

SEQ ID NO: 15396 - DNA, 718 bp, Artificial Sequence
  chemically treated genomic DNA (Homo sapiens) CpG-island No: 15396
cccgattcgacaatctccaacgaaccataacgaaactctccgctctcaatcacgcaaccgtacgtccaaataaattccatcaacgttacaataccttctttataacccaacgaacgcaacgaacccgcaacaacgatataaatcatcgaccactaactaaccaattcaccaaactaacgacctttttcttcccaaatacgtaccaaataaccgaacgcattcgacaactacttaaaatcgtttttaatcttaccgatttccgcgttcgacgcgaaacgaataatcatctccaacaccacgctataacaaaacaacaaataaatttcccaaatacaatcgaccgtaataatcaatactaaattccgccgccgaaataatcgaactatccgcgcgtttaataaacgccgcaataaatacgccgcaaacccgacccaactccaacgctttaattacctcttcgattttaccgtaatcaaaaacgccaattactacgcaacgatcgtcgaaacgatacgaaatattatcgcaaaactcccaaccgaaaataacgtaaacctaaaaatcgaaaaaacgatccgccaaatatttcgccgtttacgccgcgttaaataacgatccgcaaacaacgaaataaatacgatcaaatatcgcgcttcaccatctcttccacgataacgtacaccaacgaaacgtcataactaaaaactttttccacttc

SEQ ID NO: 15397 - DNA, 1045 bp, Artificial Sequence
  chemically treated genomic DNA (Homo sapiens) CpG-island No: 15397
  misc_feature (46)..(46): n is either a, c, g or t
  misc_feature (155)..(155): n is either a, c, g or t
  misc_feature (323)..(323): n is either a, c, g or t
acgggtttattacgtagcgtttatttatttttatcggataggcgtnagtgtggcgatatgatcgaagcgggcgatatttttatatagttttatttgtattacgtcgtatttttttagcgcgtgtatgtgcgggttttcgtttcgcgcggttcgantaagcgtagcggttcggggattggtatttggaagataattatttgattttcggttagcggcgtttcggggatgcggtgacgcgtttggatatcgtcgtatcgttcgtacgtttcgtggtgtttatttcggttacgcgtttgaagaagttgcgaatcgatacggcgttngtggtgttattcgcgttttggttaattatttttagtacgtcgttttcgttaattacgttgcggtagttgaatgtcgtcgttttttagtcgtacggtatcggtatttcgcgttcgttaaacggtatttgataatcggggatcgttatcgtttttaagatggcgcggcggattatgcgtttggtttgttcgtcgaggtaggtaaagttgtagtcgtttagattagttatggttttgtttttgttgtagacgtttgagtagttttagttcggtttggaaatcgacgtagtgggggagtttgaggtgtgagattaaagtttgcggtttcgacgttgtcggtatgtgttagtacgaattttttattttgcgtcgggtttgtcgcgtgttcgtcgtatttcggggtttgtagagcgcggtcgattagcgttatcgttatcgttttgcgttcgtttatgtcgaatattagttcgtagtcgcgcgtgaagtgcggcggtttattcggcgggtcgataaaatcgttaattattttatatttagttattagtagttcgtcgacgtttatcgtaaattttagttttttcggtataatcgatacgtcgatatagtcgttgcggatttcgtttgcgaacgggtgattgcgttcgtaatcgcgttgggtggagtaggttagcgttagtaaatagttttcgtcgtcgcgtattaattgttgtaaacgggaggagcgt

SEQ ID NO: 15398 - DNA, 1045 bp, Artificial Sequence
  chemically treated genomic DNA (Homo sapiens) CpG-island No: 15398
  misc_feature (723)..(723): n is either a, c, g or t
  misc_feature (891)..(891): n is either a, c, g or t
  misc_feature (1000)..(1000): n is either a, c, g or t
acgctcctcccgtttacaacaattaatacgcgacgacgaaaactatttactaacgctaacctactccacccaacgcgattacgaacgcaatcacccgttcgcaaacgaaatccgcaacgactatatcgacgtatcgattataccgaaaaaactaaaatttacgataaacgtcgacgaactactaataactaaatataaaataattaacgattttatcgacccgccgaataaaccgccgcacttcacgcgcgactacgaactaatattcgacataaacgaacgcaaaacgataacgataacgctaatcgaccgcgctctacaaaccccgaaatacgacgaacacgcgacaaacccgacgcaaaataaaaaattcgtactaacacataccgacaacgtcgaaaccgcaaactttaatctcacacctcaaactcccccactacgtcgatttccaaaccgaactaaaactactcaaacgtctacaacaaaaacaaaaccataactaatctaaacgactacaactttacctacctcgacgaacaaaccaaacgcataatccgccgcgccatcttaaaaacgataacgatccccgattatcaaataccgtttaacgaacgcgaaataccgataccgtacgactaaaaaacgacgacattcaactaccgcaacgtaattaacgaaaacgacgtactaaaaataattaaccaaaacgcgaataacaccacnaacgccgtatcgattcgcaacttcttcaaacgcgtaaccgaaataaacaccacgaaacgtacgaacgatacgacgatatccaaacgcgtcaccgcatccccgaaacgccgctaaccgaaaatcaaataattatcttccaaataccaatccccgaaccgctacgcttantcgaaccgcgcgaaacgaaaacccgcacatacacgcgctaaaaaaatacgacgtaatacaaataaaactatataaaaatatcgcccgcttcgatcatatcgccacactnacgcctatccgataaaaataaataaacgctacgtaataaacccgt

SEQ ID NO: 15399 - DNA, 1045 bp, Artificial Sequence
  chemically treated genomic DNA (Homo sapiens) CpG-island No: 15399
  misc_feature (723)..(723): n is either a, c, g or t
  misc_feature (891)..(891): n is either a, c, g or t
  misc_feature (1000)..(1000): n is either a, c, g or t
acgtttttttcgtttgtagtagttgatgcgcggcgacgaaggttatttgttggcgttggtttattttatttaacgcggttacgggcgtaattattcgttcgtaggcgagattcgtagcggttatatcgacgtgtcgattgtgtcggaagagttgggatttgcggtgaacgtcggcgaattgttgatgattgagtgtgaaatggttaacggttttatcgattcgtcgggtgagtcgtcgtattttacgcgcggttacgggttggtgttcggtatgagcgagcgtaaagcgatggcgatggcgttggtcgatcgcgttttgtaagtttcggagtacggcgagtacgcgataggttcggcgtaggatgaagagttcgtgttggtatatgtcgataacgtcgaagtcgtaggttttggttttatattttaaatttttttattacgtcgatttttaggtcgaattggagttatttaaacgtttgtaataggagtagaattatggttaatttgagcggttataattttgtttatttcgacgagtagattaaacgtatgattcgtcgcgttattttaaaagcggtggcgattttcggttattaggtgtcgtttggcgggcgcgagatgtcgatgtcgtacggttggggaacggcggtatttagttatcgtagcgtgattggcgaaagcgacgtgttgaaggtgattgattagggcgcggatgatattatnaacgtcgtgtcgattcgtaatttttttaagcgcgtgatcggggtaaatattacggaacgtacggacgatgcgacggtatttagacgcgttatcgtattttcgaaacgtcgttgatcgaagattagataattattttttaggtgttaattttcgagtcgttgcgtttantcgagtcgcgcgaaacggaaattcgtatatgtacgcgttggaagagtacggcgtgatgtaggtgaaattgtatgaagatatcgttcgtttcggttatatcgttatattnacgtttattcggtgaaggtaaatgggcgttacgtgatggattcgt

SEQ ID NO: 15400 - DNA, 1045 bp, Artificial Sequence
  chemically treated genomic DNA (Homo sapiens) CpG-island No: 15400
  misc_feature (46)..(46): n is either a, c, g or t
  misc_feature (155)..(155): n is either a, c, g or t
  misc_feature (323)..(323): n is either a, c, g or t
acgaatccatcacgtaacgcccatttaccttcaccgaataaacgtnaatataacgatataaccgaaacgaacgatatcttcatacaatttcacctacatcacgccgtactcttccaacgcgtacatatacgaatttccgtttcgcgcgactcgantaaacgcaacgactcgaaaattaacacctaaaaaataattatctaatcttcgatcaacgacgtttcgaaaatacgataacgcgtctaaataccgtcgcatcgtccgtacgttccgtaatatttaccccgatcacgcgcttaaaaaaattacgaatcgacacgacgttnataatatcatccgcgccctaatcaatcaccttcaacacgtcgctttcgccaatcacgctacgataactaaataccgccgttccccaaccgtacgacatcgacatctcgcgcccgccaaacgacacctaataaccgaaaatcgccaccgcttttaaaataacgcgacgaatcatacgtttaatctactcgtcgaaataaacaaaattataaccgctcaaattaaccataattctactcctattacaaacgtttaaataactccaattcgacctaaaaatcgacgtaataaaaaaatttaaaatataaaaccaaaacctacgacttcgacgttatcgacatataccaacacgaactcttcatcctacgccgaacctatcgcgtactcgccgtactccgaaacttacaaaacgcgatcgaccaacgccatcgccatcgctttacgctcgctcataccgaacaccaacccgtaaccgcgcgtaaaatacgacgactcacccgacgaatcgataaaaccgttaaccatttcacactcaatcatcaacaattcgccgacgttcaccgcaaatcccaactcttccgacacaatcgacacgtcgatataaccgctacgaatctcgcctacgaacgaataattacgcccgtaaccgcgttaaataaaataaaccaacgccaacaaataaccttcgtcgccgcgcatcaactactacaaacgaaaaaaacgt

SEQ ID NO: 15401 - DNA, 568 bp, Artificial Sequence
  chemically treated genomic DNA (Homo sapiens) CpG-island No: 15401
ggtttttcgaacgcgcggtaaagtagcgggcggagtagttagcggtagatgatcgtagtttaggatttttattttaaattggttacgaatgtttagtttatcgtattgattaagtagatttattagttagtcgcgggaaagttttattggtatatattagcgtattatgttttgtttgagtaatatttttagtgttatcgcgttgtagtagtttagcgcgtgttcggcgacgaacggtagtttgcgtttagcgtatatatttattacgtcgagatcgttggttttaattagaaatttatcgtttttaatatagcgttttagttcgtttagtttagatgatgtttgtattagcgttagcgtggagagtataatttgtttattattttcggcgagcgattttgttatttttagttagtcgttaattttggttgttcgacgtttgttgtatatcgttttattaagataaattacgtcggcgttgttggtggcggtttgttgataaaatttttttagcgttttttttggttagtattatagtattggttttaaggaatattttattgttttt

SEQ ID NO: 15402 - DNA, 568 bp, Artificial Sequence
  chemically treated genomic DNA (Homo sapiens) CpG-island No: 15402
aaaaacaataaaatattccttaaaaccaatactataatactaaccaaaaaaaacgctaaaaaaattttatcaacaaaccgccaccaacaacgccgacgtaatttatcttaataaaacgatatacaacaaacgtcgaacaaccaaaattaacgactaactaaaaataacaaaatcgctcgccgaaaataataaacaaattatactctccacgctaacgctaatacaaacatcatctaaactaaacgaactaaaacgctatattaaaaacgataaatttctaattaaaaccaacgatctcgacgtaataaatatatacgctaaacgcaaactaccgttcgtcgccgaacacgcgctaaactactacaacgcgataacactaaaaatattactcaaacaaaacataatacgctaatatataccaataaaactttcccgcgactaactaataaatctacttaatcaatacgataaactaaacattcgtaaccaatttaaaataaaaatcctaaactacgatcatctaccgctaactactccgcccgctactttaccgcgcgttcgaaaaacc

SEQ ID NO: 15403 - DNA, 568 bp, Artificial Sequence
  chemically treated genomic DNA (Homo sapiens) CpG-island No: 15403
aaaagtaatgaaatattttttagggttagtgttgtggtattggttaaaagagacgttggaagaattttattagtaggtcgttattagtagcgtcgacgtgatttattttggtgaagcggtatgtagtaagcgtcgggtaattaaagttggcgattggttggagatggtaaaatcgttcgtcgggagtggtaagtagattgtgttttttacgttggcgttggtgtaggtattatttgaattgggcgaattgaaacgttatgttgagaacggtgagtttttgattgaagttagcgatttcggcgtggtgaatatgtgcgttgaacgtaaattgtcgttcgtcgtcgggtacgcgttgaattgttataacgcggtgatattgaaaatattgtttaaatagggtatgatgcgttggtgtatgttagtggagttttttcgcgattggttggtgaatttgtttaattagtgcgatgagttgggtattcgtaattagtttgaagtggaagttttgagttacggttatttgtcgttggttatttcgttcgttgttttatcgcgcgttcggaagatt

SEQ ID NO: 15404 - DNA, 568 bp, Artificial Sequence
  chemically treated genomic DNA (Homo sapiens) CpG-island No: 15404
aatcttccgaacgcgcgataaaacaacgaacgaaataaccaacgacaaataaccgtaactcaaaacttccacttcaaactaattacgaatacccaactcatcgcactaattaaacaaattcaccaaccaatcgcgaaaaaactccactaacatacaccaacgcatcataccctatttaaacaatattttcaatatcaccgcgttataacaattcaacgcgtacccgacgacgaacgacaatttacgttcaacgcacatattcaccacgccgaaatcgctaacttcaatcaaaaactcaccgttctcaacataacgtttcaattcgcccaattcaaataatacctacaccaacgccaacgtaaaaaacacaatctacttaccactcccgacgaacgattttaccatctccaaccaatcgccaactttaattacccgacgcttactacataccgcttcaccaaaataaatcacgtcgacgctactaataacgacctactaataaaattcttccaacgtctcttttaaccaataccacaacactaaccctaaaaaatatttcattactttt

SEQ ID NO: 15405 - DNA, 589 bp, Artificial Sequence
  chemically treated genomic DNA (Homo sapiens) CpG-island No: 15405
gtttttgaggaattaggtttttaggcgcgggcgttgggggtcgatgtcgtcgtcggtattgatatcgattacgaaacggtcgggtaaaacggtagtatgttgatggttagcgttagcggtacggcggtgaaaacgcgtcgatgagaagatttttttggttggtcgttgtcgttttgttattggtaggggtgtgtaggcgaaaaaggtattgtcgagaaagagggatattagtttgatattcgacgttaggcgtaggcggcgtattcgcgtattaaagtgttggtgatttattatatcgtagatgattttgatagttcgttggcgatattgatcgataagtaggttagttcgtattatttggtttttgcggtattatcgcgatataacggtaaatcgcgtatttggtaattggtgtcggaataagaattggtttggtatgcggggattagcgtttggcgcggggtaacgcgttttaacgatatttttattggtattgagttggaaaatcgtggtttggtaaaaatcggcggagtgatatatttgtttcgtttgaatcgggatagatttagcggtttattttattggggaa

SEQ ID NO: 15406 - DNA, 589 bp, Artificial Sequence
  chemically treated genomic DNA (Homo sapiens) CpG-island No: 15406
ttccccaataaaataaaccgctaaatctatcccgattcaaacgaaacaaatatatcactccgccgatttttaccaaaccacgattttccaactcaataccaataaaaatatcgttaaaacgcgttaccccgcgccaaacgctaatccccgcataccaaaccaattcttattccgacaccaattaccaaatacgcgatttaccgttatatcgcgataataccgcaaaaaccaaataatacgaactaacctacttatcgatcaatatcgccaacgaactatcaaaatcatctacgatataataaatcaccaacactttaatacgcgaatacgccgcctacgcctaacgtcgaatatcaaactaatatccctctttctcgacaatacctttttcgcctacacacccctaccaataacaaaacgacaacgaccaaccaaaaaaatcttctcatcgacgcgttttcaccgccgtaccgctaacgctaaccatcaacatactaccgttttacccgaccgtttcgtaatcgatatcaataccgacgacgacatcgacccccaacgcccgcgcctaaaaacctaattcctcaaaaac

SEQ ID NO: 15407 - DNA, 589 bp, Artificial Sequence
  chemically treated genomic DNA (Homo sapiens) CpG-island No: 15407
ttttttagtgaaataagtcgttgaatttgtttcggtttaaacggggtaaatatgttatttcgtcgatttttgttaagttacggttttttagtttaatgttaatagaggtgtcgttaaggcgcgttgtttcgcgttaggcgttaattttcgtatgttaggttagtttttgtttcggtattagttgttagatgcgcggtttatcgttgtatcgcggtggtatcgtagggattagataatgcgagttgatttgtttatcggttagtgtcgttagcgagttattaaaattatttgcggtgtagtggattattagtattttaatgcgcggatacgtcgtttgcgtttggcgtcgggtattaagttgatatttttttttttcgataatgtttttttcgtttgtatatttttgttaataatagagcggtagcgattagttagaagaatttttttatcgacgcgtttttatcgtcgtatcgttgacgttaattattagtatattgtcgttttgttcgatcgtttcgtagtcgatattaatatcgacgacggtatcggtttttagcgttcgcgtttgggagtttaattttttaaaggt

SEQ ID NO: 15408 - DNA, 589 bp, Artificial Sequence
  chemically treated genomic DNA (Homo sapiens) CpG-island No: 15408
acctttaaaaaattaaactcccaaacgcgaacgctaaaaaccgataccgtcgtcgatattaatatcgactacgaaacgatcgaacaaaacgacaatatactaataattaacgtcaacgatacgacgataaaaacgcgtcgataaaaaaattcttctaactaatcgctaccgctctattattaacaaaaatatacaaacgaaaaaaacattatcgaaaaaaaaaaatatcaacttaatacccgacgccaaacgcaaacgacgtatccgcgcattaaaatactaataatccactacaccgcaaataattttaataactcgctaacgacactaaccgataaacaaatcaactcgcattatctaatccctacgataccaccgcgatacaacgataaaccgcgcatctaacaactaataccgaaacaaaaactaacctaacatacgaaaattaacgcctaacgcgaaacaacgcgccttaacgacacctctattaacattaaactaaaaaaccgtaacttaacaaaaatcgacgaaataacatatttaccccgtttaaaccgaaacaaattcaacgacttatttcactaaaaaa

SEQ ID NO: 15409 - DNA, 1011 bp, Artificial Sequence
  chemically treated genomic DNA (Homo sapiens) CpG-island No: 15409
  misc_feature (815)..(815): n is either a, c, g or t
  misc_feature (971)..(971): n is either a, c, g or t
ggcggtggtgtagcgttttttatggcgtttggttagtttgatgtcgatttcgattttgttttcgtatagcgcgataattcggagatggagcgtcgttgttaggaagtgatcgatcgttgttggtagtttggtgatgttaatttaattttgtttatttacgacgttggcgttggcggtttttttaacgttatgtcggaattggtgagcgacggcgggcgcggcggtaaatttgaattgcgcgagattttaagcgacgaatcgggtatgagttcgttggaaatttggtgtaacgaattttaggaacgttacgtgttggcggttgttgtcgattaattatcgttgtttgacgaattgtgtaagcgtgagcgcgtattttacgcggtgattggtgaagcgatcgaagaattgtatttttttttgtacgatcgttattttgataattagtcgatcgatttgtcgttggacgttttgtttggtaaaacgtcgaagatgattcgcgatgtataaacgttgaaagcgaaaggcgacgcgttggttcgtgaagggattattattgtagacgcggtgaaacgtgtgttgtatttgtcgattgtggcggaaaaaatttttttggtgattattggcgatcgtagcgtaatcggtatggtagcgcgcgattagatgtggggtcgtggtaggtgtcggtcgttaattgcgcggttattatcgttagtttcgatagttattacggtgaagcgatggcgattggcgagcgtgcgtcggttgcgttgttggatttcgtcgtttttgttcgtttggcggtcggtgaagcgttnattaatatcgtcgtaatataaattggcgatattaaacgtattaaatttttcgttaattggatgcggcggtaggttattttggtgaagatgcgggtttgtattaagtcgttaagtcgtgggcgaagagttttgttcggcgttggtttgacgattttngtgggttaagatttttgtcgataaattcgttgtagaaggt

SEQ ID NO: 15410 - DNA, 1011 bp, Artificial Sequence
  chemically treated genomic DNA (Homo sapiens) CpG-island No: 15410
  misc_feature (41)..(41): n is either a, c, g or t
  misc_feature (197)..(197): n is either a, c, g or t
accttctacaacgaatttatcgacaaaaatcttaacccacnaaaatcgtcaaaccaacgccgaacaaaactcttcgcccacgacttaacgacttaatacaaacccgcatcttcaccaaaataacctaccgccgcatccaattaacgaaaaatttaatacgtttaatatcgccaatttatattacgacgatattaatnaacgcttcaccgaccgccaaacgaacaaaaacgacgaaatccaacaacgcaaccgacgcacgctcgccaatcgccatcgcttcaccgtaataactatcgaaactaacgataataaccgcgcaattaacgaccgacacctaccacgaccccacatctaatcgcgcgctaccataccgattacgctacgatcgccaataatcaccaaaaaaattttttccgccacaatcgacaaatacaacacacgtttcaccgcgtctacaataataatcccttcacgaaccaacgcgtcgcctttcgctttcaacgtttatacatcgcgaatcatcttcgacgttttaccaaacaaaacgtccaacgacaaatcgatcgactaattatcaaaataacgatcgtacaaaaaaaaatacaattcttcgatcgcttcaccaatcaccgcgtaaaatacgcgctcacgcttacacaattcgtcaaacaacgataattaatcgacaacaaccgccaacacgtaacgttcctaaaattcgttacaccaaatttccaacgaactcatacccgattcgtcgcttaaaatctcgcgcaattcaaatttaccgccgcgcccgccgtcgctcaccaattccgacataacgttaaaaaaaccgccaacgccaacgtcgtaaataaacaaaattaaattaacatcaccaaactaccaacaacgatcgatcacttcctaacaacgacgctccatctccgaattatcgcgctatacgaaaacaaaatcgaaatcgacatcaaactaaccaaacgccataaaaaacgctacaccaccgcc

SEQ ID NO: 15411 - DNA, 1011 bp, Artificial Sequence
  chemically treated genomic DNA (Homo sapiens) CpG-island No: 15411
  misc_feature (41)..(41): n is either a, c, g or t
  misc_feature (197)..(197): n is either a, c, g or t
attttttgtagcgggtttatcgataggagttttaatttatngggatcgttaggttagcgtcggataaagtttttcgtttacggtttaacggtttaatataggttcgtatttttattagggtggtttgtcgtcgtatttagttggcggaaagtttgatgcgtttgatatcgttaatttgtgttgcggcgatgttggtnaacgttttatcgatcgttagacgggtagaggcggcgaaatttagtagcgtaatcggcgtacgttcgttaatcgttatcgttttatcgtagtagttgtcgaggttggcggtagtgatcgcgtagttagcgatcggtatttgttacggttttatatttgatcgcgcgttattatgtcggttacgttgcggtcgttaatggttattaggaaggtttttttcgttatagtcggtagatgtagtatacgttttatcgcgtttgtaatggtgatttttttacgggttagcgcgtcgtttttcgtttttagcgtttgtatatcgcgggttattttcggcgttttattaagtaggacgtttagcggtagatcgatcggttgattattaaaatgacgatcgtgtagagaaagatgtagtttttcggtcgttttattaattatcgcgtagggtgcgcgtttacgtttatatagttcgttaaatagcggtaattgatcggtagtaatcgttagtacgtagcgtttttgggattcgttatattagatttttagcgggtttatgttcggttcgtcgtttagaatttcgcgtagtttaaatttatcgtcgcgttcgtcgtcgtttattagtttcggtatggcgttagaaagatcgttagcgttaacgtcgtggataaataggattgggttggtattattaagttgttagtaacggtcgattattttttggtagcgacgttttattttcgggttgtcgcgttgtacggaagtaaagtcgaggtcggtattagattgattagacgttatagaagacgttgtattatcgtt

SEQ ID NO: 15412 - DNA, 1011 bp, Artificial Sequence
  chemically treated genomic DNA (Homo sapiens) CpG-island No: 15412
  misc_feature (815)..(815): n is either a, c, g or t
  misc_feature (971)..(971): n is either a, c, g or t
aacgataatacaacgtcttctataacgtctaatcaatctaataccgacctcgactttacttccgtacaacgcgacaacccgaaaataaaacgtcgctaccaaaaaataatcgaccgttactaacaacttaataataccaacccaatcctatttatccacgacgttaacgctaacgatctttctaacgccataccgaaactaataaacgacgacgaacgcgacgataaatttaaactacgcgaaattctaaacgacgaaccgaacataaacccgctaaaaatctaatataacgaatcccaaaaacgctacgtactaacgattactaccgatcaattaccgctatttaacgaactatataaacgtaaacgcgcaccctacgcgataattaataaaacgaccgaaaaactacatctttctctacacgatcgtcattttaataatcaaccgatcgatctaccgctaaacgtcctacttaataaaacgccgaaaataacccgcgatatacaaacgctaaaaacgaaaaacgacgcgctaacccgtaaaaaaatcaccattacaaacgcgataaaacgtatactacatctaccgactataacgaaaaaaaccttcctaataaccattaacgaccgcaacgtaaccgacataataacgcgcgatcaaatataaaaccgtaacaaataccgatcgctaactacgcgatcactaccgccaacctcgacaactactacgataaaacgataacgattaacgaacgtacgccgattacgctactaaatttcgccgcctctacccgtctaacgatcgataaaacgttnaccaacatcgccgcaacacaaattaacgatatcaaacgcatcaaactttccgccaactaaatacgacgacaaaccaccctaataaaaatacgaacctatattaaaccgttaaaccgtaaacgaaaaactttatccgacgctaacctaacgatcccnataaattaaaactcctatcgataaacccgctacaaaaaat

SEQ ID NO: 15413 - DNA, 628 bp, Artificial Sequence
  chemically treated genomic DNA (Homo sapiens) CpG-island No: 15413
tagtacgttcgttagaaacgcgtttatcgttatcgataagtcgattttttttagtagtaaattaaagttaaatacgaggaataacgttacggtattaaatatttttcgtaagttagagcgggttataaaacgtagcgtcggacgcgtgatatagcgttttagtaatattattagtattagcgtattcgttatttttaacgtcgagagagtaaatgcgtttatcgtcgtcgaggtattgttcgttgttagtagcggaattatcgttattagcgggatcgtcgcgatgattttggaatagtagtatcgtaaaggtattgcgatttatttgcgttattattagattgcgttttatttatcgtttgtatggtaatcgtcgtagaggagagcgttagcgttatgtcgattaatttcgcgatttgttagcgtagtttaagtaatatgtagaatagttttagtaggtcgtcgtaaattattatttgtaatgcgttatagtcgaatattgtcgtacgtagtttttatagtttttgtggatcgagttcgaggtcgataataaatagtattagtattattttatttcggtaagtgtagaatagattcggtatcggttattagtcgtagtttttacggg

SEQ ID NO: 15414 - DNA, 628 bp, Artificial Sequence
  chemically treated genomic DNA (Homo sapiens) CpG-island No: 15414
cccgtaaaaactacgactaataaccgataccgaatctattctacacttaccgaaataaaataatactaatactatttattatcgacctcgaactcgatccacaaaaactataaaaactacgtacgacaatattcgactataacgcattacaaataataatttacgacgacctactaaaactattctacatattacttaaactacgctaacaaatcgcgaaattaatcgacataacgctaacgctctcctctacgacgattaccatacaaacgataaataaaacgcaatctaataataacgcaaataaatcgcaatacctttacgatactactattccaaaatcatcgcgacgatcccgctaataacgataattccgctactaacaacgaacaatacctcgacgacgataaacgcatttactctctcgacgttaaaaataacgaatacgctaatactaataatattactaaaacgctatatcacgcgtccgacgctacgttttataacccgctctaacttacgaaaaatatttaataccgtaacgttattcctcgtatttaactttaatttactactaaaaaaaatcgacttatcgataacgataaacgcgtttctaacgaacgtacta

SEQ ID NO: 15415 - DNA, 628 bp, Artificial Sequence
  chemically treated genomic DNA (Homo sapiens) CpG-island No: 15415
ttcgtgggggttgcgattggtgatcgatgtcgaatttattttgtatttgtcgagatggggtggtgttgatgttgtttattatcggtttcgaattcgatttataaaggttgtggaagttgcgtgcggtagtgttcggttgtggcgtattgtagatggtgatttgcggcggtttgttggggttgttttgtatgttatttgggttgcgttggtaggtcgcggaattgatcggtatgacgttggcgtttttttttacggcgattgttatgtaggcgatgaatgaaacgtaatttgatggtgacgtaaatgggtcgtagtgtttttgcggtgttgttgttttaggattatcgcggcgatttcgttggtggcgatgatttcgttattggtaacgagtagtgtttcgacgacgatgggcgtatttgttttttcggcgttaaaagtggcgggtgcgttggtgttggtggtattgttggggcgttatgttacgcgttcggcgttgcgttttgtagttcgttttggtttgcgggaagtgtttagtgtcgtggcgttatttttcgtgtttggttttggtttgttgttggaagaggtcggtttgtcgatggcgatgggcgcgtttttggcgggcgtattg

SEQ ID NO: 15416 - DNA, 628 bp, Artificial Sequence
  chemically treated genomic DNA (Homo sapiens) CpG-island No: 15416
caatacgcccgccaaaaacgcgcccatcgccatcgacaaaccgacctcttccaacaacaaaccaaaaccaaacacgaaaaataacgccacgacactaaacacttcccgcaaaccaaaacgaactacaaaacgcaacgccgaacgcgtaacataacgccccaacaataccaccaacaccaacgcacccgccacttttaacgccgaaaaaacaaatacgcccatcgtcgtcgaaacactactcgttaccaataacgaaatcatcgccaccaacgaaatcgccgcgataatcctaaaacaacaacaccgcaaaaacactacgacccatttacgtcaccatcaaattacgtttcattcatcgcctacataacaatcgccgtaaaaaaaaacgccaacgtcataccgatcaattccgcgacctaccaacgcaacccaaataacatacaaaacaaccccaacaaaccgccgcaaatcaccatctacaatacgccacaaccgaacactaccgcacgcaacttccacaacctttataaatcgaattcgaaaccgataataaacaacatcaacaccaccccatctcgacaaatacaaaataaattcgacatcgatcaccaatcgcaacccccacgaa

SEQ ID NO: 15417 - DNA, 604 bp, Artificial Sequence
  chemically treated genomic DNA (Homo sapiens) CpG-island No: 15417
tatcggtttttttgaatcgttacggtttagaatgttgtcgaggaacgattgttcggttttacggttgaaaatgtttttttttttaaagcgcgagaaagtatttgtcgttagtacgttagtttataggtagttgtagtaatttgcggtataattatcggcgaaaatatggttgaaagcgtgcgggaaacggttttaggacggagatggtattacggtaattagttttttgatttttgttagagtttcgaggatttttgttttttgattcgggcggaattcggtatgaaggcggaaattaaataggtcgaattttagttgacgtagaataaatagcgtcgtttggtagtttttcgtcgttagtattttatttagtaattttttcggtagcggttcgtcggttttatagtgattagagataaacgttagcgttttcggtttttagtattagttttttataaattgattcggtagttcgatcgtattttacggatatcgttatatcggaaatattagcggtttcgatgcgggttagtatatggtgtaggtcgtgatcgaattcgtggaagagggtgattatttcgtcgtgagtgaatagcgttagttt

SEQ ID NO: 15418 - DNA, 604 bp, Artificial Sequence
  chemically treated genomic DNA (Homo sapiens) CpG-island No: 15418
aaactaacgctattcactcacgacgaaataatcaccctcttccacgaattcgatcacgacctacaccatatactaacccgcatcgaaaccgctaatatttccgatataacgatatccgtaaaatacgatcgaactaccgaatcaatttataaaaaactaatactaaaaaccgaaaacgctaacgtttatctctaatcactataaaaccgacgaaccgctaccgaaaaaattactaaataaaatactaacgacgaaaaactaccaaacgacgctatttattctacgtcaactaaaattcgacctatttaatttccgccttcataccgaattccgcccgaatcaaaaaacaaaaatcctcgaaactctaacaaaaatcaaaaaactaattaccgtaataccatctccgtcctaaaaccgtttcccgcacgctttcaaccatattttcgccgataattataccgcaaattactacaactacctataaactaacgtactaacgacaaatactttctcgcgctttaaaaaaaaaaacattttcaaccgtaaaaccgaacaatcgttcctcgacaacattctaaaccgtaacgattcaaaaaaaccgata

SEQ ID NO: 15419 - DNA, 604 bp, Artificial Sequence
  chemically treated genomic DNA (Homo sapiens) CpG-island No: 15419
aaattggcgttgtttatttacgacgaagtgattatttttttttacgagttcggttacggtttgtattatatgttgattcgtatcgaaatcgttggtgttttcggtatagcggtgttcgtgggatgcggtcgaattgtcgagttagtttatggaaaattggtgttgggagtcggaggcgttggcgtttatttttggttattatgaaatcggcgaatcgttgtcgaaagagttgttggataaaatgttggcggcgaagaattattaggcggcgttgtttattttgcgttagttggagttcggtttgtttgattttcgtttttatgtcgagtttcgttcggattagggggtaaaaattttcgaaattttggtagaaattaagaaattggttgtcgtggtgttattttcgttttggggtcgtttttcgtacgtttttagttatattttcgtcggtggttatgtcgtaggttattatagttatttgtgggttgacgtattggcggtagatgttttttcgcgttttgaggaagagggtatttttaatcgtgaaatcgggtagtcgtttttcgataatattttgagtcgtggcggtttagaagagtcgatg

SEQ ID NO: 15420 - DNA, 604 bp, Artificial Sequence
  chemically treated genomic DNA (Homo sapiens) CpG-island No: 15420
catcgactcttctaaaccgccacgactcaaaatattatcgaaaaacgactacccgatttcacgattaaaaataccctcttcctcaaaacgcgaaaaaacatctaccgccaatacgtcaacccacaaataactataataacctacgacataaccaccgacgaaaatataactaaaaacgtacgaaaaacgaccccaaaacgaaaataacaccacgacaaccaatttcttaatttctaccaaaatttcgaaaatttttaccccctaatccgaacgaaactcgacataaaaacgaaaatcaaacaaaccgaactccaactaacgcaaaataaacaacgccgcctaataattcttcgccgccaacattttatccaacaactctttcgacaacgattcgccgatttcataataaccaaaaataaacgccaacgcctccgactcccaacaccaattttccataaactaactcgacaattcgaccgcatcccacgaacaccgctataccgaaaacaccaacgatttcgatacgaatcaacatataatacaaaccgtaaccgaactcgtaaaaaaaaataatcacttcgtcgtaaataaacaacgccaattt

SEQ ID NO: 15421 - DNA, 768 bp, Artificial Sequence
  chemically treated genomic DNA (Homo sapiens) CpG-island No: 15421
tgtagtcgcgatcgcgagtcgattattttttgtcgtttgggcggtattggtagtagtaagtagatttttattgtttatgtcgtgaagattgattttttgttaggtcgtcgtgcggtggcgtatttttaatttgatacgtttgataggttatcgtacgatgttgttaggcgttcggttgtcgttgttcggtttgaagttatgtatataacgttatatcgggtagcgtgtttcgatatattttgttagacggttttaggcggcggtatcgtaggaaggcgatatatcgtttagtaagcgaattattgtcgggtaattatttgtaatattcggtaattgattttgttattgacgttgtttcgttagcggtaagggtttcgataaaatcgttattttcgtcggcgttgttaggtaaggatgattttttagtagagacgttagtcgcgttattaaagtttggttgatacgcgtatcgttttggaaaggatagcgttgtagtaataaatcggtagtttcgcgtgattgttcgttttgtattagttgttaggttagttgatttaggcgggtaagatttgtcggtttttgttgatatagtaatcgtgttagacgtagagttttagttttgttacgggtcgttacgttgatagtataacgttttttaagtattttattggcggggagggtggcgagtagtttttgcgttgcgtcgtattgatttttttttaatagtatcggtagcgtcgcgttataatatattggcggtgtcggtaa

SEQ ID NO: 15422 - DNA, 768 bp, Artificial Sequence
  chemically treated genomic DNA (Homo sapiens) CpG-island No: 15422
ttaccgacaccgccaatatattataacgcgacgctaccgatactattaaaaaaaaatcaatacgacgcaacgcaaaaactactcgccaccctccccgccaataaaatacttaaaaaacgttatactatcaacgtaacgacccgtaacaaaactaaaactctacgtctaacacgattactatatcaacaaaaaccgacaaatcttacccgcctaaatcaactaacctaacaactaatacaaaacgaacaatcacgcgaaactaccgatttattactacaacgctatcctttccaaaacgatacgcgtatcaaccaaactttaataacgcgactaacgtctctactaaaaaatcatccttacctaacaacgccgacgaaaataacgattttatcgaaacccttaccgctaacgaaacaacgtcaataacaaaatcaattaccgaatattacaaataattacccgacaataattcgcttactaaacgatatatcgccttcctacgataccgccgcctaaaaccgtctaacaaaatatatcgaaacacgctacccgatataacgttatatacataacttcaaaccgaacaacgacaaccgaacgcctaacaacatcgtacgataacctatcaaacgtatcaaattaaaaatacgccaccgcacgacgacctaacaaaaaatcaatcttcacgacataaacaataaaaatctacttactactaccaataccgcccaaacgacaaaaaataatcgactcgcgatcgcgactaca

SEQ ID NO: 15423 - DNA, 768 bp, Artificial Sequence
  chemically treated genomic DNA (Homo sapiens) CpG-island No: 15423
ttgtcgatatcgttagtatgttgtggcgcgacgttatcggtgttgttaaaagaaggttagtacgacgtagcgtaaaaattgttcgttatttttttcgttaatgaaatgtttgaggagcgttatgttgttagcgtggcgattcgtaataaggttgaagttttgcgtttggtacgattgttgtattagtaagaatcggtaaattttattcgtttggattaattaatttggtaattgatgtagaacgagtagttacgcgaagttgtcgatttattgttgtaacgttattttttttagggcgatgcgcgtgttagttagattttaatggcgcgattggcgtttttgttggaaagttatttttatttggtaacgtcggcgaaggtggcgattttatcgaaatttttatcgttggcggagtaacgttagtggtaaagttagttgtcgggtattgtagataattgttcggtaatagttcgtttgttgggcgatatgtcgtttttttacgatgtcgtcgtttggaatcgtttggtaaagtgtatcgggatacgttattcggtgtggcgttgtatgtatggttttaggtcgaataacgataatcgagcgtttggtaatatcgtgcggtagtttattaggcgtattaggttgaggatacgttatcgtacggcggtttggtagaaaattagtttttacgatatgagtaatgaggatttgtttgttgttgttaatatcgtttaggcggtaggaaatggtcggttcgcgatcgcggttata

SEQ ID NO: 15424 - DNA, 768 bp, Artificial Sequence
  chemically treated genomic DNA (Homo sapiens) CpG-island No: 15424
tataaccgcgatcgcgaaccgaccatttcctaccgcctaaacgatattaacaacaacaaacaaatcctcattactcatatcgtaaaaactaattttctaccaaaccgccgtacgataacgtatcctcaacctaatacgcctaataaactaccgcacgatattaccaaacgctcgattatcgttattcgacctaaaaccatacatacaacgccacaccgaataacgtatcccgatacactttaccaaacgattccaaacgacgacatcgtaaaaaaacgacatatcgcccaacaaacgaactattaccgaacaattatctacaatacccgacaactaactttaccactaacgttactccgccaacgataaaaatttcgataaaatcgccaccttcgccgacgttaccaaataaaaataactttccaacaaaaacgccaatcgcgccattaaaatctaactaacacgcgcatcgccctaaaaaaaataacgttacaacaataaatcgacaacttcgcgtaactactcgttctacatcaattaccaaattaattaatccaaacgaataaaatttaccgattcttactaatacaacaatcgtaccaaacgcaaaacttcaaccttattacgaatcgccacgctaacaacataacgctcctcaaacatttcattaacgaaaaaaataacgaacaatttttacgctacgtcgtactaaccttcttttaacaacaccgataacgtcgcgccacaacatactaacgatatcgacaa

SEQ ID NO: 15425 - DNA, 798 bp, Artificial Sequence
  chemically treated genomic DNA (Homo sapiens) CpG-island No: 15425
ttggacgtcgggtatttttattcgattgaagtgattttcgataagattttcgtcgttatgttgtatgtgtcgtagttgttgttgtacgttagtcgttcggttcgttgggatagcgattacgtagtgttgttggatgatgaaatttaggtaattgttagtgagattgtgcgttacgatttgtttgatcgggtgtatatcggttttgattttttcgatgtttttattaatcgtattgtcgcgtgggttattggtatacgtaatatgaaaaaagttttgttgcgtgcgttgttggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgcggatgcggtataagtgtttattaagg

SEQ ID NO: 15426 - DNA, 798 bp, Artificial Sequence
  chemically treated genomic DNA (Homo sapiens) CpG-island No: 15426
ccttaataaacacttataccgcatccgcaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattccaacaacgcacgcaacaaaacttttttcatattacgtataccaataacccacgcgacaatacgattaataaaaacatcgaaaaaatcaaaaccgatatacacccgatcaaacaaatcgtaacgcacaatctcactaacaattacctaaatttcatcatccaacaacactacgtaatcgctatcccaacgaaccgaacgactaacgtacaacaacaactacgacacatacaacataacgacgaaaatcttatcgaaaatcacttcaatcgaataaaaatacccgacgtccaa

SEQ ID NO: 15427 - DNA, 798 bp, Artificial Sequence
  chemically treated genomic DNA (Homo sapiens) CpG-island No: 15427
ttttgataagtatttgtgtcgtattcgtaattaatgtttgatgcgacgttgtcgcgttttattaggtttataattgttgtcgatttgtaggtcggataaggtatttgtgtcgtattcggtaattaatgtttgatgcgacgttgtcgcgttttattaggtttataattattgtcgatttgtaggtcggataaggtatttgtgtcgtattcggtaattaatgtttgatgcgacgttgtcgcgttttattaggtttataattgttgtcgattcgtaggtcggataaggcgttcgcgtcgtattcggtagtgtttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggttttagtaacgtacgtagtagggttttttttatattgcgtgtattaatgatttacgcggtaatgcggttgatagaggtatcgaagaagttaaggtcgatatgtattcggttaaatagatcgtgacgtataattttattggtaattgtttgggttttattatttagtagtattacgtgatcgttgttttagcgaatcggacggttgacgtgtagtagtaattgcggtatatatagtatggcggcggaaattttgtcggaaattattttagtcgggtggaagtgttcggcgtttag

SEQ ID NO: 15428 - DNA, 798 bp, Artificial Sequence
  chemically treated genomic DNA (Homo sapiens) CpG-island No: 15428
ctaaacgccgaacacttccacccgactaaaataatttccgacaaaatttccgccgccatactatatataccgcaattactactacacgtcaaccgtccgattcgctaaaacaacgatcacgtaatactactaaataataaaacccaaacaattaccaataaaattatacgtcacgatctatttaaccgaatacatatcgaccttaacttcttcgatacctctatcaaccgcattaccgcgtaaatcattaatacacgcaatataaaaaaaaccctactacgtacgttactaaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataaacactaccgaatacgacgcgaacgccttatccgacctacgaatcgacaacaattataaacctaataaaacgcgacaacgtcgcatcaaacattaattaccgaatacgacacaaataccttatccgacctacaaatcgacaataattataaacctaataaaacgcgacaacgtcgcatcaaacattaattaccgaatacgacacaaataccttatccgacctacaaatcgacaacaattataaacctaataaaacgcgacaacgtcgcatcaaacattaattacgaatacgacacaaatacttatcaaaa

SEQ ID NO: 15429 - DNA, 528 bp, Artificial Sequence
  chemically treated genomic DNA (Homo sapiens) CpG-island No: 15429
gcgcgtgtcgttatcgtgatggggtttaaaagcgattgggttattatgtagttcgtcgtcgaaattttcgaaattttgaatgtttcgtattacgttgaagtggtttttgtttatcgtattttcgataaattgtttagtttcgtcgaaagcgtcgaagagaacggttattaggtgattattgcgggcgtaggcggcgtagtcgtatttgttaggtatgattgtcgttaaaacgttggtgtcggtgttgggcgtgttagtatagagcgtcgtattgagcggtgtcgatagtttttattttatcgtataaatgtcgcgcggtatttcggtgggtacgttggcgattggtaaagttggcgcggtaaacgcggcgttattggtagtataaatttttgcgatttatgataagaattgtattagcgtttgaatgattggcgtaaagtttagatcgacgaagtgttggaaaattcggattcgcgaggtgcggtatgaaataggtttgcgttttcggtaacgggtagttaggtcgta

SEQ ID NO: 15430 - DNA, 528 bp, Artificial Sequence
  chemically treated genomic DNA (Homo sapiens) CpG-island No: 15430
tacgacctaactacccgttaccgaaaacgcaaacctatttcataccgcacctcgcgaatccgaattttccaacacttcgtcgatctaaactttacgccaatcattcaaacgctaatacaattcttatcataaatcgcaaaaatttatactaccaataacgccgcgtttaccgcgccaactttaccaatcgccaacgtacccaccgaaataccgcgcgacatttatacgataaaataaaaactatcgacaccgctcaatacgacgctctatactaacacgcccaacaccgacaccaacgttttaacgacaatcatacctaacaaatacgactacgccgcctacgcccgcaataatcacctaataaccgttctcttcgacgctttcgacgaaactaaacaatttatcgaaaatacgataaacaaaaaccacttcaacgtaatacgaaacattcaaaatttcgaaaatttcgacgacgaactacataataacccaatcgcttttaaaccccatcacgataacgacacgcgc

SEQ ID NO: 15431 - DNA, 528 bp, Artificial Sequence
  chemically treated genomic DNA (Homo sapiens) CpG-island No: 15431
tacggtttaattgttcgttatcgaggacgtaaatttgttttatgtcgtatttcgcgggttcgggttttttagtatttcgtcggtttgggttttgcgttagttatttagacgttggtgtagtttttattatgagtcgtaagaatttgtgttgttagtaacgtcgcgtttgtcgcgttagttttattaatcgttagcgtatttatcggaatgtcgcgcggtatttgtacgatggagtagaggttatcgatatcgtttagtgcggcgttttgtattggtacgtttagtatcggtattagcgttttggcggtaattatgtttggtagatgcgattgcgtcgtttgcgttcgtaataattatttgataatcgtttttttcggcgttttcggcgaagttgaatagtttatcgggggtgcggtgagtagaaattattttaacgtggtgcgggatatttaggatttcgaagatttcggcggcgaattgtatggtagtttagtcgtttttggattttattacgatggcgatacgcgt

SEQ ID NO: 15432 - DNA, 528 bp, Artificial Sequence
  chemically treated genomic DNA (Homo sapiens) CpG-island No: 15432
acgcgtatcgccatcgtaataaaatccaaaaacgactaaactaccatacaattcgccgccgaaatcttcgaaatcctaaatatcccgcaccacgttaaaataatttctactcaccgcacccccgataaactattcaacttcgccgaaaacgccgaaaaaaacgattatcaaataattattacgaacgcaaacgacgcaatcgcatctaccaaacataattaccgccaaaacgctaataccgatactaaacgtaccaatacaaaacgccgcactaaacgatatcgataacctctactccatcgtacaaataccgcgcgacattccgataaatacgctaacgattaataaaactaacgcgacaaacgcgacgttactaacaacacaaattcttacgactcataataaaaactacaccaacgtctaaataactaacgcaaaacccaaaccgacgaaatactaaaaaacccgaacccgcgaaatacgacataaaacaaatttacgtcctcgataacgaacaattaaaccgta

SEQ ID NO: 15433 - DNA, 662 bp, Artificial Sequence
  chemically treated genomic DNA (Homo sapiens) CpG-island No: 15433
  misc_feature (635)..(635): n is either a, c, g or t
tggcgtattcgcggtagaatggaagttgcgtcgtttgatacgtcggacgtcgaagagttattgcgggagtggttggatgacgattagcgggtaatattgttggagaatggttagttggattttgtcgtgtcgttggcggaaaattagcgattgcgtggtagcgtattcgcgtaacggtatggtatttcgttggcgttacggttgttattttcgtattgttcgtagttcgaatagtttggcgtattaacggtattgtcggaattatttaagagcgagaatggtttgattttggtgacgggggcgacggggagtggtaaatttattacgttggcggcgatggtggttattttaattaaatgtcgatgcgtatttttgacgttgaagattttgtgatattttttgttagttacgagtttgtttttcggggaaatggttgtttgtttgttcgttcggatgcggttattggggagattgaggatagtcgaatttgtacggaaaatcgtggttacgggtaacggattgtgggattatatcgtttcgcggatatcgggaaacggagaattcgtagggagaagcggttcggatagggaggttttaaacggtcggtttttttggttcgtttttttttttatatnggataaagaggtgaaaaaagtttttta

SEQ ID NO: 15434 - DNA, 662 bp, Artificial Sequence
  chemically treated genomic DNA (Homo sapiens) CpG-island No: 15434
  misc_feature (28)..(28): n is either a, c, g or t
taaaaaacttttttcacctctttatccnatataaaaaaaaaaacgaaccaaaaaaaccgaccgtttaaaacctccctatccgaaccgcttctccctacgaattctccgtttcccgatatccgcgaaacgatataatcccacaatccgttacccgtaaccacgattttccgtacaaattcgactatcctcaatctccccaataaccgcatccgaacgaacaaacaaacaaccatttccccgaaaaacaaactcgtaactaacaaaaaatatcacaaaatcttcaacgtcaaaaatacgcatcgacatttaattaaaataaccaccatcgccgccaacgtaataaatttaccactccccgtcgcccccgtcaccaaaatcaaaccattctcgctcttaaataattccgacaataccgttaatacgccaaactattcgaactacgaacaatacgaaaataacaaccgtaacgccaacgaaataccataccgttacgcgaatacgctaccacgcaatcgctaattttccgccaacgacacgacaaaatccaactaaccattctccaacaatattacccgctaatcgtcatccaaccactcccgcaataactcttcgacgtccgacgtatcaaacgacgcaacttccattctaccgcgaatacgcca

SEQ ID NO: 15435 - DNA, 662 bp, Artificial Sequence
  chemically treated genomic DNA (Homo sapiens) CpG-island No: 15435
  misc_feature (28)..(28): n is either a, c, g or t
tgggaggttttttttatttttttgtttnatataagaagagaagcgaattaaaagggtcgatcgtttaaagtttttttattcggatcgtttttttttacgggtttttcgtttttcggtattcgcggaacggtgtagttttatagttcgttgttcgtagttacggtttttcgtataggttcggttatttttagtttttttaatggtcgtattcgagcgagtaaataggtaattattttttcgggggataaattcgtggttggtaagagatattataggatttttagcgttagaaatgcgtatcggtatttgattgagatagttattatcgtcgttagcgtggtagatttgttatttttcgtcgttttcgttattagaattaggttattttcgtttttgagtaatttcggtaatatcgttggtgcgttaagttgttcgagttgcgggtagtgcgaaggtaatagtcgtaacgttagcgaaatgttatgtcgttgcgcgaatgcgttgttacgtaatcgttggtttttcgttagcgatacggtaaaatttagttgattattttttagtaatattgttcgttgatcgttatttagttattttcgtagtagtttttcgacgttcggcgtattaaacggcgtagtttttattttgtcgcgaatgcgtta

SEQ ID NO: 15436 - DNA, 662 bp, Artificial Sequence
  chemically treated genomic DNA (Homo sapiens) CpG-island No: 15436
  misc_feature (635)..(635): n is either a, c, g or t
taacgcattcgcgacaaaataaaaactacgccgtttaatacgccgaacgtcgaaaaactactacgaaaataactaaataacgatcaacgaacaatattactaaaaaataatcaactaaattttaccgtatcgctaacgaaaaaccaacgattacgtaacaacgcattcgcgcaacgacataacatttcgctaacgttacgactattaccttcgcactacccgcaactcgaacaacttaacgcaccaacgatattaccgaaattactcaaaaacgaaaataacctaattctaataacgaaaacgacgaaaaataacaaatctaccacgctaacgacgataataactatctcaatcaaataccgatacgcatttctaacgctaaaaatcctataatatctcttaccaaccacgaatttatcccccgaaaaaataattacctatttactcgctcgaatacgaccattaaaaaaactaaaaataaccgaacctatacgaaaaaccgtaactacgaacaacgaactataaaactacaccgttccgcgaataccgaaaaacgaaaaacccgtaaaaaaaaacgatccgaataaaaaaactttaaacgatcgacccttttaattcgcttctcttcttatatnaaacaaaaaaataaaaaaaacctccca

SEQ ID NO: 15437 - DNA, 856 bp, Artificial Sequence
  chemically treated genomic DNA (Homo sapiens) CpG-island No: 15437
ttttttatcgtttcgtttttattttatttttagtaatttttttaagatttttaggttcgttttcgttttttcgatttttgtcgtcgcgttttttattagtttttagtttcgttttttttttgcgtagtttttaaaggtaggtttcgagttcgagtcgttaattcgaggttgtttggtatttatttggtttcggtcgtcgcgcgtcgtcggtttcgggtcgggttttcggtcggacgatcgtttgttagttcgtcgttgttcgagtcgtttcgtttcgtcgcgttcgtcgttttttcgcgcgttttcgttttcgggtttcggagaggcggggacgggggcgtgacgttagcgtttttaggggcggggtatcgcgaaaagtttcgtttttattgttcgatagattaggttttatttatcgtttttatttattatcgtcgatggtgggcgagattaagtgcgaggggaggataggcgaagcgcgcgtttggggtcgcgttttttatatttagtcggcgttgttttacgtttcgtagttattttttttgcgtttttataaatggttcgattcgtaagtaagggggcgggttcggttttgaaaagtcggcgggtcgggttttgaggtggaaggcgggaaaatggcggatttttcggggcgaggcgttgggtgagttggggttttcgtaggtttggatttgtagacgttatagggttggagaggatgggtagcggaggtggggagttaggattttcggggtgagttcgggttcgatttcgttaggaattgcgcgggtttttgaagatttcgatggcgtgttgtttttgcgtatgtttcggagcgttgatattcgatcggttt

SEQ ID NO: 15438 - DNA, 856 bp, Artificial Sequence
  chemically treated genomic DNA (Homo sapiens) CpG-island No: 15438
aaaccgatcgaatatcaacgctccgaaacatacgcaaaaacaacacgccatcgaaatcttcaaaaacccgcgcaattcctaacgaaatcgaacccgaactcaccccgaaaatcctaactccccacctccgctacccatcctctccaaccctataacgtctacaaatccaaacctacgaaaaccccaactcacccaacgcctcgccccgaaaaatccgccattttcccgccttccacctcaaaacccgacccgccgacttttcaaaaccgaacccgcccccttacttacgaatcgaaccatttataaaaacgcaaaaaaaataactacgaaacgtaaaacaacgccgactaaatataaaaaacgcgaccccaaacgcgcgcttcgcctatcctcccctcgcacttaatctcgcccaccatcgacgataataaataaaaacgataaataaaacctaatctatcgaacaataaaaacgaaacttttcgcgataccccgcccctaaaaacgctaacgtcacgcccccgtccccgcctctccgaaacccgaaaacgaaaacgcgcgaaaaaacgacgaacgcgacgaaacgaaacgactcgaacaacgacgaactaacaaacgatcgtccgaccgaaaacccgacccgaaaccgacgacgcgcgacgaccgaaaccaaataaataccaaacaacctcgaattaacgactcgaactcgaaacctacctttaaaaactacgcaaaaaaaaaacgaaactaaaaactaataaaaaacgcgacgacaaaaatcgaaaaaacgaaaacgaacctaaaaatcttaaaaaaattactaaaaataaaataaaaacgaaacgataaaaaa

SEQ ID NO: 15439 - DNA, 856 bp, Artificial Sequence
  chemically treated genomic DNA (Homo sapiens) CpG-island No: 15439
gggtcggtcgggtgttagcgtttcggagtatgcgtagaggtagtacgttatcggggtttttaggggttcgcgtagtttttggcggggtcgaattcgaatttatttcgagggttttaattttttattttcgttgtttattttttttagttttatggcgtttataaatttagatttgcggaagttttaatttatttagcgtttcgtttcgaggaattcgttattttttcgttttttattttaaggttcgattcgtcggttttttaaagtcggattcgtttttttgtttgcgggtcggattatttgtggagacgtaggaggggtggttgcgaggcgtgaggtagcgtcggttaagtgtggagagcgcggttttagacgcgcgtttcgtttgtttttttttcgtatttggtttcgtttattatcggcggtagtgggtaggggcggtgggtgggatttgatttgtcggatagtaggggcggggtttttcgcgatgtttcgtttttaggagcgttggcgttacgttttcgttttcgttttttcggaattcggaagcgggagcgcgcgggggagcggcgggcgcggcggggcggagcggttcgagtagcggcgggttggtaggcggtcgttcggtcggggattcggttcgggatcggcggcgcgcggcggtcgaggttaggtgagtattaggtagtttcgggttggcgattcgagttcgaagtttgtttttgggggttgcgtagaagagggacggagttgagggttgatgggggacgcgacggtaggggtcgagggggcgggaacgagtttgggggttttggagagattgttggggatgaggtggaagcgagacggtgaagga

SEQ ID NO: 15440 - DNA, 856 bp, Artificial Sequence
  chemically treated genomic DNA (Homo sapiens) CpG-island No: 15440
tccttcaccgtctcgcttccacctcatccccaacaatctctccaaaacccccaaactcgttcccgccccctcgacccctaccgtcgcgtcccccatcaaccctcaactccgtccctcttctacgcaacccccaaaaacaaacttcgaactcgaatcgccaacccgaaactacctaatactcacctaacctcgaccgccgcgcgccgccgatcccgaaccgaatccccgaccgaacgaccgcctaccaacccgccgctactcgaaccgctccgccccgccgcgcccgccgctcccccgcgcgctcccgcttccgaattccgaaaaaacgaaaacgaaaacgtaacgccaacgctcctaaaaacgaaacatcgcgaaaaaccccgcccctactatccgacaaatcaaatcccacccaccgcccctacccactaccgccgataataaacgaaaccaaatacgaaaaaaaaacaaacgaaacgcgcgtctaaaaccgcgctctccacacttaaccgacgctacctcacgcctcgcaaccacccctcctacgtctccacaaataatccgacccgcaaacaaaaaaacgaatccgactttaaaaaaccgacgaatcgaaccttaaaataaaaaacgaaaaaataacgaattcctcgaaacgaaacgctaaataaattaaaacttccgcaaatctaaatttataaacgccataaaactaaaaaaaataaacaacgaaaataaaaaattaaaaccctcgaaataaattcgaattcgaccccgccaaaaactacgcgaacccctaaaaaccccgataacgtactacctctacgcatactccgaaacgctaacacccgaccgaccc

SEQ ID NO: 15441 - DNA, 678 bp, Artificial Sequence
  chemically treated genomic DNA (Homo sapiens) CpG-island No: 15441
atcgagcgtaacgttttcgacgattttaagtcgttggaggagtttaatttgttttataataatttgatgtcgttgttttacgatttttttacgtttttgtatcgtttcgagcgcgtgtattttaattataatttttggtattgtaattgcgacgtgttttggttgagttggtggtttaaggagacggtgtttagtaatacgacgtgttgcgttcgttgttatgcgttcgtcggttttaaggggcgttatattggggagttggattagtcgtattttatttgttatgcgttcgttatcgtggagtcgtttacggattttaacgttatcgagggtatggttgtcgagtttaaatgtcgtacgggtatttttatgattttcgttaattggttgacgtttaacggtatttttatgatttacggtttttatcgcgtgcgtattttcgttttgtatgacggtacgtttaattttattaacgttatcgtgtaggatacgggttagtatacgtgtatggtgacgaatttagtcggtaatattatcgtttcggttacgtttaacgtttcggtcgtggatttcgtggcggtcgggggtatcggtagcggcgggggcggttttgggggtagtggtggtgttggagggggtagtggcggttatatttattttattacggtgatcgtggag

SEQ ID NO: 15442 - DNA, 678 bp, Artificial Sequence
  chemically treated genomic DNA (Homo sapiens) CpG-island No: 15442
ctccacgatcaccgtaataaaataaatataaccgccactaccccctccaacaccaccactacccccaaaaccgcccccgccgctaccgatacccccgaccgccacgaaatccacgaccgaaacgttaaacgtaaccgaaacgataatattaccgactaaattcgtcaccatacacgtatactaacccgtatcctacacgataacgttaataaaattaaacgtaccgtcatacaaaacgaaaatacgcacgcgataaaaaccgtaaatcataaaaataccgttaaacgtcaaccaattaacgaaaatcataaaaatacccgtacgacatttaaactcgacaaccataccctcgataacgttaaaatccgtaaacgactccacgataacgaacgcataacaaataaaatacgactaatccaactccccaatataacgccccttaaaaccgacgaacgcataacaacgaacgcaacacgtcgtattactaaacaccgtctccttaaaccaccaactcaaccaaaacacgtcgcaattacaataccaaaaattataattaaaatacacgcgctcgaaacgatacaaaaacgtaaaaaaatcgtaaaacaacgacatcaaattattataaaacaaattaaactcctccaacgacttaaaatcgtcgaaaacgttacgctcgat

SEQ ID NO: 15443 - DNA, 678 bp, Artificial Sequence
  chemically treated genomic DNA (Homo sapiens) CpG-island No: 15443
ttttacggttatcgtggtgaagtaggtgtagtcgttattgttttttttaatattattattgtttttagggtcgttttcgtcgttgtcggtgttttcggtcgttacggggtttacggtcgagacgttgagcgtggtcgaggcggtggtgttgtcggttgagttcgttattatgtacgtgtattggttcgtgttttgtacggtgacgttggtgaagttaagcgtgtcgttatgtaggacggagatgcgtacgcggtaggagtcgtgggttatgagggtgtcgttgggcgttagttagttgacggaggttatggaggtgttcgtgcggtatttgagttcggtagttatgttttcggtgacgttgaggttcgtgggcggttttacgatgacgggcgtatagtaggtgaaatgcgattggtttagttttttaatgtagcgttttttgaggtcggcgggcgtatgatagcgggcgtagtacgtcgtgttgttgggtatcgtttttttgagttattagtttagttagagtacgtcgtagttgtaatgttaggggttgtggttgaggtgtacgcgttcgaggcggtgtaggggcgtgaagaggtcgtggggtagcgatattaggttgttgtgggataggttgagtttttttagcgatttgaggtcgtcgaaggcgttgcgttcgat

SEQ ID NO: 15444 - DNA, 678 bp, Artificial Sequence
  chemically treated genomic DNA (Homo sapiens) CpG-island No: 15444
atcgaacgcaacgccttcgacgacctcaaatcgctaaaaaaactcaacctatcccacaacaacctaatatcgctaccccacgacctcttcacgcccctacaccgcctcgaacgcgtacacctcaaccacaacccctaacattacaactacgacgtactctaactaaactaataactcaaaaaaacgatacccaacaacacgacgtactacgcccgctatcatacgcccgccgacctcaaaaaacgctacattaaaaaactaaaccaatcgcatttcacctactatacgcccgtcatcgtaaaaccgcccacgaacctcaacgtcaccgaaaacataactaccgaactcaaataccgcacgaacacctccataacctccgtcaactaactaacgcccaacgacaccctcataacccacgactcctaccgcgtacgcatctccgtcctacataacgacacgcttaacttcaccaacgtcaccgtacaaaacacgaaccaatacacgtacataataacgaactcaaccgacaacaccaccgcctcgaccacgctcaacgtctcgaccgtaaaccccgtaacgaccgaaaacaccgacaacgacgaaaacgaccctaaaaacaataataatattaaaaaaaacaataacgactacacctacttcaccacgataaccgtaaaa

SEQ ID NO: 15445 - DNA, 674 bp, Artificial Sequence
  chemically treated genomic DNA (Homo sapiens) CpG-island No: 15445
tttatttcgtttttataatagtgttaagaggtcggcgtcgttattatttcgcgtttatacggtttaataggaaggttaggaaatgtttaaggtttcggtcgtggttaaatcgcgcgcggatttaggggttttagtttcgtcgtcgtcgcgatttatatttgtcggagtttttagtagggttttatcgtttcgtaggcgtttcgagttcgcgttttcgcggatttgacgcgtcgcgtagttggtgagcgggtaacggcggtcgattttcgggaacgatattgttttaaatcgttttttagtttggaagtcgtcgttaggtttgaagttatcgcgggattgatttagtgtatcgtttacggcgaattatattttttagaattttttttttgcggtataaatgtttcggaagtcgcgaatcgtcggtattcgaagattatattttttaagggtttttgcggttgcgcggatttggtgcgtcgcgggtaaatcggttacggttttgtaagtagtttaatcgtttggggtcgtcgatttagagtcggttagttaggattatgcgtaaattgttttggggtatatagtcgttttttggtgaacgatataattcgaaattaagggatattttttatttataagggttatggcgttcggattaagaaattatattttttaga

SEQ ID NO: 15446 - DNA, 674 bp, Artificial Sequence
  chemically treated genomic DNA (Homo sapiens) CpG-island No: 15446
tctaaaaaatataatttcttaatccgaacgccataacccttataaataaaaaatatcccttaatttcgaattatatcgttcaccaaaaaacgactatataccccaaaacaatttacgcataatcctaactaaccgactctaaatcgacgaccccaaacgattaaactacttacaaaaccgtaaccgatttacccgcgacgcaccaaatccgcgcaaccgcaaaaacccttaaaaaatataatcttcgaataccgacgattcgcgacttccgaaacatttataccgcaaaaaaaaaattctaaaaaatataattcgccgtaaacgatacactaaatcaatcccgcgataacttcaaacctaacgacgacttccaaactaaaaaacgatttaaaacaatatcgttcccgaaaatcgaccgccgttacccgctcaccaactacgcgacgcgtcaaatccgcgaaaacgcgaactcgaaacgcctacgaaacgataaaaccctactaaaaactccgacaaatataaatcgcgacgacgacgaaactaaaacccctaaatccgcgcgcgatttaaccacgaccgaaaccttaaacatttcctaaccttcctattaaaccgtataaacgcgaaataataacgacgccgacctcttaacactattataaaaacgaaataaa

SEQ ID NO: 15447 - DNA, 674 bp, Artificial Sequence
  chemically treated genomic DNA (Homo sapiens) CpG-island No: 15447
tttgggaaatgtaattttttggttcgggcgttatggtttttataagtagagggtgttttttggtttcgagttgtatcgtttattagaggacgattgtgtgttttaggataatttgcgtatggttttagttggtcggttttaggtcgacggttttaggcggttaagttatttataaagtcgtgatcggtttgttcgcggcgtattaggttcgcgtagtcgtagagatttttgggaagtgtggttttcgggtgtcggcggttcgcggttttcgggatatttgtatcgtagggggaggattttgggaaatgtggttcgtcgtgggcggtgtattgggttagtttcgcgatagttttaggtttggcggcggtttttaagttaaggaacggtttggggtagtgtcgttttcggaggtcggtcgtcgttattcgtttattagttacgcggcgcgttaggttcgcggaggcgcgggttcggggcgtttgcgggacggtgaggttttgttgaggatttcggtaagtgtgggtcgcggcgacggcggggttaaggtttttgggttcgcgcgcggtttgattacggtcggggttttgggtattttttggtttttttgttgagtcgtgtaaacgcggggtgatgacggcgtcgattttttggtattgttgtgagagcgaagtggg

SEQ ID NO: 15448 - DNA, 674 bp, Artificial Sequence
  chemically treated genomic DNA (Homo sapiens) CpG-island No: 15448
cccacttcgctctcacaacaataccaaaaaatcgacgccgtcatcaccccgcgtttacacgactcaacaaaaaaaccaaaaaatacccaaaaccccgaccgtaatcaaaccgcgcgcgaacccaaaaaccttaaccccgccgtcgccgcgacccacacttaccgaaatcctcaacaaaacctcaccgtcccgcaaacgccccgaacccgcgcctccgcgaacctaacgcgccgcgtaactaataaacgaataacgacgaccgacctccgaaaacgacactaccccaaaccgttccttaacttaaaaaccgccgccaaacctaaaactatcgcgaaactaacccaatacaccgcccacgacgaaccacatttcccaaaatcctccccctacgatacaaatatcccgaaaaccgcgaaccgccgacacccgaaaaccacacttcccaaaaatctctacgactacgcgaacctaatacgccgcgaacaaaccgatcacgactttataaataacttaaccgcctaaaaccgtcgacctaaaaccgaccaactaaaaccatacgcaaattatcctaaaacacacaatcgtcctctaataaacgatacaactcgaaaccaaaaaacaccctctacttataaaaaccataacgcccgaaccaaaaaattacatttcccaaa

SEQ ID NO: 15449 - DNA, 739 bp, Artificial Sequence
  chemically treated genomic DNA (Homo sapiens) CpG-island No: 15449
ttggcggtcggtaggttatatattaacgcgtagtcgatagttttcgtagagaaagagaagttcgcgtggatatttagtagcgttgttataaataggttgatatcggttagtagtgcgtgtaggaggtatagtagcggagtaaggaatatgaataggaattttagcggtttagttatatcggttaggaacgtagtaatagtaatagaaagtagtatatcgttaattatcggacgacgttttttcggtgttgcgaaagtatatcgttagcgtcgtattcggtagattcgaatattaatgatcgggaagaagtcggatatgaatattttcgcggtgtcgttatcggtatagaagcggttaatgttatcgtggaaaatcgtattcgtcgcgttggtgaatttattaatttggaattaggcgatggtgtttagtatttgatgtagatcggttgggattagtagacggttgatgaaattaaagatatcggaatttagcgcgttcgtagaaacgatttattcgtcgtttgtatggatagcgtgttgtatcggcggttagacgtaattaaaaatggtcgttagtattaggtagaagaattcggtggtaatcggtataaagcgtttgtcgtcgaagaagtttaggaagttcggtagtttaatatcggattaacggttataggttgcgttattaattagatcggtaatgatattcgttagtatatttatgttaatttttgggttgatgg

SEQ ID NO: 15450 - DNA, 739 bp, Artificial Sequence
  chemically treated genomic DNA (Homo sapiens) CpG-island No: 15450
ccatcaacccaaaaattaacataaatatactaacgaatatcattaccgatctaattaataacgcaacctataaccgttaatccgatattaaactaccgaacttcctaaacttcttcgacgacaaacgctttataccgattaccaccgaattcttctacctaatactaacgaccatttttaattacgtctaaccgccgatacaacacgctatccatacaaacgacgaataaatcgtttctacgaacgcgctaaattccgatatctttaatttcatcaaccgtctactaatcccaaccgatctacatcaaatactaaacaccatcgcctaattccaaattaataaattcaccaacgcgacgaatacgattttccacgataacattaaccgcttctataccgataacgacaccgcgaaaatattcatatccgacttcttcccgatcattaatattcgaatctaccgaatacgacgctaacgatatactttcgcaacaccgaaaaaacgtcgtccgataattaacgatatactactttctattactattactacgttcctaaccgatataactaaaccgctaaaattcctattcatattccttactccgctactatacctcctacacgcactactaaccgatatcaacctatttataacaacgctactaaatatccacgcgaacttctctttctctacgaaaactatcgactacgcgttaatatataacctaccgaccgccaa

SEQ ID NO: 15451 - DNA, 739 bp, Artificial Sequence
  chemically treated genomic DNA (Homo sapiens) CpG-island No: 15451
ttattaatttagaaattaatatgggtgtattggcgggtattattatcggtttggttggtggcgtagtttataatcgttggttcgatattaaattgtcggattttttgagttttttcggcggtaaacgttttgtgtcgattgttatcggatttttttgtttggtgttggcggttatttttggttacgtttggtcgtcggtatagtacgttatttatgtaggcggcgagtggatcgtttttgcgggcgcgttgggtttcggtatttttggttttattaatcgtttgttgattttaatcggtttgtattaggtattgaatattatcgtttggttttagattggtgaatttattaacgcggcgggtacggttttttacggtgatattaatcgtttttatgtcggtgacggtatcgcggggatgtttatgttcggttttttttcgattattgatgttcgggtttgtcgggtgcggcgttggcgatgtattttcgtagtatcgaaagagcgtcgttcgatggttggcggtatgttgttttttgttgttgttattgcgtttttgatcggtgtgattgagtcgttggaatttttgtttatgttttttgtttcgttgttgtattttttgtacgtattgttgatcggtattagtttgtttgtggtaacgttgttgggtatttacgcgggtttttttttttttgcgggggttatcgattacgcgttgatgtataatttgtcggtcgttag

SEQ ID NO: 15452 - DNA, 739 bp, Artificial Sequence
  chemically treated genomic DNA (Homo sapiens) CpG-island No: 15452
ctaacgaccgacaaattatacatcaacgcgtaatcgataacccccgcaaaaaaaaaaaaacccgcgtaaatacccaacaacgttaccacaaacaaactaataccgatcaacaatacgtacaaaaaatacaacaacgaaacaaaaaacataaacaaaaattccaacgactcaatcacaccgatcaaaaacgcaataacaacaacaaaaaacaacataccgccaaccatcgaacgacgctctttcgatactacgaaaatacatcgccaacgccgcacccgacaaacccgaacatcaataatcgaaaaaaaaccgaacataaacatccccgcgataccgtcaccgacataaaaacgattaatatcaccgtaaaaaaccgtacccgccgcgttaataaattcaccaatctaaaaccaaacgataatattcaatacctaatacaaaccgattaaaatcaacaaacgattaataaaaccaaaaataccgaaacccaacgcgcccgcaaaaacgatccactcgccgcctacataaataacgtactataccgacgaccaaacgtaaccaaaaataaccgccaacaccaaacaaaaaaatccgataacaatcgacacaaaacgtttaccgccgaaaaaactcaaaaaatccgacaatttaatatcgaaccaacgattataaactacgccaccaaccaaaccgataataatacccgccaatacacccatattaatttctaaattaataa

SEQ ID NO: 15453 - DNA, 608 bp, Artificial Sequence
  chemically treated genomic DNA (Homo sapiens) CpG-island No: 15453
  misc_feature (544)..(544): n is either a, c, g or t
atgggttatgtgtcgatgagttacggcgtcgatttttatttcggtttgagtcgtaatgtcgttaaagcggcgggtatgatgggtttaacggtagaaatgttggcgcgtatgtacggtattagtcgtgaaatgtaggatgtttttgtcgcgcggttatacgttcgcgtttgggtcgttacgtagtcggtcgtatttaaaaatgaaattatttcgatcggtggttacgatgtcgacggcgttttgaagtagtttaattacgacgaagtgattcgttcggaaattatcgtggaagttttcgttacgttgcgttcggcgtttgatttagtaaacggtatggtaacggcgggtatattttttgtatttttcgatggcgtagttgttatgttggtgatgagtgaaagtcgcgtttatgaattaggttttaagtcgcgcgttcgtgtgcgttcgatggcggtcgttggttgtgatttatcgattatgggttacggttcggtttcggtttcgaaattggcgttgaaaaaagcggggttttttgttagcgaantcggcgtgtttgaaatgaacgaagtttttgtcgcgtagattttgttatgtattaaagatttggg

SEQ ID NO: 15454 - DNA, 608 bp, Artificial Sequence
  chemically treated genomic DNA (Homo sapiens) CpG-island No: 15454
  misc_feature (65)..(65): n is either a, c, g or t
cccaaatctttaatacataacaaaatctacgcgacaaaaacttcgttcatttcaaacacgccganttcgctaacaaaaaaccccgcttttttcaacgccaatttcgaaaccgaaaccgaaccgtaacccataatcgataaatcacaaccaacgaccgccatcgaacgcacacgaacgcgcgacttaaaacctaattcataaacgcgactttcactcatcaccaacataacaactacgccatcgaaaaatacaaaaaatatacccgccgttaccataccgtttactaaatcaaacgccgaacgcaacgtaacgaaaacttccacgataatttccgaacgaatcacttcgtcgtaattaaactacttcaaaacgccgtcgacatcgtaaccaccgatcgaaataatttcatttttaaatacgaccgactacgtaacgacccaaacgcgaacgtataaccgcgcgacaaaaacatcctacatttcacgactaataccgtacatacgcgccaacatttctaccgttaaacccatcatacccgccgctttaacgacattacgactcaaaccgaaataaaaatcgacgccgtaactcatcgacacataacccat

SEQ ID NO: 15455 - DNA, 608 bp, Artificial Sequence
  chemically treated genomic DNA (Homo sapiens) CpG-island No: 15455
  misc_feature (65)..(65): n is either a, c, g or t
tttagatttttaatatatggtaggatttgcgcggtaaaggtttcgtttattttaaatacgtcganttcgttggtagaaagtttcgttttttttagcgttagtttcgaggtcggaatcgggtcgtaatttataatcgatgggttataattaacgatcgttatcgaacgtatacgagcgcgcggtttaagatttaatttatgggcgcggtttttatttattattagtatggtagttgcgttatcggaaagtgtagaagatgtgttcgtcgttattatatcgtttattggattaaacgtcggacgtagcgtggcgagggtttttacggtggttttcgggcgaattatttcgtcgtaattaaattgttttaggacgtcgtcggtatcgtgattatcggtcgggatgattttatttttaaatgcggtcgattgcgtggcggtttaggcgcgggcgtgtgatcgcgcggtaaaggtattttgtattttacggttgatatcgtgtatacgcgttagtatttttgtcgttaagtttattatgttcgtcgttttggcgatattgcggtttaggtcggggtgaaaatcgacgtcgtgatttatcggtatatggtttat

SEQ ID NO: 15456 - DNA, 608 bp, Artificial Sequence
  chemically treated genomic DNA (Homo sapiens) CpG-island No: 15456
  misc_feature (544)..(544): n is either a, c, g or t
ataaaccatataccgataaatcacgacgtcgattttcaccccgacctaaaccgcaatatcgccaaaacgacgaacataataaacttaacgacaaaaatactaacgcgtatacacgatatcaaccgtaaaatacaaaatacctttaccgcgcgatcacacgcccgcgcctaaaccgccacgcaatcgaccgcatttaaaaataaaatcatcccgaccgataatcacgataccgacgacgtcctaaaacaatttaattacgacgaaataattcgcccgaaaaccaccgtaaaaaccctcgccacgctacgtccgacgtttaatccaataaacgatataataacgacgaacacatcttctacactttccgataacgcaactaccatactaataataaataaaaaccgcgcccataaattaaatcttaaaccgcgcgctcgtatacgttcgataacgatcgttaattataacccatcgattataaattacgacccgattccgacctcgaaactaacgctaaaaaaaacgaaactttctaccaacgaantcgacgtatttaaaataaacgaaacctttaccgcgcaaatcctaccatatattaaaaatctaaa

SEQ ID NO: 15457 - DNA, 561 bp, Artificial Sequence
  chemically treated genomic DNA (Homo sapiens) CpG-island No: 15457
cgatttacggtgttttcgttgttggtgtttcgtttggtttgttgatttatagttattacggttttgtcgtattggcgattattataatggtattattcgtattggcgtgggtttgtaacggtatagtgcgtaaagtatcggttttggcgggagaacgtttatcgttgtggagcgttgtcgggtttatttggaaattagggttaggtttggtattataaggcgttggttttgttgttatcgggattttcgtttcgttttattttgttagtaaaggatgggcgatggcgggttttatttttatcgcgtttggcggcgtatttgtcgtgatgcgcgttatgtttggttggatgtcggatcgttttggcggcgtgaaagtggcgaatgtttttttgtttgtagaaacggggggtttgttgttgttttggtaagtttagtgtatgggttcgattaagagggtcggttatcggacggagtttttttttatcgatagggtgaagggttatacgtttttttatattgggattatagtagggtattatttagattttcgattaggtagag

SEQ ID NO: 15458 - DNA, 561 bp, Artificial Sequence
  chemically treated genomic DNA (Homo sapiens) CpG-island No: 15458
ctctacctaatcgaaaatctaaataataccctactataatcccaatataaaaaaacgtataacccttcaccctatcgataaaaaaaaactccgtccgataaccgaccctcttaatcgaacccatacactaaacttaccaaaacaacaacaaaccccccgtttctacaaacaaaaaaacattcgccactttcacgccgccaaaacgatccgacatccaaccaaacataacgcgcatcacgacaaatacgccgccaaacgcgataaaaataaaacccgccatcgcccatcctttactaacaaaataaaacgaaacgaaaatcccgataacaacaaaaccaacgccttataataccaaacctaaccctaatttccaaataaacccgacaacgctccacaacgataaacgttctcccgccaaaaccgatactttacgcactataccgttacaaacccacgccaatacgaataataccattataataatcgccaatacgacaaaaccgtaataactataaatcaacaaaccaaacgaaacaccaacaacgaaaacaccgtaaatcg

SEQ ID NO: 15459 - DNA, 561 bp, Artificial Sequence
  chemically treated genomic DNA (Homo sapiens) CpG-island No: 15459
ttttgtttgatcgggaatttaaatggtattttattgtggttttaatgtgagggggcgtgtaattttttattttgtcggtaaaaaggaatttcgttcggtaatcggtttttttaatcggatttatgtattgggtttgttagggtagtaataagtttttcgtttttataagtagagagatattcgttatttttacgtcgttaaaacggttcggtatttagttaaatatgacgcgtattacgataaatgcgtcgttaaacgcggtaagagtaaagttcgttatcgtttattttttgttggtaaagtagagcgaaacgaaagtttcgataatagtaaaattaacgttttgtagtgttagatttaattttggtttttagataagttcgataacgttttatagcgatggacgttttttcgttagggtcggtattttgcgtattgtgtcgttataggtttacgttagtacgggtaatattattgtggtgatcgttagtgcggtaaaatcgtaatggttatgaattaataggttaagcggagtattaatagcgagggtatcgtaaatcg

SEQ ID NO: 15460 - DNA, 561 bp, Artificial Sequence
  chemically treated genomic DNA (Homo sapiens) CpG-island No: 15460
cgatttacgataccctcgctattaatactccgcttaacctattaattcataaccattacgattttaccgcactaacgatcaccacaataatattacccgtactaacgtaaacctataacgacacaatacgcaaaataccgaccctaacgaaaaaacgtccatcgctataaaacgttatcgaacttatctaaaaaccaaaattaaatctaacactacaaaacgttaattttactattatcgaaactttcgtttcgctctactttaccaacaaaaaataaacgataacgaactttactcttaccgcgtttaacgacgcatttatcgtaatacgcgtcatatttaactaaataccgaaccgttttaacgacgtaaaaataacgaatatctctctacttataaaaacgaaaaacttattactaccctaacaaacccaatacataaatccgattaaaaaaaccgattaccgaacgaaattcctttttaccgacaaaataaaaaattacacgccccctcacattaaaaccacaataaaataccatttaaattcccgatcaaacaaaa

SEQ ID NO: 15461 - DNA, 537 bp, Artificial Sequence
  chemically treated genomic DNA (Homo sapiens) CpG-island No: 15461
ttagacggttatcgaggtatgcggttttatcgttatatggttttggttcggggtcgtgtaggtagtattaatttttatcgtagcggaggtgaaagtttcgttaaagttatcgacgttttaatagtatagggcgtgtttttcggcggttgattgacggtttgtttttcgttcgttagggagtaagtttttttattacggcgatagtgtgtttgtattagcgaggttagtcgttcgcgtttgttcgtataggtttcggttattattagcgtaatggtttgatgatagtgtttaatagtgggggcggttaatagtttggcggagataatgttagtttggcgaatgttcggagattatgtaggaatgaagtagtacgtcgaggtatttgttcgttcgaatacggcgcgaaagtttggaagggcgattaaaatatattggagtggggtaattagttatgagttatttatgcgtattaggcgaaacgcgggaacgaattaagagaggttcgagtttatgaagattatataaaggagtttttaa

SEQ ID NO: 15462 - DNA, 537 bp, Artificial Sequence
  chemically treated genomic DNA (Homo sapiens) CpG-island No: 15462
ttaaaaactcctttatataatcttcataaactcgaacctctcttaattcgttcccgcgtttcgcctaatacgcataaataactcataactaattaccccactccaatatattttaatcgcccttccaaactttcgcgccgtattcgaacgaacaaatacctcgacgtactacttcattcctacataatctccgaacattcgccaaactaacattatctccgccaaactattaaccgcccccactattaaacactatcatcaaaccattacgctaataataaccgaaacctatacgaacaaacgcgaacgactaacctcgctaatacaaacacactatcgccgtaataaaaaaacttactccctaacgaacgaaaaacaaaccgtcaatcaaccgccgaaaaacacgccctatactattaaaacgtcgataactttaacgaaactttcacctccgctacgataaaaattaatactacctacacgaccccgaaccaaaaccatataacgataaaaccgcatacctcgataaccgtctaa

SEQ ID NO: 15463 - DNA, 537 bp, Artificial Sequence
  chemically treated genomic DNA (Homo sapiens) CpG-island No: 15463
ttggagatttttttgtatggtttttatgaattcggattttttttagttcgttttcgcgtttcgtttgatacgtataagtggtttatggttgattgttttattttagtgtattttggtcgtttttttaggttttcgcgtcgtattcgagcgggtaaatgtttcggcgtattgttttatttttgtataattttcgggtattcgttaagttgatattattttcgttaggttgttagtcgtttttattattgagtattattattaggttattgcgttggtagtggtcgagatttgtgcgaataggcgcgagcggttggtttcgttggtgtaggtatattatcgtcgtaataaaggagtttattttttggcggacgaaaaataggtcgttaattagtcgtcggaagatacgttttgtattgttaaaacgtcggtgattttgacggggtttttattttcgttgcggtgaagattgatgttatttatacgatttcggattagagttatatggcgatggagtcgtatgtttcgatggtcgtttgg

SEQ ID NO: 15464 - DNA, 537 bp, Artificial Sequence
  chemically treated genomic DNA (Homo sapiens) CpG-island No: 15464
ccaaacgaccatcgaaacatacgactccatcgccatataactctaatccgaaatcgtataaataacatcaatcttcaccgcaacgaaaataaaaaccccgtcaaaatcaccgacgttttaacaatacaaaacgtatcttccgacgactaattaacgacctatttttcgtccgccaaaaaataaactcctttattacgacgataatatacctacaccaacgaaaccaaccgctcgcgcctattcgcacaaatctcgaccactaccaacgcaataacctaataataatactcaataataaaaacgactaacaacctaacgaaaataatatcaacttaacgaatacccgaaaattatacaaaaataaaacaatacgccgaaacatttacccgctcgaatacgacgcgaaaacctaaaaaaacgaccaaaatacactaaaataaaacaatcaaccataaaccacttatacgtatcaaacgaaacgcgaaaacgaactaaaaaaaatccgaattcataaaaaccatacaaaaaaatctccaa

SEQ ID NO: 15465 - DNA, 1304 bp, Artificial Sequence
  chemically treated genomic DNA (Homo sapiens) CpG-island No: 15465
aggcgcgagtttagttcggtgatttcgttattttcgcggtttttattttggggttagggaagagggcgtggtcgattttagtttttttatcgaaatcgcgtttgtttttttttttatcgcggtttcgtacggcggcggaggggtcgaggggtggcggtatcgggatttcgtcgttatttcggcgcgtacggaggtagggttgggggaaatacgatttttggggagattggaggaggcgatgtcgtcgaggttgcgggggagttttttcggagaattcgggggtcgggtgggaatgcgatttttagggtagttatcgttgttttttcgtaattgtcgtagggattttttcggggtgggggtggggacgcggggttttcgtttttttcgggtcgcggaggtgtaggttcgaggggttcgtgtagttagacgtgtagtgtgcgcggttcgtgatttagtcgggtggcgacgcgaggtcggggaggtagggggaaggggcgggcgggtcgggcgcgtaatcgggatttcgcggtttcgggagaagcgaggtgcgcgcgtttaggagtggggggcggggcggcgggcgcgcgcgtagcggaggcgtcgggcggcggcgagggtcgggtcgtatgtcgttttttcggcgtcgcgtttttagagttcgcgtcgtttttcggggcgtcgcgcgggtggcgtaggtagaggtcgggcgggggtggtagttatttcggggtttaggttttagtcgttaggtttggtttttagcgggcgttgttagagggcgggttcgcgggagcggggcggcggcggcggcggtagaggagcgtagggcgggcggagatcgtcggggttatttttttagtttttcgcggtggtcgagttattcgtagttgcgttcgaggcgtcgaggcggggtggtcgagcgagattcgggtcgggcgcggttcgggtcgtatagtcgcggcggcggttgtagatttgtaaattttaatgatagtaattttgttcgtttgcgtttttgatttacgtggtgatttagtttttagttattcggcggtcgtttttcggttttagtttttttcgtcgtcgaataatgaagttattgtgtcgtcgtttatttttgagcgtcgttttatacgcggagcgtcgtcgtttttttggggaagggatcgaggcgttcggtttttaattattttcggtgggcgggcgtggggaggtcgcgttttgttggataattgaattttgggattattttttcgttagtttaagttttttattttaagtcgtttttttttttttatcgtatt

SEQ ID NO: 15466 - DNA, 1304 bp, Artificial Sequence
  chemically treated genomic DNA (Homo sapiens) CpG-island No: 15466
aatacgataaaaaaaaaaaaacgacttaaaataaaaaacttaaactaacgaaaaaataatcccaaaattcaattatccaacaaaacgcgacctccccacgcccgcccaccgaaaataattaaaaaccgaacgcctcgatcccttccccaaaaaaacgacgacgctccgcgtataaaacgacgctcaaaaataaacgacgacacaataacttcattattcgacgacgaaaaaaactaaaaccgaaaaacgaccgccgaataactaaaaactaaatcaccacgtaaatcaaaaacgcaaacgaacaaaattactatcattaaaatttacaaatctacaaccgccgccgcgactatacgacccgaaccgcgcccgacccgaatctcgctcgaccaccccgcctcgacgcctcgaacgcaactacgaataactcgaccaccgcgaaaaactaaaaaaataaccccgacgatctccgcccgccctacgctcctctaccgccgccgccgccgccccgctcccgcgaacccgccctctaacaacgcccgctaaaaaccaaacctaacgactaaaacctaaaccccgaaataactaccacccccgcccgacctctacctacgccacccgcgcgacgccccgaaaaacgacgcgaactctaaaaacgcgacgccgaaaaaacgacatacgacccgaccctcgccgccgcccgacgcctccgctacgcgcgcgcccgccgccccgccccccactcctaaacgcgcgcacctcgcttctcccgaaaccgcgaaatcccgattacgcgcccgacccgcccgccccttccccctacctccccgacctcgcgtcgccacccgactaaatcacgaaccgcgcacactacacgtctaactacacgaacccctcgaacctacacctccgcgacccgaaaaaaacgaaaaccccgcgtccccacccccaccccgaaaaaatccctacgacaattacgaaaaaacaacgataactaccctaaaaatcgcattcccacccgacccccgaattctccgaaaaaactcccccgcaacctcgacgacatcgcctcctccaatctccccaaaaatcgtatttcccccaaccctacctccgtacgcgccgaaataacgacgaaatcccgataccgccacccctcgacccctccgccgccgtacgaaaccgcgataaaaaaaaaaacaaacgcgatttcgataaaaaaactaaaatcgaccacgccctcttccctaaccccaaaataaaaaccgcgaaaataacgaaatcaccgaactaaactcgcgcct

SEQ ID NO: 15467 - DNA, 1304 bp, Artificial Sequence
  chemically treated genomic DNA (Homo sapiens) CpG-island No: 15467
aatacgatgaagaggaaaggacggtttaagataaagagtttgggttgacgagggaatagttttagggtttaattatttagtagagcgcggtttttttacgttcgtttatcggggataattaaaagtcggacgtttcggttttttttttagggaggcggcggcgtttcgcgtgtgaaacggcgtttagaaatgaacggcgatatagtggttttattgttcggcggcgggggaaattgaggtcggagggcggtcgtcgggtgattggaggttgggttattacgtgagttagaggcgtagacgggtaagattgttgttattaaggtttataggtttgtagtcgtcgtcgcggttgtgcggttcgagtcgcgttcggttcgggtttcgttcggttatttcgtttcggcgtttcgagcgtaattgcgggtggttcggttatcgcggggggttggagaggtgatttcgacggttttcgttcgttttgcgtttttttgtcgtcgtcgtcgtcgtttcgttttcgcgggttcgttttttgatagcgttcgttgagggttaagtttggcggttggaatttgagtttcggggtggttgttattttcgttcggtttttatttgcgttattcgcgcggcgtttcgggaggcggcgcgagttttgggagcgcggcgtcgggaagacggtatacggttcggttttcgtcgtcgttcggcgttttcgttgcgcgcgcgttcgtcgtttcgttttttatttttgggcgcgcgtatttcgtttttttcgaggtcgcggggtttcggttgcgcgttcggttcgttcgttttttttttttgttttttcggtttcgcgtcgttattcggttgagttacgggtcgcgtatattgtacgtttgattgtacgggtttttcgggtttgtattttcgcggttcggaagggacggaagtttcgcgtttttatttttatttcgggagggtttttgcggtagttacgggggagtagcgatagttgttttggaggtcgtatttttattcggttttcgagtttttcgggagaattttttcgtagtttcggcggtatcgttttttttaatttttttaggaatcgtgttttttttaattttgttttcgtgcgcgtcggggtggcggcgggatttcggtgtcgttatttttcggttttttcgtcgtcgtgcgggatcgcgatgggggaggggataggcgcggtttcggtgagggggttggggtcggttacgtttttttttttggttttagggtgggggtcgcgaggatggcggggttatcgggttgaattcgcgttt

SEQ ID NO: 15468 - DNA, 1304 bp, Artificial Sequence
  chemically treated genomic DNA (Homo sapiens) CpG-island No: 15468
aaacgcgaattcaacccgataaccccgccatcctcgcgacccccaccctaaaaccaaaaaaaaaaacgtaaccgaccccaaccccctcaccgaaaccgcgcctatcccctcccccatcgcgatcccgcacgacgacgaaaaaaccgaaaaataacgacaccgaaatcccgccgccaccccgacgcgcacgaaaacaaaattaaaaaaaacacgattcctaaaaaaattaaaaaaaacgataccgccgaaactacgaaaaaattctcccgaaaaactcgaaaaccgaataaaaatacgacctccaaaacaactatcgctactcccccgtaactaccgcaaaaaccctcccgaaataaaaataaaaacgcgaaacttccgtcccttccgaaccgcgaaaatacaaacccgaaaaacccgtacaatcaaacgtacaatatacgcgacccgtaactcaaccgaataacgacgcgaaaccgaaaaaacaaaaaaaaaaaacgaacgaaccgaacgcgcaaccgaaaccccgcgacctcgaaaaaaacgaaatacgcgcgcccaaaaataaaaaacgaaacgacgaacgcgcgcgcaacgaaaacgccgaacgacgacgaaaaccgaaccgtataccgtcttcccgacgccgcgctcccaaaactcgcgccgcctcccgaaacgccgcgcgaataacgcaaataaaaaccgaacgaaaataacaaccaccccgaaactcaaattccaaccgccaaacttaaccctcaacgaacgctatcaaaaaacgaacccgcgaaaacgaaacgacgacgacgacgacaaaaaaacgcaaaacgaacgaaaaccgtcgaaatcacctctccaaccccccgcgataaccgaaccacccgcaattacgctcgaaacgccgaaacgaaataaccgaacgaaacccgaaccgaacgcgactcgaaccgcacaaccgcgacgacgactacaaacctataaaccttaataacaacaatcttacccgtctacgcctctaactcacgtaataacccaacctccaatcacccgacgaccgccctccgacctcaatttcccccgccgccgaacaataaaaccactatatcgccgttcatttctaaacgccgtttcacacgcgaaacgccgccgcctccctaaaaaaaaaaccgaaacgtccgacttttaattatccccgataaacgaacgtaaaaaaaccgcgctctactaaataattaaaccctaaaactattccctcgtcaacccaaactctttatcttaaaccgtcctttcctcttcatcgtatt

SEQ ID NO: 15469 - DNA, 561 bp, Artificial Sequence
  chemically treated genomic DNA (Homo sapiens) CpG-island No: 15469
ttttataggcgttagtttcgttttggacgtcgatcgtcgtttttatagtttcggtttcggttgttggatgagaattagcgtggttcgtttaagggggaggggataggcgttgtaaggagtagagtcgcgggaagtaattttttaagttataatgttagtcgcgaatataggaaaaagtttatttcgtcgtcgcggggttttatgttttcgtcggtaatgattatgtttgtgggagtaacggttatcggcgcgcggttttttgggagttgtttgttgcgcggagcgcgggtacgttcgtcggttatcggaagtatcgttattggtcggtgcgtgtaggtgagtttggcggttttaaggttggttcggaggttttattgttagtcgggtgcggtcggagcgtaggattaggttagagtcgttttaagtgatttgggcgtgtcggagaaacgagtagggtttgcgggggttttttatgcggcgaggtcgagtaagggtaggggtttgatgggatcgggattttttcggttttagggacggggaaggtcggtttagttaggtttt

SEQ ID NO: 15470 - DNA, 561 bp, Artificial Sequence
  chemically treated genomic DNA (Homo sapiens) CpG-island No: 15470
aaaacctaactaaaccgaccttccccgtccctaaaaccgaaaaaatcccgatcccatcaaacccctacccttactcgacctcgccgcataaaaaacccccgcaaaccctactcgtttctccgacacgcccaaatcacttaaaacgactctaacctaatcctacgctccgaccgcacccgactaacaataaaacctccgaaccaaccttaaaaccgccaaactcacctacacgcaccgaccaataacgatacttccgataaccgacgaacgtacccgcgctccgcgcaacaaacaactcccaaaaaaccgcgcgccgataaccgttactcccacaaacataatcattaccgacgaaaacataaaaccccgcgacgacgaaataaactttttcctatattcgcgactaacattataacttaaaaaattacttcccgcgactctactccttacaacgcctatcccctcccccttaaacgaaccacgctaattctcatccaacaaccgaaaccgaaactataaaaacgacgatcgacgtccaaaacgaaactaacgcctataaaa

SEQ ID NO: 15471 - DNA, 561 bp, Artificial Sequence
  chemically treated genomic DNA (Homo sapiens) CpG-island No: 15471
gaaatttgattggatcggtttttttcgtttttgaggtcggagagatttcgattttattaggtttttgtttttgttcggtttcgtcgtatgagggattttcgtaggttttgttcgttttttcggtacgtttagattatttggggcggttttggtttggttttgcgtttcggtcgtattcggttaatagtgaaattttcgagttaattttgaggtcgttagatttatttgtacgtatcggttaatggcggtgttttcggtggtcggcggacgtgttcgcgtttcgcgtaataaataatttttagaaggtcgcgcgtcggtagtcgttgtttttataggtatagttattgtcggcgggagtatggggtttcgcggcggcgggatgagtttttttttgtgttcgcgattagtattgtggtttagggagttgtttttcgcggttttgttttttgtagcgtttgtttttttttttttaaacgggttacgttggtttttatttagtaatcgaagtcgagattgtggaggcggcggtcggcgtttagggcgggattagcgtttatgggg

SEQ ID NO: 15472 - DNA, 561 bp, Artificial Sequence
  chemically treated genomic DNA (Homo sapiens) CpG-island No: 15472
ccccataaacgctaatcccgccctaaacgccgaccgccgcctccacaatctcgacttcgattactaaataaaaaccaacgtaacccgtttaaaaaaaaaaaaacaaacgctacaaaaaacaaaaccgcgaaaaacaactccctaaaccacaatactaatcgcgaacacaaaaaaaaactcatcccgccgccgcgaaaccccatactcccgccgacaataactatacctataaaaacaacgactaccgacgcgcgaccttctaaaaattatttattacgcgaaacgcgaacacgtccgccgaccaccgaaaacaccgccattaaccgatacgtacaaataaatctaacgacctcaaaattaactcgaaaatttcactattaaccgaatacgaccgaaacgcaaaaccaaaccaaaaccgccccaaataatctaaacgtaccgaaaaaacgaacaaaacctacgaaaatccctcatacgacgaaaccgaacaaaaacaaaaacctaataaaatcgaaatctctccgacctcaaaaacgaaaaaaaccgatccaatcaaatttc

SEQ ID NO: 15473 - DNA, 1107 bp, Artificial Sequence
  chemically treated genomic DNA (Homo sapiens) CpG-island No: 15473
tttaacgacgtatagcgtatgaaatgtttacgtttattaggtaattgtcgttgatattacgtagtacgttagaaaattacggggtaagttcggcgatgataaaatcgattttttgtataaacgttattagtttgttagtaatagtcggttgtatagagtgatcgagcgttagtagtaaatagagcggaaacgcgtcgtttagatttaatttatatattatcgtttataatatcggtaattgtatcggtagttagataaagtcgtagaattttattagttgtaatattagcgttagtattaatagtttgcgtcgattttgatggcgagttatagtaggtattagtaaagtttttgcggtttgtttaagcgttattaatgttagtaaggaatcgttgtattgcgcgttggtattaattttaatatagaaagcgggtaattaggtattaggttggcgtaatcgtcgttaattagatcgaagtaaatatttagcgtttacgcgcggggagtgaatattacgcgaatcggagtggtgttgttttgtgggaagaggcgatttcgcgggcgttgtgttattattaggtaaagagcgtaataacggtaggtagcgtttattaggcgagtgtttgatattaggtttcgttatgttgaattaattagggcgttatggcggtattaagtttatcgtcgtttattagagtcgcggattatagttttattattagtggcgtgcgttgttgaaatcgtcgtttaattatcgaaggtattatcgtttgaatgatgtcgatttttattttattaagtagtgcgttgttaagtagtagcgtattttgcgggtaaagtttacgtattaatgtatcgacggtaattagtaatagattgatggcgatattgcgacgttcgttgatatgttgatgaagttagttttcggttagcgttagttcgtttatggtaattatcggtagagcggttaatagggtagttacgttaaagtttatttcgttcgtttggcgtaattgcggtagtagtggttcgacggaggtgagtagtggtcgtatattaagattaattagtattagtattagtagtatcgtgaacgttttttgatgg

SEQ ID NO: 15474 - DNA, 1107 bp, Artificial Sequence
  chemically treated genomic DNA (Homo sapiens) CpG-island No: 15474
ccatcaaaaaacgttcacgatactactaatactaatactaattaatcttaatatacgaccactactcacctccgtcgaaccactactaccgcaattacgccaaacgaacgaaataaactttaacgtaactaccctattaaccgctctaccgataattaccataaacgaactaacgctaaccgaaaactaacttcatcaacatatcaacgaacgtcgcaatatcgccatcaatctattactaattaccgtcgatacattaatacgtaaactttacccgcaaaatacgctactacttaacaacgcactacttaataaaataaaaatcgacatcattcaaacgataataccttcgataattaaacgacgatttcaacaacgcacgccactaataataaaactataatccgcgactctaataaacgacgataaacttaataccgccataacgccctaattaattcaacataacgaaacctaatatcaaacactcgcctaataaacgctacctaccgttattacgctctttacctaataataacacaacgcccgcgaaatcgcctcttcccacaaaacaacaccactccgattcgcgtaatattcactccccgcgcgtaaacgctaaatatttacttcgatctaattaacgacgattacgccaacctaatacctaattacccgctttctatattaaaattaataccaacgcgcaatacaacgattccttactaacattaataacgcttaaacaaaccgcaaaaactttactaatacctactataactcgccatcaaaatcgacgcaaactattaatactaacgctaatattacaactaataaaattctacgactttatctaactaccgatacaattaccgatattataaacgataatatataaattaaatctaaacgacgcgtttccgctctatttactactaacgctcgatcactctatacaaccgactattactaacaaactaataacgtttatacaaaaaatcgattttatcatcgccgaacttaccccgtaattttctaacgtactacgtaatatcaacgacaattacctaataaacgtaaacatttcatacgctatacgtcgttaaa

SEQ ID NO: 15475 - DNA, 1107 bp, Artificial Sequence
  chemically treated genomic DNA (Homo sapiens) CpG-island No: 15475
ttattaaaagacgtttacgatgttgttggtattggtgttgattggttttaatatgcgattattgtttattttcgtcgggttattgttatcgtaattgcgttaggcgagcggaatgagttttagcgtggttgttttgttgatcgttttgtcggtggttattatgggcgggttggcgttggtcggaagttggttttattagtatgttagcgaacgtcgtagtgtcgttattagtttgttgttgattgtcgtcggtgtattgatgcgtgagttttattcgtaaagtgcgttgttgtttagtagcgtattgtttggtggggtggggatcggtattatttaggcggtgatgttttcggtgattaaacggcggttttagtagcgtacgttattggtgatggggttgtggttcgcggttttgatgggcggcggtgggtttggtgtcgttataacgttttggttagtttaatatagcgaaatttggtattaaatattcgtttggtgggcgttgtttgtcgttgttgcgttttttgtttggtggtggtatagcgttcgcgaggtcgtttttttttataagataatattatttcggttcgcgtggtatttatttttcgcgcgtggacgttgggtgtttatttcggtttgattaacggcggttacgttagtttgatgtttggttattcgttttttatattgagattggtgttagcgcgtagtatagcggttttttattggtattgatgacgtttgggtaagtcgtaggagttttgttgatgtttgttatggttcgttattaggatcggcgtaaattgttaatgttggcgttggtgttataattggtggggttttgcggttttatttggttgtcgatgtaattgtcggtattgtgggcgatggtgtgtgggttaggtttgggcggcgcgttttcgttttgtttgttgttggcgttcgattattttgtgtaatcggttattgttggtaagttggtggcgtttatgtagggaatcggttttattatcgtcgggtttgtttcgtggttttttggcgtgttgcgtagtattagcggtaattatttgatggacgtgggtattttatgcgttgtgcgtcgttggg

SEQ ID NO: 15476 - DNA, 1107 bp, Artificial Sequence
  chemically treated genomic DNA (Homo sapiens) CpG-island No: 15476
cccaacgacgcacaacgcataaaatacccacgtccatcaaataattaccgctaatactacgcaacacgccaaaaaaccacgaaacaaacccgacgataataaaaccgattccctacataaacgccaccaacttaccaacaataaccgattacacaaaataatcgaacgccaacaacaaacaaaacgaaaacgcgccgcccaaacctaacccacacaccatcgcccacaataccgacaattacatcgacaaccaaataaaaccgcaaaaccccaccaattataacaccaacgccaacattaacaatttacgccgatcctaataacgaaccataacaaacatcaacaaaactcctacgacttacccaaacgtcatcaataccaataaaaaaccgctatactacgcgctaacaccaatctcaatataaaaaacgaataaccaaacatcaaactaacgtaaccgccgttaatcaaaccgaaataaacacccaacgtccacgcgcgaaaaataaataccacgcgaaccgaaataatattatcttataaaaaaaaacgacctcgcgaacgctataccaccaccaaacaaaaaacgcaacaacgacaaacaacgcccaccaaacgaatatttaataccaaatttcgctatattaaactaaccaaaacgttataacgacaccaaacccaccgccgcccatcaaaaccgcgaaccacaaccccatcaccaataacgtacgctactaaaaccgccgtttaatcaccgaaaacatcaccgcctaaataataccgatccccaccccaccaaacaatacgctactaaacaacaacgcactttacgaataaaactcacgcatcaatacaccgacgacaatcaacaacaaactaataacgacactacgacgttcgctaacatactaataaaaccaacttccgaccaacgccaacccgcccataataaccaccgacaaaacgatcaacaaaacaaccacgctaaaactcattccgctcgcctaacgcaattacgataacaataacccgacgaaaataaacaataatcgcatattaaaaccaatcaacaccaataccaacaacatcgtaaacgtcttttaataa

SEQ ID NO: 15477 - DNA, 522 bp, Artificial Sequence
  chemically treated genomic DNA (Homo sapiens) CpG-island No: 15477
tagttagcgtgtaatttgtttttcgttttgttttaattgtgtaaggtaattatcggtaatttgacgatcgtaacgatattcgttaggcgacgtgtttcgcgatttatttttacgcgtagcggttgtattatattattatgtaggattttcgtcggttgtttatttagtttattcggtttacgggcgtgaattttttgttttagtaggtcgagcgttattgtaaagtcgtatagcgtggcggtaggcgttggcgggtagttaggatattaatatttatagggattattttattcgtatcgttttatacgtagtaagatcgtggaagatttcgttattgttatcgtagtatcgtagagatataaattttcgggttcggcgcggattgttacgtacgtagcgtagggggatcgtattgtacgggtgatcgcgtcggtaatagtaaaatattcgtatgacgcggtgaaggaacgattttaatgttaagcgttttgtattaaatagcggcgaaagcgtggcgaaaat

SEQ ID NO: 15478 - DNA, 522 bp, Artificial Sequence
  chemically treated genomic DNA (Homo sapiens) CpG-island No: 15478
attttcgccacgctttcgccgctatttaatacaaaacgcttaacattaaaatcgttccttcaccgcgtcatacgaatattttactattaccgacgcgatcacccgtacaatacgatccccctacgctacgtacgtaacaatccgcgccgaacccgaaaatttatatctctacgatactacgataacaataacgaaatcttccacgatcttactacgtataaaacgatacgaataaaataatccctataaatattaatatcctaactacccgccaacgcctaccgccacgctatacgactttacaataacgctcgacctactaaaacaaaaaattcacgcccgtaaaccgaataaactaaataaacaaccgacgaaaatcctacataataatataatacaaccgctacgcgtaaaaataaatcgcgaaacacgtcgcctaacgaatatcgttacgatcgtcaaattaccgataattaccttacacaattaaaacaaaacgaaaaacaaattacacgctaacta

SEQ ID NO: 15479 - DNA, 522 bp, Artificial Sequence
  chemically treated genomic DNA (Homo sapiens) CpG-island No: 15479
attttcgttacgttttcgtcgttgtttgatgtagaacgtttggtattaaagtcgtttttttatcgcgttatgcggatattttattgttatcggcgcggttattcgtgtaatgcgatttttttgcgttgcgtgcgtggtagttcgcgtcggattcgaaaatttgtatttttacggtgttgcggtaatagtggcgggattttttacgattttattgcgtgtggggcggtacggataaaatggtttttgtggatgttaatattttggttgttcgttaacgtttgtcgttacgttgtacggttttgtaatggcgttcggtttgttggagtagaaaatttacgttcgtgggtcgggtgaattggatgaataatcggcggagattttgtatggtgatatggtgtagtcgttgcgcgtgaaagtggatcgcgaagtacgtcgtttggcgggtatcgttacggtcgttagattgtcgatgattattttatatagttagggtagggcgaagaataggttgtacgttggttg

SEQ ID NO: 15480 - DNA, 522 bp, Artificial Sequence
  chemically treated genomic DNA (Homo sapiens) CpG-island No: 15480
caaccaacgtacaacctattcttcgccctaccctaactatataaaataatcatcgacaatctaacgaccgtaacgatacccgccaaacgacgtacttcgcgatccactttcacgcgcaacgactacaccatatcaccatacaaaatctccgccgattattcatccaattcacccgacccacgaacgtaaattttctactccaacaaaccgaacgccattacaaaaccgtacaacgtaacgacaaacgttaacgaacaaccaaaatattaacatccacaaaaaccattttatccgtaccgccccacacgcaataaaatcgtaaaaaatcccgccactattaccgcaacaccgtaaaaatacaaattttcgaatccgacgcgaactaccacgcacgcaacgcaaaaaaatcgcattacacgaataaccgcgccgataacaataaaatatccgcataacgcgataaaaaaacgactttaataccaaacgttctacatcaaacaacgacgaaaacgtaacgaaaat

SEQ ID NO: 15481 - DNA, 559 bp, Artificial Sequence
  chemically treated genomic DNA (Homo sapiens) CpG-island No: 15481
ggtttttcgaacgcgcggtaaagtagcgggcggagtagttagcggtagatgatcgtagtttaggatttttattttaaattggttacgaatgtttagtttatcgtattgattaagtagatttattagttagtcgcgggaaagttttattggtatatattagcgtattatgttttgtttgagtaatatttttagtgttattcgcgttgtagtagtttagcgcgtgttcggcgacgaacggtagtttgcgtttagcgtatatatttattacgtcgagatcgttggttttaattagaaatttatcgtttttaatatagcgttttagttcgtttagtttagatgatgtttgtattagcgtcgcgtgggagagtataatttgcgttattattttcggcgagcgatttttgttatttttagttaggtcgtttatttttgggttgttcgacgtttgggtgtttttcgttttttaggattaattcgtttcgggtttttttgggtggcggttcgcgttgttaaattttttttcgggggttttttttgggtcgtttttcgttggttttta

SEQ ID NO: 15482 - DNA, 559 bp, Artificial Sequence
  chemically treated genomic DNA (Homo sapiens) CpG-island No: 15482
taaaaaccaacgaaaaacgacccaaaaaaaacccccgaaaaaaaatttaacaacgcgaaccgccacccaaaaaaacccgaaacgaattaatcctaaaaaacgaaaaacacccaaacgtcgaacaacccaaaaataaacgacctaactaaaaataacaaaaatcgctcgccgaaaataataacgcaaattatactctcccacgcgacgctaatacaaacatcatctaaactaaacgaactaaaacgctatattaaaaacgataaatttctaattaaaaccaacgatctcgacgtaataaatatatacgctaaacgcaaactaccgttcgtcgccgaacacgcgctaaactactacaacgcgaataacactaaaaatattactcaaacaaaacataatacgctaatatataccaataaaactttcccgcgactaactaataaatctacttaatcaatacgataaactaaacattcgtaaccaatttaaaataaaaatcctaaactacgatcatctaccgctaactactccgcccgctactttaccgcgcgttcgaaaaacc

SEQ ID NO: 15483 - DNA, 559 bp, Artificial Sequence
  chemically treated genomic DNA (Homo sapiens) CpG-island No: 15483
taggggttagcgggggacggtttaaaaggggttttcgggaaagaatttaataacgcgggtcgttatttaggaaggttcgaaacggattaattttggggaacgggaagtatttaagcgtcgggtaatttaaaagtaggcgatttggttggagatggtaaaaatcgttcgtcgggagtggtaacgtagattgtgtttttttacgcggcgttggtgtaggtattatttgaattgggcgaattgaaacgttatgttgagaacggtgagtttttgattgaagttagcgatttcggcgtggtgaatatgtgcgttgaacgtaaattgtcgttcgtcgtcgggtacgcgttgaattgttataacgcgggtgatattgaaaatattgtttaaatagggtatgatgcgttggtgtatgttagtggagttttttcgcgattggttggtgaatttgtttaattagtgcgatgagttgggtattcgtaattagtttgaagtggaagttttgagttacggttatttgtcgttggttatttcgttcgttgttttatcgcgcgttcggaagatt

SEQ ID NO: 15484 - DNA, 559 bp, Artificial Sequence
  chemically treated genomic DNA (Homo sapiens) CpG-island No: 15484
aatcttccgaacgcgcgataaaacaacgaacgaaataaccaacgacaaataaccgtaactcaaaacttccacttcaaactaattacgaatacccaactcatcgcactaattaaacaaattcaccaaccaatcgcgaaaaaactccactaacatacaccaacgcatcataccctatttaaacaatattttcaatatcacccgcgttataacaattcaacgcgtacccgacgacgaacgacaatttacgttcaacgcacatattcaccacgccgaaatcgctaacttcaatcaaaaactcaccgttctcaacataacgtttcaattcgcccaattcaaataatacctacaccaacgccgcgtaaaaaaacacaatctacgttaccactcccgacgaacgatttttaccatctccaaccaaatcgcctacttttaaattacccgacgcttaaatacttcccgttccccaaaattaatccgtttcgaaccttcctaaataacgacccgcgttattaaattctttcccgaaaaccccttttaaaccgtcccccgctaaccccta

SEQ ID NO: 15485 - DNA, 1045 bp, Artificial Sequence
  chemically treated genomic DNA (Homo sapiens) CpG-island No: 15485
  misc_feature (1013)..(1013): n is either a, c, g or t
ggcgttacggtttttcgtgcggtttatgtggcgggtgtttgtcgattatttaggttaggcgacggtgattttttcgttgattggtgcgtggtaacgcgtggatatcggttaatatgatgttgtacgtcgcggggatgttttttttttggtttcggtgtgatcgcgtcgatcgtcgaatggggcgtgatgataaacgacgcgcgttagtaatatttggatttagtcgtatgtaaatgattttggatcggggacgtggcgtatgattatgtagtattgatggttttttaatttggtgggtgacgtatatgtcgcgattatcgtggattttatatttggtgaacggagatacgtatatataatgtcgtaatagattgaatttacgtaatatcgcgtttattaggtacgcgtagtcgttggttacggtgtatcgattaattttgtaacgcgggcgcgtgttggcgttagtcggcggtagcggtagcgggaaattattaatttgcgtcgtaacgttgggtattttgttcgttggcgttcgttagacggcgggggaaattttagtcgatggtaaatcggtttcgttttgcgttttgcgcggtattaaaattgttattattatgtagaattcgcgtagcgtttttaatttattgtatattatgtatatttacgcgcgggaaatttgtttggcgttagggaaattcgtcgatgacgttacgtttatcgttgttatagaagcggtggggttggaaaacgtcgcgcgcgtgttgaagttgtattcgttcgagatgagcggcggtatgttgtagcgtatgatgattgcgatggcggtgttgtgtgaattatcgtttattatcgtcgatgaatcgattatcgattttgacgtggtagtataggcgcgtattttcgatttgttggaaagtattatgtaaaaataagcgtcgggaatgttgttggtgatttatgatatgggcgttgtggcgcgtttggcggatgacgtggcggtgatgtttgacggntagattgttcgaatagggcgatgtagaaaacg

SEQ ID NO: 15486 - DNA, 1045 bp, Artificial Sequence
  chemically treated genomic DNA (Homo sapiens) CpG-island No: 15486
  misc_feature (33)..(33): n is either a, c, g or t
cgttttctacatcgccctattcgaacaatctanccgtcaaacatcaccgccacgtcatccgccaaacgcgccacaacgcccatatcataaatcaccaacaacattcccgacgcttatttttacataatactttccaacaaatcgaaaatacgcgcctatactaccacgtcaaaatcgataatcgattcatcgacgataataaacgataattcacacaacaccgccatcgcaatcatcatacgctacaacataccgccgctcatctcgaacgaatacaacttcaacacgcgcgcgacgttttccaaccccaccgcttctataacaacgataaacgtaacgtcatcgacgaatttccctaacgccaaacaaatttcccgcgcgtaaatatacataatatacaataaattaaaaacgctacgcgaattctacataataataacaattttaataccgcgcaaaacgcaaaacgaaaccgatttaccatcgactaaaatttcccccgccgtctaacgaacgccaacgaacaaaatacccaacgttacgacgcaaattaataatttcccgctaccgctaccgccgactaacgccaacacgcgcccgcgttacaaaattaatcgatacaccgtaaccaacgactacgcgtacctaataaacgcgatattacgtaaattcaatctattacgacattatatatacgtatctccgttcaccaaatataaaatccacgataatcgcgacatatacgtcacccaccaaattaaaaaaccatcaatactacataatcatacgccacgtccccgatccaaaatcatttacatacgactaaatccaaatattactaacgcgcgtcgtttatcatcacgccccattcgacgatcgacgcgatcacaccgaaaccaaaaaaaaaacatccccgcgacgtacaacatcatattaaccgatatccacgcgttaccacgcaccaatcaacgaaaaaatcaccgtcgcctaacctaaataatcgacaaacacccgccacataaaccgcacgaaaaaccgtaacgcc

SEQ ID NO: 15487 - DNA, 1045 bp, Artificial Sequence
  chemically treated genomic DNA (Homo sapiens) CpG-island No: 15487
  misc_feature (33)..(33): n is either a, c, g or t
cgttttttatatcgttttgttcggataatttantcgttagatattatcgttacgttattcgttagacgcgttataacgtttatattatgggttattagtagtattttcggcgtttgtttttgtataatgttttttagtagatcgaggatgcgcgtttgtgttattacgttaaggtcggtggtcggtttatcggcgatgataaacggtgatttatatagtatcgttatcgtaattattatgcgttgtaatatgtcgtcgtttatttcgaacgggtatagttttagtacgcgcgcggcgttttttagttttatcgtttttatggtagcggtaagcgtagcgttatcggcgggtttttttaacgttaggtaggtttttcgcgcgtgggtgtgtatggtgtgtagtggattaaaggcgttgcgcgggttttgtatgatggtggtaattttgatgtcgcgtagggcgtaaggcgaaatcggtttgttatcggttaaaatttttttcgtcgtttggcgaacgttagcgggtaaaatgtttagcgttgcggcgtaggttaatgatttttcgttgtcgttatcgtcgattaacgttagtacgcgttcgcgttgtagggttaatcgatatatcgtgattagcggttgcgcgtgtttggtagacgcgatattacgtaggtttaatttgttgcggtattatgtgtgcgtgttttcgtttattagatgtagggtttacgatgatcgcgatatgtgcgttatttattaggttaaagggttattaatgttgtataattatgcgttacgttttcggtttagaattatttgtatgcggttgggtttagatattattggcgcgcgtcgtttattattacgttttattcggcggtcggcgcggttatatcgaggttaaggaaaagatattttcgcgacgtgtagtattatattggtcgatatttacgcgttgttacgtattagttagcgaagggattatcgtcgtttggtttagatgatcgataaatattcgttatatggatcgtacggaaagtcgtgacgtt

SEQ ID NO: 15488 - DNA, 1045 bp, Artificial Sequence
  chemically treated genomic DNA (Homo sapiens) CpG-island No: 15488
  misc_feature (1013)..(1013): n is either a, c, g or t
aacgtcacgactttccgtacgatccatataacgaatatttatcgatcatctaaaccaaacgacgataatcccttcgctaactaatacgtaacaacgcgtaaatatcgaccaatataatactacacgtcgcgaaaatatcttttccttaacctcgatataaccgcgccgaccgccgaataaaacgtaataataaacgacgcgcgccaataatatctaaacccaaccgcatacaaataattctaaaccgaaaacgtaacgcataattatacaacattaataaccctttaacctaataaataacgcacatatcgcgatcatcgtaaaccctacatctaataaacgaaaacacgcacacataataccgcaacaaattaaacctacgtaatatcgcgtctaccaaacacgcgcaaccgctaatcacgatatatcgattaaccctacaacgcgaacgcgtactaacgttaatcgacgataacgacaacgaaaaatcattaacctacgccgcaacgctaaacattttacccgctaacgttcgccaaacgacgaaaaaaattttaaccgataacaaaccgatttcgccttacgccctacgcgacatcaaaattaccaccatcatacaaaacccgcgcaacgcctttaatccactacacaccatacacacccacgcgcgaaaaacctacctaacgttaaaaaaacccgccgataacgctacgcttaccgctaccataaaaacgataaaactaaaaaacgccgcgcgcgtactaaaactatacccgttcgaaataaacgacgacatattacaacgcataataattacgataacgatactatataaatcaccgtttatcatcgccgataaaccgaccaccgaccttaacgtaataacacaaacgcgcatcctcgatctactaaaaaacattatacaaaaacaaacgccgaaaatactactaataacccataatataaacgttataacgcgtctaacgaataacgtaacgataatatctaacgantaaattatccgaacaaaacgatataaaaaacg

SEQ ID NO: 15489 - DNA, 763 bp, Artificial Sequence
  chemically treated genomic DNA (Homo sapiens) CpG-island No: 15489
  misc_feature (604)..(604): n is either a, c, g or t
attttggtcgtagcgcgcgggcgatgtacgttagtttatttacgtttttacggtagatttagcgtttggaagaagatttcggttagtcgttgtttgtgcgcgataatcgtacggtgacgttgattgaagcgggcgaagagttgcgcgttttcgtttagtaaacgttgttgtagtattagtagttgcgttatattatcgattagtaagggtcgtcgttttttggcgaattatatattttttgttcggtgatcgttgtttatagttatttgtcgtcgattttggatcgttttcgcgcggaatattcgtcggtggagattaaatttattattggtgatgcggtagatgcgatggaaaaggtggttattggtgaagcggatttggcgattgcgggtaaatcggaaattttgttcggcgtagtggcgttttcgatgttggagaatttggtagtagtgttgattgttttcgcgttgttttgttcggtgcgtaattaggtgtcggtagagaagtcggattggttaacggtgtcgtttattatggtcgattaggggtcggtacgtcgtcgtattgaattgtggtttcgacgtaataaaattagtaattcgantatttacgttacggttggcgggtatgaagcgatggtatcgatggtggtattcggttggtggcgtgtgtattgttgtcggaagtggtgttggaaaatagtttcgaatcggtgcgtaatcgcgtgatgattttagagcgtaggattaaaaacgtttttgag

SEQ ID NO: 15490 - DNA, 763 bp, Artificial Sequence
  chemically treated genomic DNA (Homo sapiens) CpG-island No: 15490
  misc_feature (160)..(160): n is either a, c, g or t
ctcaaaaacgtttttaatcctacgctctaaaatcatcacgcgattacgcaccgattcgaaactattttccaacaccacttccgacaacaatacacacgccaccaaccgaataccaccatcgataccatcgcttcatacccgccaaccgtaacgtaaatantcgaattactaattttattacgtcgaaaccacaattcaatacgacgacgtaccgacccctaatcgaccataataaacgacaccgttaaccaatccgacttctctaccgacacctaattacgcaccgaacaaaacaacgcgaaaacaatcaacactactaccaaattctccaacatcgaaaacgccactacgccgaacaaaatttccgatttacccgcaatcgccaaatccgcttcaccaataaccaccttttccatcgcatctaccgcatcaccaataataaatttaatctccaccgacgaatattccgcgcgaaaacgatccaaaatcgacgacaaataactataaacaacgatcaccgaacaaaaaatatataattcgccaaaaaacgacgacccttactaatcgataatataacgcaactactaatactacaacaacgtttactaaacgaaaacgcgcaactcttcgcccgcttcaatcaacgtcaccgtacgattatcgcgcacaaacaacgactaaccgaaatcttcttccaaacgctaaatctaccgtaaaaacgtaaataaactaacgtacatcgcccgcgcgctacgaccaaaat

SEQ ID NO: 15491 - DNA, 763 bp, Artificial Sequence
  chemically treated genomic DNA (Homo sapiens) CpG-island No: 15491
  misc_feature (160)..(160): n is either a, c, g or t
tttaaaggcgtttttaattttgcgttttaaaattattacgcggttacgtatcggttcggggttgttttttagtattattttcggtaataatgtatacgttattagtcgagtgttattatcgatattatcgttttatgttcgttaatcgtggcgtaaatantcgggttattgattttattgcgtcgaaattatagtttaatgcggcggcgtatcggtttttgatcggttataataaacggtatcgttgattagttcggtttttttatcgatatttgattacgtatcgggtagggtagcgcgggggtaattagtattattgttagattttttagtatcgaaaacgttattgcgtcgggtaaggttttcggtttattcgtaatcgttagattcgttttattagtgattattttttttatcgtatttgtcgtattattagtagtaagtttaatttttatcgacgggtgtttcgcgcggaagcgatttagaatcggcggtagatggttgtaggtagcggttatcgagtagaagatatgtaattcgttagagagcgacggtttttgttgatcgatggtgtggcgtaattgttgatattgtaatagcgtttgttgggcgaaaacgcgtagtttttcgttcgttttagttagcgttatcgtgcggttatcgcgtataaatagcggttgatcgagatttttttttaggcgttgaatttgtcgtgagagcgtggatgggttaacgtgtatcgttcgcgcgttgcggttaaaat

SEQ ID NO: 15492 - DNA, 763 bp, Artificial Sequence
  chemically treated genomic DNA (Homo sapiens) CpG-island No: 15492
  misc_feature (604)..(604): n is either a, c, g or t
attttaaccgcaacgcgcgaacgatacacgttaacccatccacgctctcacgacaaattcaacgcctaaaaaaaaatctcgatcaaccgctatttatacgcgataaccgcacgataacgctaactaaaacgaacgaaaaactacgcgttttcgcccaacaaacgctattacaatatcaacaattacgccacaccatcgatcaacaaaaaccgtcgctctctaacgaattacatatcttctactcgataaccgctacctacaaccatctaccgccgattctaaatcgcttccgcgcgaaacacccgtcgataaaaattaaacttactactaataatacgacaaatacgataaaaaaaataatcactaataaaacgaatctaacgattacgaataaaccgaaaaccttacccgacgcaataacgttttcgatactaaaaaatctaacaataatactaattacccccgcgctaccctacccgatacgtaatcaaatatcgataaaaaaaccgaactaatcaacgataccgtttattataaccgatcaaaaaccgatacgccgccgcattaaactataatttcgacgcaataaaatcaataacccgantatttacgccacgattaacgaacataaaacgataatatcgataataacactcgactaataacgtatacattattaccgaaaataatactaaaaaacaaccccgaaccgatacgtaaccgcgtaataattttaaaacgcaaaattaaaaacgcctttaaa

SEQ ID NO: 15493 - DNA, 654 bp, Artificial Sequence
  chemically treated genomic DNA (Homo sapiens) CpG-island No: 15493
cgaatattcgttttttttgtcgtcgtttcggtattttatttgtaacgcggttataagtggttttagcgttgggtttaggaaggtgtcgtcggtttttaggatcgttcgcgtatttcgtattatttttcgaatcgtttatttgacgatattacggttttgttgcgtatggtttatgatcgttatgaacgttggggagttcgtaagattaagcgttggttcgaggattaggggtatattatgttcgtttttagtatcgtttataatttgatggttcgttatggtttgttgtcgggcgttttatcgggtattttcgttacgggtcggttcgaatacgacgcgtcgaatcgtttttggtagatggattttaagggttattttttttttggcggtggacgttgttattcgtttattttgttggacgattattttcgtttttttttgtgtttggcgtattgtatcgatgaacggcgcgagatcgtgtagtagtagttggttagcgtgtttgagcgttacggtttgtcggatcggatgattaatgggattacggggtataacgtggaggcggaaatataatacggggaatttggaattggcggttagggaagttagtagagtttgattgtagtttagggtattttcgggttaggggtaatt

SEQ ID NO: 15494 - DNA, 654 bp, Artificial Sequence
  chemically treated genomic DNA (Homo sapiens) CpG-island No: 15494
aattacccctaacccgaaaataccctaaactacaatcaaactctactaacttccctaaccgccaattccaaattccccgtattatatttccgcctccacgttataccccgtaatcccattaatcatccgatccgacaaaccgtaacgctcaaacacgctaaccaactactactacacgatctcgcgccgttcatcgatacaatacgccaaacacaaaaaaaaacgaaaataatcgtccaacaaaataaacgaataacaacgtccaccgccaaaaaaaaaataacccttaaaatccatctaccaaaaacgattcgacgcgtcgtattcgaaccgacccgtaacgaaaatacccgataaaacgcccgacaacaaaccataacgaaccatcaaattataaacgatactaaaaacgaacataatatacccctaatcctcgaaccaacgcttaatcttacgaactccccaacgttcataacgatcataaaccatacgcaacaaaaccgtaatatcgtcaaataaacgattcgaaaaataatacgaaatacgcgaacgatcctaaaaaccgacgacaccttcctaaacccaacgctaaaaccacttataaccgcgttacaaataaaataccgaaacgacgacaaaaaaaacgaatattcg

SEQ ID NO: 15495 - DNA, 654 bp, Artificial Sequence
  chemically treated genomic DNA (Homo sapiens) CpG-island No: 15495
agttgtttttaattcgggaatattttaggttgtaattaagttttattagtttttttagtcgttagttttaagtttttcgtgttgtgttttcgtttttacgttgtatttcgtaattttattggttattcggttcggtaggtcgtaacgtttaaatacgttgattagttgttgttgtacggtttcgcgtcgtttatcggtatagtgcgttaggtatagggaaaaacgggagtggtcgtttagtagggtgagcggatggtagcgtttatcgttaaaaggaaagtggtttttaaaatttatttgttagaggcggttcggcgcgtcgtgttcgaatcggttcgtggcgggaatgttcggtgaagcgttcggtagtaggttatggcgggttattaggttatggacggtgttgaaggcgggtatggtgtgtttttggttttcgagttagcgtttaattttgcgggttttttagcgtttatgacggttatgggttatacgtagtagggtcgtgatgtcgttagatgagcggttcggggaatggtgcggaatgcgcgggcggttttgaagatcggcggtatttttttgagtttagcgttggagttatttgtagtcgcgttgtaggtgaaatgtcgaagcgacggtagagggaacggatgttcg

SEQ ID NO: 15496 - DNA, 654 bp, Artificial Sequence
  chemically treated genomic DNA (Homo sapiens) CpG-island No: 15496
cgaacatccgttccctctaccgtcgcttcgacatttcacctacaacgcgactacaaataactccaacgctaaactcaaaaaaataccgccgatcttcaaaaccgcccgcgcattccgcaccattccccgaaccgctcatctaacgacatcacgaccctactacgtataacccataaccgtcataaacgctaaaaaacccgcaaaattaaacgctaactcgaaaaccaaaaacacaccatacccgccttcaacaccgtccataacctaataacccgccataacctactaccgaacgcttcaccgaacattcccgccacgaaccgattcgaacacgacgcgccgaaccgcctctaacaaataaattttaaaaaccactttccttttaacgataaacgctaccatccgctcaccctactaaacgaccactcccgtttttccctatacctaacgcactataccgataaacgacgcgaaaccgtacaacaacaactaatcaacgtatttaaacgttacgacctaccgaaccgaataaccaataaaattacgaaatacaacgtaaaaacgaaaacacaacacgaaaaacttaaaactaacgactaaaaaaactaataaaacttaattacaacctaaaatattcccgaattaaaaacaact

SEQ ID NO: 15497 - DNA, 749 bp, Artificial Sequence
  chemically treated genomic DNA (Homo sapiens) CpG-island No: 15497
ggttttagtggtaggaggcgtttggaggaagcgcgggtttttaattttaacgttatttttaatattttttttacgcgtttcgagcgttatgtgtttttaagatcggtgcgggggcggggcgttttgggtagggttgtaggtgacgttatttcgggttttgggattcggagagcgtttggaggcggggtttggattttacgttcggcgcgttttttttttttaaggcgcgcggtcgggcggggtttttatgatttttttaaggcgcggttagagttttttcgtagaaaaacgatttaaaggagacgcgtggcgcgatggcggcggttttacgcgcgggtcggcggcgcgggtagtcgtttttggcgttgttgtttttgttgttggcgttattgtcgtcgggggtttcgtcgggcgtcgacgtttattttttcgaggagcgttggagttcggagtcgtttttgtaggcgtcgcgcgtgtttatcgcgttgttggcgcgaaacgcggtttacgcgttgtttattacgttgggcgtattcgagcggttgcggtattcgcgggagcgtacggcgttatggtgagtcgagttcgttgtttttattaggcgggttacgcgagtttttgtttgttgtttttataggggtgggtttacgcgagtttcgtgttcgcgtgtttttttttgggcgggttcgcgcgtgttttcgtgtcgttattttatcgggacggttttaagtatgtttttgttcgtggtt

SEQ ID NO: 15498 - DNA, 749 bp, Artificial Sequence
  chemically treated genomic DNA (Homo sapiens) CpG-island No: 15498
aaccacgaacaaaaacatacttaaaaccgtcccgataaaataacgacacgaaaacacgcgcgaacccgcccaaaaaaaaacacgcgaacacgaaactcgcgtaaacccacccctataaaaacaacaaacaaaaactcgcgtaacccgcctaataaaaacaacgaactcgactcaccataacgccgtacgctcccgcgaataccgcaaccgctcgaatacgcccaacgtaataaacaacgcgtaaaccgcgtttcgcgccaacaacgcgataaacacgcgcgacgcctacaaaaacgactccgaactccaacgctcctcgaaaaaataaacgtcgacgcccgacgaaacccccgacgacaataacgccaacaacaaaaacaacaacgccaaaaacgactacccgcgccgccgacccgcgcgtaaaaccgccgccatcgcgccacgcgtctcctttaaatcgtttttctacgaaaaaactctaaccgcgccttaaaaaaatcataaaaaccccgcccgaccgcgcgccttaaaaaaaaaaaacgcgccgaacgtaaaatccaaaccccgcctccaaacgctctccgaatcccaaaacccgaaataacgtcacctacaaccctacccaaaacgccccgcccccgcaccgatcttaaaaacacataacgctcgaaacgcgtaaaaaaaatattaaaaataacgttaaaattaaaaacccgcgcttcctccaaacgcctcctaccactaaaacc

SEQ ID NO: 15499 - DNA, 749 bp, Artificial Sequence
  chemically treated genomic DNA (Homo sapiens) CpG-island No: 15499
ggttacgggtaggggtatgtttagaatcgtttcgatggggtagcgatacggaagtacgcgcggattcgtttagaagaggatacgcgggtacggggttcgcgtggatttatttttatggggatagtaagtaggggttcgcgtgattcgtttgatggggatagcgggttcgatttattatagcgtcgtgcgttttcgcgggtgtcgtagtcgttcgagtgcgtttagcgtggtgggtaacgcgtgggtcgcgtttcgcgttaatagcgcgatgagtacgcgcggcgtttgtaggggcgatttcgggttttagcgtttttcggggaagtaggcgtcggcgttcggcggggttttcggcggtagtggcgttagtagtagaagtagtagcgttaggagcggttgttcgcgtcgtcggttcgcgcgtggggtcgtcgttatcgcgttacgcgttttttttaagtcgtttttttgcgggaggattttggtcgcgttttaaaggggttataggggtttcgttcggtcgcgcgttttaaaggggaggagcgcgtcgggcgtgaagtttaggtttcgtttttagacgtttttcgagttttaaggttcggagtgacgttatttgtagttttatttaggacgtttcgttttcgtatcgattttaaaggtatatagcgttcggagcgcgtggaagggatgttaggggtagcgttagggttaggaattcgcgttttttttaggcgttttttattattgagatt

SEQ ID NO: 15500 - DNA, 749 bp, Artificial Sequence
  chemically treated genomic DNA (Homo sapiens) CpG-island No: 15500
aatctcaataataaaaaacgcctaaaaaaaacgcgaattcctaaccctaacgctacccctaacatcccttccacgcgctccgaacgctatatacctttaaaatcgatacgaaaacgaaacgtcctaaataaaactacaaataacgtcactccgaaccttaaaactcgaaaaacgtctaaaaacgaaacctaaacttcacgcccgacgcgctcctcccctttaaaacgcgcgaccgaacgaaacccctataacccctttaaaacgcgaccaaaatcctcccgcaaaaaaacgacttaaaaaaaacgcgtaacgcgataacgacgaccccacgcgcgaaccgacgacgcgaacaaccgctcctaacgctactacttctactactaacgccactaccgccgaaaaccccgccgaacgccgacgcctacttccccgaaaaacgctaaaacccgaaatcgcccctacaaacgccgcgcgtactcatcgcgctattaacgcgaaacgcgacccacgcgttacccaccacgctaaacgcactcgaacgactacgacacccgcgaaaacgcacgacgctataataaatcgaacccgctatccccatcaaacgaatcacgcgaacccctacttactatccccataaaaataaatccacgcgaaccccgtacccgcgtatcctcttctaaacgaatccgcgcgtacttccgtatcgctaccccatcgaaacgattctaaacatacccctacccgtaacc

SEQ ID NO: 15501 - DNA, 661 bp, Artificial Sequence
  chemically treated genomic DNA (Homo sapiens) CpG-island No: 15501
ttgagtggttattgcggcggatttttcgtattggcgcgtatattcgtgggtggtttgtcggacgtaagcgtcgtcgtgtacgtaagtagatcgaataggcgttgttgaaattggcggaaggcgattattagtaagttgaaaagttgatggcgaaaaatgtcgattacgcggaataatcggtggtgaattatttattggttgtcgaagtcgcgtaataacgtggtgatgaagtacgcgttaattaatatttggaacgtagtagcggagttggtcggtaacgatattatatcggtagaaattattcgcgatacgtttagtaattggttcgtattgaaaattttgttgtacgttacggcgatggataagattgttggatacgttatagcgaaggttattatcgatagtataatcgtttaggatagcgaatacggcgtaatatttcgatattagcgtatggacgtacgttagcgcggtattttattttcgaataatcggatcgaaagattacgatcggtagatagtacgaatttttagacgttacgtttcggaattaatatcgtcgcggatatgggtacgaagagaatatacgagttagtcgtaaatagaagaaaaagttagtatattacgaggtataaatatatattaatacgcgtttgaataa

SEQ ID NO: 15502 - DNA, 661 bp, Artificial Sequence
  chemically treated genomic DNA (Homo sapiens) CpG-island No: 15502
ttattcaaacgcgtattaatatatatttatacctcgtaatatactaactttttcttctatttacgactaactcgtatattctcttcgtacccatatccgcgacgatattaattccgaaacgtaacgtctaaaaattcgtactatctaccgatcgtaatctttcgatccgattattcgaaaataaaataccgcgctaacgtacgtccatacgctaatatcgaaatattacgccgtattcgctatcctaaacgattatactatcgataataaccttcgctataacgtatccaacaatcttatccatcgccgtaacgtacaacaaaattttcaatacgaaccaattactaaacgtatcgcgaataatttctaccgatataatatcgttaccgaccaactccgctactacgttccaaatattaattaacgcgtacttcatcaccacgttattacgcgacttcgacaaccaataaataattcaccaccgattattccgcgtaatcgacatttttcgccatcaacttttcaacttactaataatcgccttccgccaatttcaacaacgcctattcgatctacttacgtacacgacgacgcttacgtccgacaaaccacccacgaatatacgcgccaatacgaaaaatccgccgcaataaccactcaa

SEQ ID NO: 15503 - DNA, 661 bp, Artificial Sequence
  chemically treated genomic DNA (Homo sapiens) CpG-island No: 15503
ttgtttaggcgcgtgttggtgtgtgtttgtgtttcgtgatgtgttgatttttttttttgtttgcggttggttcgtgtatttttttcgtgtttatgttcgcggcggtgttggtttcgaggcgtggcgtttgagggttcgtgttgtttgtcggtcgtggtttttcggttcggttgttcggggatgagatgtcgcgttggcgtgcgtttatgcgttggtgtcgggatattacgtcgtgttcgttgttttagacggttatattgtcggtgatggttttcgttgtgacgtgtttagtagttttatttatcgtcgtggcgtgtagtagggtttttagtacgggttagttgttagacgtatcgcgggtgatttttatcggtatggtgtcgttgtcggttagtttcgttgttgcgttttagatgttggttggcgcgtgttttattattacgttgttgcgcggtttcggtagttagtagatagtttattatcggttgtttcgcgtgatcggtatttttcgttattagttttttaatttgttgataatcgtttttcgttagttttagtagcgtttgttcggtttgtttacgtgtacggcgacgtttacgttcgataaattatttacgggtgtgcgcgttagtgcggaagattcgtcgtagtagttatttaa

SEQ ID NO: 15504 - DNA, 661 bp, Artificial Sequence
  chemically treated genomic DNA (Homo sapiens) CpG-island No: 15504
ttaaataactactacgacgaatcttccgcactaacgcgcacacccgtaaataatttatcgaacgtaaacgtcgccgtacacgtaaacaaaccgaacaaacgctactaaaactaacgaaaaacgattatcaacaaattaaaaaactaataacgaaaaataccgatcacgcgaaacaaccgataataaactatctactaactaccgaaaccgcgcaacaacgtaataataaaacacgcgccaaccaacatctaaaacgcaacaacgaaactaaccgacaacgacaccataccgataaaaatcacccgcgatacgtctaacaactaacccgtactaaaaaccctactacacgccacgacgataaataaaactactaaacacgtcacaacgaaaaccatcaccgacaatataaccgtctaaaacaacgaacacgacgtaatatcccgacaccaacgcataaacgcacgccaacgcgacatctcatccccgaacaaccgaaccgaaaaaccacgaccgacaaacaacacgaaccctcaaacgccacgcctcgaaaccaacaccgccgcgaacataaacacgaaaaaaatacacgaaccaaccgcaaacaaaaaaaaaaatcaacacatcacgaaacacaaacacacaccaacacgcgcctaaacaa

SEQ ID NO: 15505 - DNA, 598 bp, Artificial Sequence
  chemically treated genomic DNA (Homo sapiens) CpG-island No: 15505
tcgcgatgatcgttttcggtgcgcgggcgataaagttttcgttcgttagttgttttcgatacggttgattttatttttaattttcgttatttttttcgttagacgcgttagtttatttttttgttgatgaggttagttatcgggattagtagttttgtatcgtcgatgattttcgtaacggaaatcggatttttgttatcggtaggtagtacggtgatattttttagacgcgttagggtttgtaggaagttacggtttttatttacgcgacgttttgtattcgcgttgtaattacgtagtagtagttttagcggtttgttcggcgcgatgtttatttttgtacggatgttacgtatcgtaacgatcgtttgttttagttattcggtgtcggttagtgcggttttattaatttgagatgtatcgtattgcgggaacggttgtagtatgatggtgtcggtagtgatatcgtaaagtatttttatacgttgttagatggtttcggtgatgaacggaatgatcggatgcgcgaggcgtagtagattttttagtatagttattagcgtatggcgagtatcgcgtagttttgtttcggtgttat

SEQ ID NO: 15506 - DNA, 598 bp, Artificial Sequence
  chemically treated genomic DNA (Homo sapiens) CpG-island No: 15506
ataacaccgaaacaaaactacgcgatactcgccatacgctaataactatactaaaaaatctactacgcctcgcgcatccgatcattccgttcatcaccgaaaccatctaacaacgtataaaaatactttacgatatcactaccgacaccatcatactacaaccgttcccgcaatacgatacatctcaaattaataaaaccgcactaaccgacaccgaataactaaaacaaacgatcgttacgatacgtaacatccgtacaaaaataaacatcgcgccgaacaaaccgctaaaactactactacgtaattacaacgcgaatacaaaacgtcgcgtaaataaaaaccgtaacttcctacaaaccctaacgcgtctaaaaaatatcaccgtactacctaccgataacaaaaatccgatttccgttacgaaaatcatcgacgatacaaaactactaatcccgataactaacctcatcaacaaaaaaataaactaacgcgtctaacgaaaaaaataacgaaaattaaaaataaaatcaaccgtatcgaaaacaactaacgaacgaaaactttatcgcccgcgcaccgaaaacgatcatcgcga

SEQ ID NO: 15507 - DNA, 598 bp, Artificial Sequence
  chemically treated genomic DNA (Homo sapiens) CpG-island No: 15507
gtggtatcgaagtagaattgcgcggtattcgttatacgttggtgattgtattggaaggtttgttgcgtttcgcgtattcgattatttcgtttattatcgaaattatttggtagcgtgtgaaagtattttgcggtattattgtcgatattattatgttgtagtcgttttcgtagtacgatgtattttaggttgatgaagtcgtattggtcgatatcgaatggttgaaataggcgatcgttgcggtacgtaatattcgtgtagaaatgaatatcgcgtcgggtaaatcgttggagttgttgttgcgtggttgtagcgcggatgtagaacgtcgcgtaaatgaaaatcgtggttttttgtaaattttggcgcgtttggaaagtattatcgtgttgtttgtcgatgataaaggttcggttttcgttacgaagattatcgacggtgtagagttgttgatttcgatggttggttttattaataagaagatgagttggcgcgtttggcgaaagaagtggcgaagattgaaggtgaaattagtcgtatcgagaataattggcgaacgaaggttttgtcgttcgcgtatcggaagcggttatcgcga

SEQ ID NO: 15508 - DNA, 598 bp, Artificial Sequence
  chemically treated genomic DNA (Homo sapiens) CpG-island No: 15508
tcgcgataaccgcttccgatacgcgaacgacaaaaccttcgttcgccaattattctcgatacgactaatttcaccttcaatcttcgccacttctttcgccaaacgcgccaactcatcttcttattaataaaaccaaccatcgaaatcaacaactctacaccgtcgataatcttcgtaacgaaaaccgaacctttatcatcgacaaacaacacgataatactttccaaacgcgccaaaatttacaaaaaaccacgattttcatttacgcgacgttctacatccgcgctacaaccacgcaacaacaactccaacgatttacccgacgcgatattcatttctacacgaatattacgtaccgcaacgatcgcctatttcaaccattcgatatcgaccaatacgacttcatcaacctaaaatacatcgtactacgaaaacgactacaacataataatatcgacaataataccgcaaaatactttcacacgctaccaaataatttcgataataaacgaaataatcgaatacgcgaaacgcaacaaaccttccaatacaatcaccaacgtataacgaataccgcgcaattctacttcgataccac

SEQ ID NO: 15509 - DNA, 515 bp, Artificial Sequence
  chemically treated genomic DNA (Homo sapiens) CpG-island No: 15509
gatattacgtcgattatcgagaagtgaggattttataggtcgagagtttacgtgaagtcggagttcgtcggtgattgatagacgttttgaattttatagatgtcgtcgttttttatatttgcgcgcgttttgtttttttttcgcgtttcgcgaggtttcgtttcgcgtatgagcgacgtaaatatcgttttcgtagttcgcgatagttagtatcgttttagttaggcgtttgcgcgtttacgtattatttgtcgggagttgtagtttcggttcggtagattcggcgagtttagtggtcgcgtttcggtgcggcggcgttcgaggttcgaggcggaagtgggacggttaagtagggaagcgagggttcgggatcgacggtcgcggggcgtcgacgaggagtgtaggatttaggaagggcgagtgcgcggcgatagagttcggggaaggaggtagggtaaggtcgggtttgggggtaggtggttcgggtatttagttttgaagatgtataagaggaa

SEQ ID NO: 15510 - DNA, 515 bp, Artificial Sequence
  chemically treated genomic DNA (Homo sapiens) CpG-island No: 15510
ttcctcttatacatcttcaaaactaaatacccgaaccacctacccccaaacccgaccttaccctacctccttccccgaactctatcgccgcgcactcgcccttcctaaatcctacactcctcgtcgacgccccgcgaccgtcgatcccgaaccctcgcttccctacttaaccgtcccacttccgcctcgaacctcgaacgccgccgcaccgaaacgcgaccactaaactcgccgaatctaccgaaccgaaactacaactcccgacaaataatacgtaaacgcgcaaacgcctaactaaaacgatactaactatcgcgaactacgaaaacgatatttacgtcgctcatacgcgaaacgaaacctcgcgaaacgcgaaaaaaaaacaaaacgcgcgcaaatataaaaaacgacgacatctataaaattcaaaacgtctatcaatcaccgacgaactccgacttcacgtaaactctcgacctataaaatcctcacttctcgataatcgacgtaatatc

SEQ ID NO: 15511 - DNA, 515 bp, Artificial Sequence
  chemically treated genomic DNA (Homo sapiens) CpG-island No: 15511
ttttttttgtgtatttttaaggttggatgttcggattatttgtttttaagttcggttttgttttgttttttttttcgggttttgtcgtcgcgtattcgttttttttgagttttgtatttttcgtcggcgtttcgcggtcgtcgatttcgagttttcgtttttttgtttggtcgttttattttcgtttcgggtttcgggcgtcgtcgtatcggagcgcggttattgggttcgtcgggtttgtcgagtcgaaattataattttcggtaggtagtgcgtgggcgcgtaggcgtttggttggggcggtgttgattgtcgcgggttgcgagggcggtgtttgcgtcgtttatgcgcggggcgggatttcgcggggcgcgggaaagaggtagagcgcgcgtaggtgtgaggggcggcgatatttgtggggtttagagcgtttgttagttatcgacgggtttcggttttacgtgggttttcggtttgtggagtttttatttttcggtggtcggcgtagtgtt

SEQ ID NO: 15512 - DNA, 515 bp, Artificial Sequence
  chemically treated genomic DNA (Homo sapiens) CpG-island No: 15512
aacactacgccgaccaccgaaaaataaaaactccacaaaccgaaaacccacgtaaaaccgaaacccgtcgataactaacaaacgctctaaaccccacaaatatcgccgcccctcacacctacgcgcgctctacctctttcccgcgccccgcgaaatcccgccccgcgcataaacgacgcaaacaccgccctcgcaacccgcgacaatcaacaccgccccaaccaaacgcctacgcgcccacgcactacctaccgaaaattataatttcgactcgacaaacccgacgaacccaataaccgcgctccgatacgacgacgcccgaaacccgaaacgaaaataaaacgaccaaacaaaaaaacgaaaactcgaaatcgacgaccgcgaaacgccgacgaaaaatacaaaactcaaaaaaaacgaatacgcgacgacaaaacccgaaaaaaaaaacaaaacaaaaccgaacttaaaaacaaataatccgaacatccaaccttaaaaatacacaaaaaaaa

SEQ ID NO: 15513 - DNA, 833 bp, Artificial Sequence
  chemically treated genomic DNA (Homo sapiens) CpG-island No: 15513
tcggtcgggttatgttgattgttttttcgcggcgttcggaagcgatttttagtaaataaagtcgtgtgtgggcgtagttttagaagtttggggcgcgtagtttagtttaagagaggcgggggaggaatgttgtgaatgaatttcgggttcgtttcgaaatttcgtataaggtttgggtcgcgggggtttttttattttgattggtttttggcgtttcgtgattgatagcgtttttcgttgtgcgttttggttgggtaaataagaaaagattggtatcgtagttatcgagtgagtagcgaggtttggatacgggtttggcggcgtagttaatggcgggggagggtcgaggaggtcgagggggggttaatagggataggcggtgggggcgggacgacggcggagttaaagcggcggttgaagtagttttattgttgtgaagagttttaaaggggtcgtattattttgtcggttcggcgcgggtcgggggtgggtgcggtaggggttcggggcggtcgagcgtagaggacggacgggaaggagggtagggggcgcgggagtcggcgaagcggagcgggtatcggatcgagttttttaaagaggtttcgtttcggttttggtttcggtcgggtcggatggaatttttcgcggttaagcggagtcggggttgtttcgcgggattcgaggagcgcgatgtcggggtcggggtcgcgcgtggtcggggtcggttcgaggcgttgttggattttagcgttaagcgggtagtcgagagttgggttttcgagtaggtgatcgcgggggaagggggcgggggtagggacgtatttttagtattt

SEQ ID NO: 15514 - DNA, 833 bp, Artificial Sequence
  chemically treated genomic DNA (Homo sapiens) CpG-island No: 15514
aaatactaaaaatacgtccctacccccgcccccttcccccgcgatcacctactcgaaaacccaactctcgactacccgcttaacgctaaaatccaacaacgcctcgaaccgaccccgaccacgcgcgaccccgaccccgacatcgcgctcctcgaatcccgcgaaacaaccccgactccgcttaaccgcgaaaaattccatccgacccgaccgaaaccaaaaccgaaacgaaacctctttaaaaaactcgatccgatacccgctccgcttcgccgactcccgcgccccctaccctccttcccgtccgtcctctacgctcgaccgccccgaacccctaccgcacccacccccgacccgcgccgaaccgacaaaataatacgacccctttaaaactcttcacaacaataaaactacttcaaccgccgctttaactccgccgtcgtcccgcccccaccgcctatccctattaaccccccctcgacctcctcgaccctcccccgccattaactacgccgccaaacccgtatccaaacctcgctactcactcgataactacgataccaatcttttcttatttacccaaccaaaacgcacaacgaaaaacgctatcaatcacgaaacgccaaaaaccaatcaaaataaaaaaacccccgcgacccaaaccttatacgaaatttcgaaacgaacccgaaattcattcacaacattcctcccccgcctctcttaaactaaactacgcgccccaaacttctaaaactacgcccacacacgactttatttactaaaaatcgcttccgaacgccgcgaaaaaacaatcaacataacccgaccga

SEQ ID NO: 15515 - DNA, 833 bp, Artificial Sequence
  chemically treated genomic DNA (Homo sapiens) CpG-island No: 15515
aggtgttgggggtgcgtttttgttttcgtttttttttttcgcggttatttgttcgaaggtttagttttcggttattcgtttggcgttgaggtttagtagcgtttcgggtcggtttcggttacgcgcggtttcggtttcggtatcgcgtttttcgggtttcgcggggtagtttcggtttcgtttggtcgcggggggttttattcggttcggtcggggttagggtcggggcggggtttttttggggggttcggttcgatgttcgtttcgtttcgtcggttttcgcgttttttgttttttttttcgttcgttttttgcgttcggtcgtttcggatttttatcgtatttattttcgattcgcgtcgggtcggtagggtgatgcggtttttttaagattttttataataatgaagttgttttagtcgtcgttttagtttcgtcgtcgtttcgtttttatcgtttgtttttattggttttttttcggttttttcggttttttttcgttattggttgcgtcgttagattcgtgtttaagtttcgttgtttattcgatgattgcgatgttagtttttttttgtttatttaattagagcgtatagcgaggggcgttgttaattacggggcgttagaggttaattagagtgggaggattttcgcggtttaggttttatgcggagtttcggggcgggttcggggtttatttataatatttttttttcgttttttttgggttggattgcgcgttttaggtttttggggttgcgtttatatacggttttgtttattgagggtcgttttcgggcgtcgcgaggggataattaatatagttcggtcgg

SEQ ID NO: 15516 - DNA, 833 bp, Artificial Sequence
  chemically treated genomic DNA (Homo sapiens) CpG-island No: 15516
ccgaccgaactatattaattatcccctcgcgacgcccgaaaacgaccctcaataaacaaaaccgtatataaacgcaaccccaaaaacctaaaacgcgcaatccaacccaaaaaaaacgaaaaaaaaatattataaataaaccccgaacccgccccgaaactccgcataaaacctaaaccgcgaaaatcctcccactctaattaacctctaacgccccgtaattaacaacgcccctcgctatacgctctaattaaataaacaaaaaaaaactaacatcgcaatcatcgaataaacaacgaaacttaaacacgaatctaacgacgcaaccaataacgaaaaaaaaccgaaaaaaccgaaaaaaaaccaataaaaacaaacgataaaaacgaaacgacgacgaaactaaaacgacgactaaaacaacttcattattataaaaaatcttaaaaaaaccgcatcaccctaccgacccgacgcgaatcgaaaataaatacgataaaaatccgaaacgaccgaacgcaaaaaacgaacgaaaaaaaaaacaaaaaacgcgaaaaccgacgaaacgaaacgaacatcgaaccgaaccccccaaaaaaaccccgccccgaccctaaccccgaccgaaccgaataaaaccccccgcgaccaaacgaaaccgaaactaccccgcgaaacccgaaaaacgcgataccgaaaccgaaaccgcgcgtaaccgaaaccgacccgaaacgctactaaacctcaacgccaaacgaataaccgaaaactaaaccttcgaacaaataaccgcgaaaaaaaaaaacgaaaacaaaaacgcacccccaacacct

SEQ ID NO: 15517 - DNA, 606 bp, Artificial Sequence
  chemically treated genomic DNA (Homo sapiens) CpG-island No: 15517
cgtgacgtcgttgagatagatagagatatttatttattagattaaagttatttgggtagggcgaataaacgggattttcgagtggtacgtttttaaggcggggcgggaatacggtaacgggtcgcgggggttgttattgtcgttattaattaagagtcgagatggttttgatggataggtatagcgcgagtgcgggttttcgtttaatcggcgggtcgttgtttcgaaaaaggattaatgaggaggcggtaggggtggggcgaaggggtcggttgtttcggaagtggagggagggggtgaaaatggcgtttagttcgaaatcggagcggaatagcggggttgggagcggcggcggcggtttcgggggagtcggagggaagcgggtagtagggcggcggcgcggagtacgtttttaagtagttggagcgggttaaggtgaggtttggagtcggagtggggagcgcgtcggagggtggggagtagggacgagggaggcggagcggaggacgggcgtcgcggggtgaggggttgggggcggggttttagggagggggttcggatgtagggtttgggcggggttcgggggagatggtttggatggagggg

SEQ ID NO: 15518 - DNA, 606 bp, Artificial Sequence
  chemically treated genomic DNA (Homo sapiens) CpG-island No: 15518
cccctccatccaaaccatctcccccgaaccccgcccaaaccctacatccgaaccccctccctaaaaccccgcccccaacccctcaccccgcgacgcccgtcctccgctccgcctccctcgtccctactccccaccctccgacgcgctccccactccgactccaaacctcaccttaacccgctccaactacttaaaaacgtactccgcgccgccgccctactacccgcttccctccgactcccccgaaaccgccgccgccgctcccaaccccgctattccgctccgatttcgaactaaacgccattttcaccccctccctccacttccgaaacaaccgaccccttcgccccacccctaccgcctcctcattaatcctttttcgaaacaacgacccgccgattaaacgaaaacccgcactcgcgctatacctatccatcaaaaccatctcgactcttaattaataacgacaataacaacccccgcgacccgttaccgtattcccgccccgccttaaaaacgtaccactcgaaaatcccgtttattcgccctacccaaataactttaatctaataaataaatatctctatctatctcaacgacgtcacg

SEQ ID NO: 15519 - DNA, 606 bp, Artificial Sequence
  chemically treated genomic DNA (Homo sapiens) CpG-island No: 15519
tttttttatttaagttatttttttcgggtttcgtttaggttttgtattcgagttttttttttggggtttcgtttttaattttttatttcgcgacgttcgtttttcgtttcgtttttttcgtttttattttttatttttcggcgcgttttttatttcggttttaggttttattttgattcgttttagttgtttgaggacgtgtttcgcgtcgtcgttttgttgttcgttttttttcggttttttcggggtcgtcgtcgtcgtttttagtttcgttgtttcgtttcgatttcgagttgggcgttatttttattttttttttttattttcggagtaatcggttttttcgttttatttttgtcgtttttttattggttttttttcgggatagcggttcgtcggttgggcgaaagttcgtattcgcgttatgtttgtttattaaagttatttcgatttttgattggtagcgatagtaatagttttcgcggttcgttgtcgtattttcgtttcgttttaaggacgtattattcggaggtttcgtttgttcgttttgtttagataattttgatttgataggtgaatatttttgtttgttttaacggcgttacg

SEQ ID NO: 15520 - DNA, 606 bp, Artificial Sequence
  chemically treated genomic DNA (Homo sapiens) CpG-island No: 15520
cgtaacgccgttaaaacaaacaaaaatattcacctatcaaatcaaaattatctaaacaaaacgaacaaacgaaacctccgaataatacgtccttaaaacgaaacgaaaatacgacaacgaaccgcgaaaactattactatcgctaccaatcaaaaatcgaaataactttaataaacaaacataacgcgaatacgaactttcgcccaaccgacgaaccgctatcccgaaaaaaaaccaataaaaaaacgacaaaaataaaacgaaaaaaccgattactccgaaaataaaaaaaaaaaataaaaataacgcccaactcgaaatcgaaacgaaacaacgaaactaaaaacgacgacgacgaccccgaaaaaaccgaaaaaaaacgaacaacaaaacgacgacgcgaaacacgtcctcaaacaactaaaacgaatcaaaataaaacctaaaaccgaaataaaaaacgcgccgaaaaataaaaaataaaaacgaaaaaaacgaaacgaaaaacgaacgtcgcgaaataaaaaattaaaaacgaaaccccaaaaaaaaaactcgaatacaaaacctaaacgaaacccgaaaaaaataacttaaataaaaaaa

SEQ ID NO: 15521 - DNA, 1732 bp, Artificial Sequence
  chemically treated genomic DNA (Homo sapiens) CpG-island No: 15521
gcgcgcgttgggaattcgattttttttttcgcgttttttcgtttgcgtttttggttcgtgcgtgtcgtttatttgtgtgcgtgcgtagatgcgtttttagatgcgaatttttggtgtaggttttgtcgtagttcgcgtagttgtaggtgtgagtggcggtgcgtttgcggggttaagagcggcggtcgcgttttggtttggtttttagtagttttagcggggacgtaggcggcgtgaggagatcgcgggcggcggggggcgttaggtttagggttgtcgcggcggcggtcgcgtcgtcgaagagatcgaaggttgggggcgtaggcggcgcgtaatgtaggtcgggttcgggcgcgtcgaaattagggttatcgaaaggcggcgggaaggaggcgcgcggatcgggcgcgggtaggcgcgcggggtcgtcggggttgagcggcggtgtgtcgggcggcggcggggggcggttttcgggatttcgtatgtacgaagtcgtcgggttcggggcgttttcgcgtttgaggtcgcgcggtttacgggttagttcgggggcgtagtcgtagtcgtcgtcgtcgttcgttttagggggttcggttttgattaggcggtcgggcggcgttagtagaaagcggtcgtgtagtgcgggttttagcggcgtatttagttcgggtcgtagtagtttagatattaggttattcgcgggggcgttgtagggcgggggcgcgtcgggttcggggtaatagaacgtagcgcggcgggggcggcggcggcggtttcggggcggtttcggcgtttaggttatttagttttatggataggatgaagtttagtacgttgttgaggtcgtcgtcggtgtcgtcggattcgggttcggcgcgcggttagcgttgcgggcgatagggtaatgggcgtgagcgggcggcggggttcggggggcgttgtttgttttttattattttaagttcgcgattttcgtggttcgtattttttttttttgagtttgtagttttcgttttcgcgttttgttatttcgtagtttacgttttattatttcgagttcgtcgtttacggtttcggtcgtttcgtcgttttcgtcgtttttattttttgtaggtcgcgttcgcggtacgggttggcgaaagtggagaaggacggtaggatgggtttatttagcgttatggtcgggattcggggagaaaggacgcggacggggatatcggtgagtggttgttcgaggtcgggttggtcggggcgcgggcgggcggggacggttttgtgggtcgcggtcgggttcgtttaagttttataggcgcggcgcgcgcgggggtcgggttaaagcggcggcggcggaaacgcgtttcggatggggacgagtttcgggcgtagtttaaatttagtcgcggtatataagtcggcgggcggtagcggtcgtggttattgcggcggtttgggttttgcgttgatagttcggtttttcgcgcgtcgttagggtcgcgtttttttttttttcgggtttcgttttcgttcgttttttcggcgacgttgttaatacgcgttttataatagcggcgtgacgtttagggattttttcgggcgtttcgggttttcgtttgcgcgagtatttcggggatttggagcgggggcggtgtcggggttttttagagatttttaggggagtatcgggtttggcggttttttcggattttttgacggaaggggagattggttt

SEQ ID NO: 15522 - DNA, 1732 bp, Artificial Sequence
  chemically treated genomic DNA (Homo sapiens) CpG-island No: 15522
aaaccaatctccccttccgtcaaaaaatccgaaaaaaccgccaaacccgatactcccctaaaaatctctaaaaaaccccgacaccgcccccgctccaaatccccgaaatactcgcgcaaacgaaaacccgaaacgcccgaaaaaatccctaaacgtcacgccgctattataaaacgcgtattaacaacgtcgccgaaaaaacgaacgaaaacgaaacccgaaaaaaaaaaaaacgcgaccctaacgacgcgcgaaaaaccgaactatcaacgcaaaacccaaaccgccgcaataaccacgaccgctaccgcccgccgacttatataccgcgactaaatttaaactacgcccgaaactcgtccccatccgaaacgcgtttccgccgccgccgctttaacccgacccccgcgcgcgccgcgcctataaaacttaaacgaacccgaccgcgacccacaaaaccgtccccgcccgcccgcgccccgaccaacccgacctcgaacaaccactcaccgatatccccgtccgcgtcctttctccccgaatcccgaccataacgctaaataaacccatcctaccgtccttctccactttcgccaacccgtaccgcgaacgcgacctacaaaaaataaaaacgacgaaaacgacgaaacgaccgaaaccgtaaacgacgaactcgaaataataaaacgtaaactacgaaataacaaaacgcgaaaacgaaaactacaaactcaaaaaaaaaaaatacgaaccacgaaaatcgcgaacttaaaataataaaaaacaaacaacgccccccgaaccccgccgcccgctcacgcccattaccctatcgcccgcaacgctaaccgcgcgccgaacccgaatccgacgacaccgacgacgacctcaacaacgtactaaacttcatcctatccataaaactaaataacctaaacgccgaaaccgccccgaaaccgccgccgccgcccccgccgcgctacgttctattaccccgaacccgacgcgcccccgccctacaacgcccccgcgaataacctaatatctaaactactacgacccgaactaaatacgccgctaaaacccgcactacacgaccgctttctactaacgccgcccgaccgcctaatcaaaaccgaaccccctaaaacgaacgacgacgacgactacgactacgcccccgaactaacccgtaaaccgcgcgacctcaaacgcgaaaacgccccgaacccgacgacttcgtacatacgaaatcccgaaaaccgccccccgccgccgcccgacacaccgccgctcaaccccgacgaccccgcgcgcctacccgcgcccgatccgcgcgcctccttcccgccgcctttcgataaccctaatttcgacgcgcccgaacccgacctacattacgcgccgcctacgcccccaaccttcgatctcttcgacgacgcgaccgccgccgcgacaaccctaaacctaacgccccccgccgcccgcgatctcctcacgccgcctacgtccccgctaaaactactaaaaaccaaaccaaaacgcgaccgccgctcttaaccccgcaaacgcaccgccactcacacctacaactacgcgaactacgacaaaacctacaccaaaaattcgcatctaaaaacgcatctacgcacgcacacaaataaacgacacgcacgaaccaaaaacgcaaacgaaaaaacgcgaaaaaaaaaatcgaattcccaacgcgcgc

SEQ ID NO: 15523 - DNA, 1732 bp, Artificial Sequence
  chemically treated genomic DNA (Homo sapiens) CpG-island No: 15523
gagttaattttttttttcgttaagggattcggggagatcgttaagttcggtgtttttttgagagtttttgagaggtttcgatatcgttttcgttttaggttttcgggatgttcgcgtaggcgggagttcggggcgttcggggggatttttgagcgttacgtcgttgttgtggagcgcgtgttgataacgtcgtcggggagacgggcgggggcggggttcgggagagggggaggcgcggttttggcggcgcgcgaggggtcgggttgttagcgtaaggtttaggtcgtcgtagtggttacggtcgttgtcgttcgtcggtttatatatcgcggttaaatttaggttgcgttcggagttcgtttttattcgggacgcgttttcgtcgtcgtcgttttggttcggttttcgcgcgcgtcgcgtttataaggtttgggcgggttcggtcgcggtttatagagtcgttttcgttcgttcgcgtttcgattagttcggtttcgggtagttatttatcggtgttttcgttcgcgtttttttttttcgggtttcggttatggcgttgagtgaatttattttgtcgtttttttttattttcgttagttcgtgtcgcgagcgcggtttgtaggaggtgagggcggcggggacggcggggcggtcgggatcgtgggcggcgggttcggggtagtagaacgtgggttgcggggtgataggacgcgaaggcggggattgtagatttaggagaggaggatgcgggttacggggatcgcggatttagggtggtaaaaggtaagtagcgtttttcgagtttcgtcgttcgtttacgtttattgttttgtcgttcgtagcgttggtcgcgcgtcgaattcgagttcggcggtatcgacgacgattttaatagcgtgttggattttattttgtttatggggttggatggtttgggcgtcgaggtcgtttcggagtcgtcgtcgtcgttttcgtcgcgttgcgttttattatttcgaattcggcgcgttttcgttttatagcgttttcgcgggtggtttggtgtttgagttgttgcgattcgagttggatgcgtcgttggggttcgtattgtacggtcgttttttgttggcgtcgttcggtcgtttggttaaggtcgagttttttgaagcggacggcggcggcggttacggttgcgttttcgggttgattcgtggatcgcgcggttttaagcgcgagggcgtttcgggttcggcggtttcgtgtatgcgaggtttcgggggtcgtttttcgtcgtcgttcgatatatcgtcgtttagtttcgacggtttcgcgcgtttgttcgcgttcggttcgcgcgtttttttttcgtcgtttttcggtggttttggtttcggcgcgttcgggttcggtttgtattacgcgtcgtttgcgtttttagttttcggttttttcgacgacgcggtcgtcgtcgcggtagttttgggtttggcgtttttcgtcgttcgcggtttttttacgtcgtttgcgttttcgttggagttgttggaggttaagttaaagcgcggtcgtcgtttttggtttcgtaaacgtatcgttatttatatttgtagttacgcgggttgcggtaagatttatattaagagttcgtatttgaaggcgtatttgcgtacgtatataggtgggcggtacgtacgagttaggagcgtaggcggggggacgcgggaggagaggtcggatttttagcgcgcgt

SEQ ID NO: 15524 - DNA, 1732 bp, Artificial Sequence
  chemically treated genomic DNA (Homo sapiens) CpG-island No: 15524
acgcgcgctaaaaatccgacctctcctcccgcgtccccccgcctacgctcctaactcgtacgtaccgcccacctatatacgtacgcaaatacgccttcaaatacgaactcttaatataaatcttaccgcaacccgcgtaactacaaatataaataacgatacgtttacgaaaccaaaaacgacgaccgcgctttaacttaacctccaacaactccaacgaaaacgcaaacgacgtaaaaaaaccgcgaacgacgaaaaacgccaaacccaaaactaccgcgacgacgaccgcgtcgtcgaaaaaaccgaaaactaaaaacgcaaacgacgcgtaatacaaaccgaacccgaacgcgccgaaaccaaaaccaccgaaaaacgacgaaaaaaaaacgcgcgaaccgaacgcgaacaaacgcgcgaaaccgtcgaaactaaacgacgatatatcgaacgacgacgaaaaacgacccccgaaacctcgcatacacgaaaccgccgaacccgaaacgccctcgcgcttaaaaccgcgcgatccacgaatcaacccgaaaacgcaaccgtaaccgccgccgccgtccgcttcaaaaaactcgaccttaaccaaacgaccgaacgacgccaacaaaaaacgaccgtacaatacgaaccccaacgacgcatccaactcgaatcgcaacaactcaaacaccaaaccacccgcgaaaacgctataaaacgaaaacgcgccgaattcgaaataataaaacgcaacgcgacgaaaacgacgacgacgactccgaaacgacctcgacgcccaaaccatccaaccccataaacaaaataaaatccaacacgctattaaaatcgtcgtcgataccgccgaactcgaattcgacgcgcgaccaacgctacgaacgacaaaacaataaacgtaaacgaacgacgaaactcgaaaaacgctacttaccttttaccaccctaaatccgcgatccccgtaacccgcatcctcctctcctaaatctacaatccccgccttcgcgtcctatcaccccgcaacccacgttctactaccccgaacccgccgcccacgatcccgaccgccccgccgtccccgccgccctcacctcctacaaaccgcgctcgcgacacgaactaacgaaaataaaaaaaaacgacaaaataaattcactcaacgccataaccgaaacccgaaaaaaaaaaacgcgaacgaaaacaccgataaataactacccgaaaccgaactaatcgaaacgcgaacgaacgaaaacgactctataaaccgcgaccgaacccgcccaaaccttataaacgcgacgcgcgcgaaaaccgaaccaaaacgacgacgacgaaaacgcgtcccgaataaaaacgaactccgaacgcaacctaaatttaaccgcgatatataaaccgacgaacgacaacgaccgtaaccactacgacgacctaaaccttacgctaacaacccgacccctcgcgcgccgccaaaaccgcgcctccccctctcccgaaccccgcccccgcccgtctccccgacgacgttatcaacacgcgctccacaacaacgacgtaacgctcaaaaatccccccgaacgccccgaactcccgcctacgcgaacatcccgaaaacctaaaacgaaaacgatatcgaaacctctcaaaaactctcaaaaaaacaccgaacttaacgatctccccgaatcccttaacgaaaaaaaaaattaactc

SEQ ID NO: 15525 - DNA, 565 bp, Artificial Sequence
  chemically treated genomic DNA (Homo sapiens) CpG-island No: 15525
  misc_feature (114)..(114): n is either a, c, g or t
  misc_feature (282)..(282): n is either a, c, g or t
tttcgttggcgattcggggttgtgtttcgtaggtttttgggtttttataaaacgtaatgggcgagttaatttaaggtacggttaggatttcggttatttggaggtatgtggttnacgtcgatgattggttaggtcggtggattattaagcgtagttattaatgatttggcggtgatagaggtatgagataaatgatttcggttatgtaatgtgtaggcgtagtttgcggcgtaagtttgttatgggttcgtaggttaatattgtgttacgtggtataggcgngtagattttagagtggtaggaatatatttattgcggcgttatttaattgttaagatttgggtttgaaatagcgggagtattcgtggttttgttatagtgtagtattatacgtttgggtttaatagtttacgcggttgtttattaagtgtatagaacgattgttaaaagcgacgcgattaagtcgttaacgtttcgtatgttttgatacggtcgattatgagaggattatattagtatatattatgttcgtggttatagggtttgtgttagagtaattgtatat

SEQ ID NO: 15526 - DNA, 565 bp, Artificial Sequence
  chemically treated genomic DNA (Homo sapiens) CpG-island No: 15526
  misc_feature (284)..(284): n is either a, c, g or t
  misc_feature (452)..(452): n is either a, c, g or t
atatacaattactctaacacaaaccctataaccacgaacataatatatactaatataatcctctcataatcgaccgtatcaaaacatacgaaacgttaacgacttaatcgcgtcgcttttaacaatcgttctatacacttaataaacaaccgcgtaaactattaaacccaaacgtataatactacactataacaaaaccacgaatactcccgctatttcaaacccaaatcttaacaattaaataacgccgcaataaatatattcctaccactctaaaatctacncgcctataccacgtaacacaatattaacctacgaacccataacaaacttacgccgcaaactacgcctacacattacataaccgaaatcatttatctcatacctctatcaccgccaaatcattaataactacgcttaataatccaccgacctaaccaatcatcgacgtnaaccacatacctccaaataaccgaaatcctaaccgtaccttaaattaactcgcccattacgttttataaaaacccaaaaacctacgaaacacaaccccgaatcgccaacgaaa

SEQ ID NO: 15527 - DNA, 565 bp, Artificial Sequence
  chemically treated genomic DNA (Homo sapiens) CpG-island No: 15527
  misc_feature (284)..(284): n is either a, c, g or t
  misc_feature (452)..(452): n is either a, c, g or t
gtgtgtagttattttggtataagttttgtggttacgagtatggtgtgtattggtgtgatttttttatagtcgatcgtgttaggatatgcgaagcgttggcgatttggtcgcgtcgtttttaataatcgttttgtgtatttggtgaataatcgcgtgggttgttgagtttagacgtgtaatattgtattatgataagattacgagtattttcgttattttaggtttaggttttggtagttagataacgtcgtaatggatgtgtttttgttattttggaatttgtncgtttatattacgtaatatagtattagtttgcgagtttatagtagatttgcgtcgtagattgcgtttgtatattgtatagtcggggttatttattttatatttttattatcgttaagttattggtgattgcgtttagtaatttatcgatttgattagttatcggcgtnggttatatatttttaggtaatcgaaattttagtcgtattttggattggttcgtttattacgttttataggggtttaagagtttgcggaatatagtttcgggtcgttaacgaag

SEQ ID NO: 15528 - DNA, 565 bp, Artificial Sequence
  chemically treated genomic DNA (Homo sapiens) CpG-island No: 15528
  misc_feature (114)..(114): n is either a, c, g or t
  misc_feature (282)..(282): n is either a, c, g or t
cttcgttaacgacccgaaactatattccgcaaactcttaaacccctataaaacgtaataaacgaaccaatccaaaatacgactaaaatttcgattacctaaaaatatataaccnacgccgataactaatcaaatcgataaattactaaacgcaatcaccaataacttaacgataataaaaatataaaataaataaccccgactatacaatatacaaacgcaatctacgacgcaaatctactataaactcgcaaactaatactatattacgtaatataaacgnacaaattccaaaataacaaaaacacatccattacgacgttatctaactaccaaaacctaaacctaaaataacgaaaatactcgtaatcttatcataatacaatattacacgtctaaactcaacaacccacgcgattattcaccaaatacacaaaacgattattaaaaacgacgcgaccaaatcgccaacgcttcgcatatcctaacacgatcgactataaaaaaatcacaccaatacacaccatactcgtaaccacaaaacttataccaaaataactacacac

SEQ ID NO: 15529 - DNA, 596 bp, Artificial Sequence
  chemically treated genomic DNA (Homo sapiens) CpG-island No: 15529
gcgggagcgtggggcgtagattcgtattgttataggaatttttcggtttttcgaagagtttcgcgtcggggtttttgtttcgtacgtcggttggggcgggagttaggttttcgtagtttttttttatcgttttgcgttttttttgtttttttagaagtcgttattaaagtttagtttttgattaggtttcggtttcgttggtcggcgtagtttcggcgattattttaggcggtttggcgtacgcgaggattcgtcgcgttttagatgtaggtgttttttttttttagtcgtcgatcgatagtgtacgtcgcggtcgtcggaagtgatagcgtttgtcgttggggagttttcgtttttttcgtttcggcgtttcgtttaggtttcgtttttaggtgttttcgtttttttttttttcgtgtcgttcgttttttgttagtttttttttttttttttttttttttttttttttttcgttttttttttcgtatttgagcgtacgtatttgttcgggttcggttttttttttttttttttttttttttttttcgttcggtcgcgggagtttcgtggttgcgttatcgtcgtttttttagata

SEQ ID NO: 15530 - DNA, 596 bp, Artificial Sequence
  chemically treated genomic DNA (Homo sapiens) CpG-island No: 15530
tatctaaaaaaacgacgataacgcaaccacgaaactcccgcgaccgaacgaaaaaaaaaaaaaaaaaaaaaaaaaaaaaaccgaacccgaacaaatacgtacgctcaaatacgaaaaaaaaaacgaaaaaaaaaaaaaaaaaaaaaaaaaaaaaaaaaaactaacaaaaaacgaacgacacgaaaaaaaaaaaaacgaaaacacctaaaaacgaaacctaaacgaaacgccgaaacgaaaaaaacgaaaactccccaacgacaaacgctatcacttccgacgaccgcgacgtacactatcgatcgacgactaaaaaaaaaaaacacctacatctaaaacgcgacgaatcctcgcgtacgccaaaccgcctaaaataatcgccgaaactacgccgaccaacgaaaccgaaacctaatcaaaaactaaactttaataacgacttctaaaaaaacaaaaaaaacgcaaaacgataaaaaaaaactacgaaaacctaactcccgccccaaccgacgtacgaaacaaaaaccccgacgcgaaactcttcgaaaaaccgaaaaattcctataacaatacgaatctacgccccacgctcccgc

SEQ ID NO: 15531 - DNA, 596 bp, Artificial Sequence
  chemically treated genomic DNA (Homo sapiens) CpG-island No: 15531
tgtttgggggggcggcggtgacgtagttacgaggttttcgcggtcgggcggggaaagagggaggggagaggaggagggagtcgggttcgggtaggtgcgtacgtttaggtgcgagagaggaagcgagaggaaggagaggggagagggagagggagagaggttgatagaaagcgagcgatacgggagggggaggggcgggaatatttaggggcgaggtttgggcggggcgtcgaggcggaaggggcgggagttttttaacgataggcgttgttattttcggcggtcgcggcgtgtattgtcggtcggcggttaaggaggggaggtatttgtatttggggcgcggcgaattttcgcgtgcgttaggtcgtttggggtagtcgtcgagattgcgtcggttagcggggtcgaaatttaattaggagttgagttttgatggcggtttttggagggataaagaaggcgtagagcggtgggaggaggttgcgagaatttagttttcgttttagtcgacgtgcgagataaaggtttcggcgcggggtttttcggaaggtcgggaggtttttgtgataatgcgagtttgcgttttacgttttcgt

SEQ ID NO: 15532 - DNA, 596 bp, Artificial Sequence
  chemically treated genomic DNA (Homo sapiens) CpG-island No: 15532
acgaaaacgtaaaacgcaaactcgcattatcacaaaaacctcccgaccttccgaaaaaccccgcgccgaaacctttatctcgcacgtcgactaaaacgaaaactaaattctcgcaacctcctcccaccgctctacgccttctttatccctccaaaaaccgccatcaaaactcaactcctaattaaatttcgaccccgctaaccgacgcaatctcgacgactaccccaaacgacctaacgcacgcgaaaattcgccgcgccccaaatacaaatacctcccctccttaaccgccgaccgacaatacacgccgcgaccgccgaaaataacaacgcctatcgttaaaaaactcccgccccttccgcctcgacgccccgcccaaacctcgcccctaaatattcccgcccctccccctcccgtatcgctcgctttctatcaacctctctccctctccctctcccctctccttcctctcgcttcctctctcgcacctaaacgtacgcacctacccgaacccgactccctcctcctctcccctccctctttccccgcccgaccgcgaaaacctcgtaactacgtcaccgccgcccccccaaaca

SEQ ID NO: 15533 - DNA, 568 bp, Artificial Sequence
  chemically treated genomic DNA (Homo sapiens) CpG-island No: 15533
tgacggtaatgtgttatttggcggttggttatttgagagtatgaatcggagagtattacgtcgcgtttagcgagcggacgttttgttttgcgagtttggttatcgtttttttgcgtttattgtcgggttaggttaatcgttagattagaatcgttcgttattagtggggtatcgcgtaaggtttttttttgaatttttagatggtgttcggttagcgtattaagtatcgcgtagcggtagtttttttgttgtaagcgagttagtttttgacgaacggtatttatattttgttcgaaaatatgtgtcgaaacgacgtcgtagcgttttgtggattgcgttttaattagacggggaagatagttgtcggttatgggatttatcgggtgatggcgtatttcggattcggttagtagttgatttattacgaataaatatttttgataaatcgtacgttcgttgatcggtagggtcggagagaagatcgtaaacggcgtgtcgagagtatttattaaggtatcggtaatcgggttaatattatttttcgtcgtattgtcgaaagtagagtagt

SEQ ID NO: 15534 - DNA, 568 bp, Artificial Sequence
  chemically treated genomic DNA (Homo sapiens) CpG-island No: 15534
actactctactttcgacaatacgacgaaaaataatattaacccgattaccgataccttaataaatactctcgacacgccgtttacgatcttctctccgaccctaccgatcaacgaacgtacgatttatcaaaaatatttattcgtaataaatcaactactaaccgaatccgaaatacgccatcacccgataaatcccataaccgacaactatcttccccgtctaattaaaacgcaatccacaaaacgctacgacgtcgtttcgacacatattttcgaacaaaatataaataccgttcgtcaaaaactaactcgcttacaacaaaaaaactaccgctacgcgatacttaatacgctaaccgaacaccatctaaaaattcaaaaaaaaaccttacgcgataccccactaataacgaacgattctaatctaacgattaacctaacccgacaataaacgcaaaaaaacgataaccaaactcgcaaaacaaaacgtccgctcgctaaacgcgacgtaatactctccgattcatactctcaaataaccaaccgccaaataacacattaccgtca

SEQ ID NO: 15535 - DNA, 568 bp, Artificial Sequence
  chemically treated genomic DNA (Homo sapiens) CpG-island No: 15535
attgttttattttcgatagtacggcgaaaggtaatattggttcggttatcgatgttttaatggatgttttcgatacgtcgtttacggtttttttttcggttttgtcggttaacggacgtacggtttattaggggtatttgttcgtaatgaattaattgttggtcgaattcgggatgcgttattattcggtaaattttatgatcgatagttatttttttcgtttggttgaagcgtaatttatagggcgttgcggcgtcgtttcggtatatgttttcgaataaggtgtggatgtcgttcgttaagagttggttcgtttatagtaagagggttatcgttacgcggtgtttgatgcgttgatcgaatattatttggaaatttagggagaagttttgcgcgatgttttattggtaacgggcggttttggtttggcgattggtttggttcggtagtgggcgtaagaaaacggtaattaggttcgtaaagtagggcgttcgttcgttgggcgcggcgtagtgtttttcggtttatgtttttaaatgattaatcgttaggtagtatattatcgtta

SEQ ID NO: 15536 - DNA, 568 bp, Artificial Sequence
  chemically treated genomic DNA (Homo sapiens) CpG-island No: 15536
taacgataatatactacctaacgattaatcatttaaaaacataaaccgaaaaacactacgccgcgcccaacgaacgaacgccctactttacgaacctaattaccgttttcttacgcccactaccgaaccaaaccaatcgccaaaccaaaaccgcccgttaccaataaaacatcgcgcaaaacttctccctaaatttccaaataatattcgatcaacgcatcaaacaccgcgtaacgataaccctcttactataaacgaaccaactcttaacgaacgacatccacaccttattcgaaaacatataccgaaacgacgccgcaacgccctataaattacgcttcaaccaaacgaaaaaaataactatcgatcataaaatttaccgaataataacgcatcccgaattcgaccaacaattaattcattacgaacaaatacccctaataaaccgtacgtccgttaaccgacaaaaccgaaaaaaaaaccgtaaacgacgtatcgaaaacatccattaaaacatcgataaccgaaccaatattacctttcgccgtactatcgaaaataaaacaat

SEQ ID NO: 15537 - DNA, 806 bp, Artificial Sequence
  chemically treated genomic DNA (Homo sapiens) CpG-island No: 15537
cgatcgtagtaatgggggtcgtcgtcgggatggtatggttggtggatgggcgttatgaaattatttcgatggcgattagtagtatgatcggcgatgttagcggtatgatttgcgatggtgcgtcgaatagttgcgcgatgaaggtttcgattagtgtttcggttgcgtggaaagcggtgttaatggcgttggatgatatcgtcgtgatcggtaatgaagggattgtggcgtatgatgttgagtagtcgattgttaatttgtgtgcgttagtaagttattcgatgtagtaaacggatcggtagattatcgagattatggcgagtaaggttagataaacgttaggttttggggatcgtgtcggatgcgatgttggcgtattttgttcggtttacgggttgtttaattcgttaatgttgttggattttgtaggtcggatgtggcgttttcgtcgtattcggtaattggtgtatgatgtttgatgcgacgttggcgcgttttattaggtttatattggtgtcggatcggtagatcggataaggcgtttacgtcgtattcggtaagtggttaaattcgtttaaatatcgtcgtaatattttgatttagatcgatatatatcgtcgttagattaaattgaacgtttttgcgttttattagatttagtagcgtggtgttgatacgcgtatcggaataatttagcggatgatttagcgcgatcgcgttatcgttgaggttgattttttcgttaatttgtttaattagttttagatttttaatatatggtaggatttgcgcggtaaaggtttcgt

SEQ ID NO: 15538 - DNA, 806 bp, Artificial Sequence
  chemically treated genomic DNA (Homo sapiens) CpG-island No: 15538
acgaaacctttaccgcgcaaatcctaccatatattaaaaatctaaaactaattaaacaaattaacgaaaaaatcaacctcaacgataacgcgatcgcgctaaatcatccgctaaattattccgatacgcgtatcaacaccacgctactaaatctaataaaacgcaaaaacgttcaatttaatctaacgacgatatatatcgatctaaatcaaaatattacgacgatatttaaacgaatttaaccacttaccgaatacgacgtaaacgccttatccgatctaccgatccgacaccaatataaacctaataaaacgcgccaacgtcgcatcaaacatcatacaccaattaccgaatacgacgaaaacgccacatccgacctacaaaatccaacaacattaacgaattaaacaacccgtaaaccgaacaaaatacgccaacatcgcatccgacacgatccccaaaacctaacgtttatctaaccttactcgccataatctcgataatctaccgatccgtttactacatcgaataacttactaacgcacacaaattaacaatcgactactcaacatcatacgccacaatcccttcattaccgatcacgacgatatcatccaacgccattaacaccgctttccacgcaaccgaaacactaatcgaaaccttcatcgcgcaactattcgacgcaccatcgcaaatcataccgctaacatcgccgatcatactactaatcgccatcgaaataatttcataacgcccatccaccaaccataccatcccgacgacgacccccattactacgatcg

SEQ ID NO: 15539 - DNA, 806 bp, Artificial Sequence
  chemically treated genomic DNA (Homo sapiens) CpG-island No: 15539
acgaagtttttgtcgcgtagattttgttatgtattaaagatttgggattaattgagtagattgacgagaagattaattttaacggtggcgcgatcgcgttgggttattcgttgggttgtttcggtgcgcgtattagtattacgttgttgaatttgatggaacgtaaagacgtttagtttggtttggcgacgatgtgtatcggtttgggttagggtattgcgacggtgtttgagcgggtttaattatttgtcggatgcggcgtgaacgttttattcggtttatcgattcggtattaatgtaggtttgataagacgcgttagcgtcgtattaggtattatgtattaattgtcggatgcggcgaaaacgttatattcggtttataaaatttaataatattaacgaattaaataattcgtaggtcggataagatgcgttagtatcgtattcggtacgatttttaaaatttggcgtttatttggttttgttcgttataatttcgataatttgtcgattcgtttgttgtatcgaatggtttgttaacgtatataggttggtaatcgattgtttaatattatgcgttataatttttttattgtcggttacggcggtattatttagcgttattaatatcgttttttacgtagtcgaagtattggtcgaaatttttatcgcgtagttgttcgacgtattatcgtaaattatgtcgttgatatcgtcgattatattgttgatcgttatcgagatggttttataacgtttatttattagttatgttatttcggcggcggtttttattgttgcggtcg

SEQ ID NO: 15540 - DNA, 806 bp, Artificial Sequence
  chemically treated genomic DNA (Homo sapiens) CpG-island No: 15540
cgaccgcaacaataaaaaccgccgccgaaataacataactaataaataaacgttataaaaccatctcgataacgatcaacaatataatcgacgatatcaacgacataatttacgataatacgtcgaacaactacgcgataaaaatttcgaccaatacttcgactacgtaaaaaacgatattaataacgctaaataataccgccgtaaccgacaataaaaaaattataacgcataatattaaacaatcgattaccaacctatatacgttaacaaaccattcgatacaacaaacgaatcgacaaattatcgaaattataacgaacaaaaccaaataaacgccaaattttaaaaatcgtaccgaatacgatactaacgcatcttatccgacctacgaattatttaattcgttaatattattaaattttataaaccgaatataacgttttcgccgcatccgacaattaatacataatacctaatacgacgctaacgcgtcttatcaaacctacattaataccgaatcgataaaccgaataaaacgttcacgccgcatccgacaaataattaaacccgctcaaacaccgtcgcaataccctaacccaaaccgatacacatcgtcgccaaaccaaactaaacgtctttacgttccatcaaattcaacaacgtaatactaatacgcgcaccgaaacaacccaacgaataacccaacgcgatcgcgccaccgttaaaattaatcttctcgtcaatctactcaattaatcccaaatctttaatacataacaaaatctacgcgacaaaaacttcgt

SEQ ID NO: 15541 - DNA, 885 bp, Artificial Sequence
  chemically treated genomic DNA (Homo sapiens) CpG-island No: 15541
ttattagtgaagtcgtcgttcgttatgatcgcgttagtcgcgcgttatttgtatttggggtgaaggacgttgaatttagcgttagcgattcggttgtggataattgttttgtgtcgggaagtcgaagcgttgtagatattttgtagcgtagtcgacgtttatcgttcgtattgcgcgtattattattacgtttttcgattgatttagtttttgacgtaagcgaattggattagtatattgcggtggtgagtttttcggttgttagttagaatcggtatttgtattttagcgagaaattggtatatcgtttaatatatttgttagcgttagatttttatttatcgtcgcggtgtagaggaacggtttgatgttggaatttatttgacgtagtgtttgggtggcgcggttaaatttgttttgattgaaattaaagttatcgattagcgttataacggtatcgttttgcggattgatcgatattagcgtcgagtttattttcggtatttgtgttagttattatgtatcgttaatttgacgaatttagatttgttgattcgtttgtagaatatcggttattttacgcggcgtcggtttttgttgagtattcgaacggtaaggacgcgtttagcgaacgttttttatatttaatgcgacggtcgattcgttcgttagtatcgtcgtcgtttgttgaggattggcgttggtgattgcggtaggtagtagcggattataggttggtagcgtttttagcgtatcggtaattttgttgttattttacgtcgattcgtttattttttatagtatatttgtcgggtcgcgatagtcgtggcgtatgtcgtagtttagtacgttattacgtatcgtttgttgcgcggtttgttgtat

SEQ ID NO: 15542 - DNA, 885 bp, Artificial Sequence
  chemically treated genomic DNA (Homo sapiens) CpG-island No: 15542
atacaacaaaccgcgcaacaaacgatacgtaataacgtactaaactacgacatacgccacgactatcgcgacccgacaaatatactataaaaaataaacgaatcgacgtaaaataacaacaaaattaccgatacgctaaaaacgctaccaacctataatccgctactacctaccgcaatcaccaacgccaatcctcaacaaacgacgacgatactaacgaacgaatcgaccgtcgcattaaatataaaaaacgttcgctaaacgcgtccttaccgttcgaatactcaacaaaaaccgacgccgcgtaaaataaccgatattctacaaacgaatcaacaaatctaaattcgtcaaattaacgatacataataactaacacaaataccgaaaataaactcgacgctaatatcgatcaatccgcaaaacgataccgttataacgctaatcgataactttaatttcaatcaaaacaaatttaaccgcgccacccaaacactacgtcaaataaattccaacatcaaaccgttcctctacaccgcgacgataaataaaaatctaacgctaacaaatatattaaacgatataccaatttctcgctaaaatacaaataccgattctaactaacaaccgaaaaactcaccaccgcaatatactaatccaattcgcttacgtcaaaaactaaatcaatcgaaaaacgtaataataatacgcgcaatacgaacgataaacgtcgactacgctacaaaatatctacaacgcttcgacttcccgacacaaaacaattatccacaaccgaatcgctaacgctaaattcaacgtccttcaccccaaatacaaataacgcgcgactaacgcgatcataacgaacgacgacttcactaataa

SEQ ID NO: 15543 - DNA, 885 bp, Artificial Sequence
  chemically treated genomic DNA (Homo sapiens) CpG-island No: 15543
gtgtagtaggtcgcgtagtaggcggtacgtaataacgtgttggattacgatatgcgttacggttatcgcggttcggtaaatgtgttgtggaaagtgggcgagtcggcgtgggataataataagattatcgatacgttgaaggcgttgttaatttatggttcgttgttgtttgtcgtagttattagcgttaatttttagtaagcgacggcgatgttggcggacgggtcgatcgtcgtattgagtatggaaggcgttcgttgggcgcgtttttatcgttcggatatttagtaaggatcgacgtcgcgtaaagtgatcgatgttttgtaaacgggttagtaaatttgggttcgttaggttggcgatgtatggtggttggtataagtgtcggaagtgaattcggcgttggtgtcgattaattcgtaaaacggtgtcgttatggcgttggtcggtggttttgattttaattagagtaagtttaatcgcgttatttaggtattgcgttaggtgggttttaatattaaatcgtttttttatatcgcggcgatggataaaggtttgacgttggtaagtatgttgaacgatgtgttaatttttcgttgggatgtaagtgtcggttttgattggtagtcgaagaatttattatcgtagtatgttggtttaattcgtttacgttaggggttgggttagtcgaaaaacgtggtgatggtacgcgtaatgcgggcgatgggcgtcgattacgttgtagaatatttgtaacgtttcggtttttcggtataaaatagttgtttatagtcgaatcgttggcgttgggtttagcgttttttattttaagtgtaggtggcgcgcggttagcgcggttatggcgaacggcggttttattggtgg

SEQ ID NO: 15544 - DNA, 885 bp, Artificial Sequence
  chemically treated genomic DNA (Homo sapiens) CpG-island No: 15544
ccaccaataaaaccgccgttcgccataaccgcgctaaccgcgcgccacctacacttaaaataaaaaacgctaaacccaacgccaacgattcgactataaacaactattttataccgaaaaaccgaaacgttacaaatattctacaacgtaatcgacgcccatcgcccgcattacgcgtaccatcaccacgtttttcgactaacccaacccctaacgtaaacgaattaaaccaacatactacgataataaattcttcgactaccaatcaaaaccgacacttacatcccaacgaaaaattaacacatcgttcaacatacttaccaacgtcaaacctttatccatcgccgcgatataaaaaaacgatttaatattaaaacccacctaacgcaatacctaaataacgcgattaaacttactctaattaaaatcaaaaccaccgaccaacgccataacgacaccgttttacgaattaatcgacaccaacgccgaattcacttccgacacttataccaaccaccatacatcgccaacctaacgaacccaaatttactaacccgtttacaaaacatcgatcactttacgcgacgtcgatccttactaaatatccgaacgataaaaacgcgcccaacgaacgccttccatactcaatacgacgatcgacccgtccgccaacatcgccgtcgcttactaaaaattaacgctaataactacgacaaacaacaacgaaccataaattaacaacgccttcaacgtatcgataatcttattattatcccacgccgactcgcccactttccacaacacatttaccgaaccgcgataaccgtaacgcatatcgtaatccaacacgttattacgtaccgcctactacgcgacctactacac

SEQ ID NO: 15545 - DNA, 516 bp, Artificial Sequence
  chemically treated genomic DNA (Homo sapiens) CpG-island No: 15545
  misc_feature (137)..(137): n is either a, c, g or t
ttggttttggcgtgggcggttattgtattgttgttgattcgtggtttatcgtggtatagaatttttagtaggcgcggtttattcgtatcgcgcgcgaagtgaacgattataaatcgttttgggttatcgattaggtnaaagcggcggtggttgattgtttggcggttatcgataacgcgttagtgaattgaaaatcgtttgttttggtttggcgtttaaatcgaatattgatgatttgcgcgaaagttcggcgatggaaatcgttgaattgatttgtttagtggtatacggcgaaattttggttgttgagttttatatttattagattgtcggtgataaatttgagtcgtggtttttgttattttggtcgtacgttttgtatttaggcgttggtaatcggtagtacgtgttggtgatgttggtcgattattgtttgttttttggttattatgtggcgacgttgtttattattatgtatgtcggtcgatgtttaaggacgtttggcgtttgaatgag

SEQ ID NO: 15546 - DNA, 516 bp, Artificial Sequence
  chemically treated genomic DNA (Homo sapiens) CpG-island No: 15546
  misc_feature (380)..(380): n is either a, c, g or t
ctcattcaaacgccaaacgtccttaaacatcgaccgacatacataataataaacaacgtcgccacataataaccaaaaaacaaacaataatcgaccaacatcaccaacacgtactaccgattaccaacgcctaaatacaaaacgtacgaccaaaataacaaaaaccacgactcaaatttatcaccgacaatctaataaatataaaactcaacaaccaaaatttcgccgtataccactaaacaaatcaattcaacgatttccatcgccgaactttcgcgcaaatcatcaatattcgatttaaacgccaaaccaaaacaaacgattttcaattcactaacgcgttatcgataaccgccaaacaatcaaccaccgccgctttnacctaatcgataacccaaaacgatttataatcgttcacttcgcgcgcgatacgaataaaccgcgcctactaaaaattctataccacgataaaccacgaatcaacaacaatacaataaccgcccacgccaaaaccaa

SEQ ID NO: 15547 - DNA, 516 bp, Artificial Sequence
  chemically treated genomic DNA (Homo sapiens) CpG-island No: 15547
  misc_feature (380)..(380): n is either a, c, g or t
tttatttaggcgttagacgtttttaggtatcgatcgatatatatggtgatggataacgtcgttatatgataattaaggaatagataatgatcgattagtattattagtacgtattgtcggttgttagcgtttgagtataagacgtgcggttagagtaataaaagttacggtttaagtttattatcggtaatttggtggatgtaaggtttaataattagagtttcgtcgtatgttattgggtagattagtttagcgatttttatcgtcgggttttcgcgtaggttattaatattcggtttaaacgttagattaaagtaggcgatttttagtttattggcgcgttatcggtagtcgttaggtaattagttatcgtcgttttnatttgatcgataatttagaacggtttgtgatcgtttatttcgcgcgcggtacggataagtcgcgtttgttgggggttttgtgttacgataaattacggattaatagtaatgtagtgatcgtttacgttagggttag

SEQ ID NO: 15548 - DNA, 516 bp, Artificial Sequence
  chemically treated genomic DNA (Homo sapiens) CpG-island No: 15548
  misc_feature (137)..(137): n is either a, c, g or t
ctaaccctaacgtaaacgatcactacattactattaatccgtaatttatcgtaacacaaaacccccaacaaacgcgacttatccgtaccgcgcgcgaaataaacgatcacaaaccgttctaaattatcgatcaaatnaaaacgacgataactaattacctaacgactaccgataacgcgccaataaactaaaaatcgcctactttaatctaacgtttaaaccgaatattaataacctacgcgaaaacccgacgataaaaatcgctaaactaatctacccaataacatacgacgaaactctaattattaaaccttacatccaccaaattaccgataataaacttaaaccgtaacttttattactctaaccgcacgtcttatactcaaacgctaacaaccgacaatacgtactaataatactaatcgatcattatctattccttaattatcatataacgacgttatccatcaccatatatatcgatcgatacctaaaaacgtctaacgcctaaataaa

SEQ ID NO: 15549 - DNA, 651 bp, Artificial Sequence
  chemically treated genomic DNA (Homo sapiens) CpG-island No: 15549
ttttcgttggtttttattttcgtagtttttttagtagtcgtttttagtaggcgcgttttcgttttggcgttttcgcgagttttcggtaggtagatttcggtagagggtggagggatcggttgggggcgtttcggtttcggttatttcgtataggtggttggaggagttgttgtcgcgggcgcggttgtttcggtcgcgtgggtgtcgcgggcggatacgtttggaagtcggtttcgcggagcgcgcgtaggtttcggttttggcgtttcgggggggtggcgtaggttacgtcggagttggatacgcgcgcgcgttgtaattaggtttagagcggtcgcgcgcggtagtcgtacgtttaggggttagcgttgagtcgtaggaattcgagcgagggtaggtcggcgagcgttttttcgggtaaggaagtttaggtttttttttattaggtaaaagatggtgagggggtttaggtcgcggaagggtcgcgcggttgtacgttttgtagtcggttttcgtggtaatagtagtcggtttaggttggtttagttcgcgaaatacgtgttttgtgagtagtcgtaggcgggttttcgtggaggaagaggtggtttaggttggttaggttcgcgaataagttattttgggtggggtgga

SEQ ID NO: 15550 - DNA, 651 bp, Artificial Sequence
  chemically treated genomic DNA (Homo sapiens) CpG-island No: 15550
tccaccccacccaaaataacttattcgcgaacctaaccaacctaaaccacctcttcctccacgaaaacccgcctacgactactcacaaaacacgtatttcgcgaactaaaccaacctaaaccgactactattaccacgaaaaccgactacaaaacgtacaaccgcgcgacccttccgcgacctaaaccccctcaccatcttttacctaataaaaaaaaacctaaacttccttacccgaaaaaacgctcgccgacctaccctcgctcgaattcctacgactcaacgctaacccctaaacgtacgactaccgcgcgcgaccgctctaaacctaattacaacgcgcgcgcgtatccaactccgacgtaacctacgccacccccccgaaacgccaaaaccgaaacctacgcgcgctccgcgaaaccgacttccaaacgtatccgcccgcgacacccacgcgaccgaaacaaccgcgcccgcgacaacaactcctccaaccacctatacgaaataaccgaaaccgaaacgcccccaaccgatccctccaccctctaccgaaatctacctaccgaaaactcgcgaaaacgccaaaacgaaaacgcgcctactaaaaacgactactaaaaaaactacgaaaataaaaaccaacgaaaa

SEQ ID NO: 15551 - DNA, 651 bp, Artificial Sequence
  chemically treated genomic DNA (Homo sapiens) CpG-island No: 15551
tttattttatttaggatgatttgttcgcggatttggttaatttgagttatttttttttttacgggaattcgtttgcggttgtttatagagtacgtgtttcgcgggttgggttagtttggatcggttgttgttgttacgggaatcggttgtagggcgtgtaatcgcgcggttttttcgcggtttaaatttttttattattttttatttggtaaaaaaaagtttgggtttttttgttcgggagggcgttcgtcgatttgttttcgttcgagtttttgcggtttaacgttaatttttgggcgtgcgattgtcgcgcgcggtcgttttgggtttggttgtagcgcgcgcgcgtgtttagtttcgacgtgatttgcgttattttttcggagcgttagggtcgagatttgcgcgcgtttcgcgaggtcgatttttaggcgtgttcgttcgcggtatttacgcggtcggggtagtcgcgttcgcggtaatagtttttttaattatttgtacggggtggtcgaggtcggggcgtttttagtcgatttttttattttttatcgagatttgtttgtcgaagattcgcgggggcgttagggcggggacgcgtttattgaggacgattattgggggggttacgggggtgaggattagcgaggg

SEQ ID NO: 15552 - DNA, 651 bp, Artificial Sequence
  chemically treated genomic DNA (Homo sapiens) CpG-island No: 15552
ccctcgctaatcctcacccccgtaacccccccaataatcgtcctcaataaacgcgtccccgccctaacgcccccgcgaatcttcgacaaacaaatctcgataaaaaataaaaaaatcgactaaaaacgccccgacctcgaccaccccgtacaaataattaaaaaaactattaccgcgaacgcgactaccccgaccgcgtaaataccgcgaacgaacacgcctaaaaatcgacctcgcgaaacgcgcgcaaatctcgaccctaacgctccgaaaaaataacgcaaatcacgtcgaaactaaacacgcgcgcgcgctacaaccaaacccaaaacgaccgcgcgcgacaatcgcacgcccaaaaattaacgttaaaccgcaaaaactcgaacgaaaacaaatcgacgaacgccctcccgaacaaaaaaacccaaacttttttttaccaaataaaaaataataaaaaaatttaaaccgcgaaaaaaccgcgcgattacacgccctacaaccgattcccgtaacaacaacaaccgatccaaactaacccaacccgcgaaacacgtactctataaacaaccgcaaacgaattcccgtaaaaaaaaaaataactcaaattaaccaaatccgcgaacaaatcatcctaaataaaataaa

SEQ ID NO: 15553 - DNA, 713 bp, Artificial Sequence
  chemically treated genomic DNA (Homo sapiens) CpG-island No: 15553
taaacgcgtagttttaagtagaggaagtgtagcgagcggggattcgggaggaagagaagagtcggaggggttagagaaaagaaaagggaaggacgcgtttggcgagatgggatattgtgtcgcgggatcgcgggcgtaagtaacggtttttttttgggaagtttggtagtgtcggcgggagtcggtttcggtgttttttagtcgacgtatagtcggagattttacgcgcgtttttttttcgtttacgttgtttattttcggttatcggtaaatgagtagttagtagttgcggacgttttcgggagcgtaacgttttcgcggcgcgttcggagtttcgtgggtttagttttgagtcgcgtcggcgttggggttttttttgcgtgtaggattcggtcgttacggagttttagtttgatagttcggtggtttcgttttcgttgttttttcggaagaagcgggggaattgggaattcgtcgggcgttagaggtttgcgaagttgggtttggatgaagtggatttgcggagttgatagttgtatttatacgcgttcggagttgcgtttcgaggtgggggcgggggtttttttttttttttttttttttaggtcgagttttacgcgtacgtgattcgttcgttggtttcggatattttttttttggtatagttttagtatttatatttttattttggatttttatttttttttttaagt

SEQ ID NO: 15554 - DNA, 713 bp, Artificial Sequence
  chemically treated genomic DNA (Homo sapiens) CpG-island No: 15554
acttaaaaaaaaaaataaaaatccaaaataaaaatataaatactaaaactataccaaaaaaaaaatatccgaaaccaacgaacgaatcacgtacgcgtaaaactcgacctaaaaaaaaaaaaaaaaaaaaaaacccccgcccccacctcgaaacgcaactccgaacgcgtataaatacaactatcaactccgcaaatccacttcatccaaacccaacttcgcaaacctctaacgcccgacgaattcccaattcccccgcttcttccgaaaaaacaacgaaaacgaaaccaccgaactatcaaactaaaactccgtaacgaccgaatcctacacgcaaaaaaaaccccaacgccgacgcgactcaaaactaaacccacgaaactccgaacgcgccgcgaaaacgttacgctcccgaaaacgtccgcaactactaactactcatttaccgataaccgaaaataaacaacgtaaacgaaaaaaaaacgcgcgtaaaatctccgactatacgtcgactaaaaaacaccgaaaccgactcccgccgacactaccaaacttcccaaaaaaaaaccgttacttacgcccgcgatcccgcgacacaatatcccatctcgccaaacgcgtccttcccttttcttttctctaacccctccgactcttctcttcctcccgaatccccgctcgctacacttcctctacttaaaactacgcgttta

SEQ ID NO: 15555 - DNA, 713 bp, Artificial Sequence
  chemically treated genomic DNA (Homo sapiens) CpG-island No: 15555
gtttgggggagaagatgggggtttagggtggaaatgtaggtgttggggttgtgttagagggagagtgttcgggattagcgggcgagttacgtgcgcgtgaaattcgatttaaggggaggggaaaagaagggagttttcgtttttatttcggggcgtagtttcggacgcgtgtaaatataattattaatttcgtagatttattttatttaagtttagtttcgtagatttttggcgttcggcgggtttttagttttttcgtttttttcgaggagatagcggaggcgaggttatcgggttgttaggttgaagtttcgtggcggtcgggttttgtacgtagagaagattttagcgtcggcgcggtttagggttgggtttacgggatttcggacgcgtcgcgaaagcgttgcgttttcggaggcgttcgtagttgttggttgtttatttgtcggtgatcggaggtgagtagcgtgggcggggagggggcgcgcgtagggttttcggttatgcgtcggttgagagatatcgaggtcggttttcgtcgatattgttaggttttttaaggaaagatcgttatttgcgttcgcggtttcgcggtatagtgttttatttcgttaagcgcgtttttttttttttttttttttgattttttcgatttttttttttttttcgggttttcgttcgttgtattttttttgtttagagttgcgcgtttg

SEQ ID NO: 15556 - DNA, 713 bp, Artificial Sequence
  chemically treated genomic DNA (Homo sapiens) CpG-island No: 15556
caaacgcgcaactctaaacaaaaaaaatacaacgaacgaaaacccgaaaaaaaaaaaaaaatcgaaaaaatcaaaaaaaaaaaaaaaaaaaaacgcgcttaacgaaataaaacactataccgcgaaaccgcgaacgcaaataacgatctttccttaaaaaacctaacaatatcgacgaaaaccgacctcgatatctctcaaccgacgcataaccgaaaaccctacgcgcgccccctccccgcccacgctactcacctccgatcaccgacaaataaacaaccaacaactacgaacgcctccgaaaacgcaacgctttcgcgacgcgtccgaaatcccgtaaacccaaccctaaaccgcgccgacgctaaaatcttctctacgtacaaaacccgaccgccacgaaacttcaacctaacaacccgataacctcgcctccgctatctcctcgaaaaaaacgaaaaaactaaaaacccgccgaacgccaaaaatctacgaaactaaacttaaataaaataaatctacgaaattaataattatatttacacgcgtccgaaactacgccccgaaataaaaacgaaaactcccttcttttcccctccccttaaatcgaatttcacgcgcacgtaactcgcccgctaatcccgaacactctccctctaacacaaccccaacacctacatttccaccctaaacccccatcttctcccccaaac

SEQ ID NO: 15557 - DNA, 511 bp, Artificial Sequence
  chemically treated genomic DNA (Homo sapiens) CpG-island No: 15557
tcgacgcggaaagaatataatacgagaagaaagggtaaacggggacgttatacgacggcgataaaggaagcgtaacgtaggagaagaaaagaagagaagtagtaagaggtagaatataaatcgggtaagagacgatacgatatagtagtaaagagagatatatcggtacgagaacggtagagcggagagacggcgcggagtacggtacgttagtaggtcgagagggagagcgtaagttcgagagaaggagtcgtagaaataatacggttagagtagggaaggtaagaagagcgaggagaaggagcggagggacgagtcgagatacggtcggaggagatagacgagcgcgagatagagaagaaggagtaatagataacgaagaggagggcgcgtatataggttaggcgcgaacgatagagttagatttaagaagcgagagcggaaaatagtagaggtagcggggtaggagagatgatagataaaggtgagtcggaataaggaggatatgaga

SEQ ID NO: 15558 - DNA, 511 bp, Artificial Sequence
  chemically treated genomic DNA (Homo sapiens) CpG-island No: 15558
tctcatatcctccttattccgactcacctttatctatcatctctcctaccccgctacctctactattttccgctctcgcttcttaaatctaactctatcgttcgcgcctaacctatatacgcgccctcctcttcgttatctattactccttcttctctatctcgcgctcgtctatctcctccgaccgtatctcgactcgtccctccgctccttctcctcgctcttcttaccttccctactctaaccgtattatttctacgactccttctctcgaacttacgctctccctctcgacctactaacgtaccgtactccgcgccgtctctccgctctaccgttctcgtaccgatatatctctctttactactatatcgtatcgtctcttacccgatttatattctacctcttactacttctcttcttttcttctcctacgttacgcttcctttatcgccgtcgtataacgtccccgtttaccctttcttctcgtattatattctttccgcgtcga

SEQ ID NO: 15559 - DNA, 511 bp, Artificial Sequence
  chemically treated genomic DNA (Homo sapiens) CpG-island No: 15559
ttttatgttttttttgtttcgatttatttttgtttgttattttttttgtttcgttgtttttgttgtttttcgttttcgttttttgggtttggttttgtcgttcgcgtttggtttgtgtgcgcgttttttttttcgttgtttgttgtttttttttttttgtttcgcgttcgtttgtttttttcggtcgtgtttcggttcgttttttcgtttttttttttcgttttttttgttttttttgttttggtcgtgttgtttttgcggttttttttttcgggtttacgttttttttttcggtttgttgacgtgtcgtgtttcgcgtcgttttttcgttttgtcgttttcgtgtcggtgtgtttttttttgttgttgtgtcgtgtcgttttttgttcggtttgtgttttattttttgttgtttttttttttttttttttttgcgttacgttttttttgtcgtcgtcgtgtagcgttttcgtttgtttttttttttcgtgttgtgtttttttcgcgtcgg

SEQ ID NO: 15560 - DNA, 511 bp, Artificial Sequence
  chemically treated genomic DNA (Homo sapiens) CpG-island No: 15560
ccgacgcgaaaaaaacacaacacgaaaaaaaaaaacaaacgaaaacgctacacgacgacgacaaaaaaaacgtaacgcaaaaaaaaaaaaaaaaaaaaacaacaaaaaataaaacacaaaccgaacaaaaaacgacacgacacaacaacaaaaaaaaacacaccgacacgaaaacgacaaaacgaaaaaacgacgcgaaacacgacacgtcaacaaaccgaaaaaaaaaacgtaaacccgaaaaaaaaaaccgcaaaaacaacacgaccaaaacaaaaaaaacaaaaaaaacgaaaaaaaaaaacgaaaaaacgaaccgaaacacgaccgaaaaaaacaaacgaacgcgaaacaaaaaaaaaaaaacaacaaacaacgaaaaaaaaaacgcgcacacaaaccaaacgcgaacgacaaaaccaaacccaaaaaacgaaaacgaaaaacaacaaaaacaacgaaacaaaaaaaataacaaacaaaaataaatcgaaacaaaaaaaacataaaa

SEQ ID NO: 15561 - DNA, 792 bp, Artificial Sequence
  chemically treated genomic DNA (Homo sapiens) CpG-island No: 15561
aaattggtgcgtattcgggttttgatgtgttgtcgtagtcgttataggcgacggtaatttattgcgggttgaattggttgttatcgtttgttatgtattgtatttttatttgtgacgacgaaattttcgaagggtaggcgcgttattataagtaacgtttgttggaatggtaggaggtttattatggatagttatacgttgatttaggcgttgatttatttcggttcggtagcgttgattgtatttattgcggtacgttttggtttgggatcggtatttggttatttgatcgtcggttgtattattggttcgtgggggttgcgattggtgatcgatgtcgaatttattttgtattttgtcgagattggggtggtgttgatgttgtttattatcggtttcgaattcgatttataaaggttgtggaagttgcgtgcggtagtgttcggttgtggcgtattgtagatggtgatttgcggcggtttgttggggttgttttgtatgttatttgggttgcgttggtaggtcgcggaattgatcggtatgacgttggcgtttttttttacggcgattgttatgtaggcgatgaatgaacgtaatttgatggtgacgttaaatgggtcgtagtggttttgcggggttgttgtttttcgatattgcggggaaacggcggtggggaggattcgttatggggagagaatgttgtttaataatggcgtttgtcgttcgcgggaaaagaggggggtaggcggggaatattggggtatatattaacgcgggttgtaataatttttg

SEQ ID NO: 15562 - DNA, 792 bp, Artificial Sequence
  chemically treated genomic DNA (Homo sapiens) CpG-island No: 15562
caaaaattattacaacccgcgttaatatataccccaatattccccgcctacccccctcttttcccgcgaacgacaaacgccattattaaacaacattctctccccataacgaatcctccccaccgccgtttccccgcaatatcgaaaaacaacaaccccgcaaaaccactacgacccatttaacgtcaccatcaaattacgttcattcatcgcctacataacaatcgccgtaaaaaaaaacgccaacgtcataccgatcaattccgcgacctaccaacgcaacccaaataacatacaaaacaaccccaacaaaccgccgcaaatcaccatctacaatacgccacaaccgaacactaccgcacgcaacttccacaacctttataaatcgaattcgaaaccgataataaacaacatcaacaccaccccaatctcgacaaaatacaaaataaattcgacatcgatcaccaatcgcaacccccacgaaccaataatacaaccgacgatcaaataaccaaataccgatcccaaaccaaaacgtaccgcaataaatacaatcaacgctaccgaaccgaaataaatcaacgcctaaatcaacgtataactatccataataaacctcctaccattccaacaaacgttacttataataacgcgcctacccttcgaaaatttcgtcgtcacaaataaaaatacaatacataacaaacgataacaaccaattcaacccgcaataaattaccgtcgcctataacgactacgacaacacatcaaaacccgaatacgcaccaattt

SEQ ID NO: 15563 - DNA, 792 bp, Artificial Sequence
  chemically treated genomic DNA (Homo sapiens) CpG-island No: 15563
tagaggttgttataattcgcgttgatgtatgttttaatatttttcgtttgttttttttttttttcgcgggcgataagcgttattgttagatagtattttttttttatagcgaattttttttatcgtcgttttttcgtaatatcggggaatagtagtttcgtaaggttattgcgatttatttggcgttattattagattgcgtttatttatcgtttgtatggtaatcgtcgtagaggagagcgttagcgttatgtcgattaatttcgcgatttgttagcgtagtttaagtaatatgtagaatagttttagtaggtcgtcgtaaattattatttgtaatgcgttatagtcgaatattgtcgtacgtagtttttatagtttttgtggatcgagttcgaggtcgataataaatagtattagtattattttaatttcggtaaagtgtagaatagattcggtatcggttattagtcgtagtttttacgggttaataatgtagtcggcgattaggtagttaagtatcgattttagattaagacgtatcgtaatgggtataattagcgttgtcgaatcgagataaattagcgtttgaattagcgtatggttatttatgatgggttttttgttattttagtagacgttgtttatagtgacgcgtttgtttttcgagggtttcgtcgttataaataaaggtgtagtgtatggtaaacggtggtagttagtttagttcgtagtagattgtcgtcgtttgtagcggttgcgatagtatattaaagttcggatgcgtattaattt

SEQ ID NO: 15564 - DNA, 792 bp, Artificial Sequence
  chemically treated genomic DNA (Homo sapiens) CpG-island No: 15564
aaattaatacgcatccgaactttaatatactatcgcaaccgctacaaacgacgacaatctactacgaactaaactaactaccaccgtttaccatacactacacctttatttataacgacgaaaccctcgaaaaacaaacgcgtcactataaacaacgtctactaaaataacaaaaaacccatcataaataaccatacgctaattcaaacgctaatttatctcgattcgacaacgctaattatacccattacgatacgtcttaatctaaaatcgatacttaactacctaatcgccgactacattattaacccgtaaaaactacgactaataaccgataccgaatctattctacactttaccgaaattaaaataatactaatactatttattatcgacctcgaactcgatccacaaaaactataaaaactacgtacgacaatattcgactataacgcattacaaataataatttacgacgacctactaaaactattctacatattacttaaactacgctaacaaatcgcgaaattaatcgacataacgctaacgctctcctctacgacgattaccatacaaacgataaataaacgcaatctaataataacgccaaataaatcgcaataaccttacgaaactactattccccgatattacgaaaaaacgacgataaaaaaaattcgctataaaaaaaaaatactatctaacaataacgcttatcgcccgcgaaaaaaaaaaaaaacaaacgaaaaatattaaaacatacatcaacgcgaattataacaacctcta

SEQ ID NO: 15565 - DNA, 654 bp, Artificial Sequence
  chemically treated genomic DNA (Homo sapiens) CpG-island No: 15565
cgttcggcgttggttgaaaaattgatcgttattgtttttaaagttattggcgaaattaatatcgatgattttttttcggtatcggatgcgtggttacgtttcggatattttattgtacgcgttggcgatgttgaaaaacgttcgtgaaggtattgagttagattagtttggtgttgttggttcgattaagtaaatcgaagttttgtaatagaaaggtttttcgttggcgtacgtcggtgacgttgtgggtacgggtttttcgcgtaaattcgttattaatttcgttttgtggtttatgggcgatgatattttatatgtgtcgaataaacgcggcggtggtttgtgtttcggcggtaaattgtatttattttttttaatacgatggaagacgcgggtgtattgttaatcgaagtcgacgtttttatttgaatatgggcgacgtgattgacgtttattcgtataaaggttaagtgcgtaattacgaaatcggcgaattgttggcgattttcgaattgaaaatcgacgtgttgattgatgaagtgcgtgttggtggtcgtatttcgttattatcgggcgtgtgtttgagtattaaagcgcgttaagtatttggtttggtcgtatagtggatgttgttcgttaggcggaagatgtttt

SEQ ID NO: 15566 - DNA, 654 bp, Artificial Sequence
  chemically treated genomic DNA (Homo sapiens) CpG-island No: 15566
aaaacatcttccgcctaacgaacaacatccactatacgaccaaaccaaatacttaacgcgctttaatactcaaacacacgcccgataataacgaaatacgaccaccaacacgcacttcatcaatcaacacgtcgattttcaattcgaaaatcgccaacaattcgccgatttcgtaattacgcacttaacctttatacgaataaacgtcaatcacgtcgcccatattcaaataaaaacgtcgacttcgattaacaatacacccgcgtcttccatcgtattaaaaaaaataaatacaatttaccgccgaaacacaaaccaccgccgcgtttattcgacacatataaaatatcatcgcccataaaccacaaaacgaaattaataacgaatttacgcgaaaaacccgtacccacaacgtcaccgacgtacgccaacgaaaaacctttctattacaaaacttcgatttacttaatcgaaccaacaacaccaaactaatctaactcaataccttcacgaacgtttttcaacatcgccaacgcgtacaataaaatatccgaaacgtaaccacgcatccgataccgaaaaaaaatcatcgatattaatttcgccaataactttaaaaacaataacgatcaatttttcaaccaacgccgaacg

SEQ ID NO: 15567 - DNA, 654 bp, Artificial Sequence
  chemically treated genomic DNA (Homo sapiens) CpG-island No: 15567
ggaatatttttcgtttgacggataatatttattgtgcggttagattaagtgtttaacgcgttttggtgtttaggtatacgttcgataatagcggaatacggttattagtacgtattttattaattagtacgtcggtttttagttcgaaggtcgttagtagttcgtcggtttcgtggttacgtatttaatttttgtacgggtaaacgttaattacgtcgtttatgtttaggtagagacgtcgatttcgattggtagtgtattcgcgttttttatcgtgttaaagaagatgggtgtaatttatcgtcgaggtataaattatcgtcgcgtttgttcggtatatgtggaatattatcgtttataaattatagaacggagttagtggcggatttacgcgaagaattcgtatttataacgttatcgacgtacgttagcgggaaatttttttgttgtagagtttcgatttgtttgatcggattaataatattaggttggtttggtttaatatttttacgggcgttttttagtatcgttagcgcgtgtagtgggatattcggggcgtgattacgtattcggtgtcggagaaaggttatcggtgttagtttcgttagtgattttgaagatagtaacggttagttttttagttagcgtcgggcg

SEQ ID NO: 15568 - DNA, 654 bp, Artificial Sequence
  chemically treated genomic DNA (Homo sapiens) CpG-island No: 15568
cgcccgacgctaactaaaaaactaaccgttactatcttcaaaatcactaacgaaactaacaccgataacctttctccgacaccgaatacgtaatcacgccccgaatatcccactacacgcgctaacgatactaaaaaacgcccgtaaaaatattaaaccaaaccaacctaatattattaatccgatcaaacaaatcgaaactctacaacaaaaaaatttcccgctaacgtacgtcgataacgttataaatacgaattcttcgcgtaaatccgccactaactccgttctataatttataaacgataatattccacatataccgaacaaacgcgacgataatttatacctcgacgataaattacacccatcttctttaacacgataaaaaacgcgaatacactaccaatcgaaatcgacgtctctacctaaacataaacgacgtaattaacgtttacccgtacaaaaattaaatacgtaaccacgaaaccgacgaactactaacgaccttcgaactaaaaaccgacgtactaattaataaaatacgtactaataaccgtattccgctattatcgaacgtatacctaaacaccaaaacgcgttaaacacttaatctaaccgcacaataaatattatccgtcaaacgaaaaatattcc

SEQ ID NO: 15569 - DNA, 500 bp, Artificial Sequence
  chemically treated genomic DNA (Homo sapiens) CpG-island No: 15569
gttattttataaagtgtttgtagcgtcgggattcgtttagtcgtcgttaggttaggattttagaaattacgaataattatacgttcgatatattattaagcgttttcggttggttttcgggcgtaataggacggtttgcgtcgatttagatgtttggtttttttacgtaattcgagtggtagtagttttcgtttgtattattaatagttcggggtattatatgtgacgtttagttggttagtttgtaaggtttaggtcgacgaaaattttcgacgagttagggtttttttaggcgaatttttttaattacgttaagttgttttatttttaaacgtttgtaggcgattatgcgttgtggttcgtttcgtacgtttaatttttttgaagcgttgttagttaggcgttaggcgttagtagcggataaaatattaatcgttatagagcggataaatttttcgttataggagtttatattgattttatagtatagtagtcgttat

SEQ ID NO: 15570 - DNA, 500 bp, Artificial Sequence
  chemically treated genomic DNA (Homo sapiens) CpG-island No: 15570
ataacgactactatactataaaatcaatataaactcctataacgaaaaatttatccgctctataacgattaatattttatccgctactaacgcctaacgcctaactaacaacgcttcaaaaaaattaaacgtacgaaacgaaccacaacgcataatcgcctacaaacgtttaaaaataaaacaacttaacgtaattaaaaaaattcgcctaaaaaaaccctaactcgtcgaaaattttcgtcgacctaaaccttacaaactaaccaactaaacgtcacatataataccccgaactattaataatacaaacgaaaactactaccactcgaattacgtaaaaaaaccaaacatctaaatcgacgcaaaccgtcctattacgcccgaaaaccaaccgaaaacgcttaataatatatcgaacgtataattattcgtaatttctaaaatcctaacctaacgacgactaaacgaatcccgacgctacaaacactttataaaataac

SEQ ID NO: 15571 - DNA, 500 bp, Artificial Sequence
  chemically treated genomic DNA (Homo sapiens) CpG-island No: 15571
atagcggttattgtgttgtaagattagtgtgagtttttatagcggagagtttattcgttttgtagcgattggtgttttattcgttattggcgtttaacgtttaattggtagcgttttagaagggttgggcgtacggagcgggttataacgtataatcgtttgtaggcgtttgggggtagagtagtttggcgtaattgaagggattcgtttgggaaaattttgattcgtcgaagattttcgtcggtttgagttttgtaagttagttagttggacgttatatgtggtatttcgagttgttggtagtgtaaacgaaaattgttattattcgagttgcgtaggaaagttaagtatttgggtcgacgtaagtcgttttattgcgttcggagattagtcggagacgtttggtggtgtgtcgagcgtatagttattcgtggtttttaaaattttggtttagcggcgattgggcgaatttcggcgttgtaaatattttataagatgat

SEQ ID NO: 15572 - DNA, 500 bp, Artificial Sequence
  chemically treated genomic DNA (Homo sapiens) CpG-island No: 15572
atcatcttataaaatatttacaacgccgaaattcgcccaatcgccgctaaaccaaaattttaaaaaccacgaataactatacgctcgacacaccaccaaacgtctccgactaatctccgaacgcaataaaacgacttacgtcgacccaaatacttaactttcctacgcaactcgaataataacaattttcgtttacactaccaacaactcgaaataccacatataacgtccaactaactaacttacaaaactcaaaccgacgaaaatcttcgacgaatcaaaattttcccaaacgaatcccttcaattacgccaaactactctacccccaaacgcctacaaacgattatacgttataacccgctccgtacgcccaacccttctaaaacgctaccaattaaacgttaaacgccaataacgaataaaacaccaatcgctacaaaacgaataaactctccgctataaaaactcacactaatcttacaacacaataaccgctat

SEQ ID NO: 15573 - DNA, 604 bp, Artificial Sequence
  chemically treated genomic DNA (Homo sapiens) CpG-island No: 15573
gagcggcggttagagtggcgtattcgcgttcgattgttgttgtcggtttcgtcgggtttatttagtggattcgggcgttttcgtgaggtcgcgggtgggcggcgtatttagttagtgcgttttgggtttcggcggtaaattttcgcggtttggtatttatttgcgcgttatttggattgtcgtttttttttttcgagtttcgttagcgttcggcggatcggttgtttgttaggtcgtcggggtttttagggtcgagtcggcggtggtcggttaagtagagttaacgagatttttgggagggtagttgcggtagtcgggttatggtaatttgtcgcgttgtcgtcgtcgtcgcggtcgtcgtagtgtaggttcggtagtgtttttaggtttcgtattagttcgcgatttgtttcgtcgtcgttttttttttagtttttgtttcgttgttagcggaggtttttacgagttttatattgagcgttttttcgtattgtttcgcggcgaagtcgtcgtagaggaagatcgggttgggggtaaaggggcgttagttttgtttatttttagtgttattttcgaacgcgtttttttcggtttttttaaaaat

SEQ ID NO: 15574 - DNA, 604 bp, Artificial Sequence
  chemically treated genomic DNA (Homo sapiens) CpG-island No: 15574
atttttaaaaaaaccgaaaaaaacgcgttcgaaaataacactaaaaataaacaaaactaacgcccctttacccccaacccgatcttcctctacgacgacttcgccgcgaaacaatacgaaaaaacgctcaatataaaactcgtaaaaacctccgctaacaacgaaacaaaaactaaaaaaaaaacgacgacgaaacaaatcgcgaactaatacgaaacctaaaaacactaccgaacctacactacgacgaccgcgacgacgacgacaacgcgacaaattaccataacccgactaccgcaactaccctcccaaaaatctcgttaactctacttaaccgaccaccgccgactcgaccctaaaaaccccgacgacctaacaaacaaccgatccgccgaacgctaacgaaactcgaaaaaaaaaaacgacaatccaaataacgcgcaaataaataccaaaccgcgaaaatttaccgccgaaacccaaaacgcactaactaaatacgccgcccacccgcgacctcacgaaaacgcccgaatccactaaataaacccgacgaaaccgacaacaacaatcgaacgcgaatacgccactctaaccgccgctc

SEQ ID NO: 15575 - DNA, 604 bp, Artificial Sequence
  chemically treated genomic DNA (Homo sapiens) CpG-island No: 15575
gtttttggaggggtcggggagggcgcgttcggggatggtattgggagtgggtagggttgacgtttttttgtttttagttcggtttttttttacggcgatttcgtcgcggggtagtgcggggaggcgtttagtgtagagttcgtgggggttttcgttgatagcggggtagggattgggagaagggcggcggcggagtaggtcgcgggttggtgcggggtttgggggtattgtcgagtttatattgcggcggtcgcggcggcggcggtagcgcgataagttgttatggttcggttgtcgtagttgtttttttaagggtttcgttagttttgtttggtcggttatcgtcgattcggttttagggatttcggcgatttagtaaatagtcgattcgtcgggcgttgacgaggttcgggggaagagggcggtagtttagatggcgcgtaagtgagtgttaggtcgcgaggatttgtcgtcgggatttagggcgtattagttaggtgcgtcgtttattcgcggttttacgggggcgttcgagtttattgaatgagttcggcggggtcgatagtagtagtcgagcgcgggtgcgttattttgatcgtcgttt

SEQ ID NO: 15576 - DNA, 604 bp, Artificial Sequence
  chemically treated genomic DNA (Homo sapiens) CpG-island No: 15576
aaacgacgatcaaaataacgcacccgcgctcgactactactatcgaccccgccgaactcattcaataaactcgaacgcccccgtaaaaccgcgaataaacgacgcacctaactaatacgccctaaatcccgacgacaaatcctcgcgacctaacactcacttacgcgccatctaaactaccgccctcttcccccgaacctcgtcaacgcccgacgaatcgactatttactaaatcgccgaaatccctaaaaccgaatcgacgataaccgaccaaacaaaactaacgaaacccttaaaaaaacaactacgacaaccgaaccataacaacttatcgcgctaccgccgccgccgcgaccgccgcaatataaactcgacaatacccccaaaccccgcaccaacccgcgacctactccgccgccgcccttctcccaatccctaccccgctatcaacgaaaacccccacgaactctacactaaacgcctccccgcactaccccgcgacgaaatcgccgtaaaaaaaaaccgaactaaaaacaaaaaaacgtcaaccctacccactcccaataccatccccgaacgcgccctccccgacccctccaaaaac

SEQ ID NO: 15577 - DNA, 591 bp, Artificial Sequence
  chemically treated genomic DNA (Homo sapiens) CpG-island No: 15577
agaagggatattatcgattgaagtacgattagttcgagcgtcgaagcgaatatagtatattaataataaaagcgatagtaggatatacgtaattcgagtcgatagaagagaagtaattagttcgttatattatttagtatcgcgtatagttaaattatattatattcgagtcgtttaatataataatagtagttagaacgacgaacgtagatagtcgagtattatatatagcgaagtaatagaagaacgaaatataacgaggttagatagcgtaggaagagacgcgaaattatagcgaagacggaaattagaggagagaggtacgatagaatagagagcgtcgagttatatatattcgtatgtagaaagaagtagattatatacgatattacgagaagaagcgtaaattaacgaatataagttaacgagcgatcgtcgagatatagagattaggaagtaggagtcgagcgtaagtagttacgaagagatagtataatataggtacgagcgagcgaagcgataggcggagtagaggacgtagacgtacgtacgttatagtagtcgtattagatagatcgtcgatacgaagta

SEQ ID NO: 15578 - DNA, 591 bp, Artificial Sequence
  chemically treated genomic DNA (Homo sapiens) CpG-island No: 15578
tacttcgtatcgacgatctatctaatacgactactataacgtacgtacgtctacgtcctctactccgcctatcgcttcgctcgctcgtacctatattatactatctcttcgtaactacttacgctcgactcctacttcctaatctctatatctcgacgatcgctcgttaacttatattcgttaatttacgcttcttctcgtaatatcgtatataatctacttctttctacatacgaatatatataactcgacgctctctattctatcgtacctctctcctctaatttccgtcttcgctataatttcgcgtctcttcctacgctatctaacctcgttatatttcgttcttctattacttcgctatatataatactcgactatctacgttcgtcgttctaactactattattatattaaacgactcgaatataatataatttaactatacgcgatactaaataatataacgaactaattacttctcttctatcgactcgaattacgtatatcctactatcgcttttattattaatatactatattcgcttcgacgctcgaactaatcgtacttcaatcgataatatcccttct

SEQ ID NO: 15579 - DNA, 591 bp, Artificial Sequence
  chemically treated genomic DNA (Homo sapiens) CpG-island No: 15579
tgtttcgtgtcggcggtttgtttggtgcggttgttgtggcgtgcgtgcgtttgcgttttttgtttcgtttatcgtttcgttcgttcgtgtttgtgttgtgttgttttttcgtggttgtttacgttcggtttttgttttttggtttttgtgtttcgacggtcgttcgttggtttgtgttcgttggtttgcgttttttttcgtggtgtcgtgtgtggtttgtttttttttgtatgcgggtgtgtgtagttcggcgttttttgttttgtcgtattttttttttttggttttcgttttcgttgtggtttcgcgtttttttttgcgttgtttagtttcgttgtgtttcgtttttttgttgtttcgttgtgtgtggtgttcggttgtttgcgttcgtcgttttgattgttgttgttgtgttgggcggttcgagtgtggtgtggtttggttgtgcgcggtgttgagtggtgtggcgggttggttgttttttttttgtcggttcgggttgcgtgtgttttgttgtcgtttttgttgttggtgtgttgtgttcgtttcggcgttcgggttggtcgtgttttagtcggtggtgtttttttt

SEQ ID NO: 15580 - DNA, 591 bp, Artificial Sequence
  chemically treated genomic DNA (Homo sapiens) CpG-island No: 15580
aaaaaaaacaccaccgactaaaacacgaccaacccgaacgccgaaacgaacacaacacaccaacaacaaaaacgacaacaaaacacacgcaacccgaaccgacaaaaaaaaaacaaccaacccgccacaccactcaacaccgcgcacaaccaaaccacaccacactcgaaccgcccaacacaacaacaacaatcaaaacgacgaacgcaaacaaccgaacaccacacacaacgaaacaacaaaaaaacgaaacacaacgaaactaaacaacgcaaaaaaaaacgcgaaaccacaacgaaaacgaaaaccaaaaaaaaaaaatacgacaaaacaaaaaacgccgaactacacacacccgcatacaaaaaaaaacaaaccacacacgacaccacgaaaaaaaacgcaaaccaacgaacacaaaccaacgaacgaccgtcgaaacacaaaaaccaaaaaacaaaaaccgaacgtaaacaaccacgaaaaaacaacacaacacaaacacgaacgaacgaaacgataaacgaaacaaaaaacgcaaacgcacgcacgccacaacaaccgcaccaaacaaaccgccgacacgaaaca

SEQ ID NO: 15581 - DNA, 664 bp, Artificial Sequence
  chemically treated genomic DNA (Homo sapiens) CpG-island No: 15581
tgaattcgcggtaatttgtttcgtttttttcgttttacggtagttaatcgttttcgttagagaaagaaaggcgtcgaaatgaaattcgttttcgttcgttttcggaattgtcgttattttcgtttttagatttggaggggcggggatgaggagggcggggaggacgacgagggcgaagagggtgggtgagagtttcggagttcgagtcgaagggcgagtcgtaaacgttaagtcgttggttattggtggatatggcgtaggcgcgtttgtttcgacgggtcgaatgttttggggtagtgttttgagcgcggagatcgcgtgatattggatgcgtatgggtatatcgtgttttgcggttgtttggcgttgtttttttttttagaagtgggcgttgggtagttacgtagggtttgaatcggaagcgggagtaggtagttgcgtggttaacggagaaaagaagtcgtggtcgcgggaggaggcgagaggagtcgggatttgcgttgtagttatcgtcgcggttgatattattttgatttttcgagtgtagtggtaggggcgcggaggtaacgtagcggtttttgcgttgggaaatttagtcgtgtgcgatttagtttgttttttttttagatcgttaattttatgtatttttttagagtggtttttg

SEQ ID NO: 15582 - DNA, 664 bp, Artificial Sequence
  chemically treated genomic DNA (Homo sapiens) CpG-island No: 15582
caaaaaccactctaaaaaaatacataaaattaacgatctaaaaaaaaaacaaactaaatcgcacacgactaaatttcccaacgcaaaaaccgctacgttacctccgcgcccctaccactacactcgaaaaatcaaaataatatcaaccgcgacgataactacaacgcaaatcccgactcctctcgcctcctcccgcgaccacgacttcttttctccgttaaccacgcaactacctactcccgcttccgattcaaaccctacgtaactacccaacgcccacttctaaaaaaaaaaacaacgccaaacaaccgcaaaacacgatatacccatacgcatccaatatcacgcgatctccgcgctcaaaacactaccccaaaacattcgacccgtcgaaacaaacgcgcctacgccatatccaccaataaccaacgacttaacgtttacgactcgcccttcgactcgaactccgaaactctcacccaccctcttcgccctcgtcgtcctccccgccctcctcatccccgcccctccaaatctaaaaacgaaaataacgacaattccgaaaacgaacgaaaacgaatttcatttcgacgcctttctttctctaacgaaaacgattaactaccgtaaaacgaaaaaaacgaaacaaattaccgcgaattca

SEQ ID NO: 15583 - DNA, 664 bp, Artificial Sequence
  chemically treated genomic DNA (Homo sapiens) CpG-island No: 15583
taagggttattttggaggggtgtatgagattggcggtttggggagaggatagattgggtcgtatacgattgaattttttagcgtagaagtcgttgcgttgttttcgcgtttttattattgtattcggaaggttaaagtagtattaatcgcggcggtggttgtagcgtagatttcgatttttttcgttttttttcgcggttacggtttttttttttcgttagttacgtagttatttattttcgttttcggtttaaattttgcgtgattgtttagcgtttatttttggaggaagaagtaacgttaagtagtcgtagagtacggtatgtttatgcgtatttagtattacgcggttttcgcgtttaaaatattgttttaaaatattcggttcgtcggagtaaacgcgtttgcgttatgtttattaatggttagcgatttagcgtttgcggttcgtttttcggttcgggtttcggggtttttatttatttttttcgttttcgtcgtttttttcgttttttttattttcgtttttttaagtttgaggacggaagtgacgatagtttcgaaggcgaacggaggcgggttttatttcggcgtttttttttttttggcggaagcgattggttgtcgtgaagcgaaagaggcgggataaattgtcgcgagttta

SEQ ID NO: 15584 - DNA, 664 bp, Artificial Sequence
  chemically treated genomic DNA (Homo sapiens) CpG-island No: 15584
taaactcgcgacaatttatcccgcctctttcgcttcacgacaaccaatcgcttccgccaaaaaaaaaaaaacgccgaaataaaacccgcctccgttcgccttcgaaactatcgtcacttccgtcctcaaacttaaaaaaacgaaaataaaaaaaacgaaaaaaacgacgaaaacgaaaaaaataaataaaaaccccgaaacccgaaccgaaaaacgaaccgcaaacgctaaatcgctaaccattaataaacataacgcaaacgcgtttactccgacgaaccgaatattttaaaacaatattttaaacgcgaaaaccgcgtaatactaaatacgcataaacataccgtactctacgactacttaacgttacttcttcctccaaaaataaacgctaaacaatcacgcaaaatttaaaccgaaaacgaaaataaataactacgtaactaacgaaaaaaaaaaaccgtaaccgcgaaaaaaaacgaaaaaaatcgaaatctacgctacaaccaccgccgcgattaatactactttaaccttccgaatacaataataaaaacgcgaaaacaacgcaacgacttctacgctaaaaaattcaatcgtatacgacccaatctatcctctccccaaaccgccaatctcatacacccctccaaaataaccctta

SEQ ID NO: 15585 - DNA, 501 bp, Artificial Sequence
  chemically treated genomic DNA (Homo sapiens) CpG-island No: 15585
ggcgcgttattgagtataaaggagataatagcgaggcggtagcgggcgttgattttcgttcgttagttattcgtaattgcggttatagatttgtagtttttttttttttagtcggttcgttcgtttttttgtttttttttttttttcgtattggacggtttcggtttattttcgggtttcggatatttggtatcgattggggtcggggacgcggagtaggtggtcgcggcggggtagttgggtcgttagtttggtgtttcggggatcgtttttcgttgttttggttattagtttttgttcgttcgattcgtttcgtttttcggtttgcgagttttgtcggtcggattttgcgtcgcgttcggcgttgttgttgcgttcggggtttcgttcggcgtcggcggtgatcgggaagttcgcgttaaaggggtaatcgggattttggttcggtatggttgaagttagtatcgattagtttaagttgtttggagttaaggaaggtaa

SEQ ID NO: 15586 - DNA, 501 bp, Artificial Sequence
  chemically treated genomic DNA (Homo sapiens) CpG-island No: 15586
ttaccttccttaactccaaacaacttaaactaatcgatactaacttcaaccataccgaaccaaaatcccgattacccctttaacgcgaacttcccgatcaccgccgacgccgaacgaaaccccgaacgcaacaacaacgccgaacgcgacgcaaaatccgaccgacaaaactcgcaaaccgaaaaacgaaacgaatcgaacgaacaaaaactaataaccaaaacaacgaaaaacgatccccgaaacaccaaactaacgacccaactaccccgccgcgaccacctactccgcgtccccgaccccaatcgataccaaatatccgaaacccgaaaataaaccgaaaccgtccaatacgaaaaaaaaaaaaaaacaaaaaaacgaacgaaccgactaaaaaaaaaaaaactacaaatctataaccgcaattacgaataactaacgaacgaaaatcaacgcccgctaccgcctcgctattatctcctttatactcaataacgcgcc

SEQ ID NO: 15587 - DNA, 501 bp, Artificial Sequence
  chemically treated genomic DNA (Homo sapiens) CpG-island No: 15587
ttattttttttgattttaggtagtttggattggtcgatgttgattttagttatatcgggttagggtttcggttgtttttttaacgcgggtttttcggttatcgtcggcgtcgagcggggtttcgagcgtagtagtagcgtcggacgcggcgtaaagttcggtcggtagggttcgtaggtcggagaacggagcgggtcgggcgggtaggggttggtgattaaagtagcgggagacggttttcgaggtattaagttggcggtttagttgtttcgtcgcggttatttgtttcgcgttttcggttttaatcgatattaaatattcggagttcggaaatggatcggggtcgtttagtacggagggagagaggagatagaaaggcgggcgggtcggttgggggagggggagttgtaggtttgtaatcgtaattgcgagtggttggcgagcgaagattagcgttcgttgtcgtttcgttgttgttttttttgtgtttagtgacgcgtt

SEQ ID NO: 15588 - DNA, 501 bp, Artificial Sequence
  chemically treated genomic DNA (Homo sapiens) CpG-island No: 15588
aacgcgtcactaaacacaaaaaaaacaacaacgaaacgacaacgaacgctaatcttcgctcgccaaccactcgcaattacgattacaaacctacaactccccctcccccaaccgacccgcccgcctttctatctcctctctccctccgtactaaacgaccccgatccatttccgaactccgaatatttaatatcgattaaaaccgaaaacgcgaaacaaataaccgcgacgaaacaactaaaccgccaacttaatacctcgaaaaccgtctcccgctactttaatcaccaacccctacccgcccgacccgctccgttctccgacctacgaaccctaccgaccgaactttacgccgcgtccgacgctactactacgctcgaaaccccgctcgacgccgacgataaccgaaaaacccgcgttaaaaaaacaaccgaaaccctaacccgatataactaaaatcaacatcgaccaatccaaactacctaaaatcaaaaaaaataa

SEQ ID NO: 15589 - DNA, 583 bp, Artificial Sequence
  chemically treated genomic DNA (Homo sapiens) CpG-island No: 15589
gggttacgggcgagtggagttgtaggggttcgggcggagagtcgttgttatttagggaagttttcgggatttcgggtttttcgcgaagtttcggacgggcgttatcgaagtcgagagtttcggtcgagttttttcgtacggtgggcgtcgcgtttaggcgagcgcgcgaggtcgggcggggtcgggggtcgttcggggagggggcggggtcgggattttcgcggtcgcgcgtaggggttgggaagttgttttttcggtcgcgtcgggcgaggggttgcgtcggttcgcgaggcgtatgcgcgttgtcgagcggttttcgtttttttttcgtttatcgttttttttttttttttttttttttttgtattttcgtcgtttttttttttttttcgttcgttgggtgttgaagttgggcggatggtagtaaatcggtttcgttagaggatcgagtcgtttagtttcgttttttcggatttatcggcgcgttgtttatatttttaggcgatcgggtaagacgttgtttttaaaataagcggtgttaagtaaatgatattaaaatgtttgttttgtattaatggatgga

SEQ ID NO: 15590 - DNA, 583 bp, Artificial Sequence
  chemically treated genomic DNA (Homo sapiens) CpG-island No: 15590
tccatccattaatacaaaacaaacattttaatatcatttacttaacaccgcttattttaaaaacaacgtcttacccgatcgcctaaaaatataaacaacgcgccgataaatccgaaaaaacgaaactaaacgactcgatcctctaacgaaaccgatttactaccatccgcccaacttcaacacccaacgaacgaaaaaaaaaaaaaaacgacgaaaatacaaaaaaaaaaaaaaaaaaaaaaaaaacgataaacgaaaaaaaaacgaaaaccgctcgacaacgcgcatacgcctcgcgaaccgacgcaacccctcgcccgacgcgaccgaaaaaacaacttcccaacccctacgcgcgaccgcgaaaatcccgaccccgccccctccccgaacgacccccgaccccgcccgacctcgcgcgctcgcctaaacgcgacgcccaccgtacgaaaaaactcgaccgaaactctcgacttcgataacgcccgtccgaaacttcgcgaaaaacccgaaatcccgaaaacttccctaaataacaacgactctccgcccgaacccctacaactccactcgcccgtaaccc

SEQ ID NO: 15591 - DNA, 583 bp, Artificial Sequence
  chemically treated genomic DNA (Homo sapiens) CpG-island No: 15591
tttatttattggtgtaaagtagatattttgatgttatttatttagtatcgtttgttttggaggtagcgttttattcggtcgtttggaggtgtgggtagcgcgtcgatgggttcgggggagcggggttgggcggttcggttttttagcggagtcggtttgttgttattcgtttaattttagtatttagcgggcgaggagagagggagagcggcgaggatgtagaggagggggagggggaggagggagcggtgggcggggagggagcgagagtcgttcggtagcgcgtatgcgtttcgcgggtcggcgtagtttttcgttcggcgcggtcggaggggtagttttttagtttttgcgcgcggtcgcgagagtttcggtttcgtttttttttcgggcggttttcggtttcgttcgatttcgcgcgttcgtttgggcgcggcgtttatcgtgcggaggggttcggtcgggattttcggtttcggtgacgttcgttcggagtttcgcgggaggttcggagtttcgagagtttttttgggtgatagcggtttttcgttcgggtttttgtaattttattcgttcgtagttt

SEQ ID NO: 15592 - DNA, 583 bp, Artificial Sequence
  chemically treated genomic DNA (Homo sapiens) CpG-island No: 15592
aaactacgaacgaataaaattacaaaaacccgaacgaaaaaccgctatcacccaaaaaaactctcgaaactccgaacctcccgcgaaactccgaacgaacgtcaccgaaaccgaaaatcccgaccgaacccctccgcacgataaacgccgcgcccaaacgaacgcgcgaaatcgaacgaaaccgaaaaccgcccgaaaaaaaaacgaaaccgaaactctcgcgaccgcgcgcaaaaactaaaaaactacccctccgaccgcgccgaacgaaaaactacgccgacccgcgaaacgcatacgcgctaccgaacgactctcgctccctccccgcccaccgctccctcctccccctccccctcctctacatcctcgccgctctccctctctcctcgcccgctaaatactaaaattaaacgaataacaacaaaccgactccgctaaaaaaccgaaccgcccaaccccgctcccccgaacccatcgacgcgctacccacacctccaaacgaccgaataaaacgctacctccaaaacaaacgatactaaataaataacatcaaaatatctactttacaccaataaataaa

SEQ ID NO: 15593 - DNA, 531 bp, Artificial Sequence
  chemically treated genomic DNA (Homo sapiens) CpG-island No: 15593
gggcggggcgtggagggttaggtttcgtttttcgaacgacggttttaagtgtgcgtacgcgtagggggtcgcgtttttttcgggcggcggtatcgtttatagtttgggacgttagcggcgcgcgacgtgttttgttgtataaatgcggtggcgttcggcgtagggatatttcggttttgagcgtttgggagttaggttgtttgtcggcgtagcggttagcgtttgagttcgtttttgattttcgttgtggtatggcggacgaggggaagtcgtatagcggtaagtgttggttttcgggtcgggaattggttatttggggcgcgggtgggcggcgtcggtttaggttttagttttcggggcgtgaggtcgttaggggttcggcgttcgcggggagcggcgcgcggggggtcgggtattcgaggtggatattcgagttgttgatttttggatttttgttggtattttggtgttgggggatttgcggttcggagcggatggttcgggggtagggtgacgggatttttttgaatt

SEQ ID NO: 15594 - DNA, 531 bp, Artificial Sequence
  chemically treated genomic DNA (Homo sapiens) CpG-island No: 15594
aattcaaaaaaatcccgtcaccctacccccgaaccatccgctccgaaccgcaaatcccccaacaccaaaataccaacaaaaatccaaaaatcaacaactcgaatatccacctcgaatacccgaccccccgcgcgccgctccccgcgaacgccgaacccctaacgacctcacgccccgaaaactaaaacctaaaccgacgccgcccacccgcgccccaaataaccaattcccgacccgaaaaccaacacttaccgctatacgacttcccctcgtccgccataccacaacgaaaatcaaaaacgaactcaaacgctaaccgctacgccgacaaacaacctaactcccaaacgctcaaaaccgaaatatccctacgccgaacgccaccgcatttatacaacaaaacacgtcgcgcgccgctaacgtcccaaactataaacgataccgccgcccgaaaaaaacgcgaccccctacgcgtacgcacacttaaaaccgtcgttcgaaaaacgaaacctaaccctccacgccccgccc

SEQ ID NO: 15595 - DNA, 531 bp, Artificial Sequence
  chemically treated genomic DNA (Homo sapiens) CpG-island No: 15595
agtttaaaggaatttcgttattttattttcgagttattcgtttcgagtcgtaggttttttaatattaggatgttagtaggaatttaggagttaataattcgggtgtttatttcgagtgttcggtttttcgcgcgtcgtttttcgcggacgtcgggtttttagcggttttacgtttcgggggttgaggtttaggtcggcgtcgtttattcgcgttttagatagttagttttcgattcgaagattagtatttatcgttgtacgattttttttcgttcgttatgttatagcgaagattaagggcgggtttaggcgttggtcgttacgtcggtaaataatttaatttttaagcgtttaggatcgaagtgtttttacgtcgggcgttatcgtatttatatagtaaagtacgtcgcgcgtcgttgacgttttaggttgtgggcggtgtcgtcgttcggagaaagcgcggttttttgcgcgtgcgtatatttaaggtcgtcgttcgaggggcggggtttggttttttacgtttcgttt

SEQ ID NO: 15596 - DNA, 531 bp, Artificial Sequence
  chemically treated genomic DNA (Homo sapiens) CpG-island No: 15596
aaacgaaacgtaaaaaaccaaaccccgcccctcgaacgacgaccttaaatatacgcacgcgcaaaaaaccgcgctttctccgaacgacgacaccgcccacaacctaaaacgtcaacgacgcgcgacgtactttactatataaatacgataacgcccgacgtaaaaacacttcgatcctaaacgcttaaaaattaaattatttaccgacgtaacgaccaacgcctaaacccgcccttaatcttcgctataacataacgaacgaaaaaaaatcgtacaacgataaatactaatcttcgaatcgaaaactaactatctaaaacgcgaataaacgacgccgacctaaacctcaacccccgaaacgtaaaaccgctaaaaacccgacgtccgcgaaaaacgacgcgcgaaaaaccgaacactcgaaataaacacccgaattattaactcctaaattcctactaacatcctaatattaaaaaacctacgactcgaaacgaataactcgaaaataaaataacgaaattcctttaaact

SEQ ID NO: 15597 - DNA, 524 bp, Artificial Sequence
  chemically treated genomic DNA (Homo sapiens) CpG-island No: 15597
ggagatagcgatttcgtagttcgggaaggtttcgtttcgtttcgtttcgtttcgtcgtgttggatttcgttttgggttgaagtttcgttttttacggttataaaagcggtcggcggagaggggcgggattttttcgggagtcggaagtttcgttttacggttgttttggtagcgcgcgaggttggtgagtcggtagttttgtggtagtcggcgggttggtttttatggttgtacgattaggtaggggtttcgggcgttttgtttattttcgagttggaggggattggcgggaagcggcggttggttgtagggcgtttcgtcgggcgtggggtgtagtcgtgtcggtgagcgagttttgttcgaggcggagaggagaaattcgggaagtaattgtggttattttaaggttattggtttcgagttaggtcgtgcgattttaggtaagtcgtatatttttttcgtgtagttgtttagtagtgtggatttagtattatcgtgtgtgtaaagttttttttaagaatcgt

SEQ ID NO: 15598 - DNA, 524 bp, Artificial Sequence
  chemically treated genomic DNA (Homo sapiens) CpG-island No: 15598
acgattcttaaaaaaaactttacacacacgataatactaaatccacactactaaacaactacacgaaaaaaatatacgacttacctaaaatcgcacgacctaactcgaaaccaataaccttaaaataaccacaattacttcccgaatttctcctctccgcctcgaacaaaactcgctcaccgacacgactacaccccacgcccgacgaaacgccctacaaccaaccgccgcttcccgccaatcccctccaactcgaaaataaacaaaacgcccgaaacccctacctaatcgtacaaccataaaaaccaacccgccgactaccacaaaactaccgactcaccaacctcgcgcgctaccaaaacaaccgtaaaacgaaacttccgactcccgaaaaaatcccgcccctctccgccgaccgcttttataaccgtaaaaaacgaaacttcaacccaaaacgaaatccaacacgacgaaacgaaacgaaacgaaacgaaaccttcccgaactacgaaatcgctatctcc

SEQ ID NO: 15599 - DNA, 524 bp, Artificial Sequence
  chemically treated genomic DNA (Homo sapiens) CpG-island No: 15599
acgatttttagaaagagttttatatatacggtgatattgaatttatattgttaggtagttgtacggagagaatgtgcgatttgtttaaggtcgtacggtttgattcgaaattagtagttttagagtagttataattgtttttcgagtttttttttttcgtttcgagtagagttcgtttatcgatacggttatattttacgttcggcggagcgttttgtagttaatcgtcgtttttcgttagttttttttagttcgggggtgggtaaagcgttcggagtttttatttaatcgtgtaattatggaaattagttcgtcggttgttatagggttgtcgatttattagtttcgcgcgttgttagggtaatcgtgagacgggattttcggttttcggggaagtttcgttttttttcgtcggtcgtttttgtagtcgtgggaggcggggttttagtttagggcggggtttagtacggcggggcggggcgggacggggcggagttttttcgagttgcgaggtcgttgttttt

SEQ ID NO: 15600 - DNA, 524 bp, Artificial Sequence
  chemically treated genomic DNA (Homo sapiens) CpG-island No: 15600
aaaaacaacgacctcgcaactcgaaaaaactccgccccgtcccgccccgccccgccgtactaaaccccgccctaaactaaaaccccgcctcccacgactacaaaaacgaccgacgaaaaaaaacgaaacttccccgaaaaccgaaaatcccgtctcacgattaccctaacaacgcgcgaaactaataaatcgacaaccctataacaaccgacgaactaatttccataattacacgattaaataaaaactccgaacgctttacccacccccgaactaaaaaaaactaacgaaaaacgacgattaactacaaaacgctccgccgaacgtaaaatataaccgtatcgataaacgaactctactcgaaacgaaaaaaaaaaactcgaaaaacaattataactactctaaaactactaatttcgaatcaaaccgtacgaccttaaacaaatcgcacattctctccgtacaactacctaacaatataaattcaatatcaccgtatatataaaactctttctaaaaatcgt

SEQ ID NO: 15601 - DNA, 1205 bp, Artificial Sequence
  chemically treated genomic DNA (Homo sapiens) CpG-island No: 15601
acgaaattcgattttatttagtgttttaagacgttattgattcgtttttttggcgaggggataatttcgaagtatgatttggttaggaggagttataaagcgcgattagtttcgttgtattttaggtataggtcggcgttagtcgtgttttattaggtttatcggtttcgagtagtagtaagttcggtcggaaagcgaaagtggtttcgttatgtttagatcggttagttttttcgtttatttgatttcgtttcgtagtcgtatttgggttcgagttatcgtcgcggtcgttacggtttcgtataggaaggcggtagtaaagagcgtaagttcgacgcgttgtagttaggatagcgttatggcgttttgattattaggaagcgtcgttgtagtagtatttcgtttaaagtttattttattcggcgcgatttacgaaggtggagacgttattttcgggggcgggatttatttataaggaacgaaggggttattgatttagagcggtaagtatagcgagtagttcgagagcgtttatcggcgggcggggcggttggtacggtcgattatgggtagtttttgtacgtagcgcgaggtcgggttaggttcgtacggcgcggggaaggtagtttggaaaaggcgttcgcggtagcgttttttagtttgtcgttcggttatgatgaaacgaaagtgcggggcgtcgcgcggggcgaaacggttttgggggagaacgtcgcgggtgtcggtttcggggttttgttgtcggggtgtttcgcgcgttcgatgtacgcgcggtaagggtttgtttttagaggcggcgggtttagaggtcgacgcggggtcgttttcgtcgttgtttcgggggttttcgtcgtcgtgcgggttgattatggcgtttgtcgttagttgcggtatttttcgtatcgagttcggggttgtcgtcggtttttttttgttttcgggcggtcgcggagtcgtgggtgtaggttggtcggtgttaaagcgtgtggttaagttgttatcgaagaaggcgtagagttttcggtagatgtcggttaaggttatcgaaagagaagggtttttcggtttcgcgttttttggcggtagcgggaggtcggatttaaagttgggttttgtatcgttttcggaggacgatttttgaaagagaaggttgttttatggtaggtcgtttaggcgtcggtattttt

SEQ ID NO: 15602 - DNA, 1205 bp, Artificial Sequence
  chemically treated genomic DNA (Homo sapiens) CpG-island No: 15602
aaaaataccgacgcctaaacgacctaccataaaacaaccttctctttcaaaaatcgtcctccgaaaacgatacaaaacccaactttaaatccgacctcccgctaccgccaaaaaacgcgaaaccgaaaaacccttctctttcgataaccttaaccgacatctaccgaaaactctacgccttcttcgataacaacttaaccacacgctttaacaccgaccaacctacacccacgactccgcgaccgcccgaaaacaaaaaaaaaccgacgacaaccccgaactcgatacgaaaaataccgcaactaacgacaaacgccataatcaacccgcacgacgacgaaaacccccgaaacaacgacgaaaacgaccccgcgtcgacctctaaacccgccgcctctaaaaacaaacccttaccgcgcgtacatcgaacgcgcgaaacaccccgacaacaaaaccccgaaaccgacacccgcgacgttctcccccaaaaccgtttcgccccgcgcgacgccccgcactttcgtttcatcataaccgaacgacaaactaaaaaacgctaccgcgaacgccttttccaaactaccttccccgcgccgtacgaacctaacccgacctcgcgctacgtacaaaaactacccataatcgaccgtaccaaccgccccgcccgccgataaacgctctcgaactactcgctatacttaccgctctaaatcaataaccccttcgttccttataaataaatcccgcccccgaaaataacgtctccaccttcgtaaatcgcgccgaataaaataaactttaaacgaaatactactacaacgacgcttcctaataatcaaaacgccataacgctatcctaactacaacgcgtcgaacttacgctctttactaccgccttcctatacgaaaccgtaacgaccgcgacgataactcgaacccaaatacgactacgaaacgaaatcaaataaacgaaaaaactaaccgatctaaacataacgaaaccactttcgctttccgaccgaacttactactactcgaaaccgataaacctaataaaacacgactaacgccgacctatacctaaaatacaacgaaactaatcgcgctttataactcctcctaaccaaatcatacttcgaaattatcccctcgccaaaaaaacgaatcaataacgtcttaaaacactaaataaaatcgaatttcgt

SEQ ID NO: 15603 - DNA, 1205 bp, Artificial Sequence
  chemically treated genomic DNA (Homo sapiens) CpG-island No: 15603
gggggtgtcggcgtttggacgatttgttatgggatagtttttttttttaagagtcgtttttcgggggcggtgtagaatttagttttgggttcggtttttcgttgtcgttagggggcgcggggtcggaggatttttttttttcggtgattttggtcgatatttatcgggagttttacgtttttttcggtgatagtttggttatacgttttggtatcggttagtttgtatttacggtttcgcggtcgttcggggataagaaggagtcggcggtagtttcggattcggtgcggaagatgtcgtagttgacggtaagcgttatagttagttcgtacggcgacgagagttttcggggtagcggcggaggcggtttcgcgtcggtttttgggttcgtcgtttttgagagtaggtttttgtcgcgcgtgtatcgggcgcgcggggtatttcggtagtagggtttcgggatcggtattcgcgacgtttttttttagagtcgtttcgtttcgcgcggcgtttcgtattttcgttttattatagtcgggcggtaggttgggaggcgttgtcgcgggcgttttttttagattgtttttttcgcgtcgtacgggtttagttcggtttcgcgttacgtgtagaaattgtttatgatcggtcgtattagtcgtttcgttcgtcggtgggcgttttcggattattcgttgtatttgtcgttttgagttagtggttttttcgttttttgtaaataaatttcgttttcggaagtgacgtttttattttcgtgggtcgcgtcggataaggtgggttttgggcggggtgttgttgtagcggcgttttttggtggttagggcgttatggcgttgttttggttgtagcgcgtcgagtttgcgttttttgttgtcgtttttttgtgcggggtcgtggcggtcgcggcgatgattcggatttaggtgcggttgcggggcggggttaggtaggcgggggagttggtcggtttggatatggcgaggttattttcgtttttcgatcgggtttgttgttgttcggagtcggtggatttggtgaggtacggttggcgtcggtttgtatttgaaatgtagcgaggttaatcgcgttttgtggttttttttggttaggttatatttcgaagttgttttttcgttaaagggacgggttagtagcgttttaaagtattaggtggagtcgggtttcgt

SEQ ID NO: 15604 - DNA, 1205 bp, Artificial Sequence
  chemically treated genomic DNA (Homo sapiens) CpG-island No: 15604
acgaaacccgactccacctaatactttaaaacgctactaacccgtccctttaacgaaaaaacaacttcgaaatataacctaaccaaaaaaaaccacaaaacgcgattaacctcgctacatttcaaatacaaaccgacgccaaccgtacctcaccaaatccaccgactccgaacaacaacaaacccgatcgaaaaacgaaaataacctcgccatatccaaaccgaccaactcccccgcctacctaaccccgccccgcaaccgcacctaaatccgaatcatcgccgcgaccgccacgaccccgcacaaaaaaacgacaacaaaaaacgcaaactcgacgcgctacaaccaaaacaacgccataacgccctaaccaccaaaaaacgccgctacaacaacaccccgcccaaaacccaccttatccgacgcgacccacgaaaataaaaacgtcacttccgaaaacgaaatttatttacaaaaaacgaaaaaaccactaactcaaaacgacaaatacaacgaataatccgaaaacgcccaccgacgaacgaaacgactaatacgaccgatcataaacaatttctacacgtaacgcgaaaccgaactaaacccgtacgacgcgaaaaaaacaatctaaaaaaaacgcccgcgacaacgcctcccaacctaccgcccgactataataaaacgaaaatacgaaacgccgcgcgaaacgaaacgactctaaaaaaaaacgtcgcgaataccgatcccgaaaccctactaccgaaataccccgcgcgcccgatacacgcgcgacaaaaacctactctcaaaaacgacgaacccaaaaaccgacgcgaaaccgcctccgccgctaccccgaaaactctcgtcgccgtacgaactaactataacgcttaccgtcaactacgacatcttccgcaccgaatccgaaactaccgccgactccttcttatccccgaacgaccgcgaaaccgtaaatacaaactaaccgataccaaaacgtataaccaaactatcaccgaaaaaaacgtaaaactcccgataaatatcgaccaaaatcaccgaaaaaaaaaaatcctccgaccccgcgccccctaacgacaacgaaaaaccgaacccaaaactaaattctacaccgcccccgaaaaacgactcttaaaaaaaaaaactatcccataacaaatcgtccaaacgccgacaccccc

SEQ ID NO: 15605 - DNA, 717 bp, Artificial Sequence
  chemically treated genomic DNA (Homo sapiens) CpG-island No: 15605
ataggttcggagtcgatttcgtttcgttcgtagggtttttcgtcgtttcgatatttttttagaaagataaagaatagcgggaggcggtaggttcggcggtttagttgcgagcgttttggtgttcgaggtcgtttttcggtagtagtgggaggaacgtttcgaggggagggtaggagaggggcggggaggagttgagacgggcggggaagagttcgggtttttttttttatatttcgttaggacgtcggttggggcgggtcggtagagggcgcggggcggtttttcgttcggcgggttcggtaggttcggcgggttgggggcgcgttgtttcgggcgtattgtcggagttcgcgggtatcgggtcgcggcggttcgggcggtcggagtcggtaggggaagtgcggcgggcgggtaggcgggcggtcgggaacgggcggggcggggcggggcgcgaagggggcggtgtcgcgagcggggggcggtggcggcggcggcggtggcggtcgaggaggagaatatggcggtcgcggagagcggttgaaatgtttgttttttaggtcgggcgagcgggagtttgacgcgatttgttgagttttgtttttcgacggttgtttcgcggttttgagggttttcgtcgtttgttcgttgttgttttttcgagcggagtttgcgttaggttttttttgtatttttttgcggggggatttttgtttcgga

SEQ ID NO: 15606 - DNA, 717 bp, Artificial Sequence
  chemically treated genomic DNA (Homo sapiens) CpG-island No: 15606
tccgaaacaaaaatccccccgcaaaaaaatacaaaaaaaacctaacgcaaactccgctcgaaaaaacaacaacgaacaaacgacgaaaaccctcaaaaccgcgaaacaaccgtcgaaaaacaaaactcaacaaatcgcgtcaaactcccgctcgcccgacctaaaaaacaaacatttcaaccgctctccgcgaccgccatattctcctcctcgaccgccaccgccgccgccgccaccgccccccgctcgcgacaccgcccccttcgcgccccgccccgccccgcccgttcccgaccgcccgcctacccgcccgccgcacttcccctaccgactccgaccgcccgaaccgccgcgacccgatacccgcgaactccgacaatacgcccgaaacaacgcgcccccaacccgccgaacctaccgaacccgccgaacgaaaaaccgccccgcgccctctaccgacccgccccaaccgacgtcctaacgaaatataaaaaaaaaaacccgaactcttccccgcccgtctcaactcctccccgcccctctcctaccctcccctcgaaacgttcctcccactactaccgaaaaacgacctcgaacaccaaaacgctcgcaactaaaccgccgaacctaccgcctcccgctattctttatctttctaaaaaaatatcgaaacgacgaaaaaccctacgaacgaaacgaaatcgactccgaacctat

SEQ ID NO: 15607 - DNA, 717 bp, Artificial Sequence
  chemically treated genomic DNA (Homo sapiens) CpG-island No: 15607
ttcggagtaggggttttttcgtagggggatgtagagggaatttgacgtaggtttcgttcgagggagtagtagcgaataggcggcggaggtttttaaggtcgcgaggtagtcgtcggaggatagagtttagtaaatcgcgttagattttcgttcgttcggtttgaagaataggtattttagtcgtttttcgcggtcgttatgttttttttttcggtcgttatcgtcgtcgtcgttatcgtttttcgttcgcggtatcgtttttttcgcgtttcgtttcgtttcgttcgttttcggtcgttcgtttgttcgttcgtcgtattttttttgtcggtttcggtcgttcgggtcgtcgcgattcggtgttcgcgagtttcgatagtgcgttcgggatagcgcgtttttagttcgtcgggtttgtcgggttcgtcgagcgaggaatcgtttcgcgttttttgtcggttcgttttagtcggcgttttaacgaagtgtgggaaaggaggttcgaattttttttcgttcgttttaattttttttcgttttttttttgtttttttttcggggcgttttttttattgttgtcgggaagcggtttcgaatattagggcgttcgtagttaggtcgtcgggtttgtcgtttttcgttgttttttatttttttgggaaggtgtcggagcggcgagaggttttgcggacggggcggagtcggtttcgggtttgt

SEQ ID NO: 15608 - DNA, 717 bp, Artificial Sequence
  chemically treated genomic DNA (Homo sapiens) CpG-island No: 15608
acaaacccgaaaccgactccgccccgtccgcaaaacctctcgccgctccgacaccttcccaaaaaaataaaaaacaacgaaaaacgacaaacccgacgacctaactacgaacgccctaatattcgaaaccgcttcccgacaacaataaaaaaaacgccccgaaaaaaaaacaaaaaaaaaacgaaaaaaaattaaaacgaacgaaaaaaaattcgaacctcctttcccacacttcgttaaaacgccgactaaaacgaaccgacaaaaaacgcgaaacgattcctcgctcgacgaacccgacaaacccgacgaactaaaaacgcgctatcccgaacgcactatcgaaactcgcgaacaccgaatcgcgacgacccgaacgaccgaaaccgacaaaaaaaatacgacgaacgaacaaacgaacgaccgaaaacgaacgaaacgaaacgaaacgcgaaaaaaacgataccgcgaacgaaaaacgataacgacgacgacgataacgaccgaaaaaaaaaacataacgaccgcgaaaaacgactaaaatacctattcttcaaaccgaacgaacgaaaatctaacgcgatttactaaactctatcctccgacgactacctcgcgaccttaaaaacctccgccgcctattcgctactactccctcgaacgaaacctacgtcaaattccctctacatccccctacgaaaaaacccctactccgaa

SEQ ID NO: 15609 - DNA, 848 bp, Artificial Sequence
  chemically treated genomic DNA (Homo sapiens) CpG-island No: 15609
gagggggtcggagagtcgcggcgtcgggttcgaggagcggcggaggtcggggcggcgtcgtcgttacggtcgcggacgagtgcggcgtcggtgagcggggtttagaggcggcggcggtaggtgagtggcgggttgcgggtgcggagtttttcggtgggtgtagttgttacgagtcgcgcggtcgcggaggttttagggggcggggagtagttggcgttttttcgttttttgtttttttttttttcgttttattttttttttattttttcgagtttttttcgcggttcggcgcggttggagggggcggaggtcgtagttgttacgggtattagttgggggttgtttttcgtcgggggaaatcgttgtagtagcgattttttttcgttttttttttagttgttttagttagcgcggagagggcgagtattcgcggagggggtgcgagttgcgcggtcgtttgttcggcgtggggagcgggcgtttcgggtcgtcgtcgagagggggagtcggaagtcggcgcggggcgtttttcggtttcgacgacgtcgtgattttggtcggttcgtttatttttcggaatttcgtttgtcgggatcgcgaaatgggggcgatcgcggcgttttttttcgtcggcgtagttttcgacggcgtttgggtttgatttcggcgcgtttgttcgttttttttttcgagaaggggtttcggaggtagatatgggatggatattggatatgtttttgtcgcggttcgggtttggttttttttttgggatttagtcgaaagggtcgaggaagggaagtaaatatgttgacgaggcgattgggaggtggggttggttagtgggtagt

SEQ ID NO: 15610 - DNA, 848 bp, Artificial Sequence
  chemically treated genomic DNA (Homo sapiens) CpG-island No: 15610
actacccactaaccaaccccacctcccaatcgcctcgtcaacatatttacttcccttcctcgaccctttcgactaaatcccaaaaaaaaaaccaaacccgaaccgcgacaaaaacatatccaatatccatcccatatctacctccgaaaccccttctcgaaaaaaaaaacgaacaaacgcgccgaaatcaaacccaaacgccgtcgaaaactacgccgacgaaaaaaaacgccgcgatcgcccccatttcgcgatcccgacaaacgaaattccgaaaaataaacgaaccgaccaaaatcacgacgtcgtcgaaaccgaaaaacgccccgcgccgacttccgactccccctctcgacgacgacccgaaacgcccgctccccacgccgaacaaacgaccgcgcaactcgcaccccctccgcgaatactcgccctctccgcgctaactaaaacaactaaaaaaaaaacgaaaaaaaatcgctactacaacgatttcccccgacgaaaaacaacccccaactaatacccgtaacaactacgacctccgccccctccaaccgcgccgaaccgcgaaaaaaactcgaaaaaataaaaaaaaaataaaacgaaaaaaaaaaaaacaaaaaacgaaaaaacgccaactactccccgccccctaaaacctccgcgaccgcgcgactcgtaacaactacacccaccgaaaaactccgcacccgcaacccgccactcacctaccgccgccgcctctaaaccccgctcaccgacgccgcactcgtccgcgaccgtaacgacgacgccgccccgacctccgccgctcctcgaacccgacgccgcgactctccgaccccctc

SEQ ID NO: 15611 - DNA, 848 bp, Artificial Sequence
  chemically treated genomic DNA (Homo sapiens) CpG-island No: 15611
attgtttattaattaattttattttttaatcgtttcgttaatatgtttgtttttttttttcggttttttcggttgaattttaggaaggggattaaattcgggtcgcgataggaatatgtttagtatttattttatgtttattttcgaaattttttttcgggagaaggggcgagtaagcgcgtcggggttaaatttaagcgtcgtcgagggttgcgtcgacggagagggacgtcgcggtcgtttttatttcgcggtttcggtaggcgagatttcgagaggtgagcgggtcggttaaggttacggcgtcgtcggggtcgaggggcgtttcgcgtcgattttcggttttttttttcggcggcggttcggggcgttcgttttttacgtcgggtaggcggtcgcgtagttcgtatttttttcgcggatgttcgtttttttcgcgttaattagggtaattggaaaagaggcggagagaagtcgttgttgtagcgatttttttcggcggggagtagtttttagttggtgttcgtgatagttgcgattttcgttttttttagtcgcgtcgggtcgcgaggggaattcggggaagtgggaggaggatggagcgggagaaaggagagtagggggcggaggggcgttagttgtttttcgttttttagggttttcgcggtcgcgcggttcgtgatagttgtatttatcgggaggtttcgtattcgtagttcgttatttatttgtcgtcgtcgtttttgggtttcgtttatcggcgtcgtattcgttcgcgatcgtggcggcggcgtcgtttcggttttcgtcgtttttcgggttcggcgtcgcggtttttcggttttttt

SEQ ID NO: 15612 - DNA, 848 bp, Artificial Sequence
  chemically treated genomic DNA (Homo sapiens) CpG-island No: 15612
aaaaaaaccgaaaaaccgcgacgccgaacccgaaaaacgacgaaaaccgaaacgacgccgccgccacgatcgcgaacgaatacgacgccgataaacgaaacccaaaaacgacgacgacaaataaataacgaactacgaatacgaaacctcccgataaatacaactatcacgaaccgcgcgaccgcgaaaaccctaaaaaacgaaaaacaactaacgcccctccgccccctactctcctttctcccgctccatcctcctcccacttccccgaattcccctcgcgacccgacgcgactaaaaaaaacgaaaatcgcaactatcacgaacaccaactaaaaactactccccgccgaaaaaaatcgctacaacaacgacttctctccgcctcttttccaattaccctaattaacgcgaaaaaaacgaacatccgcgaaaaaaatacgaactacgcgaccgcctacccgacgtaaaaaacgaacgccccgaaccgccgccgaaaaaaaaaaccgaaaatcgacgcgaaacgcccctcgaccccgacgacgccgtaaccttaaccgacccgctcacctctcgaaatctcgcctaccgaaaccgcgaaataaaaacgaccgcgacgtccctctccgtcgacgcaaccctcgacgacgcttaaatttaaccccgacgcgcttactcgccccttctcccgaaaaaaaatttcgaaaataaacataaaataaatactaaacatattcctatcgcgacccgaatttaatccccttcctaaaattcaaccgaaaaaaccgaaaaaaaaaaacaaacatattaacgaaacgattaaaaaataaaattaattaataaacaat

SEQ ID NO: 15613 - DNA, 718 bp, Artificial Sequence
  chemically treated genomic DNA (Homo sapiens) CpG-island No: 15613
tcgtcggggtcgggttgttgtttcgcgcgcgttattaggggtcgttcgagttatttaagtttcgtgcgttattcggcggcgttttcgcgcgtgtttattcggagtagcgcgcgtttcgtaatcgtcgtagtcgttttcgtcgtcggtcgtcgtattttaagcgattgtttaaattaagttttcgtggttgggtacgggagcgttttggggataaaaatttttttttaattgtggtttgtattttttcggttcgtgggttgatttggggcgggaagtattagcgttttagttgcgttgtagtcggggaggaaggaggaggtcgagtttggggcggagtttgggttgattggggttggatcgggtaagacgtcgtcgttgttcggatgttgcgatggttgatcgggggaggtcgagaatcgtagggattggtcgaggtaaatttcgggtgggtttgttttgcgttcgtcgagtttgttggaggggcggtttcgtttcggttcggtttttttgggtttcgatcgcggggattcgggcggaggcggggttggttgttgagttcgtgttacgcgttgtttttacgacggtgggggcggagggcgcgggagtcggagttttttagattcggcgggattttaggcgtattttggagttgtagattttcggtttcgttttacggttagttgaatcgtgagattttggtttagggacgtttagttgg

SEQ ID NO: 15614 - DNA, 718 bp, Artificial Sequence
  chemically treated genomic DNA (Homo sapiens) CpG-island No: 15614
ccaactaaacgtccctaaaccaaaatctcacgattcaactaaccgtaaaacgaaaccgaaaatctacaactccaaaatacgcctaaaatcccgccgaatctaaaaaactccgactcccgcgccctccgcccccaccgtcgtaaaaacaacgcgtaacacgaactcaacaaccaaccccgcctccgcccgaatccccgcgatcgaaacccaaaaaaaccgaaccgaaacgaaaccgcccctccaacaaactcgacgaacgcaaaacaaacccacccgaaatttacctcgaccaatccctacgattctcgacctcccccgatcaaccatcgcaacatccgaacaacgacgacgtcttacccgatccaaccccaatcaacccaaactccgccccaaactcgacctcctccttcctccccgactacaacgcaactaaaacgctaatacttcccgccccaaatcaacccacgaaccgaaaaaatacaaaccacaattaaaaaaaaatttttatccccaaaacgctcccgtacccaaccacgaaaacttaatttaaacaatcgcttaaaatacgacgaccgacgacgaaaacgactacgacgattacgaaacgcgcgctactccgaataaacacgcgcgaaaacgccgccgaataacgcacgaaacttaaataactcgaacgacccctaataacgcgcgcgaaacaacaacccgaccccgacga

SEQ ID NO: 15615 - DNA, 718 bp, Artificial Sequence
  chemically treated genomic DNA (Homo sapiens) CpG-island No: 15615
ttagttgagcgtttttgagttaggattttacgatttagttagtcgtgggacggggtcgggggtttgtagttttagggtgcgtttggggtttcgtcgggtttgaggagtttcggttttcgcgtttttcgtttttatcgtcgtgagaatagcgcgtggtacgagtttagtagttagtttcgttttcgttcgggttttcgcggtcggaatttaggaaggtcgaatcggaacgaagtcgtttttttagtaagttcgacggacgtagagtagatttattcggggtttatttcggttagtttttgcggttttcggtttttttcgattagttatcgtaatattcgggtagcggcggcgttttgttcggtttagttttagttagtttaaatttcgttttaggttcggttttttttttttttttcggttgtagcgtaattgagacgttaatatttttcgttttagattagtttacgggtcgaaggaatgtagattatagttgagggagaatttttgtttttaaagcgttttcgtatttagttacggaggtttagtttgggtagtcgtttggggtgcggcggtcgacggcgggggcggttgcggcgattgcggggcgcgcgttgtttcgagtgagtacgcgcgggagcgtcgtcgggtagcgtacggagtttaggtagttcgagcggtttttggtgacgcgcgcggagtagtaattcgatttcggcga

SEQ ID NO: 15616 - DNA, 718 bp, Artificial Sequence
  chemically treated genomic DNA (Homo sapiens) CpG-island No: 15616
tcgccgaaatcgaattactactccgcgcgcgtcaccaaaaaccgctcgaactacctaaactccgtacgctacccgacgacgctcccgcgcgtactcactcgaaacaacgcgcgccccgcaatcgccgcaaccgcccccgccgtcgaccgccgcaccccaaacgactacccaaactaaacctccgtaactaaatacgaaaacgctttaaaaacaaaaattctccctcaactataatctacattccttcgacccgtaaactaatctaaaacgaaaaatattaacgtctcaattacgctacaaccgaaaaaaaaaaaaaaaaccgaacctaaaacgaaatttaaactaactaaaactaaaccgaacaaaacgccgccgctacccgaatattacgataactaatcgaaaaaaaccgaaaaccgcaaaaactaaccgaaataaaccccgaataaatctactctacgtccgtcgaacttactaaaaaaacgacttcgttccgattcgaccttcctaaattccgaccgcgaaaacccgaacgaaaacgaaactaactactaaactcgtaccacgcgctattctcacgacgataaaaacgaaaaacgcgaaaaccgaaactcctcaaacccgacgaaaccccaaacgcaccctaaaactacaaacccccgaccccgtcccacgactaactaaatcgtaaaatcctaactcaaaaacgctcaactaa

SEQ ID NO: 15617 - DNA, 763 bp, Artificial Sequence
  chemically treated genomic DNA (Homo sapiens) CpG-island No: 15617
cgggcgcgggaggagggtcgcgaagtgtggggaaagaggggatcggaggggaggcggcgggcgaggggggtcgtaggcgtcgcgtcgaaggtgtgggtgggaacgtcgttcgttagaaggtcgggaggagggcgcgagtacggttagcgtaagtagggaggttagggtggcgggaagggtgggttgaggcgttgagatcgggtcgagggcgtagttgggtgggaagggaagaggggcggtcgggagacgggggatcgcgggcgatcgaaattaggcggaggggaggtttcgcgggttggggtttggggtgagttcgagcgagtggaggagagaggcgaggacgaaacgagacggggcgaaggtcggggcgggacggggtagggcgtcggggttcgggtgcgcgtcggaagggtttcggggcggttttcggggcggtgttgggggcggagcgggtcggggcgcggttgtattaagtgaagtttatagagattgtgtgttttagcgttttgcggcggagggaggcgatgttggtgtttcgttatacgtcgttgttgttcggggagttgtagagttggggcgaatcggagacgttgttggggtcggggagggaggcgggtattatgtcggggaaggcgggttggtagaggtgcgattgtagtttcgcgtcgttggaattcgttaggttgttggataggtttatggagttgggcggcggatcggtcgttaggttgtattgggatagcgattgcgttatggtttgttg

SEQ ID NO: 15618 - DNA, 763 bp, Artificial Sequence
  chemically treated genomic DNA (Homo sapiens) CpG-island No: 15618
caacaaaccataacgcaatcgctatcccaatacaacctaacgaccgatccgccgcccaactccataaacctatccaacaacctaacgaattccaacgacgcgaaactacaatcgcacctctaccaacccgccttccccgacataatacccgcctccctccccgaccccaacaacgtctccgattcgccccaactctacaactccccgaacaacaacgacgtataacgaaacaccaacatcgcctccctccgccgcaaaacgctaaaacacacaatctctataaacttcacttaatacaaccgcgccccgacccgctccgcccccaacaccgccccgaaaaccgccccgaaacccttccgacgcgcacccgaaccccgacgccctaccccgtcccgccccgaccttcgccccgtctcgtttcgtcctcgcctctctcctccactcgctcgaactcaccccaaaccccaacccgcgaaacctcccctccgcctaatttcgatcgcccgcgatcccccgtctcccgaccgcccctcttcccttcccacccaactacgccctcgacccgatctcaacgcctcaacccacccttcccgccaccctaacctccctacttacgctaaccgtactcgcgccctcctcccgaccttctaacgaacgacgttcccacccacaccttcgacgcgacgcctacgacccccctcgcccgccgcctcccctccgatcccctctttccccacacttcgcgaccctcctcccgcgcccg

SEQ ID NO: 15619 - DNA, 763 bp, Artificial Sequence
  chemically treated genomic DNA (Homo sapiens) CpG-island No: 15619
tagtaggttatggcgtagtcgttgttttagtgtagtttggcggtcggttcgtcgtttaattttatgggtttgtttaatagtttggcgggttttaacggcgcggggttgtagtcgtatttttattagttcgtttttttcggtatggtgttcgttttttttttcggttttagtaacgttttcggttcgttttagttttgtagtttttcggatagtagcgacgtgtggcggggtattagtatcgttttttttcgtcgtaaggcgttagagtatatagtttttatgagttttatttaatgtagtcgcgtttcggttcgtttcgtttttagtatcgtttcgggggtcgtttcgaggttttttcggcgcgtattcggatttcggcgttttgtttcgtttcgtttcggttttcgtttcgtttcgtttcgttttcgttttttttttttattcgttcgggtttattttaagttttagttcgcgaggtttttttttcgtttgatttcgatcgttcgcggtttttcgtttttcggtcgttttttttttttttttatttagttgcgttttcggttcggttttagcgttttagtttatttttttcgttattttggtttttttgtttgcgttggtcgtgttcgcgtttttttttcggttttttgacgggcggcgtttttatttatattttcgacgcgacgtttacgatttttttcgttcgtcgtttttttttcggttttttttttttttatatttcgcgatttttttttcgcgttcg

SEQ ID NO: 15620 - DNA, 763 bp, Artificial Sequence
  chemically treated genomic DNA (Homo sapiens) CpG-island No: 15620
cgaacgcgaaaaaaaaatcgcgaaatataaaaaaaaaaaaaaccgaaaaaaaaacgacgaacgaaaaaaatcgtaaacgtcgcgtcgaaaatataaataaaaacgccgcccgtcaaaaaaccgaaaaaaaaacgcgaacacgaccaacgcaaacaaaaaaaccaaaataacgaaaaaaataaactaaaacgctaaaaccgaaccgaaaacgcaactaaataaaaaaaaaaaaaaaacgaccgaaaaacgaaaaaccgcgaacgatcgaaatcaaacgaaaaaaaaacctcgcgaactaaaacttaaaataaacccgaacgaataaaaaaaaaaaacgaaaacgaaacgaaacgaaacgaaaaccgaaacgaaacgaaacaaaacgccgaaatccgaatacgcgccgaaaaaacctcgaaacgacccccgaaacgatactaaaaacgaaacgaaccgaaacgcgactacattaaataaaactcataaaaactatatactctaacgccttacgacgaaaaaaaacgatactaataccccgccacacgtcgctactatccgaaaaactacaaaactaaaacgaaccgaaaacgttactaaaaccgaaaaaaaaaacgaacaccataccgaaaaaaacgaactaataaaaatacgactacaaccccgcgccgttaaaacccgccaaactattaaacaaacccataaaattaaacgacgaaccgaccgccaaactacactaaaacaacgactacgccataacctacta

SEQ ID NO: 15621 - DNA, 1005 bp, Artificial Sequence
  chemically treated genomic DNA (Homo sapiens) CpG-island No: 15621
gcgtagtttaaagttgtgtattggttggcgattttcgcgttttattagaatgacgttattaagacgcgacgatagtttttttattttttgtagcggcgtaatttgcgtcgtttcgtaaatcggcgcgcgtagtattgtttttaaatattcggtatttttcggagtatcggataggggttgcgagttagttattattaattttttagtttcgatttattacgtatcgcgtttttgtcggcgttggttgttaggttggtataagtacgtagggtaaaggagatttgacgtttacgatttttcggcgtttaggttttgttatttcgagcgttttgcgttttacgacgcgtcgttagttcggtatcgtttatttgtaattgaatgttacggttcgggatgtcgatagcgattaggttatatttttaattaggttaatgttgtcgtcgtttgtcgttttcggtgagacgtggtcgatggaaagattagaggtgttattagagaaacgatcgtcggtgattagcgtataggttttgtcgagatttattgattttaggaagttggttgggtagagtattttttgtattttcggatcgtttttcgggtttttatagcgaattattattatattttcggcgataattttatcgtcgagaatcgtttttatcgtatcgttttggttttcgtatattttcgtcgggtcggtgaatttgaggatgttgttatcgacgtttgtcgtttttacgatgtagtcgtttttcgtaaagttatcgtagagtatcgttaggtcgtcgtttttgttgtaggcgtgttttagcgagcggatatagttattggcgcgatcgtcgtttagcgtatattaacggtattttgcgagaatgtttgtgtggtacgaagtgtttgtaggaatttgcgcggaattattttttttatcgcggttattttgggttagtatacgatcgtatggattttaaacgttggttaggtaaacgttagggtaaagtacgtttt

SEQ ID NO: 15622 - DNA, 1005 bp, Artificial Sequence
  chemically treated genomic DNA (Homo sapiens) CpG-island No: 15622
aaaacgtactttaccctaacgtttacctaaccaacgtttaaaatccatacgatcgtatactaacccaaaataaccgcgataaaaaaaataattccgcgcaaattcctacaaacacttcgtaccacacaaacattctcgcaaaataccgttaatatacgctaaacgacgatcgcgccaataactatatccgctcgctaaaacacgcctacaacaaaaacgacgacctaacgatactctacgataactttacgaaaaacgactacatcgtaaaaacgacaaacgtcgataacaacatcctcaaattcaccgacccgacgaaaatatacgaaaaccaaaacgatacgataaaaacgattctcgacgataaaattatcgccgaaaatataataataattcgctataaaaacccgaaaaacgatccgaaaatacaaaaaatactctacccaaccaacttcctaaaatcaataaatctcgacaaaacctatacgctaatcaccgacgatcgtttctctaataacacctctaatctttccatcgaccacgtctcaccgaaaacgacaaacgacgacaacattaacctaattaaaaatataacctaatcgctatcgacatcccgaaccgtaacattcaattacaaataaacgataccgaactaacgacgcgtcgtaaaacgcaaaacgctcgaaataacaaaacctaaacgccgaaaaatcgtaaacgtcaaatctcctttaccctacgtacttataccaacctaacaaccaacgccgacaaaaacgcgatacgtaataaatcgaaactaaaaaattaataataactaactcgcaacccctatccgatactccgaaaaataccgaatatttaaaaacaatactacgcgcgccgatttacgaaacgacgcaaattacgccgctacaaaaaataaaaaaactatcgtcgcgtcttaataacgtcattctaataaaacgcgaaaatcgccaaccaatacacaactttaaactacgc

SEQ ID NO: 15623 - DNA, 1005 bp, Artificial Sequence
  chemically treated genomic DNA (Homo sapiens) CpG-island No: 15623
aaaacgtattttgttttgacgtttgtttggttaacgtttgggatttatacgatcgtatgttgatttaggatgatcgcggtaaaaaaaatggtttcgcgtaggtttttgtaggtatttcgtattatataggtattttcgtaagatgtcgttggtatacgttggacgacgatcgcgttaatggttgtattcgttcgttggaatacgtttatagtaaagacggcggtttggcggtgttttacggtaattttgcggaaaacggttgtatcgtgaaaacggtaggcgtcgatgatagtatttttaaatttatcggttcggcgaaagtgtacgaaagttaggacgatgcggtagaagcgattttcggcggtaaagttgtcgtcggagatgtggtagtaattcgttatgaaggttcgaaaggcggttcggggatgtaggaaatgttttatttaattagttttttgaaattaatgggtttcggtaaagtttgtgcgttgattatcgacggtcgtttttttggtggtatttttggtttttttatcggttacgttttatcggaagcggtaagcggcggtagtattggtttgattgaagatgtgatttgatcgttatcgatatttcgaatcgtggtatttagttataggtaagcgatgtcgaattggcggcgcgtcgtgaagcgtaggacgttcgaggtgataaagtttggacgtcgaaaaatcgtgaacgttaggttttttttgttttgcgtgtttatgttagtttggtaattagcgtcgataaaggcgcggtgcgtgataaatcgaaattggggggttaataatggttgattcgtaatttttgttcggtgtttcggaaggtgtcgaatatttaagagtagtgttgcgcgcgtcggtttacgaggcggcgtaggttacgtcgttataaaaaatggaaaaattgtcgtcgcgttttgataacgttattttggtgaagcgcgaagatcgttagttagtgtatagttttaagttgcgt

SEQ ID NO: 15624 - DNA, 1005 bp, Artificial Sequence
  chemically treated genomic DNA (Homo sapiens) CpG-island No: 15624
acgcaacttaaaactatacactaactaacgatcttcgcgcttcaccaaaataacgttatcaaaacgcgacgacaatttttccattttttataacgacgtaacctacgccgcctcgtaaaccgacgcgcgcaacactactcttaaatattcgacaccttccgaaacaccgaacaaaaattacgaatcaaccattattaaccccccaatttcgatttatcacgcaccgcgcctttatcgacgctaattaccaaactaacataaacacgcaaaacaaaaaaaacctaacgttcacgatttttcgacgtccaaactttatcacctcgaacgtcctacgcttcacgacgcgccgccaattcgacatcgcttacctataactaaataccacgattcgaaatatcgataacgatcaaatcacatcttcaatcaaaccaatactaccgccgcttaccgcttccgataaaacgtaaccgataaaaaaaccaaaaataccaccaaaaaaacgaccgtcgataatcaacgcacaaactttaccgaaacccattaatttcaaaaaactaattaaataaaacatttcctacatccccgaaccgcctttcgaaccttcataacgaattactaccacatctccgacgacaactttaccgccgaaaatcgcttctaccgcatcgtcctaactttcgtacactttcgccgaaccgataaatttaaaaatactatcatcgacgcctaccgttttcacgatacaaccgttttccgcaaaattaccgtaaaacaccgccaaaccgccgtctttactataaacgtattccaacgaacgaatacaaccattaacgcgatcgtcgtccaacgtataccaacgacatcttacgaaaatacctatataatacgaaatacctacaaaaacctacgcgaaaccattttttttaccgcgatcatcctaaatcaacatacgatcgtataaatcccaaacgttaaccaaacaaacgtcaaaacaaaatacgtttt

SEQ ID NO: 15625 - DNA, 528 bp, Artificial Sequence
  chemically treated genomic DNA (Homo sapiens) CpG-island No: 15625
cgttttagtttgtaatatacgtcgttattgcggtatttttttcgttagttaggttttcgttttgggtaataattggtaggttgagcgtggcgttttttagcggttaagattgttgtcgggataagtaaacgcgagtatttgatcgtaacgttttttttgtttcgtttgggtcgtggtttgtcgttaggaaagtgttttttcggtagcgcgattgttatgataatgaatcggatcgtttgtatagatgagattttgcgtttaggcggttatcgttcgcgttttcgtggtcgttggcgaagtagaaatacgttgcgtggcgttgttgtcggggatggttaggtaatcgttttttcgattggcgttttgttgtaaaaaagtgcgaatcgttacggttatggttttcgttgttttaagaggcgtatttttcgtttcgcgatttagaattttggtaacgtattttttacgatcgagatgcgattttaatttagtttgttttttcggttagtaaggtcgtttacgtgggtgaaa

SEQ ID NO: 15626 - DNA, 528 bp, Artificial Sequence
  chemically treated genomic DNA (Homo sapiens) CpG-island No: 15626
tttcacccacgtaaacgaccttactaaccgaaaaaacaaactaaattaaaatcgcatctcgatcgtaaaaaatacgttaccaaaattctaaatcgcgaaacgaaaaatacgcctcttaaaacaacgaaaaccataaccgtaacgattcgcacttttttacaacaaaacgccaatcgaaaaaacgattacctaaccatccccgacaacaacgccacgcaacgtatttctacttcgccaacgaccacgaaaacgcgaacgataaccgcctaaacgcaaaatctcatctatacaaacgatccgattcattatcataacaatcgcgctaccgaaaaaacactttcctaacgacaaaccacgacccaaacgaaacaaaaaaaacgttacgatcaaatactcgcgtttacttatcccgacaacaatcttaaccgctaaaaaacgccacgctcaacctaccaattattacccaaaacgaaaacctaactaacgaaaaaaataccgcaataacgacgtatattacaaactaaaacg

SEQ ID NO: 15627 - DNA, 528 bp, Artificial Sequence
  chemically treated genomic DNA (Homo sapiens) CpG-island No: 15627
ttttatttacgtgagcgattttattgatcgaaaaggtaaattgaattggagtcgtatttcgatcgtgaagagtacgttgttagagttttggatcgcgaggcgaaaagtacgttttttgaggtagcgaaagttatgatcgtggcgattcgtatttttttatagtaaaacgttaatcgggaaggcgattgtttgattattttcgatagtagcgttacgtagcgtgtttttgtttcgttagcgattacgggggcgcgaacgatgatcgtttggacgtaggattttatttatgtaggcgattcggtttattattatggtagtcgcgttatcgaagggatatttttttggcggtaagttacggtttaggcggggtagggagagcgttacgattagatattcgcgtttgtttatttcgataatagttttagtcgttggggagcgttacgtttaatttgttagttattatttaaagcgaaagtttggttggcgaaaaaaatgtcgtagtggcggcgtatattataagttgagacg

SEQ ID NO: 15628 - DNA, 528 bp, Artificial Sequence
  chemically treated genomic DNA (Homo sapiens) CpG-island No: 15628
cgtctcaacttataatatacgccgccactacgacatttttttcgccaaccaaactttcgctttaaataataactaacaaattaaacgtaacgctccccaacgactaaaactattatcgaaataaacaaacgcgaatatctaatcgtaacgctctccctaccccgcctaaaccgtaacttaccgccaaaaaaatatcccttcgataacgcgactaccataataataaaccgaatcgcctacataaataaaatcctacgtccaaacgatcatcgttcgcgcccccgtaatcgctaacgaaacaaaaacacgctacgtaacgctactatcgaaaataatcaaacaatcgccttcccgattaacgttttactataaaaaaatacgaatcgccacgatcataactttcgctacctcaaaaaacgtacttttcgcctcgcgatccaaaactctaacaacgtactcttcacgatcgaaatacgactccaattcaatttaccttttcgatcaataaaatcgctcacgtaaataaaa

SEQ ID NO: 15629 - DNA, 721 bp, Artificial Sequence
  chemically treated genomic DNA (Homo sapiens) CpG-island No: 15629
cgaggaggcggagattcgttcgttcggcgtttggatttatcgcgtagttagtcggtattcgcgtgcgtgtttttgaggcggaagaggcggcggtgcgcggagttgcggtttacgtattatagtatttatagtagttgtagtagtatgagcgtcgttaggaagtatagtaggtcgtttttgtttacgttcgcggcgtgtacggtttaggttagtagtagtagtagtttcgttacgaatacgattagtttatattggttgtttagtatttcggttagtttttgtgggacgttggcgcgtatatcgtttcgtcggggggtcggggatttcggggatttcggggtcgaggacgagggaggcgagtaggtcgttggtttcgacgattttgcgatcgaggcgtttgtagttgttcggggcgaggcgggcgattttaggttttcgagtattttcgagatattcgcgttaagtttggtttcgggggtggttgtcgtcgggtttcgtttgcgtttttggtttttgtttttgtttcgacgtttttgttaattagtatttttttttttaattttttttcgatttttattttacgtttttgttaatttgtttttttttttgttatttttcgacgttcgttttttttttttttgttttttcgtttttcgttaaggtattattttgtttatttatttagcgttttattttgttgatttgggattttacgagtttt

SEQ ID NO: 15630 - DNA, 721 bp, Artificial Sequence
  chemically treated genomic DNA (Homo sapiens) CpG-island No: 15630
aaaactcgtaaaatcccaaatcaacaaaataaaacgctaaataaataaacaaaataataccttaacgaaaaacgaaaaaacaaaaaaaaaaaaaacgaacgtcgaaaaataacaaaaaaaaaaacaaattaacaaaaacgtaaaataaaaatcgaaaaaaaattaaaaaaaaaaatactaattaacaaaaacgtcgaaacaaaaacaaaaaccaaaaacgcaaacgaaacccgacgacaaccacccccgaaaccaaacttaacgcgaatatctcgaaaatactcgaaaacctaaaatcgcccgcctcgccccgaacaactacaaacgcctcgatcgcaaaatcgtcgaaaccaacgacctactcgcctccctcgtcctcgaccccgaaatccccgaaatccccgaccccccgacgaaacgatatacgcgccaacgtcccacaaaaactaaccgaaatactaaacaaccaatataaactaatcgtattcgtaacgaaactactactactactaacctaaaccgtacacgccgcgaacgtaaacaaaaacgacctactatacttcctaacgacgctcatactactacaactactataaatactataatacgtaaaccgcaactccgcgcaccgccgcctcttccgcctcaaaaacacgcacgcgaataccgactaactacgcgataaatccaaacgccgaacgaacgaatctccgcctcctcg

SEQ ID NO: 15631 - DNA, 721 bp, Artificial Sequence
  chemically treated genomic DNA (Homo sapiens) CpG-island No: 15631
ggagttcgtagaattttaggttagtagggtggggcgttgggtaagtggatagggtggtattttgacggaggacgaaggggtagaagaggggagggcgggcgtcgggaggtgataggagagggggtaggttggtaggggcgtggggtaggaatcggaagggagttgaaaagggaggtgttggttggtagaggcgtcggggtaaggataggagttaggagcgtaggcggggttcgacggtagttattttcgggattagatttggcgcgggtgtttcgaagatgttcgagggtttggggtcgttcgtttcgtttcgggtagttgtaagcgtttcggtcgtagggtcgtcggggttagcggtttgttcgtttttttcgttttcggtttcgaggttttcggaattttcggtttttcggcggggcggtgtgcgcgttagcgttttatagaaattggtcgagatgttgagtagttagtatgggttgatcgtgttcgtggcggggttgttgttgttgttggtttgggtcgtgtacgtcgcgggcgtgagtaagagcgatttgttgtgttttttgacggcgtttatgttgttgtagttgttgtggatgttgtggtacgtgggtcgtagtttcgcgtatcgtcgtttttttcgttttaaggatacgtacgcgggtgtcggttggttgcgcggtgagtttaggcgtcgggcgagcgggttttcgttttttcg

SEQ ID NO: 15632 - DNA, 721 bp, Artificial Sequence
  chemically treated genomic DNA (Homo sapiens) CpG-island No: 15632
cgaaaaaacgaaaacccgctcgcccgacgcctaaactcaccgcgcaaccaaccgacacccgcgtacgtatccttaaaacgaaaaaaacgacgatacgcgaaactacgacccacgtaccacaacatccacaacaactacaacaacataaacgccgtcaaaaaacacaacaaatcgctcttactcacgcccgcgacgtacacgacccaaaccaacaacaacaacaaccccgccacgaacacgatcaacccatactaactactcaacatctcgaccaatttctataaaacgctaacgcgcacaccgccccgccgaaaaaccgaaaattccgaaaacctcgaaaccgaaaacgaaaaaaacgaacaaaccgctaaccccgacgaccctacgaccgaaacgcttacaactacccgaaacgaaacgaacgaccccaaaccctcgaacatcttcgaaacacccgcgccaaatctaatcccgaaaataactaccgtcgaaccccgcctacgctcctaactcctatccttaccccgacgcctctaccaaccaacacctcccttttcaactcccttccgattcctaccccacgcccctaccaacctaccccctctcctatcacctcccgacgcccgccctcccctcttctaccccttcgtcctccgtcaaaataccaccctatccacttacccaacgccccaccctactaacctaaaattctacgaactcc

SEQ ID NO: 15633 - DNA, 849 bp, Artificial Sequence
  chemically treated genomic DNA (Homo sapiens) CpG-island No: 15633
gtttttagggagttcgagcgtaagtaatagtcggaggggttcgtagggacgtaggttgggttcggatatttaggcgttttcgcgttgtcgcggtttttcgcgtttagtttggtcgtatagtttagcgttcgattcgtcgtcgtcggcgtaggcgcgcgggtcggggtagtttatttgaagttgggttcggcgtttggttgatcgcgttgttgtgggtattggttgggcgcggcgttcgttttcgtacgcggtttcggttgcgtcggtcgttttgtattttatttatcgcgcgttttggtgcggagggcggattcggtagtatttagagaaggaggcggtgttgcgcgggcgcggcggttcggggagggtagggtagggtagtgtaggagcgatcggtgggagttggtcgttatcgggggttcggggcgcgttcgcgagggaatggagagttaggggcggtttcggaatttagggttggcgggtttggtagttttcgcgttcgtggtcgtgcgcgcgaggaatttgggagaaatgggtattttttacggttgtttggttcgtatatttggcggggtcggcgagttgagatgttttcgtcggttggcggaattgtgcgtttcgttcgtcgaggttcgttttttttcgaggtttgaggtttagttttataggggcgcgagagagcggcggcgtggggggcgcggaggaagcgtcggttttcgtttttatcgtttttttcgtggttgcggtttaggtcgaatagggtatcgtgtttcggtcgttttggttttggttatcgcgaggttcggggcgattatatttagtagttttgtggtttttttattgttttgg

SEQ ID NO: 15634 - DNA, 849 bp, Artificial Sequence
  chemically treated genomic DNA (Homo sapiens) CpG-island No: 15634
ccaaaacaataaaaaaaccacaaaactactaaatataatcgccccgaacctcgcgataaccaaaaccaaaacgaccgaaacacgataccctattcgacctaaaccgcaaccacgaaaaaaacgataaaaacgaaaaccgacgcttcctccgcgccccccacgccgccgctctctcgcgcccctataaaactaaacctcaaacctcgaaaaaaaacgaacctcgacgaacgaaacgcacaattccgccaaccgacgaaaacatctcaactcgccgaccccgccaaatatacgaaccaaacaaccgtaaaaaatacccatttctcccaaattcctcgcgcgcacgaccacgaacgcgaaaactaccaaacccgccaaccctaaattccgaaaccgcccctaactctccattccctcgcgaacgcgccccgaacccccgataacgaccaactcccaccgatcgctcctacactaccctaccctaccctccccgaaccgccgcgcccgcgcaacaccgcctccttctctaaatactaccgaatccgccctccgcaccaaaacgcgcgataaataaaatacaaaacgaccgacgcaaccgaaaccgcgtacgaaaacgaacgccgcgcccaaccaatacccacaacaacgcgatcaaccaaacgccgaacccaacttcaaataaactaccccgacccgcgcgcctacgccgacgacgacgaatcgaacgctaaactatacgaccaaactaaacgcgaaaaaccgcgacaacgcgaaaacgcctaaatatccgaacccaacctacgtccctacgaacccctccgactattacttacgctcgaactccctaaaaac

SEQ ID NO: 15635 - DNA, 849 bp, Artificial Sequence
  chemically treated genomic DNA (Homo sapiens) CpG-island No: 15635
ttagagtagtaggagggttatagggttgttgggtgtagtcgtttcggatttcgcggtggttaaggttaaggcggtcggggtacggtattttgttcggtttgggtcgtaattacgaaggaggcggtggaggcgggggtcggcgtttttttcgcgttttttacgtcgtcgttttttcgcgtttttatagaattgggttttaggtttcgagggggagcgggtttcggcgggcggggcgtatagtttcgttagtcggcgggggtattttaattcgtcggtttcgttaggtgtgcgggttaggtagtcgtggaaggtgtttattttttttagatttttcgcgcgtacggttacgagcgcggaggttgttaaattcgttagttttgggtttcgaagtcgtttttggttttttattttttcgcgggcgcgtttcgggttttcggtggcggttagtttttatcggtcgtttttgtattgttttgttttgtttttttcgggtcgtcgcgttcgcgtagtatcgtttttttttttaaatattgtcgggttcgtttttcgtattaggacgcgcggtgggtagggtgtagggcggtcggcgtagtcgaggtcgcgtgcggaggcggacgtcgcgtttagttagtgtttatagtagcgcggttagttaggcgtcggatttagttttaggtaagttgtttcggttcgcgcgtttgcgtcggcggcggcgggtcgggcgttgagttgtgcggttaggttgggcgcggggagtcgcggtagcgcggaggcgtttgggtattcgagtttaatttgcgtttttgcgagttttttcggttgttgtttgcgttcgggttttttaaaagt

SEQ ID NO: 15636 - DNA, 849 bp, Artificial Sequence
  chemically treated genomic DNA (Homo sapiens) CpG-island No: 15636
acttttaaaaaacccgaacgcaaacaacaaccgaaaaaactcgcaaaaacgcaaattaaactcgaatacccaaacgcctccgcgctaccgcgactccccgcgcccaacctaaccgcacaactcaacgcccgacccgccgccgccgacgcaaacgcgcgaaccgaaacaacttacctaaaactaaatccgacgcctaactaaccgcgctactataaacactaactaaacgcgacgtccgcctccgcacgcgacctcgactacgccgaccgccctacaccctacccaccgcgcgtcctaatacgaaaaacgaacccgacaatatttaaaaaaaaaaacgatactacgcgaacgcgacgacccgaaaaaaacaaaacaaaacaatacaaaaacgaccgataaaaactaaccgccaccgaaaacccgaaacgcgcccgcgaaaaaataaaaaaccaaaaacgacttcgaaacccaaaactaacgaatttaacaacctccgcgctcgtaaccgtacgcgcgaaaaatctaaaaaaaataaacaccttccacgactacctaacccgcacacctaacgaaaccgacgaattaaaatacccccgccgactaacgaaactatacgccccgcccgccgaaacccgctccccctcgaaacctaaaacccaattctataaaaacgcgaaaaaacgacgacgtaaaaaacgcgaaaaaaacgccgacccccgcctccaccgcctccttcgtaattacgacccaaaccgaacaaaataccgtaccccgaccgccttaaccttaaccaccgcgaaatccgaaacgactacacccaacaaccctataaccctcctactactctaa

SEQ ID NO: 15637 - DNA, 1002 bp, Artificial Sequence
  chemically treated genomic DNA (Homo sapiens) CpG-island No: 15637
tttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataatcgtatcgttcgtgacgcgtattatttttatcggtatgatcgttacggtaggttgatagagaaaatcgattttatttcggaaggggttattcgtacggatgatgagcggatttatcggtattattacgatagttagtatcggttggtgtattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattataatatagaacgatagaattcgtatttagacgatttattagtcggggagtttttacgttatttattagagttgaaatcgttatcggtgagttggcgaaaacgtagcgtcgtagtttggcggatgcgttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgatcgtggagtagatgtaaaattagatggattcggtgtatacgtcggcgcgaaaaatttatttgtattattgcgattatcgcggtttgtcgttggtttttattagtaaggaagggataatagaatggtgcgtagaatacgatgaatggggtaatttgttgaatgaagagaattcgtatt

SEQ ID NO: 15638 - DNA, 1002 bp, Artificial Sequence
  chemically treated genomic DNA (Homo sapiens) CpG-island No: 15638
aatacgaattctcttcattcaacaaattaccccattcatcgtattctacgcaccattctattatcccttccttactaataaaaaccaacgacaaaccgcgataatcgcaataatacaaataaatttttcgcgccgacgtatacaccgaatccatctaattttacatctactccacgatcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaacgcatccgccaaactacgacgctacgttttcgccaactcaccgataacgatttcaactctaataaataacgtaaaaactccccgactaataaatcgtctaaatacgaattctatcgttctatattataatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatacaccaaccgatactaactatcgtaataataccgataaatccgctcatcatccgtacgaataaccccttccgaaataaaatcgattttctctatcaacctaccgtaacgatcataccgataaaaataatacgcgtcacgaacgatacgattatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaa

SEQ ID NO: 15639 - DNA, 1002 bp, Artificial Sequence
  chemically treated genomic DNA (Homo sapiens) CpG-island No: 15639
gatgcgggttttttttatttagtaggttgttttatttatcgtattttgcgtattattttgttgttttttttttgttgataagggttagcggtaggtcgcgatggtcgtagtggtataggtggatttttcgcgtcggcgtgtatatcgggtttatttggttttgtatttgttttacggttaggtcgtacgatgttagttagcggcggttttttttatttattcggttagttaggattttattttttagtcggtcgagtatttgtattagtatcggcgggaatattatattgttatcgttttcgtcgtcggattgttgaagcgtattcgttaggttgcggcgttgcgttttcgttagtttatcggtggcggttttaattttgatgagtggcgtgaaagtttttcggttgataaatcgtttggatgcgggttttgtcgttttgtattgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtgtattagtcggtgttgattgtcgtaatggtatcggtgagttcgtttattattcgtgcggataatttttttcgggatgaggtcggttttttttgttagtttgtcgtgacggttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtagg

SEQ ID NO: 15640 - DNA, 1002 bp, Artificial Sequence
  chemically treated genomic DNA (Homo sapiens) CpG-island No: 15640
cctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgaactcaccgataccattacgacaatcaacaccgactaatacactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacaatacaaaacgacaaaacccgcatccaaacgatttatcaaccgaaaaactttcacgccactcatcaaaattaaaaccgccaccgataaactaacgaaaacgcaacgccgcaacctaacgaatacgcttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaaccgtaaaacaaatacaaaaccaaataaacccgatatacacgccgacgcgaaaaatccacctataccactacgaccatcgcgacctaccgctaacccttatcaacaaaaaaaaaacaacaaaataatacgcaaaatacgataaataaaacaacctactaaataaaaaaaacccgcatc

SEQ ID NO: 15641 - DNA, 726 bp, Artificial Sequence
  chemically treated genomic DNA (Homo sapiens) CpG-island No: 15641
cgggcgttgtacgatattcgttttattcgtcgttacgtgatgaaaggattattgttgttgttcggcgttggcggaggttggtagttttggtagtcggaaatcggcgaaggtttgcgggtagattatcgtatcgttaaaggtatagttagtcgttagtaattggaagatggttttttgtttacgttgaatatttaaagcgcggcggatgtgcgttttgatgcgtattagcgtatcgttcggttttggtacggtgaaatcgttattattatcgcgaaagatgttttgtaacgtttttttcgtgttttgattcgttagggttagtttattgcggttagggatagaatttatcgttcgttagtaggataattttacgtagtttgacgtgtagtagtacgttgtggaagtgtttttcgttagtgttttcgcgtaaaaacgtatcgtgaacgttggtgaaagtttgtagtttagcgtttttgagtttggcgtagtgaaatcgttggatgacgagagtataagttggacgaaggatattttgagttttagcgataaatcgttgggtgaggtgatagttacgttaattcgttatcgtaacggcgtgttgcgttgcgatttcgtcgttgtcgggttgcgtttgagcgggacgttttcgttgaaaaatatcgatgcgattttgaacgttatcgcgtaaacgtttttcgttaaaatttagtttattacgcggtattg

SEQ ID NO: 15642 - DNA, 726 bp, Artificial Sequence
  chemically treated genomic DNA (Homo sapiens) CpG-island No: 15642
caataccgcgtaataaactaaattttaacgaaaaacgtttacgcgataacgttcaaaatcgcatcgatatttttcaacgaaaacgtcccgctcaaacgcaacccgacaacgacgaaatcgcaacgcaacacgccgttacgataacgaattaacgtaactatcacctcacccaacgatttatcgctaaaactcaaaatatccttcgtccaacttatactctcgtcatccaacgatttcactacgccaaactcaaaaacgctaaactacaaactttcaccaacgttcacgatacgtttttacgcgaaaacactaacgaaaaacacttccacaacgtactactacacgtcaaactacgtaaaattatcctactaacgaacgataaattctatccctaaccgcaataaactaaccctaacgaatcaaaacacgaaaaaaacgttacaaaacatctttcgcgataataataacgatttcaccgtaccaaaaccgaacgatacgctaatacgcatcaaaacgcacatccgccgcgctttaaatattcaacgtaaacaaaaaaccatcttccaattactaacgactaactatacctttaacgatacgataatctacccgcaaaccttcgccgatttccgactaccaaaactaccaacctccgccaacgccgaacaacaacaataatcctttcatcacgtaacgacgaataaaacgaatatcgtacaacgcccg

SEQ ID NO: 15643 - DNA, 726 bp, Artificial Sequence
  chemically treated genomic DNA (Homo sapiens) CpG-island No: 15643
tagtatcgcgtaatagattgaattttaacgggaagcgtttgcgcgataacgtttaggatcgtatcggtattttttagcgggaacgtttcgtttaggcgtagttcggtaacggcgggatcgtagcgtagtacgtcgttgcggtaacgggttagcgtggttattattttatttagcggtttatcgttgaagtttaggatgtttttcgtttagtttgtattttcgttatttagcggttttattgcgttaaatttagaggcgttgaattgtaggtttttattagcgtttacgatgcgtttttgcgcgggggtattggcgagaagtatttttatagcgtgttgttgtacgttaagttgcgtgaaattattttgttggcggacggtaaattttgtttttaatcgtagtgagttggttttgacgggttaggatacggaaggggcgttgtagggtatttttcgcggtagtaatggcgattttatcgtattagagtcggacggtgcgttgatgcgtattaaaacgtatattcgtcgcgttttgggtatttagcgtgagtagggagttattttttagttgttgacggttgattgtgtttttggcggtgcggtaatttgttcgtagattttcgtcggttttcgattgttagagttgttagttttcgttagcgtcgagtaatagtagtaatttttttattacgtgacggcgggtgaggcgggtatcgtgtaacgttcg

SEQ ID NO: 15644 - DNA, 726 bp, Artificial Sequence
  chemically treated genomic DNA (Homo sapiens) CpG-island No: 15644
cgaacgttacacgatacccgcctcacccgccgtcacgtaataaaaaaattactactattactcgacgctaacgaaaactaacaactctaacaatcgaaaaccgacgaaaatctacgaacaaattaccgcaccgccaaaaacacaatcaaccgtcaacaactaaaaaataactccctactcacgctaaatacccaaaacgcgacgaatatacgttttaatacgcatcaacgcaccgtccgactctaatacgataaaatcgccattactaccgcgaaaaataccctacaacgccccttccgtatcctaacccgtcaaaaccaactcactacgattaaaaacaaaatttaccgtccgccaacaaaataatttcacgcaacttaacgtacaacaacacgctataaaaatacttctcgccaatacccccgcgcaaaaacgcatcgtaaacgctaataaaaacctacaattcaacgcctctaaatttaacgcaataaaaccgctaaataacgaaaatacaaactaaacgaaaaacatcctaaacttcaacgataaaccgctaaataaaataataaccacgctaacccgttaccgcaacgacgtactacgctacgatcccgccgttaccgaactacgcctaaacgaaacgttcccgctaaaaaataccgatacgatcctaaacgttatcgcgcaaacgcttcccgttaaaattcaatctattacgcgatacta

SEQ ID NO: 15645 - DNA, 623 bp, Artificial Sequence
  chemically treated genomic DNA (Homo sapiens) CpG-island No: 15645
cgtagtcgttcgtacggattaggcgcgcgttggtttttcgagttcggagcggcgtagttcgcggcgtttcggatatatttattgggtagttcgcgttagttcgtttcgtcggttagagagcgggagtcggagtttgggtagcggaagtcgggtcggggtcgcgcgggcggcgcgtaggggacgcggggcgcgcggttttgtttatttggcggttcgcgtttcggagcgatcggcggtcgtttcgtttcgtttcgttttcgcgtggttttcggcgtcgggtagtttcgagcgtcgtcgtatggacggtcgttatcgtcgtttagtcgtttcgcgttcgttttgtacgggttttcgttgtgtttcgatttcgcgtcgggttgcgcgggcggttagcggtttaggcgcgcgcggagagttttggtttagagtttgcgattcgagagcgggattcgcgttttttcggttttttttttttttttttttgcggtttttcgttgttatttggagtcgtttttgtcgttttttggcggcgatcgcgggaagggtcggtttttattcgtatttttgatttcggaggttaataacgggatggtttttgggttttaggggaagagatattattt

SEQ ID NO: 15646 - DNA, 623 bp, Artificial Sequence
  chemically treated genomic DNA (Homo sapiens) CpG-island No: 15646
aaataatatctcttcccctaaaacccaaaaaccatcccgttattaacctccgaaatcaaaaatacgaataaaaaccgacccttcccgcgatcgccgccaaaaaacgacaaaaacgactccaaataacaacgaaaaaccgcaaaaaaaaaaaaaaaaaaaaccgaaaaaacgcgaatcccgctctcgaatcgcaaactctaaaccaaaactctccgcgcgcgcctaaaccgctaaccgcccgcgcaacccgacgcgaaatcgaaacacaacgaaaacccgtacaaaacgaacgcgaaacgactaaacgacgataacgaccgtccatacgacgacgctcgaaactacccgacgccgaaaaccacgcgaaaacgaaacgaaacgaaacgaccgccgatcgctccgaaacgcgaaccgccaaataaacaaaaccgcgcgccccgcgtcccctacgcgccgcccgcgcgaccccgacccgacttccgctacccaaactccgactcccgctctctaaccgacgaaacgaactaacgcgaactacccaataaatatatccgaaacgccgcgaactacgccgctccgaactcgaaaaaccaacgcgcgcctaatccgtacgaacgactacg

SEQ ID NO: 15647 - DNA, 623 bp, Artificial Sequence
  chemically treated genomic DNA (Homo sapiens) CpG-island No: 15647
gggtgatgtttttttttttgggatttagggattatttcgttgttgattttcggggttaggggtgcggatgggggtcggtttttttcgcggtcgtcgttagggggcggtaggagcggttttagatgatagcgggaggtcgtaagaggggagggaggaaggatcgagggagcgcggatttcgttttcggatcgtaaattttgagttagagtttttcgcgcgcgtttgaatcgttggtcgttcgcgtagttcgacgcggaatcggggtatagcgggagttcgtgtagggcgggcgcggggcggttgggcggcggtggcggtcgtttatgcggcggcgttcggggttgttcggcgtcgggaattacgcgggggcgaggcgaggcgaggcggtcgtcggtcgtttcgggacgcggatcgttaggtgagtagagtcgcgcgtttcgcgttttttgcgcgtcgttcgcgcggtttcgattcggttttcgttgtttaggtttcggttttcgttttttggtcggcggggcgggttggcgcgggttatttagtgggtgtgttcggggcgtcgcgggttgcgtcgtttcgggttcggggagttagcgcgcgtttggttcgtgcggacggttgcg

SEQ ID NO: 15648 - DNA, 623 bp, Artificial Sequence
  chemically treated genomic DNA (Homo sapiens) CpG-island No: 15648
cgcaaccgtccgcacgaaccaaacgcgcgctaactccccgaacccgaaacgacgcaacccgcgacgccccgaacacacccactaaataacccgcgccaacccgccccgccgaccaaaaaacgaaaaccgaaacctaaacaacgaaaaccgaatcgaaaccgcgcgaacgacgcgcaaaaaacgcgaaacgcgcgactctactcacctaacgatccgcgtcccgaaacgaccgacgaccgcctcgcctcgcctcgcccccgcgtaattcccgacgccgaacaaccccgaacgccgccgcataaacgaccgccaccgccgcccaaccgccccgcgcccgccctacacgaactcccgctataccccgattccgcgtcgaactacgcgaacgaccaacgattcaaacgcgcgcgaaaaactctaactcaaaatttacgatccgaaaacgaaatccgcgctccctcgatccttcctccctcccctcttacgacctcccgctatcatctaaaaccgctcctaccgccccctaacgacgaccgcgaaaaaaaccgacccccatccgcacccctaaccccgaaaatcaacaacgaaataatccctaaatcccaaaaaaaaaaacatcaccc

SEQ ID NO: 15649 - DNA, 1049 bp, Artificial Sequence
  chemically treated genomic DNA (Homo sapiens) CpG-island No: 15649
gggtgatttaggagttcgggtcgcgggttttttttttcgttcgggtatattttgtagaggagggggcggcggggacgggattcgggtttgcgtttgcgtatattttcgcggtttttttcgtttttttcgtcgggtatttgttacggttatcgtcgcggcgttcgttcgttacgttaaatcggatggcgggagtaggggtatggggcggggggcgcggggagggtggtacggcgcgtgcgtgcgcgggagtcgtcgagcgataattgggagtgcgcgcgttcgtcgttcgttcgcgtttcggaggcggagtttgtggcggggggcggagcgggggcgggtttatgttagttacgtgggcgcgggggcggggtggggcggggtggggcggggcgttttcgagcggcgggtcgagggagggcgtagtagttgttttttgaatattttttgatttaatagttttttagcgtcggacgcgtcgcgttttggcggttttagggatttttttcgcgtttgtatttagtttcgcgttcgaggtgagttcggtttttaaatttttcgggcgggggtgggggtgcgggacgttttttttttgttgggggttttggaggcgcgaaggtattaggcgtttcggtagatggttgtatttttcgtttgcggtttttcgtgttttttggggggtcgggtgcgggcgcggaattcgggaggtgttcgtataaaaggtcgagaaaattgcgcgaggttttttttttttcgtttttttcgttttttttttttcgcgttcgtttttttttttttaaattcggtcggttcgagtggagttagtttagtttcggtagtcgtcgcgcgaggaaatggtcgaggggtcggagttataggtaaaggggggcgtttttcgttcgcgttagtcggggcgttcgtttggttttgcggaggttttcgcgtcgttttcgaggcgttcggttttcgttgttttgtttttttttaggatgattttagtttttcgttttagttttttagttgttttttttagggcgttttttttttagtcg

SEQ ID NO: 15650 - DNA, 1049 bp, Artificial Sequence
  chemically treated genomic DNA (Homo sapiens) CpG-island No: 15650
cgactaaaaaaaaaacgccctaaaaaaaacaactaaaaaactaaaacgaaaaactaaaatcatcctaaaaaaaaacaaaacaacgaaaaccgaacgcctcgaaaacgacgcgaaaacctccgcaaaaccaaacgaacgccccgactaacgcgaacgaaaaacgcccccctttacctataactccgacccctcgaccatttcctcgcgcgacgactaccgaaactaaactaactccactcgaaccgaccgaatttaaaaaaaaaaaaacgaacgcgaaaaaaaaaaaacgaaaaaaacgaaaaaaaaaaaacctcgcgcaattttctcgaccttttatacgaacacctcccgaattccgcgcccgcacccgaccccccaaaaaacacgaaaaaccgcaaacgaaaaatacaaccatctaccgaaacgcctaataccttcgcgcctccaaaacccccaacaaaaaaaaaacgtcccgcacccccacccccgcccgaaaaatttaaaaaccgaactcacctcgaacgcgaaactaaatacaaacgcgaaaaaaatccctaaaaccgccaaaacgcgacgcgtccgacgctaaaaaactattaaatcaaaaaatattcaaaaaacaactactacgccctccctcgacccgccgctcgaaaacgccccgccccaccccgccccaccccgcccccgcgcccacgtaactaacataaacccgcccccgctccgccccccgccacaaactccgcctccgaaacgcgaacgaacgacgaacgcgcgcactcccaattatcgctcgacgactcccgcgcacgcacgcgccgtaccaccctccccgcgccccccgccccatacccctactcccgccatccgatttaacgtaacgaacgaacgccgcgacgataaccgtaacaaatacccgacgaaaaaaacgaaaaaaaccgcgaaaatatacgcaaacgcaaacccgaatcccgtccccgccgccccctcctctacaaaatatacccgaacgaaaaaaaaaacccgcgacccgaactcctaaatcaccc

SEQ ID NO: 15651 - DNA, 1049 bp, Artificial Sequence
  chemically treated genomic DNA (Homo sapiens) CpG-island No: 15651
cggttggggagggggcgttttagaaagagtagttagaaagttgagacggggaattgaggttattttggggggggataagataacgagagtcgggcgtttcgggggcggcgcgggagttttcgtaggattaggcgggcgtttcggttggcgcgggcggggggcgtttttttttatttgtggtttcggtttttcggttattttttcgcgcggcggttgtcgggattgagttgattttattcgggtcggtcgggtttgaaagaggaggagcgggcgcggaggggagggggcggggagggcggagggagggaggtttcgcgtagttttttcggttttttgtgcggatatttttcggatttcgcgttcgtattcggttttttaaaagatacggggagtcgtaagcgaggggtgtagttatttgtcgaggcgtttagtgttttcgcgtttttaagatttttaataaaaaaggagcgtttcgtatttttattttcgttcggaggatttaggggtcgggtttatttcgggcgcggggttaagtgtaggcgcggggggggtttttagagtcgttagggcgcggcgcgttcggcgttgggggattgttgggttagaaagtgtttagggagtagttgttgcgttttttttcggttcgtcgttcggagacgtttcgttttatttcgttttatttcgttttcgcgtttacgtgattagtataggttcgttttcgtttcgtttttcgttatagatttcgttttcgggacgcgagcgagcggcgagcgcgcgtatttttagttatcgttcggcgattttcgcgtacgtacgcgtcgtgttatttttttcgcgtttttcgttttatatttttattttcgttattcgatttaacgtggcgggcgagcgtcgcggcggtagtcgtgataggtattcggcggggggggcggggggggtcgcgagggtgtgcgtaggcgtagattcgggtttcgttttcgtcgtttttttttttgtaaggtgtgttcgggcgaggggaggggttcgcggttcgaatttttgggttattt

SEQ ID NO: 15652 - DNA, 1049 bp, Artificial Sequence
  chemically treated genomic DNA (Homo sapiens) CpG-island No: 15652
aaataacccaaaaattcgaaccgcgaacccctcccctcgcccgaacacaccttacaaaaaaaaaaacgacgaaaacgaaacccgaatctacgcctacgcacaccctcgcgaccccccccgccccccccgccgaatacctatcacgactaccgccgcgacgctcgcccgccacgttaaatcgaataacgaaaataaaaatataaaacgaaaaacgcgaaaaaaataacacgacgcgtacgtacgcgaaaatcgccgaacgataactaaaaatacgcgcgctcgccgctcgctcgcgtcccgaaaacgaaatctataacgaaaaacgaaacgaaaacgaacctatactaatcacgtaaacgcgaaaacgaaataaaacgaaataaaacgaaacgtctccgaacgacgaaccgaaaaaaaacgcaacaactactccctaaacactttctaacccaacaatcccccaacgccgaacgcgccgcgccctaacgactctaaaaaccccccccgcgcctacacttaaccccgcgcccgaaataaacccgacccctaaatcctccgaacgaaaataaaaatacgaaacgctccttttttattaaaaatcttaaaaacgcgaaaacactaaacgcctcgacaaataactacacccctcgcttacgactccccgtatcttttaaaaaaccgaatacgaacgcgaaatccgaaaaatatccgcacaaaaaaccgaaaaaactacgcgaaacctccctccctccgccctccccgccccctcccctccgcgcccgctcctcctctttcaaacccgaccgacccgaataaaatcaactcaatcccgacaaccgccgcgcgaaaaaataaccgaaaaaccgaaaccacaaataaaaaaaaacgccccccgcccgcgccaaccgaaacgcccgcctaatcctacgaaaactcccgcgccgcccccgaaacgcccgactctcgttatcttatccccccccaaaataacctcaattccccgtctcaactttctaactactctttctaaaacgccccctccccaaccg

SEQ ID NO: 15653 - DNA, 532 bp, Artificial Sequence
  chemically treated genomic DNA (Homo sapiens) CpG-island No: 15653
ggttacgatttcggtttcggtttttaaagtttttttcgcgtatggttttaaaaggatagagatttgggagcggggtacggatggtcgggttcgggagggtttgcggtttcggtttggtgacgatcgatggcggcggcgttttcgttgttggggcggcggtaggcgtagcgttttttcgtttcgacgcgttgtttttcgtcgtagacgttatcgtcgtcgtttttttcgtcggagacgggagtaaaatatagagaatcggggttataaagtcggtgggtaggtttggttacgtttaaatcgggtagtgtcgcggtttaggcgttttttttttttttagcgattgtataaaatggcggtcgtcgttgagtcggttttaatttaacgttgcgtacggcggagacgatacgtaaatagcgtttcggaatagttcgagggtttcgcggggaattacgggtatttttggaagtattttacgttagttgcgacgatgggtgtattttgcggtttgtataagaaaaataaagtacggagt

SEQ ID NO: 15654 - DNA, 532 bp, Artificial Sequence
  chemically treated genomic DNA (Homo sapiens) CpG-island No: 15654
actccgtactttatttttcttatacaaaccgcaaaatacacccatcgtcgcaactaacgtaaaatacttccaaaaatacccgtaattccccgcgaaaccctcgaactattccgaaacgctatttacgtatcgtctccgccgtacgcaacgttaaattaaaaccgactcaacgacgaccgccattttatacaatcgctaaaaaaaaaaaaaacgcctaaaccgcgacactacccgatttaaacgtaaccaaacctacccaccgactttataaccccgattctctatattttactcccgtctccgacgaaaaaaacgacgacgataacgtctacgacgaaaaacaacgcgtcgaaacgaaaaaacgctacgcctaccgccgccccaacaacgaaaacgccgccgccatcgatcgtcaccaaaccgaaaccgcaaaccctcccgaacccgaccatccgtaccccgctcccaaatctctatccttttaaaaccatacgcgaaaaaaactttaaaaaccgaaaccgaaatcgtaacc

SEQ ID NO: 15655 - DNA, 532 bp, Artificial Sequence
  chemically treated genomic DNA (Homo sapiens) CpG-island No: 15655
gtttcgtattttgttttttttgtatagatcgtaaaatatatttatcgtcgtaattgacgtaaagtgtttttaagaatattcgtagtttttcgcggagttttcgggttatttcgaggcgttgtttacgtatcgttttcgtcgtacgtagcgttaagttggagtcgatttagcggcggtcgttattttgtgtagtcgttgggaaggaaggagacgtttaaatcgcggtattgttcggtttgagcgtagttaaatttgtttatcggttttgtagtttcgattttttgtgttttgttttcgttttcgacgagagaggcggcgacggtggcgtttgcgacgggagatagcgcgtcggagcgagagagcgttgcgtttgtcgtcgttttaatagcggaggcgtcgtcgttatcggtcgttattagatcggagtcgtaggttttttcgagttcggttattcgtgtttcgtttttagatttttatttttttgggattatgcgcggaggaggttttggggatcgggatcgggatcgtgatt

SEQ ID NO: 15656 - DNA, 532 bp, Artificial Sequence
  chemically treated genomic DNA (Homo sapiens) CpG-island No: 15656
aatcacgatcccgatcccgatccccaaaacctcctccgcgcataatcccaaaaaaataaaaatctaaaaacgaaacacgaataaccgaactcgaaaaaacctacgactccgatctaataacgaccgataacgacgacgcctccgctattaaaacgacgacaaacgcaacgctctctcgctccgacgcgctatctcccgtcgcaaacgccaccgtcgccgcctctctcgtcgaaaacgaaaacaaaacacaaaaaatcgaaactacaaaaccgataaacaaatttaactacgctcaaaccgaacaataccgcgatttaaacgtctccttccttcccaacgactacacaaaataacgaccgccgctaaatcgactccaacttaacgctacgtacgacgaaaacgatacgtaaacaacgcctcgaaataacccgaaaactccgcgaaaaactacgaatattcttaaaaacactttacgtcaattacgacgataaatatattttacgatctatacaaaaaaaacaaaatacgaaac

SEQ ID NO: 15657 - DNA, 742 bp, Artificial Sequence
  chemically treated genomic DNA (Homo sapiens) CpG-island No: 15657
tcgggttaggtcgaggggcgggtagggcggggtttcgcgggtagtcggggttttcgggttggggggcgcgcggttttcgtagtggggcgcgggttacgtgtgaggaggggcgaaagtttcgtaaagcggggcggcgtgtcgcgagttgggagttttcggcgcgtcgcgggcggcgggagttcgggttttcgggcgagtcggggacgcggtcgaggcgggggtcggggttcgagatagagggggtcgtacggagagtgggagggggagagatagagaaggataggggtcgcgagggagacggatagagacgcgtaggggagagaggtagcgcgggtagagggaggcggggggaggtcggcgggcgatcgcgacggagacggagatttcgcgggtagagggcgagcggggtcgtaggaggtagggaggtcgggagagggatcgggacgcgagcgcggcggagatttcggcggtaggagagagacgcgagagcggtcggggaggtggcgatagagttcggtcggcgggggcggggagggcgattttaggtcgggaggtcgaggggtcgcggggtcggggtcgagcgtagcggggtcgggagtggagcgtagggtcgggggtagagcgcgcgagtaggagcgggtgatagcgaaggagttgggcgtagcgggggacggcggcggggagggcgtttgtagcgggggtggggtttagtttattgtaatttttgttttttgggtttagg

SEQ ID NO: 15658 - DNA, 742 bp, Artificial Sequence
  chemically treated genomic DNA (Homo sapiens) CpG-island No: 15658
cctaaacccaaaaaacaaaaattacaataaactaaaccccacccccgctacaaacgccctccccgccgccgtcccccgctacgcccaactccttcgctatcacccgctcctactcgcgcgctctacccccgaccctacgctccactcccgaccccgctacgctcgaccccgaccccgcgacccctcgacctcccgacctaaaatcgccctccccgcccccgccgaccgaactctatcgccacctccccgaccgctctcgcgtctctctcctaccgccgaaatctccgccgcgctcgcgtcccgatccctctcccgacctccctacctcctacgaccccgctcgccctctacccgcgaaatctccgtctccgtcgcgatcgcccgccgacctccccccgcctccctctacccgcgctacctctctcccctacgcgtctctatccgtctccctcgcgacccctatccttctctatctctccccctcccactctccgtacgaccccctctatctcgaaccccgacccccgcctcgaccgcgtccccgactcgcccgaaaacccgaactcccgccgcccgcgacgcgccgaaaactcccaactcgcgacacgccgccccgctttacgaaactttcgcccctcctcacacgtaacccgcgccccactacgaaaaccgcgcgccccccaacccgaaaaccccgactacccgcgaaaccccgccctacccgcccctcgacctaacccga

SEQ ID NO: 15659 - DNA, 742 bp, Artificial Sequence
  chemically treated genomic DNA (Homo sapiens) CpG-island No: 15659
tttgaatttaggaggtagaggttgtagtgagttgagttttattttcgttgtaggcgtttttttcgtcgtcgtttttcgttgcgtttagttttttcgttgttattcgtttttgttcgcgcgttttgttttcggttttgcgttttattttcggtttcgttgcgttcggtttcggtttcgcgatttttcggtttttcggtttggggtcgtttttttcgttttcgtcggtcgggttttgtcgttattttttcgatcgttttcgcgttttttttttgtcgtcggggttttcgtcgcgttcgcgtttcggtttttttttcggtttttttgttttttgcggtttcgttcgttttttgttcgcggggttttcgttttcgtcgcggtcgttcgtcggttttttttcgtttttttttgttcgcgttgttttttttttttgcgcgtttttgttcgtttttttcgcggtttttgtttttttttgttttttttttttttatttttcgtgcggttttttttgtttcggatttcggttttcgtttcggtcgcgttttcggttcgttcgggagttcgagttttcgtcgttcgcggcgcgtcgagaatttttaattcgcggtacgtcgtttcgttttgcgagattttcgtttttttttatacgtgattcgcgttttattgcggaggtcgcgcgttttttagttcgggagtttcggttgttcgcgggatttcgttttgttcgtttttcggtttaattcgg

SEQ ID NO: 15660 - DNA, 742 bp, Artificial Sequence
  chemically treated genomic DNA (Homo sapiens) CpG-island No: 15660
ccgaattaaaccgaaaaacgaacaaaacgaaatcccgcgaacaaccgaaactcccgaactaaaaaacgcgcgacctccgcaataaaacgcgaatcacgtataaaaaaaaacgaaaatctcgcaaaacgaaacgacgtaccgcgaattaaaaattctcgacgcgccgcgaacgacgaaaactcgaactcccgaacgaaccgaaaacgcgaccgaaacgaaaaccgaaatccgaaacaaaaaaaaccgcacgaaaaataaaaaaaaaaaaaacaaaaaaaaacaaaaaccgcgaaaaaaacgaacaaaaacgcgcaaaaaaaaaaaacaacgcgaacaaaaaaaaacgaaaaaaaaccgacgaacgaccgcgacgaaaacgaaaaccccgcgaacaaaaaacgaacgaaaccgcaaaaaacaaaaaaaccgaaaaaaaaaccgaaacgcgaacgcgacgaaaaccccgacgacaaaaaaaaaacgcgaaaacgatcgaaaaaataacgacaaaacccgaccgacgaaaacgaaaaaaacgaccccaaaccgaaaaaccgaaaaatcgcgaaaccgaaaccgaacgcaacgaaaccgaaaataaaacgcaaaaccgaaaacaaaacgcgcgaacaaaaacgaataacaacgaaaaaactaaacgcaacgaaaaacgacgacgaaaaaaacgcctacaacgaaaataaaactcaactcactacaacctctacctcctaaattcaaa

SEQ ID NO: 15661 - DNA, 640 bp, Artificial Sequence
  chemically treated genomic DNA (Homo sapiens) CpG-island No: 15661
tttcgattttttcggtttggcgcgatatttttgtagattttttataagggaatatagaagcgtatttttttagatcgttatatattatcgcgttattacgtatagatagttagttataaatcgttagattgtcggataatagataattaacgggtttttatttagagtaggatttaattttacgcggataattcgatttttatcgcgaatttagtacgcgcgttttcggacgcgtttacgtattattcggtcgggcgaggtattagggatagagtaaaatattcgagtatttttaaagttacgattataatatttataaggagaatttttcggcggatttaggttttattcgcgcgtcgattttttttattcgtcgcgaatttttttaattatcgcgtttcgtcggttttttttcgttattttcgtaaattatcggcgatttatgtcggttatggtattaacgcgagtcgggtagcgcgagtaaggtcgtacgtaataatttttcgacgattagtagattagattatcgagtcgtaggcgggtcgtcgatataatatataataagatgatatagtattaaaacgataggtatattttagaaaatagatacgaattagttgttttaattattaaatttagt

SEQ ID NO: 15662 - DNA, 640 bp, Artificial Sequence
  chemically treated genomic DNA (Homo sapiens) CpG-island No: 15662
actaaatttaataattaaaacaactaattcgtatctattttctaaaatatacctatcgttttaatactatatcatcttattatatattatatcgacgacccgcctacgactcgataatctaatctactaatcgtcgaaaaattattacgtacgaccttactcgcgctacccgactcgcgttaataccataaccgacataaatcgccgataatttacgaaaataacgaaaaaaaaccgacgaaacgcgataattaaaaaaattcgcgacgaataaaaaaaatcgacgcgcgaataaaacctaaatccgccgaaaaattctccttataaatattataatcgtaactttaaaaatactcgaatattttactctatccctaatacctcgcccgaccgaataatacgtaaacgcgtccgaaaacgcgcgtactaaattcgcgataaaaatcgaattatccgcgtaaaattaaatcctactctaaataaaaacccgttaattatctattatccgacaatctaacgatttataactaactatctatacgtaataacgcgataatatataacgatctaaaaaaatacgcttctatattcccttataaaaaatctacaaaaatatcgcgccaaaccgaaaaaatcgaaa

SEQ ID NO: 15663 - DNA, 640 bp, Artificial Sequence
  chemically treated genomic DNA (Homo sapiens) CpG-island No: 15663
gttgggtttggtgattgagatagttggttcgtgtttgttttttggggtgtgtttgtcgttttggtgttgtgttattttgttgtgtgttgtgtcggcggttcgtttgcggttcggtggtttgatttgttggtcgtcggggggttattgcgtgcggttttattcgcgttgttcggttcgcgttggtgttatggtcggtatgggtcgtcggtggtttgcgagggtagcgggggggggtcggcggggcgcggtggttaggggggttcgcggcgggtggggggggtcggcgcgcgggtggggtttaggttcgtcggggggttttttttgtgggtattgtggtcgtggttttgggggtgttcgggtgttttgttttgtttttggtgtttcgttcggtcggatggtgcgtggacgcgttcgggggcgcgcgtgttgggttcgcgatgagagtcgggttgttcgcgtggggttgggttttgttttgggtgggggttcgttggttgtttgttgttcggtagtttggcggtttgtggttaattgtttgtgcgtggtgacgcgatgatatgtggcggtttgagagggtgcgtttttatgtttttttgtgggaggtttataggagtgtcgcgttaggtcggaggaatcgggg

SEQ ID NO: 15664 - DNA, 640 bp, Artificial Sequence
  chemically treated genomic DNA (Homo sapiens) CpG-island No: 15664
ccccgattcctccgacctaacgcgacactcctataaacctcccacaaaaaaacataaaaacgcaccctctcaaaccgccacatatcatcgcgtcaccacgcacaaacaattaaccacaaaccgccaaactaccgaacaacaaacaaccaacgaacccccacccaaaacaaaacccaaccccacgcgaacaacccgactctcatcgcgaacccaacacgcgcgcccccgaacgcgtccacgcaccatccgaccgaacgaaacaccaaaaacaaaacaaaacacccgaacacccccaaaaccacgaccacaatacccacaaaaaaaaccccccgacgaacctaaaccccacccgcgcgccgaccccccccacccgccgcgaacccccctaaccaccgcgccccgccgacccccccccgctaccctcgcaaaccaccgacgacccataccgaccataacaccaacgcgaaccgaacaacgcgaataaaaccgcacgcaataaccccccgacgaccaacaaatcaaaccaccgaaccgcaaacgaaccgccgacacaacacacaacaaaataacacaacaccaaaacgacaaacacaccccaaaaaacaaacacgaaccaactatctcaatcaccaaacccaac

SEQ ID NO: 15665 - DNA, 742 bp, Artificial Sequence
  chemically treated genomic DNA (Homo sapiens) CpG-island No: 15665
ttcgaggggcggggtttcggggtcggcgaggggaggggtacggatattagtataggacggggtttcgtagatagcgagcggaggggttttttcgtaaggggcgggtttcgagggtcgcgtttggaaggttttacgaggggttcggtggaagggcggtgaagggcgggttaatcgggaggcgtttaggttttgaaggtttgcgggaggtcgaaatggttttggggaggtcgaggttgaggttttattagtatcgcgggtttggaagcggcgggagttgaaagagtttgcggtgatttgtatggaagttttcgaagttaggtcgaggttttataagacggagttcgagaggtgtcggttttaagttgattgtgattacgttaaattaaggatttataggaaggaaggcggtgtcgaagtcgggagttgcgcggagaaggagcgtttaatatagttttagcggtttattacgtaagcgcgattaacggtttttcgggaagtagttaaaaacgtttggtcgtttattacgttcgcgcgttggagggcggaagtgggtgagatttcgggtattttatatcgtttttcggtttttggttacgttttttttggttatatttattcgttttgtaaggtacgtttttttcgcggcggcggttgttgtttacgtgggttttttcgggcgggcgggtagtgggcgtttttttttgtaggttgggtgtgttcgaagtttgcggttttttgtggg

SEQ ID NO: 15666 - DNA, 742 bp, Artificial Sequence
  chemically treated genomic DNA (Homo sapiens) CpG-island No: 15666
cccacaaaaaaccgcaaacttcgaacacacccaacctacaaaaaaaaacgcccactacccgcccgcccgaaaaaacccacgtaaacaacaaccgccgccgcgaaaaaaacgtaccttacaaaacgaataaatataaccaaaaaaaacgtaaccaaaaaccgaaaaacgatataaaatacccgaaatctcacccacttccgccctccaacgcgcgaacgtaataaacgaccaaacgtttttaactacttcccgaaaaaccgttaatcgcgcttacgtaataaaccgctaaaactatattaaacgctccttctccgcgcaactcccgacttcgacaccgccttccttcctataaatccttaatttaacgtaatcacaatcaacttaaaaccgacacctctcgaactccgtcttataaaacctcgacctaacttcgaaaacttccatacaaatcaccgcaaactctttcaactcccgccgcttccaaacccgcgatactaataaaacctcaacctcgacctccccaaaaccatttcgacctcccgcaaaccttcaaaacctaaacgcctcccgattaacccgcccttcaccgcccttccaccgaacccctcgtaaaaccttccaaacgcgaccctcgaaacccgccccttacgaaaaaacccctccgctcgctatctacgaaaccccgtcctatactaatatccgtacccctcccctcgccgaccccgaaaccccgcccctcgaa

SEQ ID NO: 15667 - DNA, 742 bp, Artificial Sequence
  chemically treated genomic DNA (Homo sapiens) CpG-island No: 15667
tttataggaaatcgtaggtttcgggtatatttagtttgtagggagaggcgtttattgttcgttcgttcggggaggtttacgtgggtagtagtcgtcgtcgcggagggggcgtgttttatagagcgagtgggtgtaattagagggggcgtggttagaaatcggggggcggtatggagtgttcgaggttttatttattttcgttttttagcgcgcggacgtggtaggcggttaagcgtttttggttgtttttcgggaagtcgttggtcgcgtttgcgtagtgaatcgttgaggttgtgttgagcgtttttttttcgcgtaattttcggtttcgatatcgtttttttttttatgaatttttaatttaacgtggttatagttagtttaagatcggtatttttcgggtttcgttttgtaggatttcggtttggtttcgagggtttttatataggttatcgtaggtttttttaattttcgtcgtttttaggttcgcggtattagtgagattttagtttcgatttttttaggattatttcgatttttcgtaggtttttaaggtttgagcgtttttcgattagttcgttttttatcgtttttttatcgggtttttcgtaaggttttttaaacgcgattttcgaagttcgttttttacggggaagttttttcgttcgttgtttgcgaagtttcgttttgtattggtgttcgtgttttttttttcgtcggtttcgaagtttcgtttttcgaa

SEQ ID NO: 15668 - DNA, 742 bp, Artificial Sequence
  chemically treated genomic DNA (Homo sapiens) CpG-island No: 15668
ttcgaaaaacgaaacttcgaaaccgacgaaaaaaaaaacacgaacaccaatacaaaacgaaacttcgcaaacaacgaacgaaaaaacttccccgtaaaaaacgaacttcgaaaatcgcgtttaaaaaaccttacgaaaaacccgataaaaaaacgataaaaaacgaactaatcgaaaaacgctcaaaccttaaaaacctacgaaaaatcgaaataatcctaaaaaaatcgaaactaaaatctcactaataccgcgaacctaaaaacgacgaaaattaaaaaaacctacgataacctatataaaaaccctcgaaaccaaaccgaaatcctacaaaacgaaacccgaaaaataccgatcttaaactaactataaccacgttaaattaaaaattcataaaaaaaaaaacgatatcgaaaccgaaaattacgcgaaaaaaaaacgctcaacacaacctcaacgattcactacgcaaacgcgaccaacgacttcccgaaaaacaaccaaaaacgcttaaccgcctaccacgtccgcgcgctaaaaaacgaaaataaataaaacctcgaacactccataccgccccccgatttctaaccacgccccctctaattacacccactcgctctataaaacacgccccctccgcgacgacgactactacccacgtaaacctccccgaacgaacgaacaataaacgcctctccctacaaactaaatatacccgaaacctacgatttcctataaa

SEQ ID NO: 15669 - DNA, 618 bp, Artificial Sequence
  chemically treated genomic DNA (Homo sapiens) CpG-island No: 15669
gtttttttttttttgttcgtttttatttttttgttaggtttttcggtcgtttattgttttttttttttcgtcgttttttttttttcgcggttcggcgcgcggaggtttcgtgtgtttatttgaaggttttcggggtgcgtttggtcgttcgtcggattttcgttttggggattgcgttttatttacgataaattatttttcgagaaaggggtgagttttgttgttgttttcgcgagagtaggcgtcggtttaagttttgtcgttttcgtttagttttgtattcgtttaggttatttcgatagtcgcggtttcggtcgtgggtaggacgggaaggttgcgaggtcgggcggagaggcgttttgaggtcggagcgcgtgaggacgattttttttcgttggagacgtcgtcgtcgtcgcgtttggtcgggttgtatcggggtttgggcggagggcgcgggcgcgcggggtcgcgaggggaagagtagaagcggaggcgaaggcgaggggcgtcgcgtatttgtttcgggttgtacggaagcggtttttagtggggattggcggtttttttcggtttttagggtttattcgcggttttgaaattttagtgttaggcgtttgt

SEQ ID NO: 15670 - DNA, 618 bp, Artificial Sequence
  chemically treated genomic DNA (Homo sapiens) CpG-island No: 15670
acaaacgcctaacactaaaatttcaaaaccgcgaataaaccctaaaaaccgaaaaaaaccgccaatccccactaaaaaccgcttccgtacaacccgaaacaaatacgcgacgcccctcgccttcgcctccgcttctactcttcccctcgcgaccccgcgcgcccgcgccctccgcccaaaccccgatacaacccgaccaaacgcgacgacgacgacgtctccaacgaaaaaaaatcgtcctcacgcgctccgacctcaaaacgcctctccgcccgacctcgcaaccttcccgtcctacccacgaccgaaaccgcgactatcgaaataacctaaacgaatacaaaactaaacgaaaacgacaaaacttaaaccgacgcctactctcgcgaaaacaacaacaaaactcacccctttctcgaaaaataatttatcgtaaataaaacgcaatccccaaaacgaaaatccgacgaacgaccaaacgcaccccgaaaaccttcaaataaacacacgaaacctccgcgcgccgaaccgcgaaaaaaaaaaaacgacgaaaaaaaaaaaacaataaacgaccgaaaaacctaacaaaaaaataaaaacgaacaaaaaaaaaaaaac

SEQ ID NO: 15671 - DNA, 618 bp, Artificial Sequence
  chemically treated genomic DNA (Homo sapiens) CpG-island No: 15671
ataggcgtttggtattggggttttagagtcgcgagtaggttttgaaggtcgggagggatcgttagtttttattggaagtcgttttcgtgtagttcgggataggtgcgcggcgtttttcgttttcgttttcgtttttgttttttttttcgcggtttcgcgcgttcgcgtttttcgtttagatttcggtgtagttcggttaggcgcggcggcggcggcgtttttagcgagggaaggtcgtttttacgcgtttcggttttagggcgttttttcgttcggtttcgtagttttttcgttttgtttacggtcgaggtcgcggttgtcggggtggtttggacgggtgtagggttgggcgggggcggtaggatttgaatcggcgtttgttttcgcggaggtagtagtagagtttatttttttttcgggaaatggtttatcgtggataaaacgtagtttttaaagcgaaggttcgacgggcggttagacgtatttcggggatttttaggtggatatacggggttttcgcgcgtcgagtcgcgagggaagaggggcggcgggagggagggagtagtgggcggtcggggagtttggtagaagagtgggggcgagtagggaaggaggggt

SEQ ID NO: 15672 - DNA, 618 bp, Artificial Sequence
  chemically treated genomic DNA (Homo sapiens) CpG-island No: 15672
acccctccttccctactcgcccccactcttctaccaaactccccgaccgcccactactccctccctcccgccgcccctcttccctcgcgactcgacgcgcgaaaaccccgtatatccacctaaaaatccccgaaatacgtctaaccgcccgtcgaaccttcgctttaaaaactacgttttatccacgataaaccatttcccgaaaaaaaaataaactctactactacctccgcgaaaacaaacgccgattcaaatcctaccgcccccgcccaaccctacacccgtccaaaccaccccgacaaccgcgacctcgaccgtaaacaaaacgaaaaaactacgaaaccgaacgaaaaaacgccctaaaaccgaaacgcgtaaaaacgaccttccctcgctaaaaacgccgccgccgccgcgcctaaccgaactacaccgaaatctaaacgaaaaacgcgaacgcgcgaaaccgcgaaaaaaaaaacaaaaacgaaaacgaaaacgaaaaacgccgcgcacctatcccgaactacacgaaaacgacttccaataaaaactaacgatccctcccgaccttcaaaacctactcgcgactctaaaaccccaataccaaacgcctat

SEQ ID NO: 15673 - DNA, 851 bp, Artificial Sequence
  chemically treated genomic DNA (Homo sapiens) CpG-island No: 15673
tcggacgggtcgattcggaggtggcgcgggtagtattaggtcgtcggcggcgtcgtaggcgttgagcgagacgagggagtcggggtggtcgagtatacggttcgagtagaagtatagttcggcggggcggtcgcggcgtcgggtcgcgttcgttttttttatttcgaagtttcgggataggaagcgtaggtcgcggcgtagttgaaggtataggtcgcgttcgaaggtcggtaggtgtagtagtagggcgcgtttttcgggtcgggcgcgcggggcggttgggggcgtgcgggggcgtcgtcgtcgtcggggttcgggggttgcgggtagcggcggtaggtgtacgtcgtcggggcgtattcgttacgggagtattatttttacgtcggtcgtcgcgtcgtcgatagttgcggggagagaggagacgcgttagcgcggcggggttcgttcggacgttcgttttttcgttggtcgttagtcgcgttagcgcggggatagcgcgattcggagtcggcgttgtttttttttttttcgttcggtatttttacgttggttcgcgttattcggggagggttttcggcgtagtcgcgcgagtatttttcggaacggcgtcgcgtatcggcgagcggagattcggcggcggcgcgtttgttacggagttattcgattttcgtatttcggtcgcggttcgcgtttttttcgttcgggcgtcgttagcggtttcgtcgtcgttttcgggtcgttaggacgtcgcgagaacgtagagggaaggtagtcgtaggacgcggggtgaagagggttgtgggagggggcgttatttgtgttcgggtttagtttttaaattagtagta

SEQ ID NO: 15674 - DNA, 851 bp, Artificial Sequence
  chemically treated genomic DNA (Homo sapiens) CpG-island No: 15674
tactactaatttaaaaactaaacccgaacacaaataacgccccctcccacaaccctcttcaccccgcgtcctacgactaccttccctctacgttctcgcgacgtcctaacgacccgaaaacgacgacgaaaccgctaacgacgcccgaacgaaaaaaacgcgaaccgcgaccgaaatacgaaaatcgaataactccgtaacaaacgcgccgccgccgaatctccgctcgccgatacgcgacgccgttccgaaaaatactcgcgcgactacgccgaaaaccctccccgaataacgcgaaccaacgtaaaaataccgaacgaaaaaaaaaaaaacaacgccgactccgaatcgcgctatccccgcgctaacgcgactaacgaccaacgaaaaaacgaacgtccgaacgaaccccgccgcgctaacgcgtctcctctctccccgcaactatcgacgacgcgacgaccgacgtaaaaataatactcccgtaacgaatacgccccgacgacgtacacctaccgccgctacccgcaacccccgaaccccgacgacgacgacgcccccgcacgcccccaaccgccccgcgcgcccgacccgaaaaacgcgccctactactacacctaccgaccttcgaacgcgacctataccttcaactacgccgcgacctacgcttcctatcccgaaacttcgaaataaaaaaaacgaacgcgacccgacgccgcgaccgccccgccgaactatacttctactcgaaccgtatactcgaccaccccgactccctcgtctcgctcaacgcctacgacgccgccgacgacctaatactacccgcgccacctccgaatcgacccgtccga

SEQ ID NO: 15675 - DNA, 851 bp, Artificial Sequence
  chemically treated genomic DNA (Homo sapiens) CpG-island No: 15675
tgttgttggtttggggattggattcgggtataggtagcgtttttttttatagttttttttatttcgcgttttgcggttattttttttttgcgttttcgcggcgttttggcggttcgggggcggcggcgggatcgttgacggcgttcgagcggaggaggcgcgggtcgcggtcggagtacgggaatcgggtggtttcgtggtaggcgcgtcgtcgtcgggttttcgttcgtcgatgcgcggcgtcgtttcgggaggtgttcgcgcggttgcgtcggagatttttttcgggtggcgcgggttagcgtggaggtgtcgggcgagggaagggaaggtagcgtcggtttcgggtcgcgttgttttcgcgttggcgcggttggcggttagcgggagggcgggcgttcgggcgggtttcgtcgcgttgacgcgtttttttttttttcgtagttgtcggcgacgcggcggtcgacgtggaggtggtgttttcgtggcgggtgcgtttcgacgacgtgtatttgtcgtcgttgttcgtagttttcgggtttcgacggcggcgacgttttcgtacgtttttagtcgtttcgcgcgttcggttcggagagcgcgttttgttgttgtatttgtcggttttcgggcgcgatttgtatttttagttgcgtcgcgatttgcgttttttgtttcgaggtttcgaggtggaggaggcgggcgcggttcggcgtcgcggtcgtttcgtcgagttgtgtttttattcgggtcgtgtgttcggttatttcggttttttcgtttcgtttagcgtttgcggcgtcgtcggcggtttggtattgttcgcgttattttcgggtcggttcgttcgg

SEQ ID NO: 15676 - DNA, 851 bp, Artificial Sequence
  chemically treated genomic DNA (Homo sapiens) CpG-island No: 15676
ccgaacgaaccgacccgaaaataacgcgaacaataccaaaccgccgacgacgccgcaaacgctaaacgaaacgaaaaaaccgaaataaccgaacacacgacccgaataaaaacacaactcgacgaaacgaccgcgacgccgaaccgcgcccgcctcctccacctcgaaacctcgaaacaaaaaacgcaaatcgcgacgcaactaaaaatacaaatcgcgcccgaaaaccgacaaatacaacaacaaaacgcgctctccgaaccgaacgcgcgaaacgactaaaaacgtacgaaaacgtcgccgccgtcgaaacccgaaaactacgaacaacgacgacaaatacacgtcgtcgaaacgcacccgccacgaaaacaccacctccacgtcgaccgccgcgtcgccgacaactacgaaaaaaaaaaaaacgcgtcaacgcgacgaaacccgcccgaacgcccgccctcccgctaaccgccaaccgcgccaacgcgaaaacaacgcgacccgaaaccgacgctaccttcccttccctcgcccgacacctccacgctaacccgcgccacccgaaaaaaatctccgacgcaaccgcgcgaacacctcccgaaacgacgccgcgcatcgacgaacgaaaacccgacgacgacgcgcctaccacgaaaccacccgattcccgtactccgaccgcgacccgcgcctcctccgctcgaacgccgtcaacgatcccgccgccgcccccgaaccgccaaaacgccgcgaaaacgcaaaaaaaaaataaccgcaaaacgcgaaataaaaaaaactataaaaaaaaacgctacctatacccgaatccaatccccaaaccaacaaca

SEQ ID NO: 15677 - DNA, 502 bp, Artificial Sequence
  chemically treated genomic DNA (Homo sapiens) CpG-island No: 15677
gttcgtatattcgttagcgttcgttatttgagtcgtcggtttcgcgggtgtttttttttttttttcggcgtttaagggattatttcgagtcgttcggggattttcgtcgtttttttgtatagtttggttgtcgtcgtttacgttggcgttagttttttcggtggacgaggcggcggcggcgtcgagtagttcgtgggtttcgttcgcgttttcgatagttacggtgtgtattagttacgtatttattcgggcgcgagggatgaaggggatttcgagtacgcgtatttttcggagtagttggttttcgggttgcgcggtagcgtttagttttcggtttttggggtgtaagtggttcgcgcgtttttattttttcgaggtcgagaaggggttgagcgcgtaggtagagttagtcgggtcgtttaggaatagtagttcgtttcggagtacggaatttttatttttggtgtatgagttttaaattgtagatatgtttagagtaatt

SEQ ID NO: 15678 - DNA, 502 bp, Artificial Sequence
  chemically treated genomic DNA (Homo sapiens) CpG-island No: 15678
aattactctaaacatatctacaatttaaaactcatacaccaaaaataaaaattccgtactccgaaacgaactactattcctaaacgacccgactaactctacctacgcgctcaaccccttctcgacctcgaaaaaataaaaacgcgcgaaccacttacaccccaaaaaccgaaaactaaacgctaccgcgcaacccgaaaaccaactactccgaaaaatacgcgtactcgaaatccccttcatccctcgcgcccgaataaatacgtaactaatacacaccgtaactatcgaaaacgcgaacgaaacccacgaactactcgacgccgccgccgcctcgtccaccgaaaaaactaacgccaacgtaaacgacgacaaccaaactatacaaaaaaacgacgaaaatccccgaacgactcgaaataatcccttaaacgccgaaaaaaaaaaaaaaacacccgcgaaaccgacgactcaaataacgaacgctaacgaatatacgaac

SEQ ID NO: 15679 - DNA, 502 bp, Artificial Sequence
  chemically treated genomic DNA (Homo sapiens) CpG-island No: 15679
agttgttttagatatgtttataatttagaatttatgtattaaagatgaaaatttcgtgtttcgggacgaattgttgtttttgggcggttcggttagttttgtttacgcgtttagttttttttcggtttcgggagggtgggggcgcgcgggttatttgtattttaagggtcgggagttggacgttgtcgcgtagttcgagggttagttgtttcgggaggtgcgcgtgttcggggttttttttatttttcgcgttcgggtggatgcgtggttggtgtatatcgtggttgtcgggagcgcggacgaggtttacgggttgttcggcgtcgtcgtcgtttcgtttatcggaggagttggcgttagcgtggacggcggtagttaggttgtgtaggggggcggcggggattttcgagcggttcggagtggttttttggacgtcggggaagaggagaaggtattcgcggaatcgacggtttaggtggcggacgttggcggatgtgcgagt

SEQ ID NO: 15680 - DNA, 502 bp, Artificial Sequence
  chemically treated genomic DNA (Homo sapiens) CpG-island No: 15680
actcgcacatccgccaacgtccgccacctaaaccgtcgattccgcgaataccttctcctcttccccgacgtccaaaaaaccactccgaaccgctcgaaaatccccgccgcccccctacacaacctaactaccgccgtccacgctaacgccaactcctccgataaacgaaacgacgacgacgccgaacaacccgtaaacctcgtccgcgctcccgacaaccacgatatacaccaaccacgcatccacccgaacgcgaaaaataaaaaaaaccccgaacacgcgcacctcccgaaacaactaaccctcgaactacgcgacaacgtccaactcccgacccttaaaatacaaataacccgcgcgcccccaccctcccgaaaccgaaaaaaaactaaacgcgtaaacaaaactaaccgaaccgcccaaaaacaacaattcgtcccgaaacacgaaattttcatctttaatacataaattctaaattataaacatatctaaaacaact

SEQ ID NO: 15681 - DNA, 507 bp, Artificial Sequence
  chemically treated genomic DNA (Homo sapiens) CpG-island No: 15681
ggaaagagggagaaaatgagggagatatagagatagatacgcgcgggtgttattaatttcgtttcggagtagaatcggttattttttaagtttattatttatcgtagggttcgtttattttgtttcggtcggagttttttggcgtttttttttttttttttcgttgttttattttcgcgttgtattcgggggttttattcggtttcgtttttttaagtagtttacggcgaattttaatattttcgttttttttagtttcgggtttcggaggttttatagacgggaggggagggcgtagagatagaaaggggtggggagaaagggggaaagtggtagggggaagaagggagggacggatgcgggagttggtggtgttttcgatcgtatttgcgtattgtttatagaacgcgcgattaaatgcggagtggagatgattaaggaaagttttggtttattttgagacgaaattgtttaattttaggggttggaattaatgtttaacgcgtg

SEQ ID NO: 15682 - DNA, 507 bp, Artificial Sequence
  chemically treated genomic DNA (Homo sapiens) CpG-island No: 15682
cacgcgttaaacattaattccaacccctaaaattaaacaatttcgtctcaaaataaaccaaaactttccttaatcatctccactccgcatttaatcgcgcgttctataaacaatacgcaaatacgatcgaaaacaccaccaactcccgcatccgtccctcccttcttccccctaccactttccccctttctccccacccctttctatctctacgccctcccctcccgtctataaaacctccgaaacccgaaactaaaaaaaacgaaaatattaaaattcgccgtaaactacttaaaaaaacgaaaccgaataaaacccccgaatacaacgcgaaaataaaacaacgaaaaaaaaaaaaaaaaacgccaaaaaactccgaccgaaacaaaataaacgaaccctacgataaataataaacttaaaaaataaccgattctactccgaaacgaaattaataacacccgcgcgtatctatctctatatctccctcattttctccctctttcc

SEQ ID NO: 15683 - DNA, 507 bp, Artificial Sequence
  chemically treated genomic DNA (Homo sapiens) CpG-island No: 15683
tacgcgttgggtattggttttaatttttaggattggatagtttcgttttagggtgggttaggattttttttggttatttttatttcgtatttggtcgcgcgttttgtgggtagtgcgtaaatgcgatcgggggtattattagttttcgtattcgtttttttttttttttttttgttattttttttttttttttttatttttttttgtttttgcgtttttttttttcgtttgtagaattttcggaattcgaagttggagaaagcggagatattggagttcgtcgtgggttatttgagggagcgaagtcgggtggagttttcgggtatagcgcgggggtggggtagcggagggagggaggggggacgttaggaggtttcggtcggggtagagtgggcgggttttgcggtggatggtgggtttggggagtggtcggttttgtttcgaggcgaggttaataatattcgcgcgtgtttgtttttgtgttttttttatttttttttttttttt

SEQ ID NO: 15684 - DNA, 507 bp, Artificial Sequence
  chemically treated genomic DNA (Homo sapiens) CpG-island No: 15684
aaaaaaaaaaaaaaaataaaaaaaacacaaaaacaaacacgcgcgaatattattaacctcgcctcgaaacaaaaccgaccactccccaaacccaccatccaccgcaaaacccgcccactctaccccgaccgaaacctcctaacgtcccccctccctccctccgctaccccacccccgcgctatacccgaaaactccacccgacttcgctccctcaaataacccacgacgaactccaatatctccgctttctccaacttcgaattccgaaaattctacaaacgaaaaaaaaaaacgcaaaaacaaaaaaaaataaaaaaaaaaaaaaaaaataacaaaaaaaaaaaaaaaaaaacgaatacgaaaactaataatacccccgatcgcatttacgcactacccacaaaacgcgcgaccaaatacgaaataaaaataaccaaaaaaaatcctaacccaccctaaaacgaaactatccaatcctaaaaattaaaaccaatacccaacgcgta

SEQ ID NO: 15685 - DNA, 561 bp, Artificial Sequence
  chemically treated genomic DNA (Homo sapiens) CpG-island No: 15685
gggtaggaggatattgggttcgttttttttcgcggttatcgttcgagtcggttagttcgggacgcggggtttttcggtcgttcgcgcgtagttatcggtttgggtttggtttcggggcgcggggaacgtaggagagatttcgggtattttcgacggtcggttgttaagggcggcggtcggcgtagggaagcgcggtgagggtggcgggcggtcgatttatatggcgggggtagcgggtggaggatttggtagcggtagtgatggcggcggcggttcgcgttggtttcgattggcgttggttgttcgggacggaaagatggcggtcgcgcgttattcgtattcgggtattgcgggcgggggcggggcgtcgcgggagacgcgtcgcgagcggggtcgcgggggcggggcgttgcggggcgttgcggggcgggggtcgtgtcgggtaggattacgggtttcgcgttattatgtttcggtagttttttcggtattcgcgggattttaaggcgggttgttgcggtttttttaaatttatcgttattttattttgtttgattatag

SEQ ID NO: 15686 - DNA, 561 bp, Artificial Sequence
  chemically treated genomic DNA (Homo sapiens) CpG-island No: 15686
ctataatcaaacaaaataaaataacgataaatttaaaaaaaccgcaacaacccgccttaaaatcccgcgaataccgaaaaaactaccgaaacataataacgcgaaacccgtaatcctacccgacacgacccccgccccgcaacgccccgcaacgccccgcccccgcgaccccgctcgcgacgcgtctcccgcgacgccccgcccccgcccgcaatacccgaatacgaataacgcgcgaccgccatctttccgtcccgaacaaccaacgccaatcgaaaccaacgcgaaccgccgccgccatcactaccgctaccaaatcctccacccgctacccccgccatataaatcgaccgcccgccaccctcaccgcgcttccctacgccgaccgccgcccttaacaaccgaccgtcgaaaatacccgaaatctctcctacgttccccgcgccccgaaaccaaacccaaaccgataactacgcgcgaacgaccgaaaaaccccgcgtcccgaactaaccgactcgaacgataaccgcgaaaaaaaacgaacccaatatcctcctaccc

SEQ ID NO: 15687 - DNA, 561 bp, Artificial Sequence
  chemically treated genomic DNA (Homo sapiens) CpG-island No: 15687
ttgtggttagatagggtggggtggcggtgggtttggggaagtcgtagtagttcgttttggggtttcgcgagtgtcgagggagttgtcggggtatggtggcgcggggttcgtggttttgttcggtacgattttcgtttcgtagcgtttcgtagcgtttcgttttcgcggtttcgttcgcgacgcgtttttcgcggcgtttcgttttcgttcgtagtgttcggatgcgggtgacgcgcggtcgttattttttcgtttcgggtagttagcgttagtcggagttagcgcgagtcgtcgtcgttattattgtcgttgttaagttttttattcgttgttttcgttatgtgagtcggtcgttcgttatttttatcgcgtttttttgcgtcggtcgtcgtttttggtaatcggtcgtcgggagtgttcggggttttttttgcgtttttcgcgtttcggggttaggtttaagtcggtgattgcgcgcgggcggtcgaggagtttcgcgtttcgggttggtcggttcgggcgatggtcgcgggaaggagcggatttagtgtttttttgttt

SEQ ID NO: 15688 - DNA, 561 bp, Artificial Sequence
  chemically treated genomic DNA (Homo sapiens) CpG-island No: 15688
aaacaaaaaaacactaaatccgctccttcccgcgaccatcgcccgaaccgaccaacccgaaacgcgaaactcctcgaccgcccgcgcgcaatcaccgacttaaacctaaccccgaaacgcgaaaaacgcaaaaaaaaccccgaacactcccgacgaccgattaccaaaaacgacgaccgacgcaaaaaaacgcgataaaaataacgaacgaccgactcacataacgaaaacaacgaataaaaaacttaacaacgacaataataacgacgacgactcgcgctaactccgactaacgctaactacccgaaacgaaaaaataacgaccgcgcgtcacccgcatccgaacactacgaacgaaaacgaaacgccgcgaaaaacgcgtcgcgaacgaaaccgcgaaaacgaaacgctacgaaacgctacgaaacgaaaatcgtaccgaacaaaaccacgaaccccgcgccaccataccccgacaactccctcgacactcgcgaaaccccaaaacgaactactacgacttccccaaacccaccgccaccccaccctatctaaccacaa

SEQ ID NO: 15689 - DNA, 1207 bp, Artificial Sequence
  chemically treated genomic DNA (Homo sapiens) CpG-island No: 15689
gtttatagtatcgcggtaggtttggatgtaatttacgtttagcgtcgttagtttttgtatcgcgttatttagatcgcgaagtagacggtttattcggttttttagttttcgatttaatcgttttagatttcgtagtatttcggggtcgattgggggaatggtcggtgtgggtgtgggtgtaggcgttgggtagggtcgcgtaggggtagaaggcgggggtggaggcgcgtcgtttagacggattttgagttgtaggttgttggcgataaagtgggtaaggtcgtcgtggcggtttattgtgttttcgagttttaggggattggagatggtggcgcggcgttcgtcgttcgcgtcggattcggtattttttgaggattcggcgttatcgtacgtttcgtttagttcgtttaggttgcggttgttttgaagacggttggagaacgagcggtcggttttgttgttcgcggtcgttttttcgtcgttgtttttttttttttgttgtttaatatttatttcgtcgtttggtttttttcgacggtagtttttttcggaggagggtttgttttcgggcggcgtcgggtttttgtgtcgggaggatagggaaggttcgtgttttgtattcggcgtttttttgcggttttcggttttagatagcgttttttgagggtcgggttcgttttttagagtttttcgtttcggtcggtggacgacgtcgtagtttgacgttttcggggacgttttggggtggcggttcgcgtttttaacgttttcggttttttttttttcggatattcggaggtttgcgggcggtttagaggacgttcggttcggttcgtcgttaaagattagggtttgatgtttcgttatagttagaaggttcgtttcgggttcgggtcgttttcgagacgattttatattgtaggtgggggtcgtaacggaggaattggttcgtttcggtttcggaggtagtggttgcgtttttaaggggcgttggtagaggcgagtcgattggtagcggttgataatggtaaggataggaaaagtattttgattggtcgcggcgattaggaagtttcggaagaagagttgttattgtatagcggaatatacgtgaacgtcggtagggtggagagaaggaggtgatagttgttttcgtcgtttcgttttttttgaaagttgatggggtagattttaaagattaaggttt

SEQ ID NO: 15690 - DNA, 1207 bp, Artificial Sequence
  chemically treated genomic DNA (Homo sapiens) CpG-island No: 15690
aaaccttaatctttaaaatctaccccatcaactttcaaaaaaaacgaaacgacgaaaacaactatcacctccttctctccaccctaccgacgttcacgtatattccgctatacaataacaactcttcttccgaaacttcctaatcgccgcgaccaatcaaaatacttttcctatccttaccattatcaaccgctaccaatcgactcgcctctaccaacgccccttaaaaacgcaaccactacctccgaaaccgaaacgaaccaattcctccgttacgacccccacctacaatataaaatcgtctcgaaaacgacccgaacccgaaacgaaccttctaactataacgaaacatcaaaccctaatctttaacgacgaaccgaaccgaacgtcctctaaaccgcccgcaaacctccgaatatccgaaaaaaaaaaaaccgaaaacgttaaaaacgcgaaccgccaccccaaaacgtccccgaaaacgtcaaactacgacgtcgtccaccgaccgaaacgaaaaactctaaaaaacgaacccgaccctcaaaaaacgctatctaaaaccgaaaaccgcaaaaaaacgccgaatacaaaacacgaaccttccctatcctcccgacacaaaaacccgacgccgcccgaaaacaaaccctcctccgaaaaaaactaccgtcgaaaaaaaccaaacgacgaaataaatattaaacaacaaaaaaaaaaaaacaacgacgaaaaaacgaccgcgaacaacaaaaccgaccgctcgttctccaaccgtcttcaaaacaaccgcaacctaaacgaactaaacgaaacgtacgataacgccgaatcctcaaaaaataccgaatccgacgcgaacgacgaacgccgcgccaccatctccaatcccctaaaactcgaaaacacaataaaccgccacgacgaccttacccactttatcgccaacaacctacaactcaaaatccgtctaaacgacgcgcctccacccccgccttctacccctacgcgaccctacccaacgcctacacccacacccacaccgaccattcccccaatcgaccccgaaatactacgaaatctaaaacgattaaatcgaaaactaaaaaaccgaataaaccgtctacttcgcgatctaaataacgcgatacaaaaactaacgacgctaaacgtaaattacatccaaacctaccgcgatactataaac

SEQ ID NO: 15691 - DNA, 1207 bp, Artificial Sequence
  chemically treated genomic DNA (Homo sapiens) CpG-island No: 15691
ggattttggtttttaagatttgttttattagtttttagaaagggcggggcgacgggagtagttgttatttttttttttttattttgtcggcgtttacgtgtgtttcgttgtgtagtaatagtttttttttcgggattttttggtcgtcgcgattaattaaaatgttttttttgtttttattattgttagtcgttgttaatcggttcgtttttattaacgttttttaaaggcgtagttattgttttcggagtcggggcgaattaattttttcgttgcggtttttatttgtagtatggagtcgtttcgggggcggttcgggttcgagacggattttttggttgtagcggaatattaggttttagtttttggcggcgggtcgggtcgaacgttttttgagtcgttcgtaggttttcgggtgttcggggaggaagagatcgagaacgttgggggcgcgaatcgttattttaggacgttttcgaagacgttaagttgcggcgtcgtttatcggtcggaacgggaggttttggagaacgagttcggtttttaagggacgttgtttggggtcgggagtcgtaggggggcgtcgggtgtagagtacgaattttttttgttttttcggtataagaattcggcgtcgttcgagggtaagttttttttcgggagggattgtcgtcgagggggattaggcggcgggatggatgttgagtagtaggaggaggaagataacgacgaggaggcggtcgcgggtagtagagtcggtcgttcgttttttagtcgtttttaggatagtcgtagtttggacgggttgagcgaggcgtgcggtggcgtcgggtttttagggagtgtcgagttcggcgcgggcggcggacgtcgcgttattatttttagttttttggagttcgaaggtatagtgagtcgttacggcgattttatttattttgtcgttaataatttgtaatttaagattcgtttgagcggcgcgtttttattttcgttttttgtttttgcgcggttttgtttagcgtttgtatttatatttatatcggttatttttttaatcgatttcgaggtgttgcgggatttggagcggttgagtcgggagttgggaggtcgggtggatcgtttgtttcgcggtttgggtggcgcggtgtaggagttgacggcgttgagcgtgggttgtatttagatttatcgcgatgttgtggat

SEQ ID NO: 15692 - DNA, 1207 bp, Artificial Sequence
  chemically treated genomic DNA (Homo sapiens) CpG-island No: 15692
atccacaacatcgcgataaatctaaatacaacccacgctcaacgccgtcaactcctacaccgcgccacccaaaccgcgaaacaaacgatccacccgacctcccaactcccgactcaaccgctccaaatcccgcaacacctcgaaatcgattaaaaaaataaccgatataaatataaatacaaacgctaaacaaaaccgcgcaaaaacaaaaaacgaaaataaaaacgcgccgctcaaacgaatcttaaattacaaattattaacgacaaaataaataaaatcgccgtaacgactcactataccttcgaactccaaaaaactaaaaataataacgcgacgtccgccgcccgcgccgaactcgacactccctaaaaacccgacgccaccgcacgcctcgctcaacccgtccaaactacgactatcctaaaaacgactaaaaaacgaacgaccgactctactacccgcgaccgcctcctcgtcgttatcttcctcctcctactactcaacatccatcccgccgcctaatccccctcgacgacaatccctcccgaaaaaaaacttaccctcgaacgacgccgaattcttataccgaaaaaacaaaaaaaattcgtactctacacccgacgcccccctacgactcccgaccccaaacaacgtcccttaaaaaccgaactcgttctccaaaacctcccgttccgaccgataaacgacgccgcaacttaacgtcttcgaaaacgtcctaaaataacgattcgcgcccccaacgttctcgatctcttcctccccgaacacccgaaaacctacgaacgactcaaaaaacgttcgacccgacccgccgccaaaaactaaaacctaatattccgctacaaccaaaaaatccgtctcgaacccgaaccgcccccgaaacgactccatactacaaataaaaaccgcaacgaaaaaattaattcgccccgactccgaaaacaataactacgcctttaaaaaacgttaataaaaacgaaccgattaacaacgactaacaataataaaaacaaaaaaaacattttaattaatcgcgacgaccaaaaaatcccgaaaaaaaaactattactacacaacgaaacacacgtaaacgccgacaaaataaaaaaaaaaaaataacaactactcccgtcgccccgccctttctaaaaactaataaaacaaatcttaaaaaccaaaatcc

SEQ ID NO: 15693 - DNA, 540 bp, Artificial Sequence
  chemically treated genomic DNA (Homo sapiens) CpG-island No: 15693
  misc_feature (3)..(3): n is either a, c, g or t
ganatgcggatttaagcggagttttttcggtagcgtttgttagagtgcggttagtcggtgatttttatttagtttcgttatatcgtcgcgtattagttatagtgattcgttgcggttgtaatcgtttttatcgggaaataggtgtttaaaatataggtttttgtcgtcgtagttattgagtattagtgtgttatcgcgtagttgtaagcggatattcgtaggtattttttagtcggggtcgaggtttttatatcggcgcgggcgtttttgttcggtaattgttgtaggtgcgggagagaatgaacggtagcgggtcgggtagggcgatgtcggttttatcgggaaggatttttgtatcgagtagcggattgatcggatggtcggacgttatttcgtcggggtatatcgaataggttacgtcggtgggggtatcgatgcgtatttcggttgaattttggataatgttatcgttatattgcgttatgtcgttttgacgcgtcgtcggtttttcgtttatcgtaaaattttttttttattatt

SEQ ID NO: 15694 - DNA, 540 bp, Artificial Sequence
  chemically treated genomic DNA (Homo sapiens) CpG-island No: 15694
  misc_feature (538)..(538): n is either a, c, g or t
aataataaaaaaaaaattttacgataaacgaaaaaccgacgacgcgtcaaaacgacataacgcaatataacgataacattatccaaaattcaaccgaaatacgcatcgatacccccaccgacgtaacctattcgatataccccgacgaaataacgtccgaccatccgatcaatccgctactcgatacaaaaatccttcccgataaaaccgacatcgccctacccgacccgctaccgttcattctctcccgcacctacaacaattaccgaacaaaaacgcccgcgccgatataaaaacctcgaccccgactaaaaaatacctacgaatatccgcttacaactacgcgataacacactaatactcaataactacgacgacaaaaacctatattttaaacacctatttcccgataaaaacgattacaaccgcaacgaatcactataactaatacgcgacgatataacgaaactaaataaaaatcaccgactaaccgcactctaacaaacgctaccgaaaaaactccgcttaaatccgcatntc

SEQ ID NO: 15695 - DNA, 540 bp, Artificial Sequence
  chemically treated genomic DNA (Homo sapiens) CpG-island No: 15695
  misc_feature (538)..(538): n is either a, c, g or t
aataatagaaaaaggattttacgataagcggaaaatcggcggcgcgttagggcgatatgacgtagtatggcggtagtattgtttagggtttagtcggggtacgtatcggtgtttttatcggcgtggtttgttcggtgtgtttcggcggggtgacgttcggttattcggttaattcgttgttcggtgtaaaggtttttttcggtgaaatcgatatcgttttgttcggttcgttgtcgtttattttttttcgtatttatagtagttatcggataaaaacgttcgcgtcggtgtgggagtttcggtttcggttggaaaatgtttgcggatattcgtttatagttgcgcgataatatattgatatttagtgattacggcggtagaagtttgtattttgagtatttgtttttcggtgaggacggttatagtcgtagcgagttattgtggttggtgcgcggcggtgtggcgaaattggatgaaggttatcggttggtcgtattttggtaggcgttgtcggaagaatttcgtttaagttcgtatntt

SEQ ID NO: 15696 - DNA, 540 bp, Artificial Sequence
  chemically treated genomic DNA (Homo sapiens) CpG-island No: 15696
  misc_feature (3)..(3): n is either a, c, g or t
aanatacgaacttaaacgaaattcttccgacaacgcctaccaaaatacgaccaaccgataaccttcatccaatttcgccacaccgccgcgcaccaaccacaataactcgctacgactataaccgtcctcaccgaaaaacaaatactcaaaatacaaacttctaccgccgtaatcactaaatatcaatatattatcgcgcaactataaacgaatatccgcaaacattttccaaccgaaaccgaaactcccacaccgacgcgaacgtttttatccgataactactataaatacgaaaaaaaataaacgacaacgaaccgaacaaaacgatatcgatttcaccgaaaaaaacctttacaccgaacaacgaattaaccgaataaccgaacgtcaccccgccgaaacacaccgaacaaaccacgccgataaaaacaccgatacgtaccccgactaaaccctaaacaatactaccgccatactacgtcatatcgccctaacgcgccgccgattttccgcttatcgtaaaatcctttttctattatt

SEQ ID NO: 15697 - DNA, 589 bp, Artificial Sequence
  chemically treated genomic DNA (Homo sapiens) CpG-island No: 15697
acgtagagtttttcgcgttagcggggataaatcgtagtcgaagttaaaggtgatgtcgaatacgttgagtttttcgcgttagcggggataaatcgggttttttgtcggttgtaattgataatgttgagagtttttcgcgttagcggggataaatcgtttggatcgggtttggaatttttgagcggtcgcgagtttttcgcgttagcggggataaatcgcgaatcgcgtatattttgcgcgtcgtcgtttgcgagtttttcgcgttagcggggataaatcgttagttttataaattcggagatacggaaattagagtttttcgcgttagcgaggattaatcggatttatttcgaaagagattgttagttagtttgagtttttcgcgttagcggggataaatcgttgttggagttggttgtaaggtaagtcgtttagagtttttcggcgttagcggggattaatcggggggcgtatggatcgtaaatattatttttcgggagtttttcgcgttagcggggataaatcgggagttttagatattatgtggtattgatggttttttaatttttcgcggttaataggggataaa

SEQ ID NO: 15698 - DNA, 589 bp, Artificial Sequence
  chemically treated genomic DNA (Homo sapiens) CpG-island No: 15698
tttatcccctattaaccgcgaaaaattaaaaaaccatcaataccacataatatctaaaactcccgatttatccccgctaacgcgaaaaactcccgaaaaataatatttacgatccatacgccccccgattaatccccgctaacgccgaaaaactctaaacgacttaccttacaaccaactccaacaacgatttatccccgctaacgcgaaaaactcaaactaactaacaatctctttcgaaataaatccgattaatcctcgctaacgcgaaaaactctaatttccgtatctccgaatttataaaactaacgatttatccccgctaacgcgaaaaactcgcaaacgacgacgcgcaaaatatacgcgattcgcgatttatccccgctaacgcgaaaaactcgcgaccgctcaaaaattccaaacccgatccaaacgatttatccccgctaacgcgaaaaactctcaacattatcaattacaaccgacaaaaaacccgatttatccccgctaacgcgaaaaactcaacgtattcgacatcacctttaacttcgactacgatttatccccgctaacgcgaaaaactctacgt

SEQ ID NO: 15699 - DNA, 589 bp, Artificial Sequence
  chemically treated genomic DNA (Homo sapiens) CpG-island No: 15699
tttattttttgttaatcgcggggaattggaaggttattaatgttatatagtgtttggaattttcggtttattttcgttggcgcggggaattttcggggaataatgtttacggtttatgcgtttttcggttaattttcgttggcgtcggggaattttgggcggtttgttttgtagttagttttagtagcggtttattttcgttggcgcggggaatttaagttggttggtaatttttttcggggtgagttcggttaattttcgttggcgcggggaattttagttttcgtattttcggatttataaagttgacggtttattttcgttggcgcggggaattcgtaggcggcgacgcgtagggtatgcgcgattcgcggtttattttcgttggcgcggggaattcgcgatcgtttagaaattttagattcgatttaaacggtttattttcgttggcgcggggaatttttaatattattaattataatcgatagggagttcggtttattttcgttggcgcggggaatttagcgtgttcggtattatttttggtttcggttgcggtttattttcgttggcgcggggaattttgcgt

SEQ ID NO: 15700 - DNA, 589 bp, Artificial Sequence
  chemically treated genomic DNA (Homo sapiens) CpG-island No: 15700
acgcaaaattccccgcgccaacgaaaataaaccgcaaccgaaaccaaaaataataccgaacacgctaaattccccgcgccaacgaaaataaaccgaactccctatcgattataattaataatattaaaaattccccgcgccaacgaaaataaaccgtttaaatcgaatctaaaatttctaaacgatcgcgaattccccgcgccaacgaaaataaaccgcgaatcgcgcataccctacgcgtcgccgcctacgaattccccgcgccaacgaaaataaaccgtcaactttataaatccgaaaatacgaaaactaaaattccccgcgccaacgaaaattaaccgaactcaccccgaaaaaaattaccaaccaacttaaattccccgcgccaacgaaaataaaccgctactaaaactaactacaaaacaaaccgcccaaaattccccgacgccaacgaaaattaaccgaaaaacgcataaaccgtaaacattattccccgaaaattccccgcgccaacgaaaataaaccgaaaattccaaacactatataacattaataaccttccaattccccgcgattaacaaaaaataaa

SEQ ID NO: 15701 - DNA, 545 bp, Artificial Sequence
  chemically treated genomic DNA (Homo sapiens) CpG-island No: 15701
acgtattttcgaagcgtatatatttacgtagcggcggcggaataatttttttattaatttgtaaggttgcgtgttcgagatcgattaacggtcggttttggatacgaataaatagttacgtttcgtttatcgttaatagtataatcgttagcgtatagcggaatagcggagagaaatcgttttgatgaatttcggttagcggtacgcgtatttagatattgggcgatagttaggtttttagttagacgataggcgaatttttgttgattttaacgcgtattttcgtcgggtcgtttagttgttgcgttatttgatggtttaagaatttatagtgttgcgtttaacgtagatttgttttttcggtagtttcgttggagtagagagagatttttagtttacggtagatttttcgacggaaagcgggaggtataattaattgcgtgtcgttttttagttgtagtttgtcggttattaatatacgtatttcgtacgcgaggattttattaaattgttggaggttcggtaaaatcgcgaagtttagtatt

SEQ ID NO: 15702 - DNA, 545 bp, Artificial Sequence
  chemically treated genomic DNA (Homo sapiens) CpG-island No: 15702
aatactaaacttcgcgattttaccgaacctccaacaatttaataaaatcctcgcgtacgaaatacgtatattaataaccgacaaactacaactaaaaaacgacacgcaattaattatacctcccgctttccgtcgaaaaatctaccgtaaactaaaaatctctctctactccaacgaaactaccgaaaaaacaaatctacgttaaacgcaacactataaattcttaaaccatcaaataacgcaacaactaaacgacccgacgaaaatacgcgttaaaatcaacaaaaattcgcctatcgtctaactaaaaacctaactatcgcccaatatctaaatacgcgtaccgctaaccgaaattcatcaaaacgatttctctccgctattccgctatacgctaacgattatactattaacgataaacgaaacgtaactatttattcgtatccaaaaccgaccgttaatcgatctcgaacacgcaaccttacaaattaataaaaaaattattccgccgccgctacgtaaatatatacgcttcgaaaatacgt

SEQ ID NO: 15703 - DNA, 545 bp, Artificial Sequence
  chemically treated genomic DNA (Homo sapiens) CpG-island No: 15703
ggtgttgaatttcgcgattttgtcgagtttttagtagtttaataaagttttcgcgtacgaagtgcgtatgttgatgatcgataaattgtaattggaggacggtacgtagttggttgtgtttttcgtttttcgtcgggagatttatcgtgagttggggatttttttttattttaacgaggttgtcgaagaggtaggtttgcgttgggcgtaatattatgaatttttaagttattagatggcgtagtaattgggcggttcgacggaagtgcgcgttgaggttaataaaagttcgtttgtcgtttggttgaaaatttggttgtcgtttaatatttgggtacgcgtgtcgttgatcgaaatttattagggcgattttttttcgttgtttcgttatacgttggcgattatgttattggcgataggcggggcgtggttgtttattcgtatttagaatcgatcgttggtcgatttcgaatacgtagttttgtaggttggtaaagggattatttcgtcgtcgttgcgtgagtatgtgcgtttcggaggtgcgt

SEQ ID NO: 15704 - DNA, 545 bp, Artificial Sequence
  chemically treated genomic DNA (Homo sapiens) CpG-island No: 15704
acgcacctccgaaacgcacatactcacgcaacgacgacgaaataatccctttaccaacctacaaaactacgtattcgaaatcgaccaacgatcgattctaaatacgaataaacaaccacgccccgcctatcgccaataacataatcgccaacgtataacgaaacaacgaaaaaaaatcgccctaataaatttcgatcaacgacacgcgtacccaaatattaaacgacaaccaaattttcaaccaaacgacaaacgaacttttattaacctcaacgcgcacttccgtcgaaccgcccaattactacgccatctaataacttaaaaattcataatattacgcccaacgcaaacctacctcttcgacaacctcgttaaaataaaaaaaaatccccaactcacgataaatctcccgacgaaaaacgaaaaacacaaccaactacgtaccgtcctccaattacaatttatcgatcatcaacatacgcacttcgtacgcgaaaactttattaaactactaaaaactcgacaaaatcgcgaaattcaacacc

SEQ ID NO: 15705 - DNA, 517 bp, Artificial Sequence
  chemically treated genomic DNA (Homo sapiens) CpG-island No: 15705
tattaggttggcgaatagtaaggtgacgatgagtaataacgtacgggtaaatgaatttcgtggcgagaagcgtaatcgttttatgttttagagtcgttcggtataaagacgtagtttagattttagacggtttgaatgtaacgcggatgcgttggatttttttttattatgcggcgtagacgcgaaatttgtacgtcgatggagcgttttattgcggaatatttacgattacgggtaaggtttattagtttatcgcgggagagcggtttacgcggatgggtgattagtgttttagtatcgaaattttcggtggtgagcggatcggtcgtttcgcggaaaattcggcgtacgaggttacgttgatttacgaaggaatacggttttcgggagagggtagaagatgttgcggtataaatcgtagggataggtatagaatcggtaacggtgagtggtaggtaattagcgaaaggattttttggtatgaggggggtttaagaggtaaacgggatattaaagg

SEQ ID NO: 15706 - DNA, 517 bp, Artificial Sequence
  chemically treated genomic DNA (Homo sapiens) CpG-island No: 15706
cctttaatatcccgtttacctcttaaacccccctcataccaaaaaatcctttcgctaattacctaccactcaccgttaccgattctatacctatccctacgatttataccgcaacatcttctaccctctcccgaaaaccgtattccttcgtaaatcaacgtaacctcgtacgccgaattttccgcgaaacgaccgatccgctcaccaccgaaaatttcgatactaaaacactaatcacccatccgcgtaaaccgctctcccgcgataaactaataaaccttacccgtaatcgtaaatattccgcaataaaacgctccatcgacgtacaaatttcgcgtctacgccgcataataaaaaaaaatccaacgcatccgcgttacattcaaaccgtctaaaatctaaactacgtctttataccgaacgactctaaaacataaaacgattacgcttctcgccacgaaattcatttacccgtacgttattactcatcgtcaccttactattcgccaacctaata

SEQ ID NO: 15707 - DNA, 517 bp, Artificial Sequence
  chemically treated genomic DNA (Homo sapiens) CpG-island No: 15707
tttttggtgtttcgtttgttttttagattttttttatgttaaggaattttttcgttgattgtttattatttatcgttatcggttttgtgtttatttttgcggtttatatcgtaatattttttgttttttttcgagaatcgtattttttcgtaagttaacgtgatttcgtacgtcgaatttttcgcgaaacgatcgattcgtttattatcgggagtttcggtattgaagtattggttatttattcgcgtgagtcgttttttcgcgataagttgatgaattttgttcgtggtcgtgaatatttcgtaatggaacgttttatcgacgtgtagatttcgcgtttgcgtcgtatggtggaagaagatttagcgtattcgcgttatatttagatcgtttggggtttgggttacgtttttgtatcggacggttttaaagtatgaggcgattgcgtttttcgttacgaagtttatttgttcgtacgttattgtttatcgttattttgttgttcgttagtttggtg

SEQ ID NO: 15708 - DNA, 517 bp, Artificial Sequence
  chemically treated genomic DNA (Homo sapiens) CpG-island No: 15708
caccaaactaacgaacaacaaaataacgataaacaataacgtacgaacaaataaacttcgtaacgaaaaacgcaatcgcctcatactttaaaaccgtccgatacaaaaacgtaacccaaaccccaaacgatctaaatataacgcgaatacgctaaatcttcttccaccatacgacgcaaacgcgaaatctacacgtcgataaaacgttccattacgaaatattcacgaccacgaacaaaattcatcaacttatcgcgaaaaaacgactcacgcgaataaataaccaatacttcaataccgaaactcccgataataaacgaatcgatcgtttcgcgaaaaattcgacgtacgaaatcacgttaacttacgaaaaaatacgattctcgaaaaaaaacaaaaaatattacgatataaaccgcaaaaataaacacaaaaccgataacgataaataataaacaatcaacgaaaaaattccttaacataaaaaaaatctaaaaaacaaacgaaacaccaaaaa

SEQ ID NO: 15709 - DNA, 605 bp, Artificial Sequence
  chemically treated genomic DNA (Homo sapiens) CpG-island No: 15709
tttatgtagcgcgattaggtgttgacgtagtgggcgttgtttagtatgttgcgttagggcggtagtaattttatcggcggttaacgttaacgtgatcgtcgtaagcgtattaagtttttgtttagtatgggttaattgttgttgttattgtcgtagatgttcgcgatcgttggtttgttgggagaattgcgtacgttaattcgtcggttcgttgttttattgacggaagcggtcgtgtttttgtaattaggtatttaggttttgttgttgttgttgtaattttgttgattgtttcgtcgcgtggtggcgaatgttcgcgcgaagcgttattgtgttttgtaagcgagtatttatttttttaatttgttggcgaatatgcgttagcgtcgcgttgtgttttgcgatgcgtttttagtgtggacgaagatttcgtgtcggttgtgttagattaagcgtcgttagttgaggttgcgttttttttttttcggttaacgtttgttgtaaggtttgttgacggcggttggttttttgttgtaattcgttttgacgcgttaattagtttagcgattgttgtttttgttgttgcgcggtaattaattgttttt

SEQ ID NO: 15710 - DNA, 605 bp, Artificial Sequence
  chemically treated genomic DNA (Homo sapiens) CpG-island No: 15710
aaaaacaattaattaccgcgcaacaacaaaaacaacaatcgctaaactaattaacgcgtcaaaacgaattacaacaaaaaaccaaccgccgtcaacaaaccttacaacaaacgttaaccgaaaaaaaaaaaacgcaacctcaactaacgacgcttaatctaacacaaccgacacgaaatcttcgtccacactaaaaacgcatcgcaaaacacaacgcgacgctaacgcatattcgccaacaaattaaaaaaataaatactcgcttacaaaacacaataacgcttcgcgcgaacattcgccaccacgcgacgaaacaatcaacaaaattacaacaacaacaacaaaacctaaatacctaattacaaaaacacgaccgcttccgtcaataaaacaacgaaccgacgaattaacgtacgcaattctcccaacaaaccaacgatcgcgaacatctacgacaataacaacaacaattaacccatactaaacaaaaacttaatacgcttacgacgatcacgttaacgttaaccgccgataaaattactaccgccctaacgcaacatactaaacaacgcccactacgtcaacacctaatcgcgctacataaa

SEQ ID NO: 15711 - DNA, 605 bp, Artificial Sequence
  chemically treated genomic DNA (Homo sapiens) CpG-island No: 15711
aaaaatagttaattatcgcgtagtagtaagaataataatcgttaaattggttaacgcgttaggacgaattgtagtaagaagttagtcgtcgttagtaggttttgtaataggcgttagtcgaagaagaaaaagcgtaattttaattggcggcgtttagtttggtataatcggtacgaaattttcgtttatattgggaacgtatcgtagaatatagcgcggcgttggcgtatattcgttagtagattgaagaagtaaatattcgtttatagagtataatggcgtttcgcgcgagtattcgttattacgcggcgaagtagttagtagaattatagtagtagtaataaagtttgaatatttggttataggaatacgatcgttttcgttagtggaataacgaatcggcgggttggcgtgcgtagtttttttaataaattagcgatcgcgagtatttgcggtaatggtagtaatagttaatttatgttgagtaaaaatttaatgcgtttgcggcgattacgttgacgttaatcgtcgatgaagttgttatcgttttggcgtaatatgttgagtaacgtttattgcgttagtatttggtcgcgttgtatgga

SEQ ID NO: 15712 - DNA, 605 bp, Artificial Sequence
  chemically treated genomic DNA (Homo sapiens) CpG-island No: 15712
tccatacaacgcgaccaaatactaacgcaataaacgttactcaacatattacgccaaaacgataacaacttcatcgacgattaacgtcaacgtaatcgccgcaaacgcattaaatttttactcaacataaattaactattactaccattaccgcaaatactcgcgatcgctaatttattaaaaaaactacgcacgccaacccgccgattcgttattccactaacgaaaacgatcgtattcctataaccaaatattcaaactttattactactactataattctactaactacttcgccgcgtaataacgaatactcgcgcgaaacgccattatactctataaacgaatatttacttcttcaatctactaacgaatatacgccaacgccgcgctatattctacgatacgttcccaatataaacgaaaatttcgtaccgattataccaaactaaacgccgccaattaaaattacgctttttcttcttcgactaacgcctattacaaaacctactaacgacgactaacttcttactacaattcgtcctaacgcgttaaccaatttaacgattattattcttactactacgcgataattaactattttt

SEQ ID NO: 15713 - DNA, 868 bp, Artificial Sequence
  chemically treated genomic DNA (Homo sapiens) CpG-island No: 15713
ttgttttgtcgttagtttttcggcgattttaatcggtagcgtgatcgtgttgttatcgtaattaaaggagacgcgtgtatttgcgtttatatttaatttcgcggtattcgttgggttgagtttgatgtacggttgcggtatacggttttggaagatcggagtacgttgtgataatttatcgttgttaaataggtggtaatacggcgcgatacgttatttttcgttttgcggttggaagcgtgtcggtacgttggtgaagtaatttagattattttcgttggttttaaatagacgtacgttcggatcgttaaagcgtagtttgtcgtttatttcgttttggaatttgttttacgtttgcggggagttttagttcggcgtttaggtaaacggtatttgcgaacggtgcgtagtcggttggttgttattttttatcgagaaggtgaatatggtgttaatattttgcggttgacgcggtttatgaacgttgatattggcgcgtatggcggtacgatcgttgtaacggtgcggtttacgggttagtttttgtttacgaatacggaatgtcgtattcggcgtagtatttttgatatttgttagtttcgggattttcgttataatagcgttattatatggtcgagttgcgtttagtttattttacggtttagtagggtgttgtgtagcgagtgtaattagcgttagttttttagtatgatagttttgttgtcgtaataagtaggatcgtaaatttggaagaaacgttgggcgcggttttcgttgttgattatcgtatcgtcgtttttagtaaagttggtagtagaaagtattagatgggcgttttttataatcgttgtgcgttgatgattaatta

SEQ ID NO: 15714 - DNA, 868 bp, Artificial Sequence
  chemically treated genomic DNA (Homo sapiens) CpG-island No: 15714
taattaatcatcaacgcacaacgattataaaaaacgcccatctaatactttctactaccaactttactaaaaacgacgatacgataatcaacaacgaaaaccgcgcccaacgtttcttccaaatttacgatcctacttattacgacaacaaaactatcatactaaaaaactaacgctaattacactcgctacacaacaccctactaaaccgtaaaataaactaaacgcaactcgaccatataataacgctattataacgaaaatcccgaaactaacaaatatcaaaaatactacgccgaatacgacattccgtattcgtaaacaaaaactaacccgtaaaccgcaccgttacaacgatcgtaccgccatacgcgccaatatcaacgttcataaaccgcgtcaaccgcaaaatattaacaccatattcaccttctcgataaaaaataacaaccaaccgactacgcaccgttcgcaaataccgtttacctaaacgccgaactaaaactccccgcaaacgtaaaacaaattccaaaacgaaataaacgacaaactacgctttaacgatccgaacgtacgtctatttaaaaccaacgaaaataatctaaattacttcaccaacgtaccgacacgcttccaaccgcaaaacgaaaaataacgtatcgcgccgtattaccacctatttaacaacgataaattatcacaacgtactccgatcttccaaaaccgtataccgcaaccgtacatcaaactcaacccaacgaataccgcgaaattaaatataaacgcaaatacacgcgtctcctttaattacgataacaacacgatcacgctaccgattaaaatcgccgaaaaactaacgacaaaacaa

SEQ ID NO: 15715 - DNA, 868 bp, Artificial Sequence
  chemically treated genomic DNA (Homo sapiens) CpG-island No: 15715
tggttgattattaacgtatagcgattatggaaaacgtttatttggtattttttgttgttagttttgttgaaagcgacggtacggtgattaataacgaaggtcgcgtttaacgttttttttaggtttacgattttgtttattacgatagtaaaattgttatgttggaaagttggcgttggttatattcgttgtatagtattttgttgagtcgtgaagtggattggacgtagttcgattatgtgatgacgttgttgtggcgaaaatttcggaattggtaggtattaaagatgttgcgtcggatgcgatatttcgtattcgtgggtagaaattggttcgtgaatcgtatcgttatagcggtcgtatcgttatgcgcgttaatattagcgtttatgagtcgcgttagtcgtaggatattgatattatgtttattttttcgatggaaggtaataattagtcgattgcgtatcgttcgtaagtgtcgtttgtttgggcgtcgggttggaatttttcgtaggcgtggaataaattttaggacgaagtgggcggtaaattgcgttttggcgattcgggcgtgcgtttgtttgaaattagcgaaaatggtttggattattttattagcgtatcggtacgtttttagtcgtaggacgggaaatggcgtatcgcgtcgtattattatttgtttggtagcgatgaattgttatagcgtgtttcggttttttagagtcgtatgtcgtagtcgtatattaaatttaatttagcggatgtcgcgaagttgggtgtgaacgtaggtatacgcgttttttttagttacgatggtaatacggttacgttgtcggttgaaatcgtcgaaggattgacggtagggtag

SEQ ID NO: 15716 - DNA, 868 bp, Artificial Sequence
  chemically treated genomic DNA (Homo sapiens) CpG-island No: 15716
ctaccctaccgtcaatccttcgacgatttcaaccgacaacgtaaccgtattaccatcgtaactaaaaaaaacgcgtatacctacgttcacacccaacttcgcgacatccgctaaattaaatttaatatacgactacgacatacgactctaaaaaaccgaaacacgctataacaattcatcgctaccaaacaaataataatacgacgcgatacgccatttcccgtcctacgactaaaaacgtaccgatacgctaataaaataatccaaaccattttcgctaatttcaaacaaacgcacgcccgaatcgccaaaacgcaatttaccgcccacttcgtcctaaaatttattccacgcctacgaaaaattccaacccgacgcccaaacaaacgacacttacgaacgatacgcaatcgactaattattaccttccatcgaaaaaataaacataatatcaatatcctacgactaacgcgactcataaacgctaatattaacgcgcataacgatacgaccgctataacgatacgattcacgaaccaatttctacccacgaatacgaaatatcgcatccgacgcaacatctttaatacctaccaattccgaaattttcgccacaacaacgtcatcacataatcgaactacgtccaatccacttcacgactcaacaaaatactatacaacgaatataaccaacgccaactttccaacataacaattttactatcgtaataaacaaaatcgtaaacctaaaaaaaacgttaaacgcgaccttcgttattaatcaccgtaccgtcgctttcaacaaaactaacaacaaaaaataccaaataaacgttttccataatcgctatacgttaataatcaacca

SEQ ID NO: 15717 - DNA, 516 bp, Artificial Sequence
  chemically treated genomic DNA (Homo sapiens) CpG-island No: 15717
tcgcgtttcgcgaagttttaatgagcgttttggcgtagattcgcgagtaaggttacgttttggatagcgaagagaacgagtagggcgtgcgttgcgtggcggtgtcggtgtggaattacgagtttcgcgttatcgtcgttttgagtttgtcgacgttgatttttcgcgtggacgacgcggagttggttaattttcgcgagtagttttagtaggtcgggttcgcgttttcgcgcgcgttgggttattcggtttgagtcgttagatcggttcgtaggtaagtagtcgaagttcgcgtatgtagtcgtcgtcgttgatgttttcgtagtgtaggtttataaacgcgtcggtgaagaagtcgcgttcgtcgatgtagtcgttcgatagtttttacgttttatacgtttatcggtacggtgtgtttacgtttttgttatttaaacgagttagttttatgcggtagatttatcgtattacgtttattcggtaatcggaagttttcgtattgtttcggaacgg

SEQ ID NO: 15718 - DNA, 516 bp, Artificial Sequence
  chemically treated genomic DNA (Homo sapiens) CpG-island No: 15718
ccgttccgaaacaatacgaaaacttccgattaccgaataaacgtaatacgataaatctaccgcataaaactaactcgtttaaataacaaaaacgtaaacacaccgtaccgataaacgtataaaacgtaaaaactatcgaacgactacatcgacgaacgcgacttcttcaccgacgcgtttataaacctacactacgaaaacatcaacgacgacgactacatacgcgaacttcgactacttacctacgaaccgatctaacgactcaaaccgaataacccaacgcgcgcgaaaacgcgaacccgacctactaaaactactcgcgaaaattaaccaactccgcgtcgtccacgcgaaaaatcaacgtcgacaaactcaaaacgacgataacgcgaaactcgtaattccacaccgacaccgccacgcaacgcacgccctactcgttctcttcgctatccaaaacgtaaccttactcgcgaatctacgccaaaacgctcattaaaacttcgcgaaacgcga

SEQ ID NO: 15719 - DNA, 516 bp, Artificial Sequence
  chemically treated genomic DNA (Homo sapiens) CpG-island No: 15719
tcgtttcggaataatgcgagagttttcggttgtcgggtgaacgtgatacggtgggtttatcgtataaagttaattcgtttagatggtagagacgtggatatatcgtgtcggtgaacgtatgaggcgtggaagttgtcggacgattatatcggcgggcgcggtttttttatcggcgcgtttgtgggtttgtattgcgaggatattagcggcgacggttgtatacgcggatttcgattatttatttacgagtcggtttaacggtttaggtcgggtagtttagcgcgcgcgagagcgcgagttcggtttgttgaagttgttcgcggaaattagttagtttcgcgtcgtttacgcgggaggttagcgtcgataggtttagggcggcgatgacgcgggattcgtggttttatatcggtatcgttacgtagcgtacgttttgttcgtttttttcgttgtttagggcgtagttttgttcgcgggtttgcgttagggcgtttattaaggtttcgcgagacgcga

SEQ ID NO: 15720 - DNA, 516 bp, Artificial Sequence
  chemically treated genomic DNA (Homo sapiens) CpG-island No: 15720
tcgcgtctcgcgaaaccttaataaacgccctaacgcaaacccgcgaacaaaactacgccctaaacaacgaaaaaaacgaacaaaacgtacgctacgtaacgataccgatataaaaccacgaatcccgcgtcatcgccgccctaaacctatcgacgctaacctcccgcgtaaacgacgcgaaactaactaatttccgcgaacaacttcaacaaaccgaactcgcgctctcgcgcgcgctaaactacccgacctaaaccgttaaaccgactcgtaaataaataatcgaaatccgcgtatacaaccgtcgccgctaatatcctcgcaatacaaacccacaaacgcgccgataaaaaaaccgcgcccgccgatataatcgtccgacaacttccacgcctcatacgttcaccgacacgatatatccacgtctctaccatctaaacgaattaactttatacgataaacccaccgtatcacgttcacccgacaaccgaaaactctcgcattattccgaaacga

SEQ ID NO: 15721 - DNA, 514 bp, Artificial Sequence
  chemically treated genomic DNA (Homo sapiens) CpG-island No: 15721
ttaaattatcgtattagttaatattcggttgtataatgtcgatatcggtttttgaaagcgtacgaaaagattgtagtgtgtcgtggtgtttatcgttggtgattattatttcgattggcgcgttgcgttttagttcgcgataatttttatattgttgtggcggtaggtatttttcgatttattttaggttatagggcgcgtaagcgtgggttagtttggtcgtatagtttacgttttgatttatttagtagtcgagtattaattagaaatttttatcgtattttttacgtatattcgcgattatagcggtatttttgcggattttcgtatcgttattatgtggtttttagtgcgtcggtattttgttatcgataaagtttattttttttgttagattcggacgcgtatttgtggcgtagaattgaattttattacgaatagcgtcgtttaaaagtttataaatcggaagttcgattattttgtcgaatagattttatagagttagatcgatata

SEQ ID NO: 15722 - DNA, 514 bp, Artificial Sequence
  chemically treated genomic DNA (Homo sapiens) CpG-island No: 15722
tatatcgatctaactctataaaatctattcgacaaaataatcgaacttccgatttataaacttttaaacgacgctattcgtaataaaattcaattctacgccacaaatacgcgtccgaatctaacaaaaaaaataaactttatcgataacaaaataccgacgcactaaaaaccacataataacgatacgaaaatccgcaaaaataccgctataatcgcgaatatacgtaaaaaatacgataaaaatttctaattaatactcgactactaaataaatcaaaacgtaaactatacgaccaaactaacccacgcttacgcgccctataacctaaaataaatcgaaaaatacctaccgccacaacaatataaaaattatcgcgaactaaaacgcaacgcgccaatcgaaataataatcaccaacgataaacaccacgacacactacaatcttttcgtacgctttcaaaaaccgatatcgacattatacaaccgaatattaactaatacgataatttaa

SEQ ID NO: 15723 - DNA, 514 bp, Artificial Sequence
  chemically treated genomic DNA (Homo sapiens) CpG-island No: 15723
tgtgtcgatttggttttgtgggatttgttcggtaaagtggtcgggttttcggtttataaatttttaggcggcgttgttcgtgatgagatttagttttacgttataggtgcgcgttcggatttggtaaaagagatgggttttatcggtggtaaaatgtcgacgtattgggggttatatgatggcgatgcggggattcgtaaagatgtcgttatggtcgcggatatgcgtgaaaaatgcggtgaggatttttggttaatgttcgattgttggatgagttaggacgtgaattatgcgattaaattggtttacgtttgcgcgttttataatttgaaatggatcgaagagtgtttgtcgttatagtagtatgaaagttatcgcgaattgaaacgtaacgcgttagtcggaatgatggttattagcggtgagtattacggtatattgtaattttttcgtacgtttttagaaatcggtatcgatattatgtagtcggatgttggttggtgcggtggtttaa

SEQ ID NO: 15724 - DNA, 514 bp, Artificial Sequence
  chemically treated genomic DNA (Homo sapiens) CpG-island No: 15724
ttaaaccaccgcaccaaccaacatccgactacataatatcgataccgatttctaaaaacgtacgaaaaaattacaatataccgtaatactcaccgctaataaccatcattccgactaacgcgttacgtttcaattcgcgataactttcatactactataacgacaaacactcttcgatccatttcaaattataaaacgcgcaaacgtaaaccaatttaatcgcataattcacgtcctaactcatccaacaatcgaacattaaccaaaaatcctcaccgcatttttcacgcatatccgcgaccataacgacatctttacgaatccccgcatcgccatcatataacccccaatacgtcgacattttaccaccgataaaacccatctcttttaccaaatccgaacgcgcacctataacgtaaaactaaatctcatcacgaacaacgccgcctaaaaatttataaaccgaaaacccgaccactttaccgaacaaatcccacaaaaccaaatcgacaca

SEQ ID NO: 15725 - DNA, 669 bp, Artificial Sequence
  chemically treated genomic DNA (Homo sapiens) CpG-island No: 15725
gtttgcggtcgtgtgttcgtttcgttcgggttgtggttttcgttcggtttgttcgtgatggatgggagtgtgcgatgtgttcgttgttttcgtgtgttttgttcggtgtcggttcggaatgatgggatggagatggtcgcggggagtttaggtcgtcggggttttcggagtaattattcgagtagacggagtatacggagtagcggtttcggtttcgttaacgttgtcgtcgggtgagtcggggttttcgttcggcgttcgagtttcgcgcgggggtgggaaggggttgcggaaaagttgggagtttcgggtgtcgttttgtcgcggggtcgcggaggggtcgggttgggaaggtcgcggggtcggggcgaggagggaggcggcgttggcggggggcgttgcgggcgtttatggcggcggtcgtcgggtaaggcgggcgtagcgttttaagggagcggtcggggtcggcgggtttggcgtcgcggtgttcgcggtagcgtcgttttgagtcggagaagttttttcgggtaataggtagggcggaaggtggggacgcgggggttgcgggcgacggggtcgagtcgtgggtttttttttgttggggagtggaggagtttggtgattattggcgcgagagtttttattttggtagcggttcgcggggttgtt

SEQ ID NO: 15726 - DNA, 669 bp, Artificial Sequence
  chemically treated genomic DNA (Homo sapiens) CpG-island No: 15726
aacaaccccgcgaaccgctaccaaaataaaaactctcgcgccaataatcaccaaactcctccactccccaacaaaaaaaaacccacgactcgaccccgtcgcccgcaacccccgcgtccccaccttccgccctacctattacccgaaaaaacttctccgactcaaaacgacgctaccgcgaacaccgcgacgccaaacccgccgaccccgaccgctcccttaaaacgctacgcccgccttacccgacgaccgccgccataaacgcccgcaacgccccccgccaacgccgcctccctcctcgccccgaccccgcgaccttcccaacccgacccctccgcgaccccgcgacaaaacgacacccgaaactcccaacttttccgcaaccccttcccacccccgcgcgaaactcgaacgccgaacgaaaaccccgactcacccgacgacaacgttaacgaaaccgaaaccgctactccgtatactccgtctactcgaataattactccgaaaaccccgacgacctaaactccccgcgaccatctccatcccatcattccgaaccgacaccgaacaaaacacacgaaaacaacgaacacatcgcacactcccatccatcacgaacaaaccgaacgaaaaccacaacccgaacgaaacgaacacacgaccgcaaac

SEQ ID NO: 15727 - DNA, 669 bp, Artificial Sequence
  chemically treated genomic DNA (Homo sapiens) CpG-island No: 15727
ggtaatttcgcgggtcgttgttagggtggaggttttcgcgttaatggttattaagtttttttattttttaataaagggaagtttacggttcggtttcgtcgttcgtagttttcgcgtttttatttttcgttttatttgttgttcgggaaagttttttcggtttagggcggcgttgtcgcggatatcgcggcgttaggttcgtcggtttcggtcgtttttttgaggcgttgcgttcgttttattcggcggtcgtcgttatgagcgttcgtagcgtttttcgttagcgtcgttttttttttcgtttcggtttcgcggtttttttagttcgattttttcgcggtttcgcgataaagcggtattcggggtttttaattttttcgtagtttttttttattttcgcgcggggttcgggcgtcgggcgggggtttcgatttattcggcggtagcgttggcggggtcggggtcgttgtttcgtgtatttcgtttgttcgggtggttgtttcgaggatttcgacggtttggatttttcgcgattatttttattttattatttcggatcgatatcgaataggatatacgaaggtaacgaatatatcgtatatttttatttattacgaatagatcgaacggaagttatagttcgaacgaaacgaatatacgatcgtaggt

SEQ ID NO: 15728 - DNA, 669 bp, Artificial Sequence
  chemically treated genomic DNA (Homo sapiens) CpG-island No: 15728
acctacgatcgtatattcgtttcgttcgaactataacttccgttcgatctattcgtaataaataaaaatatacgatatattcgttaccttcgtatatcctattcgatatcgatccgaaataataaaataaaaataatcgcgaaaaatccaaaccgtcgaaatcctcgaaacaaccacccgaacaaacgaaatacacgaaacaacgaccccgaccccgccaacgctaccgccgaataaatcgaaacccccgcccgacgcccgaaccccgcgcgaaaataaaaaaaaactacgaaaaaattaaaaaccccgaataccgctttatcgcgaaaccgcgaaaaaatcgaactaaaaaaaccgcgaaaccgaaacgaaaaaaaaaacgacgctaacgaaaaacgctacgaacgctcataacgacgaccgccgaataaaacgaacgcaacgcctcaaaaaaacgaccgaaaccgacgaacctaacgccgcgatatccgcgacaacgccgccctaaaccgaaaaaactttcccgaacaacaaataaaacgaaaaataaaaacgcgaaaactacgaacgacgaaaccgaaccgtaaacttccctttattaaaaaataaaaaaacttaataaccattaacgcgaaaacctccaccctaacaacgacccgcgaaattacc

SEQ ID NO: 15729 - DNA, 660 bp, Artificial Sequence
  chemically treated genomic DNA (Homo sapiens) CpG-island No: 15729
tcgttttgtattttgtcggtaaagatacgttcgtaacgtagttggtggttttattttttaaagatgtgatgtcgtagttggggttgttttatattttgttggtttatttcgttattgtgggtattggtaacgcggtaaatttgatcgatggtttcgacggtttggtaattatgtcgatcgtatttgtcgtcggtggttttgcgttggtggcgtgggcgatcggtaatatgaattttgttagttatttgtatatatcgtatttgcgatacgtcggggaattggttattgtttgtatcgcgatagtcggggtaggattggttttttgttggtttaatatttattcggcgtaggtttttatgggcgatgtaggttcgttggcgttaggtggtgcgttaggtattatcgtcgtattgttacgttaggaatttttgttggtgattatggggggcgtgttcgtggtagaaacgttttttgttattttgtaggtcggtttttttaaattgcgcggataacgtattttttcgtatggtatcgatttattattattatgaattgaaaggttggtcggaatcgcgcgttattgtgcgtttttggattatttcgttgatgttggttttgattggtttggttacgttgaaggtacgttaattatggttgatt

SEQ ID NO: 15730 - DNA, 660 bp, Artificial Sequence
  chemically treated genomic DNA (Homo sapiens) CpG-island No: 15730
aatcaaccataattaacgtaccttcaacgtaaccaaaccaatcaaaaccaacatcaacgaaataatccaaaaacgcacaataacgcgcgattccgaccaacctttcaattcataataataataaatcgataccatacgaaaaaatacgttatccgcgcaatttaaaaaaaccgacctacaaaataacaaaaaacgtttctaccacgaacacgccccccataatcaccaacaaaaattcctaacgtaacaatacgacgataatacctaacgcaccacctaacgccaacgaacctacatcgcccataaaaacctacgccgaataaatattaaaccaacaaaaaaccaatcctaccccgactatcgcgatacaaacaataaccaattccccgacgtatcgcaaatacgatatatacaaataactaacaaaattcatattaccgatcgcccacgccaccaacgcaaaaccaccgacgacaaatacgatcgacataattaccaaaccgtcgaaaccatcgatcaaatttaccgcgttaccaatacccacaataacgaaataaaccaacaaaatataaaacaaccccaactacgacatcacatctttaaaaaataaaaccaccaactacgttacgaacgtatctttaccgacaaaatacaaaacga

SEQ ID NO: 15731 - DNA, 660 bp, Artificial Sequence
  chemically treated genomic DNA (Homo sapiens) CpG-island No: 15731
aattagttatgattaacgtatttttagcgtggttagattaattagaattagtattagcgaaataatttagaaacgtataatgacgcgcggtttcggttagttttttagtttatagtggtgatgaatcggtgttatgcgggaaaatacgttgttcgcgtagtttaaaggagtcgatttgtaggatgatagaaagcgtttttattacgaatacgttttttataattattagtaggaatttttgacgtagtagtacggcgataatgtttaacgtattatttaacgttagcgaatttatatcgtttataaagatttgcgtcggataggtgttaaattaataggaagttagttttgtttcgattatcgcggtatagataataattagtttttcggcgtgtcgtagatacggtatatgtaagtagttggtaaagtttatattgtcggtcgtttacgttattagcgtaaaattatcggcgataaatacggtcggtataattgttaggtcgtcgagattatcggttaggtttatcgcgttgttagtatttataatgacgaagtaagttagtagaatgtagaatagttttagttgcggtattatatttttaaagaatgggattattagttgcgttgcgggcgtgtttttgtcggtaaggtatagggcga

SEQ ID NO: 15732 - DNA, 660 bp, Artificial Sequence
  chemically treated genomic DNA (Homo sapiens) CpG-island No: 15732
tcgccctataccttaccgacaaaaacacgcccgcaacgcaactaataatcccattctttaaaaatataataccgcaactaaaactattctacattctactaacttacttcgtcattataaatactaacaacgcgataaacctaaccgataatctcgacgacctaacaattataccgaccgtatttatcgccgataattttacgctaataacgtaaacgaccgacaatataaactttaccaactacttacatataccgtatctacgacacgccgaaaaactaattattatctataccgcgataatcgaaacaaaactaacttcctattaatttaacacctatccgacgcaaatctttataaacgatataaattcgctaacgttaaataatacgttaaacattatcgccgtactactacgtcaaaaattcctactaataattataaaaaacgtattcgtaataaaaacgctttctatcatcctacaaatcgactcctttaaactacgcgaacaacgtattttcccgcataacaccgattcatcaccactataaactaaaaaactaaccgaaaccgcgcgtcattatacgtttctaaattatttcgctaatactaattctaattaatctaaccacgctaaaaatacgttaatcataactaatt

SEQ ID NO: 15733 - DNA, 1035 bp, Artificial Sequence
  chemically treated genomic DNA (Homo sapiens) CpG-island No: 15733
  misc_feature (623)..(623): n is either a, c, g or t
gtaggtttcgcggtcgatgcgtatcggtgcgaagtcgggcggtagcgcgtcgttggttattatatgcgcggtagtgatgtgggttttgtcgtcgcggttgtcgaatagcgttagtttattcgagcgtacgttgacggcgtatagcgttagtcgcgtgtcgtcggaggcggtgaggtcgaagtcgacgaggtcgtttagcgtttgggttagcggcgtggtgtcgtagaagtttagttcgtttaggggcgtttcgcggtttaggttttaggttagcggttcgcgcggtcggaagaagtcgggtacgtcgtttattagggtttgttaggtttgtaggttcgcgttgaaggcgttcgtcgggtcggttatcggtaggttcggtcgcgttacgcgcgattagaattcgcgtagcgtcgcgaggcggtcggtcggtttgttgtcggcgattagcgtcgcgttgatggcgtcgatggaggtgtcgattagttagttcggcgcgatgtcgtcggcgtttagcgtttcggttatatcggtttggtaggcgtttagggtattatcgttttggaagacgtagacggtttggggagggcgtcgcgtcgttattaggtgggttgtagttgtaagtngtcgtcgtagggaacggcgcggaagaacggtagggtttcgacggtcgcggtatgcgcggcgagtcgcgggaagttttcggtcggtatcgagttcgggtagtacgaattgcgtgaaagtttaggttacgtcgatcgtgagggtcgtttggtcgagatcggtttcgttcgtgtttagcggttgcgcggttagttcggcgttaagggcgcggtaggcggcgtcgagttggtcgttgacgcgttcgatttagggttggtggcgtttttcggtcgggcgtaggtcgcgttcgtagacgatttgggcgtttttttcgtaggtcgttagcgttaggtcgatgaggcgtagttcgcgtagtagcgcggcgggttgggcgggtattaggttgcggtcgtttagggtttcgacgtaggttag

SEQ ID NO: 15734 - DNA, 1035 bp, Artificial Sequence
  chemically treated genomic DNA (Homo sapiens) CpG-island No: 15734
  misc_feature (413)..(413): n is either a, c, g or t
ctaacctacgtcgaaaccctaaacgaccgcaacctaatacccgcccaacccgccgcgctactacgcgaactacgcctcatcgacctaacgctaacgacctacgaaaaaaacgcccaaatcgtctacgaacgcgacctacgcccgaccgaaaaacgccaccaaccctaaatcgaacgcgtcaacgaccaactcgacgccgcctaccgcgcccttaacgccgaactaaccgcgcaaccgctaaacacgaacgaaaccgatctcgaccaaacgaccctcacgatcgacgtaacctaaactttcacgcaattcgtactacccgaactcgataccgaccgaaaacttcccgcgactcgccgcgcataccgcgaccgtcgaaaccctaccgttcttccgcgccgttccctacgacgacnacttacaactacaacccacctaataacgacgcgacgccctccccaaaccgtctacgtcttccaaaacgataataccctaaacgcctaccaaaccgatataaccgaaacgctaaacgccgacgacatcgcgccgaactaactaatcgacacctccatcgacgccatcaacgcgacgctaatcgccgacaacaaaccgaccgaccgcctcgcgacgctacgcgaattctaatcgcgcgtaacgcgaccgaacctaccgataaccgacccgacgaacgccttcaacgcgaacctacaaacctaacaaaccctaataaacgacgtacccgacttcttccgaccgcgcgaaccgctaacctaaaacctaaaccgcgaaacgcccctaaacgaactaaacttctacgacaccacgccgctaacccaaacgctaaacgacctcgtcgacttcgacctcaccgcctccgacgacacgcgactaacgctatacgccgtcaacgtacgctcgaataaactaacgctattcgacaaccgcgacgacaaaacccacatcactaccgcgcatataataaccaacgacgcgctaccgcccgacttcgcaccgatacgcatcgaccgcgaaacctac

SEQ ID NO: 15735 - DNA, 1035 bp, Artificial Sequence
  chemically treated genomic DNA (Homo sapiens) CpG-island No: 15735
  misc_feature (413)..(413): n is either a, c, g or t
ttggtttacgtcgaggttttgggcggtcgtagtttgatgttcgtttagttcgtcgcgttgttgcgcgagttgcgttttatcggtttggcgttggcggtttgcgagaagagcgtttagatcgtttacgagcgcggtttgcgttcggtcgagaagcgttattagttttggatcgagcgcgttagcggttagttcgacgtcgtttatcgcgtttttgacgtcgaattggtcgcgtaatcgttggatacgggcgaggtcggtttcggttaggcggtttttacggtcggcgtggtttggatttttacgtagttcgtgttgttcgagttcggtgtcggtcgagggtttttcgcggttcgtcgcgtatgtcgcggtcgtcgaggttttgtcgttttttcgcgtcgttttttgcgacgatngtttgtagttgtagtttatttgatggcgacgcgacgttttttttagatcgtttacgttttttagggcggtggtgttttgggcgtttattaggtcggtgtggtcgaggcgttggacgtcggcggtatcgcgtcggattggttggtcggtatttttatcggcgttattaacgcggcgttgatcgtcggtaataagtcggtcgatcgtttcgcggcgttgcgcgagttttggtcgcgcgtgacgcggtcgggtttgtcgatggtcggttcggcgaacgtttttagcgcgggtttgtagatttggtagattttggtgggcggcgtgttcggtttttttcggtcgcgcgggtcgttggtttgggatttgaatcgcgaggcgtttttgaacgaattgggtttttacgatattacgtcgttggtttagacgttgaacgatttcgtcgatttcgattttatcgttttcggcgatacgcggttgacgttgtgcgtcgttaacgtgcgttcgggtgagttggcgttgttcgataatcgcgacggtaagatttatattattgtcgcgtatgtgatggttagcggcgcgttgtcgttcggtttcgtatcggtgcgtatcggtcgcgaggtttat

SEQ ID NO: 15736 - DNA, 1035 bp, Artificial Sequence
  chemically treated genomic DNA (Homo sapiens) CpG-island No: 15736
  misc_feature (623)..(623): n is either a, c, g or t
ataaacctcgcgaccgatacgcaccgatacgaaaccgaacgacaacgcgccgctaaccatcacatacgcgacaataatataaatcttaccgtcgcgattatcgaacaacgccaactcacccgaacgcacgttaacgacgcacaacgtcaaccgcgtatcgccgaaaacgataaaatcgaaatcgacgaaatcgttcaacgtctaaaccaacgacgtaatatcgtaaaaacccaattcgttcaaaaacgcctcgcgattcaaatcccaaaccaacgacccgcgcgaccgaaaaaaaccgaacacgccgcccaccaaaatctaccaaatctacaaacccgcgctaaaaacgttcgccgaaccgaccatcgacaaacccgaccgcgtcacgcgcgaccaaaactcgcgcaacgccgcgaaacgatcgaccgacttattaccgacgatcaacgccgcgttaataacgccgataaaaataccgaccaaccaatccgacgcgataccgccgacgtccaacgcctcgaccacaccgacctaataaacgcccaaaacaccaccgccctaaaaaacgtaaacgatctaaaaaaaacgtcgcgtcgccatcaaataaactacaactacaaacnatcgtcgcaaaaaacgacgcgaaaaaacgacaaaacctcgacgaccgcgacatacgcgacgaaccgcgaaaaaccctcgaccgacaccgaactcgaacaacacgaactacgtaaaaatccaaaccacgccgaccgtaaaaaccgcctaaccgaaaccgacctcgcccgtatccaacgattacgcgaccaattcgacgtcaaaaacgcgataaacgacgtcgaactaaccgctaacgcgctcgatccaaaactaataacgcttctcgaccgaacgcaaaccgcgctcgtaaacgatctaaacgctcttctcgcaaaccgccaacgccaaaccgataaaacgcaactcgcgcaacaacgcgacgaactaaacgaacatcaaactacgaccgcccaaaacctcgacgtaaaccaa

SEQ ID NO: 15737 - DNA, 855 bp, Artificial Sequence
  chemically treated genomic DNA (Homo sapiens) CpG-island No: 15737
tgaaaaattaggatggcgcggtggtgggttgtatcgtattgtgtatcgaaatcggtgaagtggtttattttaaagttcgcgttatcgtgttggcgattggcggagtagggcgtatttattagtttattattaacgtttatattaatatcggcgacggtgtcggtatggttattcgtgtcggcgtatcggtgtaggatatggaaatgtggtagttttattcgatcggtattgtcggtgcgggcgtattggttatcgaaggttgtcgtggtgaaggcggttatttgttgaataaatatggttatcgtagtttgtaagattacggtatgggttcggaaatttcgttgggcgagtcgaaaaataaatatatggaattgggtttacgcgataaagttttttaggttttttggtacgaatggcgtaaaggtaatattatttttacgtcgcgtggcgatgtggtttatttcgatttgcgttatttcggcgagaaaaaattgtatgaacgtttgtcgtttatttgcgaattggcgaaagcgtacgttggcgtcgattcggttaaagaatcgatttcggtacgttcgatcgtatattatattatgggcggtatcgaaatcgattagaattgtgaaattcgtattaaaggtttgttcgtcgtgggtgaatgtttttttgttggtttgtacggtgtaaatcgtttgggttttaattttttggcggaattggtggttttcggtcgtttggtcggtgaataagcgatagagcgtgtagtaattgtcggtaatggtaacgaagcggtaattgaagcgtaggtagttggcgttgaataacgtttgaaagatttggttaattaggatggcg

SEQ ID NO: 15738 - DNA, 855 bp, Artificial Sequence
  chemically treated genomic DNA (Homo sapiens) CpG-island No: 15738
cgccatcctaattaaccaaatctttcaaacgttattcaacgccaactacctacgcttcaattaccgcttcgttaccattaccgacaattactacacgctctatcgcttattcaccgaccaaacgaccgaaaaccaccaattccgccaaaaaattaaaacccaaacgatttacaccgtacaaaccaacaaaaaaacattcacccacgacgaacaaacctttaatacgaatttcacaattctaatcgatttcgataccgcccataatataatatacgatcgaacgtaccgaaatcgattctttaaccgaatcgacgccaacgtacgctttcgccaattcgcaaataaacgacaaacgttcatacaattttttctcgccgaaataacgcaaatcgaaataaaccacatcgccacgcgacgtaaaaataatattacctttacgccattcgtaccaaaaaacctaaaaaactttatcgcgtaaacccaattccatatatttatttttcgactcgcccaacgaaatttccgaacccataccgtaatcttacaaactacgataaccatatttattcaacaaataaccgccttcaccacgacaaccttcgataaccaatacgcccgcaccgacaataccgatcgaataaaactaccacatttccatatcctacaccgatacgccgacacgaataaccataccgacaccgtcgccgatattaatataaacgttaataataaactaataaatacgccctactccgccaatcgccaacacgataacgcgaactttaaaataaaccacttcaccgatttcgatacacaatacgatacaacccaccaccgcgccatcctaatttttca

SEQ ID NO: 15739 - DNA, 855 bp, Artificial Sequence
  chemically treated genomic DNA (Homo sapiens) CpG-island No: 15739
cgttattttggttaattagattttttagacgttgtttaacgttagttgtttgcgttttaattgtcgtttcgttgttattatcggtagttgttgtacgttttgtcgtttgtttatcggttagacggtcgaagattattagtttcgttagggagttagaatttagacggtttgtatcgtgtagattaatagaggaatatttatttacggcgaatagatttttaatgcgggttttatagttttgatcggtttcgatatcgtttatggtgtagtgtgcggtcggacgtatcggaatcggttttttaatcggatcgacgttaacgtacgttttcgttagttcgtagatgaacggtagacgtttatgtagttttttttcgtcgaggtgacgtaagtcgagataaattatatcgttacgcggcgtggagatggtgttgtttttacgttattcgtgttagaaggtttgagagattttgtcgcgtggatttagttttatatatttgtttttcggttcgtttagcggagttttcgggtttatgtcgtaattttgtagattacggtagttatgtttgtttagtagataatcgtttttattacggtaattttcggtgattagtacgttcgtatcggtaatgtcggtcgggtggaattgttatatttttatattttgtatcggtacgtcggtacggatagttatgtcgatatcgtcgtcggtgttaatgtgggcgttggtggtggattgataaatacgttttgtttcgttagtcgttagtacggtagcgcgggttttgaaataaattattttatcggtttcgatgtatagtgcggtataatttattatcgcgttattttggtttttta

SEQ ID NO: 15740 - DNA, 855 bp, Artificial Sequence
  chemically treated genomic DNA (Homo sapiens) CpG-island No: 15740
taaaaaaccaaaataacgcgataataaattataccgcactatacatcgaaaccgataaaataatttatttcaaaacccgcgctaccgtactaacgactaacgaaacaaaacgtatttatcaatccaccaccaacgcccacattaacaccgacgacgatatcgacataactatccgtaccgacgtaccgatacaaaatataaaaatataacaattccacccgaccgacattaccgatacgaacgtactaatcaccgaaaattaccgtaataaaaacgattatctactaaacaaacataactaccgtaatctacaaaattacgacataaacccgaaaactccgctaaacgaaccgaaaaacaaatatataaaactaaatccacgcgacaaaatctctcaaaccttctaacacgaataacgtaaaaacaacaccatctccacgccgcgtaacgatataatttatctcgacttacgtcacctcgacgaaaaaaaactacataaacgtctaccgttcatctacgaactaacgaaaacgtacgttaacgtcgatccgattaaaaaaccgattccgatacgtccgaccgcacactacaccataaacgatatcgaaaccgatcaaaactataaaacccgcattaaaaatctattcgccgtaaataaatattcctctattaatctacacgatacaaaccgtctaaattctaactccctaacgaaactaataatcttcgaccgtctaaccgataaacaaacgacaaaacgtacaacaactaccgataataacaacgaaacgacaattaaaacgcaaacaactaacgttaaacaacgtctaaaaaatctaattaaccaaaataacg

SEQ ID NO: 15741 - DNA, 788 bp, Artificial Sequence
  chemically treated genomic DNA (Homo sapiens) CpG-island No: 15741
gtagaggtggagtcgcgtcgtattcgggtatttttcggcgtgggcgttttcggcgggcgggttttggtcgagggcgttcggcggtttggaacggtgagtcgggtgtcgggtttgttacgtagtcgtagagatttagtttcgtcggcgggcggtaggaagggaggcgacgttttttggagcgcggtaggaattcgttcggttcgttttttagttcgtttagtcgcgtcggttttagaagtggcgaaagtcgtagtcgagtttaggttacgtcgaagttttgtttttttaagggggagttttgaaacggcgtttgggttttatgtttgtatcgttcgcgggaaggaaattttatgttgtaataaagtttttttcgcgtttttttttttttttttttttttagaatttggtttttttttttttcggagttcgcggggattttttttttttattttttttttttttttcgcgtttcgaattcggtttagtcgggggggaggtcgggcgttcgggttagagttcgtcggagcggagcgcgttcggttttatggatagttcggtcgttattatttagattagtaaggaggaggttcggggtcgttgcggggtaaaggtatcggggttgcggggagggggtcgaagtcggggcgtcgtgggaggagagaaggggtcgggattttttttaggggagttcgtcgcgcgttcgggcggtcgttttagttgtgttcgaagtttttagttcgagagggagtagggagagagtttgaatttagaggaggtttagagacgcg

SEQ ID NO: 15742 - DNA, 788 bp, Artificial Sequence
  chemically treated genomic DNA (Homo sapiens) CpG-island No: 15742
cgcgtctctaaacctcctctaaattcaaactctctccctactccctctcgaactaaaaacttcgaacacaactaaaacgaccgcccgaacgcgcgacgaactcccctaaaaaaaatcccgaccccttctctcctcccacgacgccccgacttcgaccccctccccgcaaccccgatacctttaccccgcaacgaccccgaacctcctccttactaatctaaataataacgaccgaactatccataaaaccgaacgcgctccgctccgacgaactctaacccgaacgcccgacctcccccccgactaaaccgaattcgaaacgcgaaaaaaaaaaaaaaaataaaaaaaaaaaatccccgcgaactccgaaaaaaaaaaaaaccaaattctaaaaaaaaaaaaaaaaaaaaaaacgcgaaaaaaactttattacaacataaaatttccttcccgcgaacgatacaaacataaaacccaaacgccgtttcaaaactcccccttaaaaaaacaaaacttcgacgtaacctaaactcgactacgactttcgccacttctaaaaccgacgcgactaaacgaactaaaaaacgaaccgaacgaattcctaccgcgctccaaaaaacgtcgcctcccttcctaccgcccgccgacgaaactaaatctctacgactacgtaacaaacccgacacccgactcaccgttccaaaccgccgaacgccctcgaccaaaacccgcccgccgaaaacgcccacgccgaaaaatacccgaatacgacgcgactccacctctac

SEQ ID NO: 15743 - DNA, 788 bp, Artificial Sequence
  chemically treated genomic DNA (Homo sapiens) CpG-island No: 15743
cgcgtttttgagttttttttgagtttaaattttttttttgttttttttcgggttgggagtttcgggtatagttaaggcggtcgttcgggcgcgcggcgagtttttttggggaagatttcggttttttttttttttttacggcgtttcggtttcggtttttttttcgtagtttcggtatttttgtttcgtagcggtttcgagttttttttttgttgatttgagtaatgacggtcgagttgtttatggggtcgggcgcgtttcgtttcggcggattttggttcgggcgttcggtttttttttcggttgggtcgaattcggggcgcgggggggaggggaggggtgggagggagggattttcgcgagtttcggagggaaggggagttaggttttaggggggagggggagggagggggcgcggaggaaattttgttataatatggagtttttttttcgcgagcgatgtaaatatggaatttaggcgtcgttttaaggtttttttttaaaagggtaaggtttcggcgtgatttggattcggttgcggttttcgttatttttgggatcggcgcggttaggcggattgggaggcgggtcgggcgggtttttgtcgcgttttagggggcgtcgtttttttttttgtcgttcgtcggcggggttgagtttttgcggttgcgtggtaggttcggtattcggtttatcgttttaggtcgtcgagcgttttcggttaaggttcgttcgtcgggagcgtttacgtcggggagtgttcgagtgcggcgcggttttatttttgt

SEQ ID NO: 15744 - DNA, 788 bp, Artificial Sequence
  chemically treated genomic DNA (Homo sapiens) CpG-island No: 15744
acaaaaataaaaccgcgccgcactcgaacactccccgacgtaaacgctcccgacgaacgaaccttaaccgaaaacgctcgacgacctaaaacgataaaccgaataccgaacctaccacgcaaccgcaaaaactcaaccccgccgacgaacgacaaaaaaaaaaacgacgccccctaaaacgcgacaaaaacccgcccgacccgcctcccaatccgcctaaccgcgccgatcccaaaaataacgaaaaccgcaaccgaatccaaatcacgccgaaaccttacccttttaaaaaaaaaccttaaaacgacgcctaaattccatatttacatcgctcgcgaaaaaaaaactccatattataacaaaatttcctccgcgccccctccctccccctcccccctaaaacctaactccccttccctccgaaactcgcgaaaatccctccctcccacccctcccctcccccccgcgccccgaattcgacccaaccgaaaaaaaaaccgaacgcccgaaccaaaatccgccgaaacgaaacgcgcccgaccccataaacaactcgaccgtcattactcaaatcaacaaaaaaaaaactcgaaaccgctacgaaacaaaaataccgaaactacgaaaaaaaaaccgaaaccgaaacgccgtaaaaaaaaaaaaaaaaccgaaatcttccccaaaaaaactcgccgcgcgcccgaacgaccgccttaactatacccgaaactcccaacccgaaaaaaaacaaaaaaaaaatttaaactcaaaaaaaactcaaaaacgcg

SEQ ID NO: 15745 - DNA, 840 bp, Artificial Sequence
  chemically treated genomic DNA (Homo sapiens) CpG-island No: 15745
atcgtggcgtatgcgtcgttagttattttttttttttttaggtaaaagttattcgtttcgagagagacgagtagcgattggtcgcgattttgggatatgtaaatttaggtcggtggggcggggcgcggcgcgagagcgcgaaatgcggtagtgaacggtcgggggcggtaggcggcgcgagcgttcgcgttgggagcgcgtttttcgcgcgtttttttcgggtcggggcggtggggatcgggtttggcggcggttttaggcgcggtttgggttacgcggggataatggaggggtggtcgtcgcggtcggggggaggggcggtatttcgagacggcggggtttcggggtcgtacgtattcgtttgcgcgcgtttcggtttttgttcgtttgcgcgttaattcgcggaggtcgtcgcggtagtttcgcgtggggtgattgcgtcgagttaatggtttcgttggcggcgagcgcgcgattgtatcgtcggtcggcgtcgcgtagttcgggagggttttcgggtttttttttttcgtcgttgttggcgttgaattcgtttggttttcgttttggcgcggttgaggattggaacggcggcgggcgggaattcggcggggagggttcggttacgttcggtttcggagagggcggttgtttttcgggagcgttcgggttcggtttttgggggcggggaatgggcgcgggtcggggggaggttgtagagacgggatttggttcgcgtggaggcgtcgggttgtaggaaatgagagttttgaggaaatttttttaatttcgagtcgggaaggaggtattcggggaaggttgcggggtatgggaaatttt

SEQ ID NO: 15746 - DNA, 840 bp, Artificial Sequence
  chemically treated genomic DNA (Homo sapiens) CpG-island No: 15746
aaaatttcccataccccgcaaccttccccgaatacctccttcccgactcgaaattaaaaaaatttcctcaaaactctcatttcctacaacccgacgcctccacgcgaaccaaatcccgtctctacaacctccccccgacccgcgcccattccccgcccccaaaaaccgaacccgaacgctcccgaaaaacaaccgccctctccgaaaccgaacgtaaccgaaccctccccgccgaattcccgcccgccgccgttccaatcctcaaccgcgccaaaacgaaaaccaaacgaattcaacgccaacaacgacgaaaaaaaaaaacccgaaaaccctcccgaactacgcgacgccgaccgacgatacaatcgcgcgctcgccgccaacgaaaccattaactcgacgcaatcaccccacgcgaaactaccgcgacgacctccgcgaattaacgcgcaaacgaacaaaaaccgaaacgcgcgcaaacgaatacgtacgaccccgaaaccccgccgtctcgaaataccgcccctccccccgaccgcgacgaccacccctccattatccccgcgtaacccaaaccgcgcctaaaaccgccgccaaacccgatccccaccgccccgacccgaaaaaaacgcgcgaaaaacgcgctcccaacgcgaacgctcgcgccgcctaccgcccccgaccgttcactaccgcatttcgcgctctcgcgccgcgccccgccccaccgacctaaatttacatatcccaaaatcgcgaccaatcgctactcgtctctctcgaaacgaataacttttacctaaaaaaaaaaaaaataactaacgacgcatacgccacgat

SEQ ID NO: 15747 - DNA, 840 bp, Artificial Sequence
  chemically treated genomic DNA (Homo sapiens) CpG-island No: 15747
ggggttttttatatttcgtagtttttttcggatgtttttttttcggttcggagttggaagggtttttttagggtttttattttttgtagttcggcgtttttacgcgggttagatttcgtttttgtagttttttttcggttcgcgtttatttttcgtttttaggagtcgggttcggacgttttcgggaagtagtcgtttttttcggggtcgggcgtggtcgggtttttttcgtcgggttttcgttcgtcgtcgttttagtttttagtcgcgttagggcgggggttaggcgagtttagcgttagtaacggcgggggaggagggttcgggagttttttcgggttgcgcggcgtcggtcggcggtgtagtcgcgcgttcgtcgttagcgaagttattggttcggcgtagttattttacgcggggttgtcgcggcggttttcgcggattggcgcgtaggcgggtagggatcggggcgcgcgtaggcgagtgcgtgcggtttcgaagtttcgtcgtttcggggtgtcgttttttttttcggtcgcgacgattatttttttattgttttcgcgtggtttaggtcgcgtttggggtcgtcgttaaattcggtttttatcgtttcggttcgaagaaagcgcgcgaaaggcgcgtttttagcgcgggcgttcgcgtcgtttgtcgttttcggtcgtttattgtcgtatttcgcgttttcgcgtcgcgtttcgttttatcggtttaaatttgtatattttaggatcgcggttaatcgttgttcgtttttttcgaagcggatggtttttgtttgagaggaaagggagtggttggcggcgtatgcgttacggt

SEQ ID NO: 15748 - DNA, 840 bp, Artificial Sequence
  chemically treated genomic DNA (Homo sapiens) CpG-island No: 15748
accgtaacgcatacgccgccaaccactccctttcctctcaaacaaaaaccatccgcttcgaaaaaaacgaacaacgattaaccgcgatcctaaaatatacaaatttaaaccgataaaacgaaacgcgacgcgaaaacgcgaaatacgacaataaacgaccgaaaacgacaaacgacgcgaacgcccgcgctaaaaacgcgcctttcgcgcgctttcttcgaaccgaaacgataaaaaccgaatttaacgacgaccccaaacgcgacctaaaccacgcgaaaacaataaaaaaataatcgtcgcgaccgaaaaaaaaaacgacaccccgaaacgacgaaacttcgaaaccgcacgcactcgcctacgcgcgccccgatccctacccgcctacgcgccaatccgcgaaaaccgccgcgacaaccccgcgtaaaataactacgccgaaccaataacttcgctaacgacgaacgcgcgactacaccgccgaccgacgccgcgcaacccgaaaaaactcccgaaccctcctcccccgccgttactaacgctaaactcgcctaacccccgccctaacgcgactaaaaactaaaacgacgacgaacgaaaacccgacgaaaaaaacccgaccacgcccgaccccgaaaaaaacgactacttcccgaaaacgtccgaacccgactcctaaaaacgaaaaataaacgcgaaccgaaaaaaaactacaaaaacgaaatctaacccgcgtaaaaacgccgaactacaaaaaataaaaaccctaaaaaaacccttccaactccgaaccgaaaaaaaaacatccgaaaaaaactacgaaatataaaaaacccc

SEQ ID NO: 15749 - DNA, 639 bp, Artificial Sequence
  chemically treated genomic DNA (Homo sapiens) CpG-island No: 15749
tcgtcgtgttattggttttgcggcgcgggcgtagggcgtacgggatttcgtagtaggcgtttcgttgtagatgtcgcggtagttgttgtaggtgtggttgcggttgagcgggtagtagtggtcgcggagtttcggggtcgggagtagaggagaagtcgtcgggggaattcgtagtcgttcgtcgtacgttgttgtcgttattcgggtgtttttttagtattttcgtgttgtttcggaattcggggtaaaggtaaggaagaaagttgggtttattagtggtgcgcgcggcgttcgtttcggtttcggcgtttagcggttttgttttagtttcgtttttttcggagcgtttagattagatgcggttatagcgtattagttttttatttgagattagaacgggtttcggtaattgagtatgtttagtgtcgtttcgcgagtttcgcgtagggagcggcgttgacgagattttatttttttaggttttggtagcggttgcgcgagggaaggttggagggattcggcggggagggggtcgaatgggagaaaggcggggtcggggggtgggggtcgggtagaaggaggcgggtcgcgtttttagggcgatttttgtaggtggaggcggtagggtttgcgggaggt

SEQ ID NO: 15750 - DNA, 639 bp, Artificial Sequence
  chemically treated genomic DNA (Homo sapiens) CpG-island No: 15750
acctcccgcaaaccctaccgcctccacctacaaaaatcgccctaaaaacgcgacccgcctccttctacccgacccccaccccccgaccccgcctttctcccattcgaccccctccccgccgaatccctccaaccttccctcgcgcaaccgctaccaaaacctaaaaaaataaaatctcgtcaacgccgctccctacgcgaaactcgcgaaacgacactaaacatactcaattaccgaaacccgttctaatctcaaataaaaaactaatacgctataaccgcatctaatctaaacgctccgaaaaaaacgaaactaaaacaaaaccgctaaacgccgaaaccgaaacgaacgccgcgcgcaccactaataaacccaactttcttccttacctttaccccgaattccgaaacaacacgaaaatactaaaaaaacacccgaataacgacaacaacgtacgacgaacgactacgaattcccccgacgacttctcctctactcccgaccccgaaactccgcgaccactactacccgctcaaccgcaaccacacctacaacaactaccgcgacatctacaacgaaacgcctactacgaaatcccgtacgccctacgcccgcgccgcaaaaccaataacacgacga

SEQ ID NO: 15751 - DNA, 639 bp, Artificial Sequence
  chemically treated genomic DNA (Homo sapiens) CpG-island No: 15751
gtttttcgtaggttttgtcgtttttatttgtaggggtcgttttgggagcgcggttcgtttttttttgttcggtttttatttttcggtttcgttttttttttattcggtttttttttcgtcgggtttttttagttttttttcgcgtagtcgttgttaaagtttggagaagtggaatttcgttagcgtcgttttttgcgcgggattcgcggaacggtattgagtatgtttagttgtcggagttcgttttggttttaagtaggaagttagtgcgttgtaatcgtatttgatttgggcgtttcgggaagggcgagattggagtagagtcgttgggcgtcggagtcgaggcgagcgtcgcgcgtattattggtgagtttagtttttttttttgtttttgtttcggatttcggggtagtacgagagtgttggggaaatattcgggtagcggtagtagcgtgcggcgagcggttgcgggttttttcggcggttttttttttgttttcggtttcggggtttcgcggttattgttgttcgtttagtcgtagttatatttgtagtagttgtcgcggtatttgtagcggggcgtttgttgcggagtttcgtgcgttttgcgttcgcgtcgtagggttagtggtacggcga

SEQ ID NO: 15752 - DNA, 639 bp, Artificial Sequence
  chemically treated genomic DNA (Homo sapiens) CpG-island No: 15752
tcgccgtaccactaaccctacgacgcgaacgcaaaacgcacgaaactccgcaacaaacgccccgctacaaataccgcgacaactactacaaatataactacgactaaacgaacaacaataaccgcgaaaccccgaaaccgaaaacaaaaaaaaaaccgccgaaaaaacccgcaaccgctcgccgcacgctactaccgctacccgaatatttccccaacactctcgtactaccccgaaatccgaaacaaaaacaaaaaaaaaaactaaactcaccaataatacgcgcgacgctcgcctcgactccgacgcccaacgactctactccaatctcgcccttcccgaaacgcccaaatcaaatacgattacaacgcactaacttcctacttaaaaccaaaacgaactccgacaactaaacatactcaataccgttccgcgaatcccgcgcaaaaaacgacgctaacgaaattccacttctccaaactttaacaacgactacgcgaaaaaaaactaaaaaaacccgacgaaaaaaaaaccgaataaaaaaaaaacgaaaccgaaaaataaaaaccgaacaaaaaaaaacgaaccgcgctcccaaaacgacccctacaaataaaaacgacaaaacctacgaaaaac

SEQ ID NO: 15753 - DNA, 658 bp, Artificial Sequence
  chemically treated genomic DNA (Homo sapiens) CpG-island No: 15753
gaaaatatcgttttcgggacgtgtttgggtttgagtagtcgtgacgtgtaggcgaatcgcggttttggttggagtttcgtggagtttttttttcgttagtttttttttcgttttttcgtcgggattttttttttttttatttcgcggtttttttcgtttttttttttatatattcgttcgcgttttcggtaggtagaattttaggaagtcgtagcggtcgcgtcgcgcgagtcgagtttttggcgggcggcggggcgtatcgtagttgtgtataagaaggggcgcgcggtattcgggacgcgcgcgtatacgagtacgcgggaggtcgtcgcgcggacgcgttttcgggatacgcgtatttttcgcgcgcgcgtttaagggagagcgagtattgcgcgtcggcgcgtatattcgagatagagttttattatttcgttttttttcgcgttttttttttcgttgggtatttaaatagtttttcgatattattagttaaggattttttttttcgttttttttagtcgtcgttcgtttattagtatttgtaggggggaggaggaggagggaggaaagcggaaagaggaaaaagtataagtttgagtttttcgattcgattacgaatatttttgtaataaatttatcgttttaataaatttgt

SEQ ID NO: 15754 - DNA, 658 bp, Artificial Sequence
  chemically treated genomic DNA (Homo sapiens) CpG-island No: 15754
acaaatttattaaaacgataaatttattacaaaaatattcgtaatcgaatcgaaaaactcaaacttatactttttcctctttccgctttcctccctcctcctcctcccccctacaaatactaataaacgaacgacgactaaaaaaaacgaaaaaaaaaatccttaactaataatatcgaaaaactatttaaatacccaacgaaaaaaaaaacgcgaaaaaaaacgaaataataaaactctatctcgaatatacgcgccgacgcgcaatactcgctctcccttaaacgcgcgcgcgaaaaatacgcgtatcccgaaaacgcgtccgcgcgacgacctcccgcgtactcgtatacgcgcgcgtcccgaataccgcgcgccccttcttatacacaactacgatacgccccgccgcccgccaaaaactcgactcgcgcgacgcgaccgctacgacttcctaaaattctacctaccgaaaacgcgaacgaatatataaaaaaaaaaacgaaaaaaaccgcgaaataaaaaaaaaaaaaatcccgacgaaaaaacgaaaaaaaaactaacgaaaaaaaaactccacgaaactccaaccaaaaccgcgattcgcctacacgtcacgactactcaaacccaaacacgtcccgaaaacgatattttc

SEQ ID NO: 15755 - DNA, 658 bp, Artificial Sequence
  chemically treated genomic DNA (Homo sapiens) CpG-island No: 15755
gtagatttgttggggcggtgggtttattataggagtattcgtggtcggatcggaaggtttaagtttatgttttttttttttttcgtttttttttttttttttttttttttttgtaggtattgatggacggacggcgattaaggagagcggggaaaaaaatttttggttggtgatgtcggaaagttgtttgaatgtttagcgaggagggaggcgcgagagggagcgagatagtaaagttttgtttcgggtgtgcgcgtcggcgcgtagtgttcgtttttttttgggcgcgcgcgcggggggtgcgcgtgtttcgggagcgcgttcgcgcggcggtttttcgcgtgttcgtgtgcgcgcgcgtttcgggtgtcgcgcgtttttttttatgtatagttgcggtgcgtttcgtcgttcgttagaggttcggttcgcgcggcgcggtcgttgcgattttttggagttttgtttgtcgggggcgcgggcgggtgtgtgagagagaaggcgaagggagtcgcggggtgggagaggagggagtttcggcgggagggcgggggagaggttggcgggaggggggttttacggagttttagttagggtcgcggttcgtttgtacgttacggttatttaaatttaagtacgtttcgaaagcggtattttt

SEQ ID NO: 15756 - DNA, 658 bp, Artificial Sequence
  chemically treated genomic DNA (Homo sapiens) CpG-island No: 15756
aaaaataccgctttcgaaacgtacttaaatttaaataaccgtaacgtacaaacgaaccgcgaccctaactaaaactccgtaaaacccccctcccgccaacctctcccccgccctcccgccgaaactccctcctctcccaccccgcgactcccttcgccttctctctcacacacccgcccgcgcccccgacaaacaaaactccaaaaaatcgcaacgaccgcgccgcgcgaaccgaacctctaacgaacgacgaaacgcaccgcaactatacataaaaaaaaacgcgcgacacccgaaacgcgcgcgcacacgaacacgcgaaaaaccgccgcgcgaacgcgctcccgaaacacgcgcaccccccgcgcgcgcgcccaaaaaaaaacgaacactacgcgccgacgcgcacacccgaaacaaaactttactatctcgctccctctcgcgcctccctcctcgctaaacattcaaacaactttccgacatcaccaaccaaaaatttttttccccgctctccttaatcgccgtccgtccatcaatacctacaaaaaaaaaaaaaaaaaaaaaaaaaaacgaaaaaaaaaaaaaacataaacttaaaccttccgatccgaccacgaatactcctataataaacccaccgccccaacaaatctac

SEQ ID NO: 15757 - DNA, 547 bp, Artificial Sequence
  chemically treated genomic DNA (Homo sapiens) CpG-island No: 15757
tttggataacggggagcgggaaaaaagttacgtaggagtttggatcgggcgaagttcgcgggaaatcgttttgggtgcgtaggataaagacgcggggatagcggggagggtcggtcgtagtttgtcgggttgtttttacggcgcggaacgcgcgtagtaatttttattaggttttcgcgtttggattttcgttttgtttttgggtttttttcgtttatcggcggcgtttttcgcgaagttcgttgggtttcgtttttatttttttttttttttttacgtcgggttttgtttttggttttggatttttggttgcgtagttcgcgttttcgcggtttttcgtcggtcgcgcgttttcgagttatgttgtttgtttgggtaaattttatttcgcgagtgacgtattcggtcgcgatgcgttagaacgtcggtttcgtttcgaggcggtgcgtttggttacgttttttcgttggaggtttagttacgtttttaaaggaagttttattttatattcgtggttattaaaaaattgcgggaagtaggaaagagt

SEQ ID NO: 15758 - DNA, 547 bp, Artificial Sequence
  chemically treated genomic DNA (Homo sapiens) CpG-island No: 15758
actctttcctacttcccgcaattttttaataaccacgaatataaaataaaacttcctttaaaaacgtaactaaacctccaacgaaaaaacgtaaccaaacgcaccgcctcgaaacgaaaccgacgttctaacgcatcgcgaccgaatacgtcactcgcgaaataaaatttacccaaacaaacaacataactcgaaaacgcgcgaccgacgaaaaaccgcgaaaacgcgaactacgcaaccaaaaatccaaaaccaaaaacaaaacccgacgtaaaaaaaaaaaaaaaaataaaaacgaaacccaacgaacttcgcgaaaaacgccgccgataaacgaaaaaaacccaaaaacaaaacgaaaatccaaacgcgaaaacctaataaaaattactacgcgcgttccgcgccgtaaaaacaacccgacaaactacgaccgaccctccccgctatccccgcgtctttatcctacgcacccaaaacgatttcccgcgaacttcgcccgatccaaactcctacgtaacttttttcccgctccccgttatccaaa

SEQ ID NO: 15759 - DNA, 547 bp, Artificial Sequence
  chemically treated genomic DNA (Homo sapiens) CpG-island No: 15759
gtttttttttgtttttcgtagttttttagtggttacgggtatggggtggagttttttttaggggcgtgattaggtttttaacgaaggggcgtggttaagcgtatcgtttcggggcggggtcggcgttttagcgtatcgcggtcgggtgcgttattcgcgaagtggaatttgtttagataagtaatatggttcggaaacgcgcggtcggcggggagtcgcggggacgcgaattgcgtagttagaaatttaaggttaagagtaaggttcggcgtgaggaggaggaggagggtgagagcgaggtttagcgggtttcgcgggagacgtcgtcggtgggcggaggaggtttagaggtagggcgggagtttagacgcggaggtttggtggaggttgttgcgcgcgtttcgcgtcgtgggggtagttcggtaggttgcggtcggtttttttcgttgttttcgcgtttttgttttgcgtatttagagcggtttttcgcgagtttcgttcgatttaagtttttgcgtagtttttttttcgtttttcgttgtttaga

SEQ ID NO: 15760 - DNA, 547 bp, Artificial Sequence
  chemically treated genomic DNA (Homo sapiens) CpG-island No: 15760
tctaaacaacgaaaaacgaaaaaaaaactacgcaaaaacttaaatcgaacgaaactcgcgaaaaaccgctctaaatacgcaaaacaaaaacgcgaaaacaacgaaaaaaaccgaccgcaacctaccgaactacccccacgacgcgaaacgcgcgcaacaacctccaccaaacctccgcgtctaaactcccgccctacctctaaacctcctccgcccaccgacgacgtctcccgcgaaacccgctaaacctcgctctcaccctcctcctcctcctcacgccgaaccttactcttaaccttaaatttctaactacgcaattcgcgtccccgcgactccccgccgaccgcgcgtttccgaaccatattacttatctaaacaaattccacttcgcgaataacgcacccgaccgcgatacgctaaaacgccgaccccgccccgaaacgatacgcttaaccacgccccttcgttaaaaacctaatcacgcccctaaaaaaaactccaccccatacccgtaaccactaaaaaactacgaaaaacaaaaaaaaac

SEQ ID NO: 15761 - DNA, 539 bp, Artificial Sequence
  chemically treated genomic DNA (Homo sapiens) CpG-island No: 15761
ggagggggaggggaggggagcgggcgggttttttagtcgtttcggggttcgagtttaagttcggcgttcgcggtttttttcgttcgcgttcgagcgtttttttttttttttttttcgttttttagattttcgtgtcgttgttttttcgttcgtttattcgttttttcggtcgtcggatttcgtcgtcgtttcgtcgttttagtttcgtttgttataggagttgttttaacgttttgacgttatcgcgtcgtcgtcgtcgtcgtcgtcgtcgttttagattcgttaggaagagggaggggcgggcgtcgggagcggaggaggggttgcggcgtatgcgtcgggttgggtcgggtcggggtcgcgttgttttttagcgggcgggcggttgagcggtgttattcggtcggcgggcgagtttgcgtgcgaggtgttgttttttacgtttcgtacgtttttgttaattttgggagaggttttttttttttagtttttcgtttgatttgcggttttttttgaattttggttttgtttatttcgtt

SEQ ID NO: 15762 - DNA, 539 bp, Artificial Sequence
  chemically treated genomic DNA (Homo sapiens) CpG-island No: 15762
aacgaaataaacaaaaccaaaattcaaaaaaaaccgcaaatcaaacgaaaaactaaaaaaaaaaaacctctcccaaaattaacaaaaacgtacgaaacgtaaaaaacaacacctcgcacgcaaactcgcccgccgaccgaataacaccgctcaaccgcccgcccgctaaaaaacaacgcgaccccgacccgacccaacccgacgcatacgccgcaacccctcctccgctcccgacgcccgcccctccctcttcctaacgaatctaaaacgacgacgacgacgacgacgacgacgcgataacgtcaaaacgttaaaacaactcctataacaaacgaaactaaaacgacgaaacgacgacgaaatccgacgaccgaaaaaacgaataaacgaacgaaaaaacaacgacacgaaaatctaaaaaacgaaaaaaaaaaaaaaaaaaacgctcgaacgcgaacgaaaaaaaccgcgaacgccgaacttaaactcgaaccccgaaacgactaaaaaacccgcccgctcccctcccctccccctcc

SEQ ID NO: 15763 - DNA, 539 bp, Artificial Sequence
  chemically treated genomic DNA (Homo sapiens) CpG-island No: 15763
agcgaggtgagtagagttagagtttagaaggggtcgtaagttagacgaggggttgggaaaaaagagttttttttaaggttaatagaagcgtgcggagcgtgagaagtagtatttcgtacgtagattcgttcgtcggtcgggtggtatcgtttagtcgttcgttcgttagaaggtagcgcggtttcggttcggtttagttcggcgtatgcgtcgtagtttttttttcgttttcggcgttcgtttttttttttttttggcgggtttggggcggcggcggcggcggcggcggcggcgcggtgacgttagggcgttggggtagtttttgtgatagacggagttggagcggcggggcggcggcggagttcggcggtcgggagagcgagtgagcgagcggaggagtagcgatacgggagtttagggagcgagaaggagaaggaggggagcgttcgggcgcgagcgagagaaatcgcgagcgtcgagtttggattcgagtttcggaacggttgaggagttcgttcgtttttttttttttttttttt

SEQ ID NO: 15764 - DNA, 539 bp, Artificial Sequence
  chemically treated genomic DNA (Homo sapiens) CpG-island No: 15764
aaaaaaaaaaaaaaaaaaaacgaacgaactcctcaaccgttccgaaactcgaatccaaactcgacgctcgcgatttctctcgctcgcgcccgaacgctcccctccttctccttctcgctccctaaactcccgtatcgctactcctccgctcgctcactcgctctcccgaccgccgaactccgccgccgccccgccgctccaactccgtctatcacaaaaactaccccaacgccctaacgtcaccgcgccgccgccgccgccgccgccgccgccccaaacccgccaaaaaaaaaaaaaaacgaacgccgaaaacgaaaaaaaaactacgacgcatacgccgaactaaaccgaaccgaaaccgcgctaccttctaacgaacgaacgactaaacgataccacccgaccgacgaacgaatctacgtacgaaatactacttctcacgctccgcacgcttctattaaccttaaaaaaaactcttttttcccaacccctcgtctaacttacgaccccttctaaactctaactctactcacctcgct

SEQ ID NO: 15765 - DNA, 1378 bp, Artificial Sequence
  chemically treated genomic DNA (Homo sapiens) CpG-island No: 15765
gtttttttcgcggttttcggatttcgcgaggtaggtaggttttgggtcgggtcggtcgggttcgtgcggggcgtcgatttcgtttacgacgtcgtagtttcgttttttaggagtttcggtttttgcgggtacgcgttttcgttacggggtcgattataatggaggtcgttttcgttttttcgtggaggggttcggtgttttcggtgattttgttagattcggtaggacgttttttgggttaattcgttcggggcgggggagatttcggttttttcgaagatttttcgcgttcgaagatcgtttcggagcgttcgtaattattgagttttcgaagattcgcggggtttttttaggtcgtttcgatttagatttttgtttttgttttttttttttttcgcggttgcggcgttcgttcgtttttatcggatttgggcgggtagcggtatacggaattagacgggatgtttattttttttacgttcgcgtgttgtcggttcgttagggtttttatgggtttttggggttgaaatttcggttcggtttcggtgttcgcgtcgtttttcgcgatttatcgcggtcgttcgtttcgcgttcgggtgcgggggtcgattgttcgtcgcggtcgggtttcgttgcggcgttgcggttttggcggcggggagttttcggcgcgtcgcgtattattttttcgtcgggtatcgcggcggcgtttttgttaagggggttgcgggtttgggtcggggggtttttttttttttttttttaggtcgcgtgatgttagcggtcgtttcgcgcggggatcgcggcggttttagttaatggcgaggcggggcgggagcgttcgcgtcggagtagttaatgagcgcgggattgtagtaggagtcggcggcgcgtgtttcgcgcggggagtcgcggttggattcggcgcgcgtggacgcggtttagggtttcgcggcgggggcgtgggcgtgggcggggattcgcgacggggacgggggcgcggtcgggtgttcgcggcggggcggggcgggatcggtcggagttgggattttaggagacgagcgttgtattcggtcgggacgcgtcgttttttcgcgtttgtttatttcggttcggattatcgcgtagggagtcgttttttttcgcggttcgcgaggattggtcgggagttcgttcgttattgttttgggcgttttaaagcgggcggttttcgtttcgttgttttcgcgtttggaggaagtttttttaatttcgttttttagcgtcggtcggcggaggttttcggaaattttatgtaggggggtagggagaggggttttacggtgtattcgtatgttttttgtttcgtgttaatgttggtgatcggttaggaagatgt

SEQ ID NO: 15766 - DNA, 1378 bp, Artificial Sequence
  chemically treated genomic DNA (Homo sapiens) CpG-island No: 15766
acatcttcctaaccgatcaccaacattaacacgaaacaaaaaacatacgaatacaccgtaaaacccctctccctacccccctacataaaatttccgaaaacctccgccgaccgacgctaaaaaacgaaattaaaaaaacttcctccaaacgcgaaaacaacgaaacgaaaaccgcccgctttaaaacgcccaaaacaataacgaacgaactcccgaccaatcctcgcgaaccgcgaaaaaaaacgactccctacgcgataatccgaaccgaaataaacaaacgcgaaaaaacgacgcgtcccgaccgaatacaacgctcgtctcctaaaatcccaactccgaccgatcccgccccgccccgccgcgaacacccgaccgcgcccccgtccccgtcgcgaatccccgcccacgcccacgcccccgccgcgaaaccctaaaccgcgtccacgcgcgccgaatccaaccgcgactccccgcgcgaaacacgcgccgccgactcctactacaatcccgcgctcattaactactccgacgcgaacgctcccgccccgcctcgccattaactaaaaccgccgcgatccccgcgcgaaacgaccgctaacatcacgcgacctaaaaaaaaaaaaaaaaaaaccccccgacccaaacccgcaacccccttaacaaaaacgccgccgcgatacccgacgaaaaaataatacgcgacgcgccgaaaactccccgccgccaaaaccgcaacgccgcaacgaaacccgaccgcgacgaacaatcgacccccgcacccgaacgcgaaacgaacgaccgcgataaatcgcgaaaaacgacgcgaacaccgaaaccgaaccgaaatttcaaccccaaaaacccataaaaaccctaacgaaccgacaacacgcgaacgtaaaaaaaataaacatcccgtctaattccgtataccgctacccgcccaaatccgataaaaacgaacgaacgccgcaaccgcgaaaaaaaaaaaaaacaaaaacaaaaatctaaatcgaaacgacctaaaaaaaccccgcgaatcttcgaaaactcaataattacgaacgctccgaaacgatcttcgaacgcgaaaaatcttcgaaaaaaccgaaatctcccccgccccgaacgaattaacccaaaaaacgtcctaccgaatctaacaaaatcaccgaaaacaccgaacccctccacgaaaaaacgaaaacgacctccattataatcgaccccgtaacgaaaacgcgtacccgcaaaaaccgaaactcctaaaaaacgaaactacgacgtcgtaaacgaaatcgacgccccgcacgaacccgaccgacccgacccaaaacctacctacctcgcgaaatccgaaaaccgcgaaaaaaac

SEQ ID NO: 15767 - DNA, 1378 bp, Artificial Sequence
  chemically treated genomic DNA (Homo sapiens) CpG-island No: 15767
gtatttttttagtcggttattagtattaatacggggtaggagatatgcgaatgtatcgtgggatttttttttttatttttttgtatgagattttcgaagattttcgtcggtcgacgttgaggggcggggttgggaaggttttttttaggcgcgggagtagcggagcggggatcgttcgttttgggacgtttaggataatggcgagcgagttttcggttagttttcgcggatcgcgggagggggcggttttttgcgcggtaattcgagtcgggataaataggcgcggaggggcgacgcgtttcggtcgggtgtagcgttcgttttttggggttttagtttcggtcggtttcgtttcgtttcgtcgcgggtattcggtcgcgttttcgttttcgtcgcgagttttcgtttacgtttacgttttcgtcgcgaggttttgggtcgcgtttacgcgcgtcgagtttagtcgcggtttttcgcgcgaggtacgcgtcgtcggtttttgttgtagtttcgcgtttattggttgtttcggcgcgggcgttttcgtttcgtttcgttattggttggggtcgtcgcggttttcgcgcggagcggtcgttgatattacgcggtttgagggggggggggggggggtttttcggtttagattcgtagtttttttggtagaggcgtcgtcgcggtgttcggcggagggatggtgcgcggcgcgtcgggggtttttcgtcgttagagtcgtagcgtcgtagcggagttcggtcgcggcgggtagtcggttttcgtattcgggcgcggggcgggcggtcgcggtgaatcgcggagggcggcgcgggtatcggggtcgggtcggggttttaattttaagggtttatgggggttttgacgagtcggtagtacgcgggcgtggaggaggtggatatttcgtttaatttcgtgtatcgttattcgtttaagttcggtgagggcgggcgggcgtcgtagtcgcgaggagggagaggggtaggggtaggggtttgggtcgggacggtttgagggggtttcgcgggttttcggggatttagtggttgcggacgtttcgaaacggttttcgagcgcgggaggttttcgagaaggtcgaggtttttttcgtttcgggcgaattagtttaaggggcgttttgtcgggtttagtagggttatcgagggtatcgagtttttttacgggaggacgggagcggtttttattgtaatcggtttcgtgacggggacgcgtgttcgtagggatcgaggtttttggggagcggggttgcggcgtcgtaggcgaggtcggcgtttcgtacggattcggtcggttcggtttaaagtttatttgtttcgcggggttcgagggtcgcgagggaggt

SEQ ID NO: 15768 - DNA, 1378 bp, Artificial Sequence
  chemically treated genomic DNA (Homo sapiens) CpG-island No: 15768
acctccctcgcgaccctcgaaccccgcgaaacaaataaactttaaaccgaaccgaccgaatccgtacgaaacgccgacctcgcctacgacgccgcaaccccgctccccaaaaacctcgatccctacgaacacgcgtccccgtcacgaaaccgattacaataaaaaccgctcccgtcctcccgtaaaaaaactcgataccctcgataaccctactaaacccgacaaaacgccccttaaactaattcgcccgaaacgaaaaaaacctcgaccttctcgaaaacctcccgcgctcgaaaaccgtttcgaaacgtccgcaaccactaaatccccgaaaacccgcgaaaccccctcaaaccgtcccgacccaaacccctacccctacccctctccctcctcgcgactacgacgcccgcccgccctcaccgaacttaaacgaataacgatacacgaaattaaacgaaatatccacctcctccacgcccgcgtactaccgactcgtcaaaacccccataaacccttaaaattaaaaccccgacccgaccccgatacccgcgccgccctccgcgattcaccgcgaccgcccgccccgcgcccgaatacgaaaaccgactacccgccgcgaccgaactccgctacgacgctacgactctaacgacgaaaaacccccgacgcgccgcgcaccatccctccgccgaacaccgcgacgacgcctctaccaaaaaaactacgaatctaaaccgaaaaaccccccccccccccccctcaaaccgcgtaatatcaacgaccgctccgcgcgaaaaccgcgacgaccccaaccaataacgaaacgaaacgaaaacgcccgcgccgaaacaaccaataaacgcgaaactacaacaaaaaccgacgacgcgtacctcgcgcgaaaaaccgcgactaaactcgacgcgcgtaaacgcgacccaaaacctcgcgacgaaaacgtaaacgtaaacgaaaactcgcgacgaaaacgaaaacgcgaccgaatacccgcgacgaaacgaaacgaaaccgaccgaaactaaaaccccaaaaaacgaacgctacacccgaccgaaacgcgtcgcccctccgcgcctatttatcccgactcgaattaccgcgcaaaaaaccgccccctcccgcgatccgcgaaaactaaccgaaaactcgctcgccattatcctaaacgtcccaaaacgaacgatccccgctccgctactcccgcgcctaaaaaaaaccttcccaaccccgcccctcaacgtcgaccgacgaaaatcttcgaaaatctcatacaaaaaaataaaaaaaaaaatcccacgatacattcgcatatctcctaccccgtattaatactaataaccgactaaaaaaatac

SEQ ID NO: 15769 - DNA, 1140 bp, Artificial Sequence
  chemically treated genomic DNA (Homo sapiens) CpG-island No: 15769
gcggtttcgtttcgaacgttcggtcgtgattaattaggaggtcggatgagttaaaatatagcggtcggttaatgttggggagttttacggcgtcgagtttcgttaatgggcgcggtcgggcgaaaagagaaatagtgagggttttataggtcgtaggattcgaatcgaacgtttttacgggagtcgggcgttggcggagcggcgtttcggttaattagcggtagttttcgaacgttgggtcggtttagtttcgtttcgcgttgttgtttgtggtgtcggtcgggtcgcgggagtcgaattataatattcgtcgggcgggcggcggcggagcgggcggcggagcggcggtagtagcggtgagcgcgagtttcggagtttcgggcggtcggtttttcgcgttcgcgtagtttcgtgtttgcgttcggtcggagacgtcgggtttcgcgtcgcgtcgcgttatgtcggtgaatatggacgagttgcggtattaggttatgattaattagttcgtgttggtcgcgggttgcgcggtcgattaggcgaagtagttgttgtaggcggtttattggtagttcgaggtgcgagtttggtcgtcgcggggtcgggtcgcgggggtcggggacgtcgggcggcggcgggggcggggagcgtttttgttgtcggttcggaaggcgatcggcgttcgcgagcgggttttacgcgggatcggggtcgggatcggtttttttttgtacgtggggtagtcgagggtcgggggtcgcgggtcgggcgcggaggcggggagagtcggtggggggtttagtcgttgcgttttttgatttcgtttggttcgtcgtgttattgttttgtttgttcgtagatcgcgttgagtacgtttttttaagaaattaatatttttaatagttattattattattagatggtaagcggcggcgggtaggggcgcgggtcggggtcgttgttagcgcggcggtgatagttatgttgtcggggagcgtcgcgtcgcgaatgtaaataaagagttaaaatgttttttaggaaagagcggttttcgggtcggcgttggcgtttttaattttgaggttcgtttttcgggttgttgttgtttggtttcgggattggtgttcggtattggttttt

SEQ ID NO: 15770 - DNA, 1140 bp, Artificial Sequence
  chemically treated genomic DNA (Homo sapiens) CpG-island No: 15770
aaaaaccaataccgaacaccaatcccgaaaccaaacaacaacaacccgaaaaacgaacctcaaaattaaaaacgccaacgccgacccgaaaaccgctctttcctaaaaaacattttaactctttatttacattcgcgacgcgacgctccccgacaacataactatcaccgccgcgctaacaacgaccccgacccgcgcccctacccgccgccgcttaccatctaataataataataactattaaaaatattaatttcttaaaaaaacgtactcaacgcgatctacgaacaaacaaaacaataacacgacgaaccaaacgaaatcaaaaaacgcaacgactaaaccccccaccgactctccccgcctccgcgcccgacccgcgacccccgaccctcgactaccccacgtacaaaaaaaaaccgatcccgaccccgatcccgcgtaaaacccgctcgcgaacgccgatcgccttccgaaccgacaacaaaaacgctccccgcccccgccgccgcccgacgtccccgacccccgcgacccgaccccgcgacgaccaaactcgcacctcgaactaccaataaaccgcctacaacaactacttcgcctaatcgaccgcgcaacccgcgaccaacacgaactaattaatcataacctaataccgcaactcgtccatattcaccgacataacgcgacgcgacgcgaaacccgacgtctccgaccgaacgcaaacacgaaactacgcgaacgcgaaaaaccgaccgcccgaaactccgaaactcgcgctcaccgctactaccgccgctccgccgcccgctccgccgccgcccgcccgacgaatattataattcgactcccgcgacccgaccgacaccacaaacaacaacgcgaaacgaaactaaaccgacccaacgttcgaaaactaccgctaattaaccgaaacgccgctccgccaacgcccgactcccgtaaaaacgttcgattcgaatcctacgacctataaaaccctcactatttctcttttcgcccgaccgcgcccattaacgaaactcgacgccgtaaaactccccaacattaaccgaccgctatattttaactcatccgacctcctaattaatcacgaccgaacgttcgaaacgaaaccgc

SEQ ID NO: 15771 - DNA, 1140 bp, Artificial Sequence
  chemically treated genomic DNA (Homo sapiens) CpG-island No: 15771
agggattagtgtcgggtattagtttcgaggttaagtagtagtagttcgggaggcgggttttaaagttggaggcgttagcgtcggttcgggagtcgtttttttttggaagatattttggttttttgtttatattcgcggcgcggcgtttttcggtaatatggttgttatcgtcgcgttgatagcggtttcggttcgcgtttttgttcgtcgtcgtttattatttggtggtggtggtggttgttgggaatgttggttttttggaagaacgtgtttagcgcggtttgcggataaatagggtagtgatacggcgggttaggcggagttaggaaacgtagcggttgggttttttatcggtttttttcgttttcgcgttcggttcgcggttttcgattttcggttgttttacgtgtagaggggagtcggtttcggtttcggtttcgcgtaagattcgttcgcgggcgtcgatcgtttttcgggtcgataataggagcgtttttcgttttcgtcgtcgttcggcgttttcgattttcgcggttcggtttcgcggcggttaggttcgtatttcgaattgttagtgggtcgtttgtagtaattgtttcgtttggtcggtcgcgtagttcgcggttagtacgaattggttgattatgatttggtgtcgtagttcgtttatgtttatcgatatggcgcggcgcggcgcggggttcggcgttttcggtcggacgtaaatacggggttgcgcgggcgcgggaggtcggtcgttcggggtttcggggttcgcgtttatcgttgttgtcgtcgtttcgtcgttcgtttcgtcgtcgttcgttcggcgaatgttgtggttcgattttcgcggttcggtcgatattataaataatagcgcggggcggggttgggtcggtttaacgttcggggattgtcgttgattggtcggggcgtcgtttcgttagcgttcggttttcgtaaggacgttcgattcgaattttgcggtttgtggggtttttattgttttttttttcgttcggtcgcgtttattggcggagttcggcgtcgtggggttttttagtattggtcggtcgttgtgttttggtttattcggttttttggttggttacggtcgggcgttcggggcggggtcgt

SEQ ID NO: 15772 - DNA, 1140 bp, Artificial Sequence
  chemically treated genomic DNA (Homo sapiens) CpG-island No: 15772
acgaccccgccccgaacgcccgaccgtaaccaaccaaaaaaccgaataaaccaaaacacaacgaccgaccaatactaaaaaaccccacgacgccgaactccgccaataaacgcgaccgaacgaaaaaaaaaacaataaaaaccccacaaaccgcaaaattcgaatcgaacgtccttacgaaaaccgaacgctaacgaaacgacgccccgaccaatcaacgacaatccccgaacgttaaaccgacccaaccccgccccgcgctattatttataatatcgaccgaaccgcgaaaatcgaaccacaacattcgccgaacgaacgacgacgaaacgaacgacgaaacgacgacaacaacgataaacgcgaaccccgaaaccccgaacgaccgacctcccgcgcccgcgcaaccccgtatttacgtccgaccgaaaacgccgaaccccgcgccgcgccgcgccatatcgataaacataaacgaactacgacaccaaatcataatcaaccaattcgtactaaccgcgaactacgcgaccgaccaaacgaaacaattactacaaacgacccactaacaattcgaaatacgaacctaaccgccgcgaaaccgaaccgcgaaaatcgaaaacgccgaacgacgacgaaaacgaaaaacgctcctattatcgacccgaaaaacgatcgacgcccgcgaacgaatcttacgcgaaaccgaaaccgaaaccgactcccctctacacgtaaaacaaccgaaaatcgaaaaccgcgaaccgaacgcgaaaacgaaaaaaaccgataaaaaacccaaccgctacgtttcctaactccgcctaacccgccgtatcactaccctatttatccgcaaaccgcgctaaacacgttcttccaaaaaaccaacattcccaacaaccaccaccaccaccaaataataaacgacgacgaacaaaaacgcgaaccgaaaccgctatcaacgcgacgataacaaccatattaccgaaaaacgccgcgccgcgaatataaacaaaaaaccaaaatatcttccaaaaaaaaacgactcccgaaccgacgctaacgcctccaactttaaaacccgcctcccgaactactactacttaacctcgaaactaatacccgacactaatccct

SEQ ID NO: 15773 - DNA, 862 bp, Artificial Sequence
  chemically treated genomic DNA (Homo sapiens) CpG-island No: 15773
cgtttttttttggtttcggttcggtcgtcgattttttgtcgttcgcgtcgtttagttttcgttcgtcgtattttggttttttttatatgttgtttgacgtttttcgggtattattggacgcgtacgtagtcgcggcgtagggggttggttcggtttttttcgtggttcgcgttttcggtttcggagtatttcgagttttcgcggttttttttttcgtttttcgagttcgagttttcgtcgtggatgaggcgtattagttcgaagtgtacggagttacggtaacggttcgatattaggtcgtgagaaaatagtaggcgttgcgagtcggtttttgggtcggagttcgaggacggttcggaggtcgagttcgaggcgggcgtcggcgtcgggacgggggttgcggttggggtcgggattgttttcggggttggagtcggggtttgggttggagcgggagttgcgggcgtgggggttgcgggattcgttataattgttttgcgcgagtttcgggcggcggcggcgatagcggcggcgaacgaggcgcggggaggcgggattagcgggcgtcgggggcggggttatagcgcgttgacgtgtttttgcgtggcgtcgtcgttagggagtcgggatgtagttgttaggagttatcgtttcgtcgttaggggacgttgaagatgtcgcggggggcgggggtaggatggaatttattaagaaggggcgagattagtgaggatttaattaaagggagcgagaaggggcggggattcgggaggaggaagtggagtggttatcgaggaagaggggagtggtcggggtggggtataggatggtggagagattgttaataatttttaatgagttt

SEQ ID NO: 15774 - DNA, 862 bp, Artificial Sequence
  chemically treated genomic DNA (Homo sapiens) CpG-island No: 15774
aaactcattaaaaattattaacaatctctccaccatcctataccccaccccgaccactcccctcttcctcgataaccactccacttcctcctcccgaatccccgccccttctcgctccctttaattaaatcctcactaatctcgccccttcttaataaattccatcctacccccgccccccgcgacatcttcaacgtcccctaacgacgaaacgataactcctaacaactacatcccgactccctaacgacgacgccacgcaaaaacacgtcaacgcgctataaccccgcccccgacgcccgctaatcccgcctccccgcgcctcgttcgccgccgctatcgccgccgccgcccgaaactcgcgcaaaacaattataacgaatcccgcaacccccacgcccgcaactcccgctccaacccaaaccccgactccaaccccgaaaacaatcccgaccccaaccgcaacccccgtcccgacgccgacgcccgcctcgaactcgacctccgaaccgtcctcgaactccgacccaaaaaccgactcgcaacgcctactattttctcacgacctaatatcgaaccgttaccgtaactccgtacacttcgaactaatacgcctcatccacgacgaaaactcgaactcgaaaaacgaaaaaaaaaaccgcgaaaactcgaaatactccgaaaccgaaaacgcgaaccacgaaaaaaaccgaaccaaccccctacgccgcgactacgtacgcgtccaataatacccgaaaaacgtcaaacaacatataaaaaaaaccaaaatacgacgaacgaaaactaaacgacgcgaacgacaaaaaatcgacgaccgaaccgaaaccaaaaaaaaacg

SEQ ID NO: 15775 - DNA, 862 bp, Artificial Sequence
  chemically treated genomic DNA (Homo sapiens) CpG-island No: 15775
gagtttattaaaagttgttgatagtttttttattattttgtgttttatttcgattatttttttttttttcggtggttattttatttttttttttcgggttttcgttttttttcgttttttttagttgaatttttattggtttcgtttttttttagtggattttattttgttttcgtttttcgcggtatttttagcgttttttagcgacgaggcggtggtttttagtaattgtatttcggttttttgacgacggcgttacgtagggatacgttagcgcgttatggtttcgttttcggcgttcgttggtttcgttttttcgcgtttcgttcgtcgtcgttgtcgtcgtcgtcgttcgagattcgcgtagagtagttatggcggatttcgtagtttttacgttcgtagttttcgttttagtttaggtttcggttttagtttcggaggtagtttcggttttagtcgtagttttcgtttcggcgtcggcgttcgtttcggattcggttttcgggtcgttttcggatttcggtttagaagtcggttcgtagcgtttgttgtttttttacgatttggtgtcgggtcgttatcgtggtttcgtgtatttcgggttggtgcgttttatttacggcgaggattcggattcggagggcgaggaggagggtcgcgggagttcggggtgtttcgaggtcgggggcgcgggttacgaggagggtcgggttagttttttgcgtcgcggttacgtgcgcgtttagtggtattcggagggcgttaagtagtatgtgaaggagattaaggtgcggcgggcgggggttgggcggcgcgggcggtagggggtcggcggtcgggtcgaggttagggaaggacg

SEQ ID NO: 15776 - DNA, 862 bp, Artificial Sequence
  chemically treated genomic DNA (Homo sapiens) CpG-island No: 15776
cgtccttccctaacctcgacccgaccgccgaccccctaccgcccgcgccgcccaacccccgcccgccgcaccttaatctccttcacatactacttaacgccctccgaataccactaaacgcgcacgtaaccgcgacgcaaaaaactaacccgaccctcctcgtaacccgcgcccccgacctcgaaacaccccgaactcccgcgaccctcctcctcgccctccgaatccgaatcctcgccgtaaataaaacgcaccaacccgaaatacacgaaaccacgataacgacccgacaccaaatcgtaaaaaaacaacaaacgctacgaaccgacttctaaaccgaaatccgaaaacgacccgaaaaccgaatccgaaacgaacgccgacgccgaaacgaaaactacgactaaaaccgaaactacctccgaaactaaaaccgaaacctaaactaaaacgaaaactacgaacgtaaaaactacgaaatccgccataactactctacgcgaatctcgaacgacgacgacgacaacgacgacgaacgaaacgcgaaaaaacgaaaccaacgaacgccgaaaacgaaaccataacgcgctaacgtatccctacgtaacgccgtcgtcaaaaaaccgaaatacaattactaaaaaccaccgcctcgtcgctaaaaaacgctaaaaataccgcgaaaaacgaaaacaaaataaaatccactaaaaaaaaacgaaaccaataaaaattcaactaaaaaaaacgaaaaaaaacgaaaacccgaaaaaaaaaaataaaataaccaccgaaaaaaaaaaaaataatcgaaataaaacacaaaataataaaaaaactatcaacaacttttaataaactc

SEQ ID NO: 15777 - DNA, 502 bp, Artificial Sequence
  chemically treated genomic DNA (Homo sapiens) CpG-island No: 15777
ggtcgttcgcgcgtaggtagggaagaggcggagcgtcgtcgtttcgttttcgaggagttatcgtttagtcgttcgtaggcgtcgtacggagttgcgtttcggggatttggggtcgtagggaggtgagcgcggggcgacgagcggggtaggatttacggtcgtttagtcgtaggcgtcggaagggtttcgaggttgtgttcgagtttgttttggagcggtggtgcgcggttaggaagggtgtttagtgttcggtgttcgttttgcggagcgtttgggttttacgtgggttcggttggaggttcgggttggtttagacggcgtcggcggggtcgttggattcggtttgttggtttttagggttcggttcggataggacgtttaaggggtttttgggcgacggggcgttagatgtaggggtaagacgattgggtagagatttaaattttcggaggaagagaggagattgcgtagggtagtttcgtttgcgttttagaagtgtttg

SEQ ID NO: 15778 - DNA, 502 bp, Artificial Sequence
  chemically treated genomic DNA (Homo sapiens) CpG-island No: 15778
caaacacttctaaaacgcaaacgaaactaccctacgcaatctcctctcttcctccgaaaatttaaatctctacccaatcgtcttacccctacatctaacgccccgtcgcccaaaaaccccttaaacgtcctatccgaaccgaaccctaaaaaccaacaaaccgaatccaacgaccccgccgacgccgtctaaaccaacccgaacctccaaccgaacccacgtaaaacccaaacgctccgcaaaacgaacaccgaacactaaacacccttcctaaccgcgcaccaccgctccaaaacaaactcgaacacaacctcgaaacccttccgacgcctacgactaaacgaccgtaaatcctaccccgctcgtcgccccgcgctcacctccctacgaccccaaatccccgaaacgcaactccgtacgacgcctacgaacgactaaacgataactcctcgaaaacgaaacgacgacgctccgcctcttccctacctacgcgcgaacgacc

SEQ ID NO: 15779 - DNA, 502 bp, Artificial Sequence
  chemically treated genomic DNA (Homo sapiens) CpG-island No: 15779
taggtatttttgggacgtaggcgggattgttttgcgtagtttttttttttttttcggaggtttaaatttttgtttaatcgttttgtttttatatttggcgtttcgtcgtttagggattttttaggcgttttgttcgagtcgagttttaggggttagtagatcgggtttagcggtttcgtcggcgtcgtttgagttagttcgggtttttagtcgagtttacgtgggatttaggcgtttcgtagggcgggtatcgggtattgggtattttttttggtcgcgtattatcgttttagggtaggttcgggtataatttcgggattttttcggcgtttgcggttgggcggtcgtgagttttgtttcgttcgtcgtttcgcgtttatttttttgcggttttaagttttcgggacgtaatttcgtgcggcgtttgcgagcggttgggcggtggtttttcgggggcggggcggcggcgtttcgttttttttttatttgcgcgcgggcggtt

SEQ ID NO: 15780 - DNA, 502 bp, Artificial Sequence
  chemically treated genomic DNA (Homo sapiens) CpG-island No: 15780
aaccgcccgcgcgcaaataaaaaaaaaacgaaacgccgccgccccgcccccgaaaaaccaccgcccaaccgctcgcaaacgccgcacgaaattacgtcccgaaaacttaaaaccgcaaaaaaataaacgcgaaacgacgaacgaaacaaaactcacgaccgcccaaccgcaaacgccgaaaaaatcccgaaattatacccgaacctaccctaaaacgataatacgcgaccaaaaaaaatacccaatacccgatacccgccctacgaaacgcctaaatcccacgtaaactcgactaaaaacccgaactaactcaaacgacgccgacgaaaccgctaaacccgatctactaacccctaaaactcgactcgaacaaaacgcctaaaaaatccctaaacgacgaaacgccaaatataaaaacaaaacgattaaacaaaaatttaaacctccgaaaaaaaaaaaaaaactacgcaaaacaatcccgcctacgtcccaaaaataccta

SEQ ID NO: 15781 - DNA, 695 bp, Artificial Sequence
  chemically treated genomic DNA (Homo sapiens) CpG-island No: 15781
gtcgtcgtcgcgttcgtgtatcgagggtatggaggtgttgggcggaaggagagggggcgtaggtttttggcgttcgaggtcggaggtgcgtttaagtttcgatagtcggggcggtgggcgggtagggggacgattttcgtgttaattttttagagtttgggcgtttagagtcgtgggagtggcgtcgcggtttttagcggttggttcgggggcgcggggagaggttcgggcgaggggagtttagttaggtttacggcggtcgtcggaggggtttttgttcgtttttacgggcgggttggcggtcggtttcgtcgcgaaagttcgggagtgttggattttgagttagtttttcgtcgcgggaagggttcgtacgcgtatattcgcgacgtcgtaagtattgggattcggaatttagcgttttcggttcgcgttcgttttagcgtatttttgtgcggttcgcgtcgtttagcgtcgcgtgatcgtttatttttttcgggatttttagcgtttcggttatatttattcgagtttcgtttcgcggtgtaatttcgtcgtggtttgcgggtgggcgggcggtagtcgcgtcgtttttatttcgcgtagtttttattttgtcggtattggtttttatttatacggggttgggggtttggagcggatttgtttttttaaatattttttagtagattatattt

SEQ ID NO: 15782 - DNA, 695 bp, Artificial Sequence
  chemically treated genomic DNA (Homo sapiens) CpG-island No: 15782
aaatataatctactaaaaaatatttaaaaaaacaaatccgctccaaacccccaaccccgtataaataaaaaccaataccgacaaaataaaaactacgcgaaataaaaacgacgcgactaccgcccgcccacccgcaaaccacgacgaaattacaccgcgaaacgaaactcgaataaatataaccgaaacgctaaaaatcccgaaaaaaataaacgatcacgcgacgctaaacgacgcgaaccgcacaaaaatacgctaaaacgaacgcgaaccgaaaacgctaaattccgaatcccaatacttacgacgtcgcgaatatacgcgtacgaacccttcccgcgacgaaaaactaactcaaaatccaacactcccgaactttcgcgacgaaaccgaccgccaacccgcccgtaaaaacgaacaaaaacccctccgacgaccgccgtaaacctaactaaactcccctcgcccgaacctctccccgcgcccccgaaccaaccgctaaaaaccgcgacgccactcccacgactctaaacgcccaaactctaaaaaattaacacgaaaatcgtccccctacccgcccaccgccccgactatcgaaacttaaacgcacctccgacctcgaacgccaaaaacctacgccccctctccttccgcccaacacctccataccctcgatacacgaacgcgacgacgac

SEQ ID NO: 15783 - DNA, 695 bp, Artificial Sequence
  chemically treated genomic DNA (Homo sapiens) CpG-island No: 15783
ggatgtggtttgttggaaaatgtttaaaaaaataaattcgttttaaatttttagtttcgtgtgggtaagagttaatgtcggtaaggtgaaggttgcgcggggtgggggcgacgcgattgtcgttcgtttattcgtaggttacggcggagttgtatcgcggggcggggttcgggtaggtgtggtcggggcgttgggggtttcgggaggaatgggcggttacgcggcgttgggcggcgcgggtcgtataggagtgcgttggggcgggcgcgggtcgggagcgttgggtttcgggttttagtgtttgcggcgtcgcgagtgtgcgcgtgcggatttttttcgcggcggggaattgatttaaagtttaatattttcgagttttcgcggcgaggtcgatcgttagttcgttcgtgggggcgaataggagttttttcggcggtcgtcgtggatttagttgggtttttttcgttcgggttttttttcgcgttttcgagttagtcgttgggggtcgcggcgttatttttacggttttggacgtttaggttttggggggttagtacgggggtcgtttttttgttcgtttatcgtttcggttgtcggaatttgagcgtattttcgatttcgggcgttagaggtttgcgtttttttttttttcgtttagtatttttatgttttcggtgtacgaacgcggcggcggt

SEQ ID NO: 15784 - DNA, 695 bp, Artificial Sequence
  chemically treated genomic DNA (Homo sapiens) CpG-island No: 15784
accgccgccgcgttcgtacaccgaaaacataaaaatactaaacgaaaaaaaaaaaaacgcaaacctctaacgcccgaaatcgaaaatacgctcaaattccgacaaccgaaacgataaacgaacaaaaaaacgacccccgtactaaccccccaaaacctaaacgtccaaaaccgtaaaaataacgccgcgacccccaacgactaactcgaaaacgcgaaaaaaaacccgaacgaaaaaaacccaactaaatccacgacgaccgccgaaaaaactcctattcgcccccacgaacgaactaacgatcgacctcgccgcgaaaactcgaaaatattaaactttaaatcaattccccgccgcgaaaaaaatccgcacgcgcacactcgcgacgccgcaaacactaaaacccgaaacccaacgctcccgacccgcgcccgccccaacgcactcctatacgacccgcgccgcccaacgccgcgtaaccgcccattcctcccgaaacccccaacgccccgaccacacctacccgaaccccgccccgcgatacaactccgccgtaacctacgaataaacgaacgacaatcgcgtcgcccccaccccgcgcaaccttcaccttaccgacattaactcttacccacacgaaactaaaaatttaaaacgaatttatttttttaaacattttccaacaaaccacatcc

SEQ ID NO: 15785 - DNA, 552 bp, Artificial Sequence
  chemically treated genomic DNA (Homo sapiens) CpG-island No: 15785
gtcgaagtatttgttcgcgcgttcggtaggtttggtcgtttagtttcgggttttttttcggtcgcggtttttttaggtattttcggcgttcgcggtcgtttcgttttcgtttcggggtcgttgttgcgcgcggggattttattttggagatcggcgttcgcgttgtttagttttcgtgtttttttcgttcgtttttcgtcggttttttcgttttcgttaaattaaataattcgttttgtgtttaagcgttcgtttttcgtagcgcggaggtcgttggggtcgcggcggtcgagggcggggtgggggggggggtcggcggttggtgagtttttcgttttttagttggttcgcgggtcgtttcgcgtggtattcggcgttttagtgggtttttcgttattgtcgtcggtgggcgcgaagggggaaagatggtcggagttggtgggaggatatttaattatttcggggagggcgtgggtagtagggagagttttgggtagaagatgggtaggggtgaggtcgggggaaggggttgtggagcgtagtttatggttt

SEQ ID NO: 15786 - DNA, 552 bp, Artificial Sequence
  chemically treated genomic DNA (Homo sapiens) CpG-island No: 15786
aaaccataaactacgctccacaaccccttcccccgacctcacccctacccatcttctacccaaaactctccctactacccacgccctccccgaaataattaaatatcctcccaccaactccgaccatctttcccccttcgcgcccaccgacgacaataacgaaaaacccactaaaacgccgaataccacgcgaaacgacccgcgaaccaactaaaaaacgaaaaactcaccaaccgccgacccccccccccaccccgccctcgaccgccgcgaccccaacgacctccgcgctacgaaaaacgaacgcttaaacacaaaacgaattatttaatttaacgaaaacgaaaaaaccgacgaaaaacgaacgaaaaaaacacgaaaactaaacaacgcgaacgccgatctccaaaataaaatccccgcgcgcaacaacgaccccgaaacgaaaacgaaacgaccgcgaacgccgaaaatacctaaaaaaaccgcgaccgaaaaaaaacccgaaactaaacgaccaaacctaccgaacgcgcgaacaaatacttcgac

SEQ ID NO: 15787 - DNA, 552 bp, Artificial Sequence
  chemically treated genomic DNA (Homo sapiens) CpG-island No: 15787
gagttatgaattgcgttttatagttttttttttcggttttatttttatttattttttgtttaaggttttttttattatttacgtttttttcgaaatagttaagtatttttttattaatttcgattattttttttttttcgcgtttatcggcggtagtggcgaagggtttattgaagcgtcgggtgttacgcggggcggttcgcgggttagttagggggcggggaatttattagtcgtcgatttttttttttatttcgttttcggtcgtcgcggttttagcggttttcgcgttgcgaggagcgggcgtttggatatagggcgagttgtttgatttggcggaggcggggaggtcggcggggagcgagcgagggaggtacgagagttgggtagcgcgggcgtcggtttttagggtagggttttcgcgcgtagtagcggtttcggggcgggggcgaggcgatcgcgggcgtcggggatgtttggaggggtcgcggtcgagaggagattcgggattggacggttagatttgtcgggcgcgcgggtaggtgtttcggt

SEQ ID NO: 15788 - DNA, 552 bp, Artificial Sequence
  chemically treated genomic DNA (Homo sapiens) CpG-island No: 15788
accgaaacacctacccgcgcgcccgacaaatctaaccgtccaatcccgaatctcctctcgaccgcgacccctccaaacatccccgacgcccgcgatcgcctcgcccccgccccgaaaccgctactacgcgcgaaaaccctaccctaaaaaccgacgcccgcgctacccaactctcgtacctccctcgctcgctccccgccgacctccccgcctccgccaaatcaaacaactcgccctatatccaaacgcccgctcctcgcaacgcgaaaaccgctaaaaccgcgacgaccgaaaacgaaataaaaaaaaaaatcgacgactaataaattccccgccccctaactaacccgcgaaccgccccgcgtaacacccgacgcttcaataaacccttcgccactaccgccgataaacgcgaaaaaaaaaaaataatcgaaattaataaaaaaatacttaactatttcgaaaaaaacgtaaataataaaaaaaaccttaaacaaaaaataaataaaaataaaaccgaaaaaaaaaactataaaacgcaattcataactc

SEQ ID NO: 15789 - DNA, 652 bp, Artificial Sequence
  chemically treated genomic DNA (Homo sapiens) CpG-island No: 15789
ttcgacgaatttcgatattgtttatatttaaattaatattttacgtgtataatattttgtttcgtcgggattttttatagtttatcgttttattatggtgcgtttttttttagttttttttggattatttcgtttttttttcgagattcgtattttttcgtatattcgttatcgtcgttcgttttttttttagtttagttttcgtttgtcgttttttcgcgtacggtttcggtttttcgtttttttcggcgcggttttttttcgtttttcgtttttttcgcgtttcgtcgtttttgtttttatgcgttttcgtttttcgtcgttttgttttttgcgttgtttcgtttttttcggcggttagtatttttgtttttatgtcgtttttgcgtttatttcgttttgttcgttttttgttttttttacgttggtttttttttttcgatcgttttttagttttttttttttcgttttcgtttcgtttttttttttttttttttttttcgtgtttttttatcgtttatttttgtttttttttttttcgtcggttcgcgtttattcgtttgcgttttttttttgttattcgttttttcggttttttttcgttttttttacgcgttcgcggatcgcgttttttttttttttcgttgcggcg

SEQ ID NO: 15790 - DNA, 652 bp, Artificial Sequence
  chemically treated genomic DNA (Homo sapiens) CpG-island No: 15790
cgccgcaacgaaaaaaaaaaaaaacgcgatccgcgaacgcgtaaaaaaaacgaaaaaaaaccgaaaaaacgaataacaaaaaaaaaacgcaaacgaataaacgcgaaccgacgaaaaaaaaaaaaacaaaaataaacgataaaaaaacacgaaaaaaaaaaaaaaaaaaaaaaacgaaacgaaaacgaaaaaaaaaaaactaaaaaacgatcgaaaaaaaaaaaccaacgtaaaaaaaacaaaaaacgaacaaaacgaaataaacgcaaaaacgacataaaaacaaaaatactaaccgccgaaaaaaacgaaacaacgcaaaaaacaaaacgacgaaaaacgaaaacgcataaaaacaaaaacgacgaaacgcgaaaaaaacgaaaaacgaaaaaaaaccgcgccgaaaaaaacgaaaaaccgaaaccgtacgcgaaaaaacgacaaacgaaaactaaactaaaaaaaaaacgaacgacgataacgaatatacgaaaaaatacgaatctcgaaaaaaaaacgaaataatccaaaaaaaactaaaaaaaaacgcaccataataaaacgataaactataaaaaatcccgacgaaacaaaatattatacacgtaaaatattaatttaaatataaacaatatcgaaattcgtcgaa

SEQ ID NO: 15791 - DNA, 652 bp, Artificial Sequence
  chemically treated genomic DNA (Homo sapiens) CpG-island No: 15791
cgtcgtaacgaaagaggagaggaacgcgattcgcggacgcgtaaaggaagcggaggaggatcggaaagacggatgataagggaggagcgtagacggataggcgcggatcgacgaagaagagagaggtagagataggcggtaggagagtacgagagaaagagggaaggggaggaacgggacggagacgaaggaaggaagattgaaagacgatcggagaggaagaattagcgtgggaggagtagaaggcgggtaggacggaatggacgtaggagcggtatgggagtagggatgttggtcgtcggagaaggcgaagtagcgtaagaagtagggcgacgagaggcgagagcgtatgggagtagagacggcggggcgcggaagaagcggaggacgaagaggagtcgcgtcggaggggacggggagtcggggtcgtacgcggagaggcggtaggcggagattaggttggaaagagagcgagcgacggtgacggatgtgcgagggagtgcggatttcgaggaaggggcgggatggtttagaaggggttagagaggaacgtattatagtggggcggtgggttgtggggagtttcggcggggtagggtgttatgtacgtggaatgttagtttgagtgtgagtagtgtcgggattcgtcggg

SEQ ID NO: 15792 - DNA, 652 bp, Artificial Sequence
  chemically treated genomic DNA (Homo sapiens) CpG-island No: 15792
cccgacgaatcccgacactactcacactcaaactaacattccacgtacataacaccctaccccgccgaaactccccacaacccaccgccccactataatacgttcctctctaaccccttctaaaccatcccgccccttcctcgaaatccgcactccctcgcacatccgtcaccgtcgctcgctctctttccaacctaatctccgcctaccgcctctccgcgtacgaccccgactccccgtcccctccgacgcgactcctcttcgtcctccgcttcttccgcgccccgccgtctctactcccatacgctctcgcctctcgtcgccctacttcttacgctacttcgccttctccgacgaccaacatccctactcccataccgctcctacgtccattccgtcctacccgccttctactcctcccacgctaattcttcctctccgatcgtctttcaatcttccttccttcgtctccgtcccgttcctccccttccctctttctctcgtactctcctaccgcctatctctacctctctcttcttcgtcgatccgcgcctatccgtctacgctcctcccttatcatccgtctttccgatcctcctccgcttcctttacgcgtccgcgaatcgcgttcctctcctctttcgttacgacg

SEQ ID NO: 15793 - DNA, 729 bp, Artificial Sequence
  chemically treated genomic DNA (Homo sapiens) CpG-island No: 15793
ggtttcggttcgcggatttgaggagtggatcgatcgagcgttgtgcgtaaaaggatcgttggggtatacgttcgagcgttatcggagttaggagatcgcggttcggaggtcggcgagtcgggggtaggttcggagttttttttacggggggcggggcgggttatatggcggtggcgcggtagcgcgcgatgtagtataggttagaggttgcgtaagcgcggggttcgtttttgggatttttcgggtcgggcggtttggttttttagcgttcgggcgtcggggcggtaaaaggtcggtagaagggaggtatttgaggtaggtgttgcgcgtcggggtttcgcgaggtacgtgatgttcgtaggcggggtttgtcgcggcgtaggtggggaaattgaggtagtgtagggtcggtagggtgggtgttgggttggtgaggcgcgtttttcgggttcgcgttaatttttttaggagtcgtcgtagcgttggcgtttttttcgaggacgacgattttttcgttattttgcgtggcggtcgatggaaaaattttgcgtttagacgtcggagaacggagacggggattcggcgttgttgcggcgggttagggttttttttgtttacgttcgtaagttttgagtgacgtcggtggcgttaattttcgcgaattgttgggataaagaatagaggagagggttttgttttggagtatgggttcgggggtcgttttgttgg

SEQ ID NO: 15794 - DNA, 729 bp, Artificial Sequence
  chemically treated genomic DNA (Homo sapiens) CpG-island No: 15794
ccaacaaaacgacccccgaacccatactccaaaacaaaaccctctcctctattctttatcccaacaattcgcgaaaattaacgccaccgacgtcactcaaaacttacgaacgtaaacaaaaaaaaccctaacccgccgcaacaacgccgaatccccgtctccgttctccgacgtctaaacgcaaaatttttccatcgaccgccacgcaaaataacgaaaaaatcgtcgtcctcgaaaaaaacgccaacgctacgacgactcctaaaaaaattaacgcgaacccgaaaaacgcgcctcaccaacccaacacccaccctaccgaccctacactacctcaatttccccacctacgccgcgacaaaccccgcctacgaacatcacgtacctcgcgaaaccccgacgcgcaacacctacctcaaatacctcccttctaccgaccttttaccgccccgacgcccgaacgctaaaaaaccaaaccgcccgacccgaaaaatcccaaaaacgaaccccgcgcttacgcaacctctaacctatactacatcgcgcgctaccgcgccaccgccatataacccgccccgccccccgtaaaaaaaactccgaacctacccccgactcgccgacctccgaaccgcgatctcctaactccgataacgctcgaacgtataccccaacgatccttttacgcacaacgctcgatcgatccactcctcaaatccgcgaaccgaaacc

SEQ ID NO: 15795 - DNA, 729 bp, Artificial Sequence
  chemically treated genomic DNA (Homo sapiens) CpG-island No: 15795
ttagtagggcggttttcgggtttatgttttagggtagggtttttttttttgttttttgttttaataattcgcgaaggttggcgttatcggcgttatttaaggtttgcgggcgtggatagagggggttttagttcgtcgtagtagcgtcgggttttcgttttcgtttttcgacgtttgggcgtagggtttttttatcggtcgttacgtagggtggcggaagggtcgtcgttttcggagggagcgttagcgttgcggcggtttttaagaaagttggcgcgggttcgaggggcgcgttttattagtttagtatttattttatcggttttgtattgttttagtttttttatttacgtcgcggtaggtttcgtttacggatattacgtgtttcgcggagtttcggcgcgtagtatttattttaagtgttttttttttgtcggttttttatcgtttcgacgttcgggcgttaaggggttaaatcgttcggttcggagggttttaggggcgggtttcgcgtttgcgtagtttttagtttgtgttgtatcgcgcgttatcgcgttatcgttatgtgattcgtttcgtttttcgtgggaggagtttcgggtttgttttcgattcgtcgattttcgggtcgcggttttttagtttcggtggcgttcgggcgtgtgttttagcggtttttttacgtatagcgttcggtcggtttattttttaagttcgcgaatcgaggtt

SEQ ID NO: 15796 - DNA, 729 bp, Artificial Sequence
  chemically treated genomic DNA (Homo sapiens) CpG-island No: 15796
aacctcgattcgcgaacttaaaaaataaaccgaccgaacgctatacgtaaaaaaaccgctaaaacacacgcccgaacgccaccgaaactaaaaaaccgcgacccgaaaatcgacgaatcgaaaacaaacccgaaactcctcccacgaaaaacgaaacgaatcacataacgataacgcgataacgcgcgatacaacacaaactaaaaactacgcaaacgcgaaacccgcccctaaaaccctccgaaccgaacgatttaaccccttaacgcccgaacgtcgaaacgataaaaaaccgacaaaaaaaaaacacttaaaataaatactacgcgccgaaactccgcgaaacacgtaatatccgtaaacgaaacctaccgcgacgtaaataaaaaaactaaaacaatacaaaaccgataaaataaatactaaactaataaaacgcgcccctcgaacccgcgccaactttcttaaaaaccgccgcaacgctaacgctccctccgaaaacgacgacccttccgccaccctacgtaacgaccgataaaaaaaccctacgcccaaacgtcgaaaaacgaaaacgaaaacccgacgctactacgacgaactaaaaccccctctatccacgcccgcaaaccttaaataacgccgataacgccaaccttcgcgaattattaaaacaaaaaacaaaaaaaaaaaccctaccctaaaacataaacccgaaaaccgccctactaa

SEQ ID NO: 15797 - DNA, 586 bp, Artificial Sequence
  chemically treated genomic DNA (Homo sapiens) CpG-island No: 15797
atttcggttcgcgtcggcgatcgcgttcgtacggcgttttatttgtttcgggttcgcgtcgatacgtttagcgatcggttcgttttcgcgttttcgttcggttttcggttttttagtaggtcgttggatttagcgcgggatttagcgtggtgtagttatcggtcggtcgggtcgtcgaggatagtagaagcggcgcgtagtagtcgggcgtttttagcggtagttatcgttcgcggtcgggaattgtcggaagcgacgtaggtcgcgttttgaggtcgcgagagattttaaagaggcgggggcggtagttgcggcgtagacgttcgagggtcgcggcgaggggcgcggggttggagtggcggagagattttgttggaagtatcgcgtcgaggtttcgcgtgtttttcgggtgatttataaagatattggtaagtagagcgcggtttcgtttcgttttttacgtttacgtcgttcggttttatggggcggggttagcgtagggggtttttattaattttttaggtttcgttgtaagttggatgtttttttagcggttgaagttgtcgtgtagaaataaaatattttg

SEQ ID NO: 15798 - DNA, 586 bp, Artificial Sequence
  chemically treated genomic DNA (Homo sapiens) CpG-island No: 15798
caaaatattttatttctacacgacaacttcaaccgctaaaaaaacatccaacttacaacgaaacctaaaaaattaataaaaaccccctacgctaaccccgccccataaaaccgaacgacgtaaacgtaaaaaacgaaacgaaaccgcgctctacttaccaatatctttataaatcacccgaaaaacacgcgaaacctcgacgcgatacttccaacaaaatctctccgccactccaaccccgcgcccctcgccgcgaccctcgaacgtctacgccgcaactaccgcccccgcctctttaaaatctctcgcgacctcaaaacgcgacctacgtcgcttccgacaattcccgaccgcgaacgataactaccgctaaaaacgcccgactactacgcgccgcttctactatcctcgacgacccgaccgaccgataactacaccacgctaaatcccgcgctaaatccaacgacctactaaaaaaccgaaaaccgaacgaaaacgcgaaaacgaaccgatcgctaaacgtatcgacgcgaacccgaaacaaataaaacgccgtacgaacgcgatcgccgacgcgaaccgaaat

SEQ ID NO: 15799 - DNA, 586 bp, Artificial Sequence
  chemically treated genomic DNA (Homo sapiens) CpG-island No: 15799
taaaatattttgtttttgtacggtaattttagtcgttaaaaaagtatttagtttataacggaatttggagggttggtaaaggttttttgcgttggtttcgttttatgggatcgggcggcgtgggcgtgagaggcggggcggggtcgcgttttgtttgttaatgtttttataggttattcggaaggtacgcggaatttcggcgcggtgtttttagtagggttttttcgttattttagtttcgcgtttttcgtcgcggttttcgggcgtttgcgtcgtagttgtcgttttcgtttttttggagtttttcgcggttttaaagcgcggtttgcgtcgttttcggtagttttcgatcgcgggcgatggttgtcgttgggggcgttcggttgttgcgcgtcgtttttgttgttttcggcggttcggtcggtcggtggttgtattacgttgggtttcgcgttggatttagcggtttgttgaggaatcgggggtcgggcgggagcgcggaggcgagtcggtcgttgagcgtgtcggcgcgggttcggagtaggtagggcgtcgtgcgggcgcgatcgtcggcgcgggtcggggt

SEQ ID NO: 15800 - DNA, 586 bp, Artificial Sequence
  chemically treated genomic DNA (Homo sapiens) CpG-island No: 15800
accccgacccgcgccgacgatcgcgcccgcacgacgccctacctactccgaacccgcgccgacacgctcaacgaccgactcgcctccgcgctcccgcccgacccccgattcctcaacaaaccgctaaatccaacgcgaaacccaacgtaatacaaccaccgaccgaccgaaccgccgaaaacaacaaaaacgacgcgcaacaaccgaacgcccccaacgacaaccatcgcccgcgatcgaaaactaccgaaaacgacgcaaaccgcgctttaaaaccgcgaaaaactccaaaaaaacgaaaacgacaactacgacgcaaacgcccgaaaaccgcgacgaaaaacgcgaaactaaaataacgaaaaaaccctactaaaaacaccgcgccgaaattccgcgtaccttccgaataacctataaaaacattaacaaacaaaacgcgaccccgccccgcctctcacgcccacgccgcccgatcccataaaacgaaaccaacgcaaaaaacctttaccaaccctccaaattccgttataaactaaatacttttttaacgactaaaattaccgtacaaaaacaaaatatttta

SEQ ID NO: 15801 - DNA, 637 bp, Artificial Sequence
  chemically treated genomic DNA (Homo sapiens) CpG-island No: 15801
tttcggtcgatcgcggtttattcgggttaaattttagcggtttgtttagtcgcgtttagcgggtttaggaatgcggaagggtggcggagttattaaaggagtgggggacgagggtcgggttgcgggcgatcgtcgtagcgtaggtcgcgatatcgtagcggatcggagtaggtcggaggggtaattaagatttcggtcgtgtgcgttcggttttagtagtttcgtcgttcggcggatacgtagatttcgtcggttcgggcgcgaatatttagcgtattttcgttttatttggtttcgtcgcgtttttcggtgcgtttttcggtgcgtttttcgtttcgtttttttaggtaggaagtgtcggcgtcgttattgttcggttatagtttaacgtttttcgttgtcgtttgcggtttcgcgtagggcggtttcggttttggtgtttggcgtcgggtgagtcgcgttcgattttgttcgcgagatttttcgggtcgtcgttttcgtattttcgcgtttttttttcgtcgcgcgtttgcggtcggatttcgttttagggcggttaggcggcggtaggatttgttagattggttgagaaggaggcgcggggtcggaggtggagggaggagggttgttggcgagg

SEQ ID NO: 15802 - DNA, 637 bp, Artificial Sequence
  chemically treated genomic DNA (Homo sapiens) CpG-island No: 15802
cctcgccaacaaccctcctccctccacctccgaccccgcgcctccttctcaaccaatctaacaaatcctaccgccgcctaaccgccctaaaacgaaatccgaccgcaaacgcgcgacgaaaaaaaaacgcgaaaatacgaaaacgacgacccgaaaaatctcgcgaacaaaatcgaacgcgactcacccgacgccaaacaccaaaaccgaaaccgccctacgcgaaaccgcaaacgacaacgaaaaacgttaaactataaccgaacaataacgacgccgacacttcctacctaaaaaaacgaaacgaaaaacgcaccgaaaaacgcaccgaaaaacgcgacgaaaccaaataaaacgaaaatacgctaaatattcgcgcccgaaccgacgaaatctacgtatccgccgaacgacgaaactactaaaaccgaacgcacacgaccgaaatcttaattacccctccgacctactccgatccgctacgatatcgcgacctacgctacgacgatcgcccgcaacccgaccctcgtcccccactcctttaataactccgccacccttccgcattcctaaacccgctaaacgcgactaaacaaaccgctaaaatttaacccgaataaaccgcgatcgaccgaaa

SEQ ID NO: 15803 - DNA, 637 bp, Artificial Sequence
  chemically treated genomic DNA (Homo sapiens) CpG-island No: 15803
tttcgttagtaatttttttttttttattttcggtttcgcgttttttttttagttagtttgataggttttgtcgtcgtttggtcgttttggggcggggttcggtcgtaggcgcgcgacgggaggggggcgcgggggtacggagacggcggttcgaggggtttcgcgagtagagtcgagcgcgatttattcgacgttaaatattagaatcggggtcgttttgcgcgagatcgtaaacgatagcgaagagcgttaggttgtggtcggatagtggcggcgtcgatattttttgtttgaaggggcggagcggaaggcgtatcggaaggcgtatcggaaggcgcggcgggattaagtggaacgggggtgcgttgagtgttcgcgttcgggtcggcggggtttgcgtgttcgtcgagcggcggggttgttgaggtcggacgtatacggtcggggttttaattgttttttcggtttgtttcgattcgttgcgatatcgcggtttgcgttgcggcggtcgttcgtagttcggttttcgttttttatttttttggtagtttcgttattttttcgtatttttgggttcgttgggcgcggttgggtaggtcgttggaatttgattcgagtgggtcgcgatcggtcgagg

SEQ ID NO: 15804 - DNA, 637 bp, Artificial Sequence
  chemically treated genomic DNA (Homo sapiens) CpG-island No: 15804
cctcgaccgatcgcgacccactcgaatcaaattccaacgacctacccaaccgcgcccaacgaacccaaaaatacgaaaaaataacgaaactaccaaaaaaataaaaaacgaaaaccgaactacgaacgaccgccgcaacgcaaaccgcgatatcgcaacgaatcgaaacaaaccgaaaaaacaattaaaaccccgaccgtatacgtccgacctcaacaaccccgccgctcgacgaacacgcaaaccccgccgacccgaacgcgaacactcaacgcacccccgttccacttaatcccgccgcgccttccgatacgccttccgatacgccttccgctccgccccttcaaacaaaaaatatcgacgccgccactatccgaccacaacctaacgctcttcgctatcgtttacgatctcgcgcaaaacgaccccgattctaatatttaacgtcgaataaatcgcgctcgactctactcgcgaaacccctcgaaccgccgtctccgtacccccgcgcccccctcccgtcgcgcgcctacgaccgaaccccgccccaaaacgaccaaacgacgacaaaacctatcaaactaactaaaaaaaaaacgcgaaaccgaaaataaaaaaaaaaaaattactaacgaaa

SEQ ID NO: 15805 - DNA, 979 bp, Artificial Sequence
  chemically treated genomic DNA (Homo sapiens) CpG-island No: 15805
ataagcgggagagtagggcgatttcgagtattttttcgttttggggcgcgagggtatttcgggcgggtagggttagttgtcggggcgcgtttttttttcgttagttcgttcgtcgggttcgttttttcgttagcgatatagcggattagggcggtgtttcgtttcgtattcgtcgtcgttttagtttttttgtttttaattttcggtttttattttcggttcggtatttttgattacgttgttgtagatggtggggcggaatttttcgcgcgcgcgttggtcgaagttttgttcgtggatgattcgtatttgttttaggaaggtggatttgtcgttttcgttcgcgtttagtagtaggatttttattagtcgttttatataggttttttttcgagataggtatttgtcgatttttttggatttgcgttgttgttcggtttcgttattcgttagtaggtagtcggggaagtatacggatagtacggatcgcgacggtaggaagttcgttattttgtcgtcgtcgtcgtcgtttcggcgggttttttcggttttttttattttttttttcggcggcgggcggtttcggtatcgaggttcgagggcggggagcgcggcggcggttcgagcgcgtttagggagggagggaattagcgaattgattcgtagggcgggtcgggtagggcgggttaggatagcgggggagggagggagggaaggagggcgggttcggtttcggaggggcggtggtttcggagcgtgcgcgttttcgttgtttttcggaggcgcgttcgtacgtcgcggtcgttttttcgtttttcgttttgggcggcgagttacgagttcgatgtgtcgttcgggtgttcgcgttcgtagtcgcggtcgggcgcgcggggagggttgaggaatcgcggttacgtgggttaggttggggagttcgattttttgttttttttttatggtttgagtttatttgtgggta

SEQ ID NO: 15806 - DNA, 979 bp, Artificial Sequence
  chemically treated genomic DNA (Homo sapiens) CpG-island No: 15806
tacccacaaataaactcaaaccataaaaaaaaaacaaaaaatcgaactccccaacctaacccacgtaaccgcgattcctcaaccctccccgcgcgcccgaccgcgactacgaacgcgaacacccgaacgacacatcgaactcgtaactcgccgcccaaaacgaaaaacgaaaaaacgaccgcgacgtacgaacgcgcctccgaaaaacaacgaaaacgcgcacgctccgaaaccaccgcccctccgaaaccgaacccgccctccttccctccctccctcccccgctatcctaacccgccctacccgacccgccctacgaatcaattcgctaattccctccctccctaaacgcgctcgaaccgccgccgcgctccccgccctcgaacctcgataccgaaaccgcccgccgccgaaaaaaaaaataaaaaaaaccgaaaaaacccgccgaaacgacgacgacgacgacaaaataacgaacttcctaccgtcgcgatccgtactatccgtatacttccccgactacctactaacgaataacgaaaccgaacaacaacgcaaatccaaaaaaatcgacaaatacctatctcgaaaaaaaacctatataaaacgactaataaaaatcctactactaaacgcgaacgaaaacgacaaatccaccttcctaaaacaaatacgaatcatccacgaacaaaacttcgaccaacgcgcgcgcgaaaaattccgccccaccatctacaacaacgtaatcaaaaataccgaaccgaaaataaaaaccgaaaattaaaaacaaaaaaactaaaacgacgacgaatacgaaacgaaacaccgccctaatccgctatatcgctaacgaaaaaacgaacccgacgaacgaactaacgaaaaaaaaacgcgccccgacaactaaccctacccgcccgaaataccctcgcgccccaaaacgaaaaaatactcgaaatcgccctactctcccgcttat

SEQ ID NO: 15807 - DNA, 979 bp, Artificial Sequence
  chemically treated genomic DNA (Homo sapiens) CpG-island No: 15807
tgtttataagtgggtttaggttatgaaagggaaatagaaagtcgggttttttagtttggtttacgtgatcgcggttttttagtttttttcgcgcgttcggtcgcggttgcgggcgcgggtattcgagcgatatatcgagttcgtgattcgtcgtttagggcgggaggcggagaagcggtcgcggcgtgcgagcgcgttttcgggaggtagcgggagcgcgtacgtttcggggttatcgttttttcggggtcgggttcgttttttttttttttttttttttttcgttgttttggttcgttttgttcggttcgttttgcgagttagttcgttggttttttttttttttgggcgcgttcgggtcgtcgtcgcgtttttcgttttcgagtttcggtgtcggagtcgttcgtcgtcggaggaggaggtggagggagtcggaggggttcgtcgaggcggcggcggcggcggtaagatggcggattttttgtcgtcgcggttcgtgttgttcgtgtgttttttcggttgtttgttgacgagtggcgaggtcgagtagtaacgtaagtttaaggagatcgataaatgtttgtttcgggaaaagatttatgtgaagcggttggtgaagattttgttgttgggcgcgggcgagagcggtaagtttatttttttgaagtagatgcggattatttacgggtaggatttcgattagcgcgcgcgcgaggagtttcgttttattatttatagtaacgtgattaaaggtgtcgggtcgggaatgggggtcgggggttaagggtaggggggttggggcggcggcgggtgcggggcggggtatcgttttggttcgttgtgtcgttggcgaaggaacgggttcggcgggcgggttggcgggaagggggcgcgtttcggtaattggttttgttcgttcggggtgttttcgcgttttagggcgagaggatgttcggggtcgttttgttttttcgtttgt

SEQ ID NO: 15808 - DNA, 979 bp, Artificial Sequence
  chemically treated genomic DNA (Homo sapiens) CpG-island No: 15808
acaaacgaaaaaacaaaacgaccccgaacatcctctcgccctaaaacgcgaaaacaccccgaacgaacaaaaccaattaccgaaacgcgcccccttcccgccaacccgcccgccgaacccgttccttcgccaacgacacaacgaaccaaaacgataccccgccccgcacccgccgccgccccaacccccctacccttaacccccgacccccattcccgacccgacacctttaatcacgttactataaataataaaacgaaactcctcgcgcgcgcgctaatcgaaatcctacccgtaaataatccgcatctacttcaaaaaaataaacttaccgctctcgcccgcgcccaacaacaaaatcttcaccaaccgcttcacataaatcttttcccgaaacaaacatttatcgatctccttaaacttacgttactactcgacctcgccactcgtcaacaaacaaccgaaaaaacacacgaacaacacgaaccgcgacgacaaaaaatccgccatcttaccgccgccgccgccgcctcgacgaacccctccgactccctccacctcctcctccgacgacgaacgactccgacaccgaaactcgaaaacgaaaaacgcgacgacgacccgaacgcgcccaaaaaaaaaaaaaaccaacgaactaactcgcaaaacgaaccgaacaaaacgaaccaaaacaacgaaaaaaaaaaaaaaaaaaaaaaaacgaacccgaccccgaaaaaacgataaccccgaaacgtacgcgctcccgctacctcccgaaaacgcgctcgcacgccgcgaccgcttctccgcctcccgccctaaacgacgaatcacgaactcgatatatcgctcgaatacccgcgcccgcaaccgcgaccgaacgcgcgaaaaaaactaaaaaaccgcgatcacgtaaaccaaactaaaaaacccgactttctatttccctttcataacctaaacccacttataaaca

SEQ ID NO: 15809 - DNA, 511 bp, Artificial Sequence
  chemically treated genomic DNA (Homo sapiens) CpG-island No: 15809
ttttgttagttttcggcgtcgttgttttttttttgcgtatcgttttttcgttcgttttttttttcgagtgttcgcgttatcgttgttttttcgtttattttcgtagtttatgcgttattttgtcgagttggttttgttatatttatcgtcgtttgttcgtatgtgttcgggtggatgttttatgttggtttttcgggttagacgattttcgttgcgcggcggtgttgttgcgtttgatcgttttttttaatttttcggttgattttcgttttgtcgttcggcggtatttttttttttgttgtcgttttcgtttttttttttttttgtttattttattttgtttcgttcgtttttattacgtttttatcgcgtttttatgttcgcgcgtttttcgtttttcgcgtttcgtattcgtcgttgttttgttgttgtttgatttcggttttttttttagttttgcgtttttgtttatttttttttttttttgttatttttttttgttatttttatt

SEQ ID NO: 15810 - DNA, 511 bp, Artificial Sequence
  chemically treated genomic DNA (Homo sapiens) CpG-island No: 15810
aataaaaataacaaaaaaaaataacaaaaaaaaaaaaaaataaacaaaaacgcaaaactaaaaaaaaaaccgaaatcaaacaacaacaaaacaacgacgaatacgaaacgcgaaaaacgaaaaacgcgcgaacataaaaacgcgataaaaacgtaataaaaacgaacgaaacaaaataaaataaacaaaaaaaaaaaaaaacgaaaacgacaacaaaaaaaaaaataccgccgaacgacaaaacgaaaatcaaccgaaaaattaaaaaaaacgatcaaacgcaacaacaccgccgcgcaacgaaaatcgtctaacccgaaaaaccaacataaaacatccacccgaacacatacgaacaaacgacgataaatataacaaaaccaactcgacaaaataacgcataaactacgaaaataaacgaaaaaacaacgataacgcgaacactcgaaaaaaaaaacgaacgaaaaaacgatacgcaaaaaaaaaacaacgacgccgaaaactaacaaaa

SEQ ID NO: 15811 - DNA, 511 bp, Artificial Sequence
  chemically treated genomic DNA (Homo sapiens) CpG-island No: 15811
ggtaagagtggtagaagagagtgataggagagaaagggagtagataggaacgtagagttaggaggaagatcgagattaaataatagtaagataacggcgagtgcggaacgcgagaggcggagggcgcgcgaatatgggagcgcgatggggacgtagtgagagcgagcggggtaggatgagatagatagagggagagggaagcggaagcggtaataaagagggaggtgtcgtcgggcgatagggcggagattaatcgaaagattaagaaggacgattaagcgtagtaatatcgtcgcgtagcgagagtcgtttggttcggaggattaatatgaagtatttattcgagtatatgcgagtaaacgacggtgagtatgataaagttaattcgataaagtggcgtataggttgcggaagtgaacggagagatagcgatagcgcgggtattcgagaggagagacggacgggggggcggtgcgtaaggagggagtagcgacgtcgggggttaatagaa

SEQ ID NO: 15812 - DNA, 511 bp, Artificial Sequence
  chemically treated genomic DNA (Homo sapiens) CpG-island No: 15812
ttctattaacccccgacgtcgctactccctccttacgcaccgcccccccgtccgtctctcctctcgaatacccgcgctatcgctatctctccgttcacttccgcaacctatacgccactttatcgaattaactttatcatactcaccgtcgtttactcgcatatactcgaataaatacttcatattaatcctccgaaccaaacgactctcgctacgcgacgatattactacgcttaatcgtccttcttaatctttcgattaatctccgccctatcgcccgacgacacctccctctttattaccgcttccgcttccctctccctctatctatctcatcctaccccgctcgctctcactacgtccccatcgcgctcccatattcgcgcgccctccgcctctcgcgttccgcactcgccgttatcttactattatttaatctcgatcttcctcctaactctacgttcctatctactccctttctctcctatcactctcttctaccactcttacc

SEQ ID NO: 15813 - DNA, 947 bp, Artificial Sequence
  chemically treated genomic DNA (Homo sapiens) CpG-island No: 15813
tgcgttttttttttagtttagggtttcgtttttggttcgtagtgtttcgggttgttttcgcgtttttgagtttatgggttgtcgtttttcgcgcgttgcggtggtcgcgcgggtcggagcggagcgggttggagcgcggcggttacggttcggggcgggggtgcgggttcgcgggggcggcgttgggcgttttttttcgttagttttttttcgtcggcgcggggggtggggtggggggggggcgcggtcgtcgttcggcgtttttaagggagcgggagggagcggcgaggcggcggcggttgcggtggcggtagtcgaggcgagcggggcgggggcgcgggcgcggcgttcggagttcgttcggggtcggaggcggtcggggtcgggttcgggaagcgcgaggagcgcgcgtagcgtcgtcggagttcgtcgttcgggatatggttaaggcgggtcgtgtaggtgagggcgggcgcggggagggtagggtcggggttcgggggagggattcgcgcgtttagaggaggggtcgtcggtttaggtgaatttttcgcgtaggtgggcggaggtttcgggagggcgtagggggcggtagcggggttggatttttcgcgcgtggagagggggtttcgcgcgtttttcgttttttttgcgttttcggttatttcgggggatatcgcgtttttttttttacggtttcgtcggaaagggttaggtttgttggcgtttcgggttagtttcgtcgttgggagttttttgtatttcgcggaggtttcgggtagattcgggtttcgttatcgaaggggatgtttcgcggtcgtcgtttcgttttatattttaacgtaaatcgggacgcgttttttgtttttgtagttttttttatttaggacgttataatttttcgttttagttttcgttattagtttagtttagagatttagattttt

SEQ ID NO: 15814 - DNA, 947 bp, Artificial Sequence
  chemically treated genomic DNA (Homo sapiens) CpG-island No: 15814
aaaaatctaaatctctaaactaaactaataacgaaaactaaaacgaaaaattataacgtcctaaataaaaaaaactacaaaaacaaaaaacgcgtcccgatttacgttaaaatataaaacgaaacgacgaccgcgaaacatccccttcgataacgaaacccgaatctacccgaaacctccgcgaaatacaaaaaactcccaacgacgaaactaacccgaaacgccaacaaacctaaccctttccgacgaaaccgtaaaaaaaaaaacgcgatatcccccgaaataaccgaaaacgcaaaaaaaacgaaaaacgcgcgaaaccccctctccacgcgcgaaaaatccaaccccgctaccgccccctacgccctcccgaaacctccgcccacctacgcgaaaaattcacctaaaccgacgacccctcctctaaacgcgcgaatccctcccccgaaccccgaccctaccctccccgcgcccgccctcacctacacgacccgccttaaccatatcccgaacgacgaactccgacgacgctacgcgcgctcctcgcgcttcccgaacccgaccccgaccgcctccgaccccgaacgaactccgaacgccgcgcccgcgcccccgccccgctcgcctcgactaccgccaccgcaaccgccgccgcctcgccgctccctcccgctcccttaaaaacgccgaacgacgaccgcgccccccccccaccccaccccccgcgccgacgaaaaaaaactaacgaaaaaaaacgcccaacgccgcccccgcgaacccgcacccccgccccgaaccgtaaccgccgcgctccaacccgctccgctccgacccgcgcgaccaccgcaacgcgcgaaaaacgacaacccataaactcaaaaacgcgaaaacaacccgaaacactacgaaccaaaaacgaaaccctaaactaaaaaaaaaacgca

SEQ ID NO: 15815 - DNA, 947 bp, Artificial Sequence
  chemically treated genomic DNA (Homo sapiens) CpG-island No: 15815
aggaatttgggtttttggattgagttggtgacgggggttggggcggggggttgtggcgttttggatggagagagttgtaggagtagggggcgcgtttcggtttgcgttggggtgtgggacgaagcggcggtcgcgggatatttttttcggtggcgaagttcgggtttgttcggggttttcgcggggtgtagagggtttttaacggcgggattggttcggggcgttagtagatttggtttttttcggcggggtcgtggagaaggggacgcggtgtttttcgaggtgatcgggggcgtaggaaggacggggggcgcgcggagttttttttttacgcgcgggaggtttagtttcgttatcgttttttacgttttttcgggattttcgtttatttgcgcgaggggtttatttgggtcggcggttttttttttagacgcgcgagtttttttttcgggtttcggttttgtttttttcgcgttcgtttttatttgtacggttcgttttggttatgtttcgggcggcgggtttcggcggcgttacgcgcgtttttcgcgtttttcgggttcggtttcgatcgttttcggtttcgaacggatttcgagcgtcgcgttcgcgttttcgtttcgttcgtttcggttgtcgttatcgtagtcgtcgtcgtttcgtcgttttttttcgtttttttaaaggcgtcgagcggcggtcgcgttttttttttattttatttttcgcgtcggcggggagggattgacgaaggaaggcgtttaacgtcgttttcgcgggttcgtattttcgtttcgggtcgtggtcgtcgcgttttagttcgtttcgtttcggttcgcgcggttatcgtagcgcgcgaggggcggtagtttatgggtttagagacgcggagatagttcgagatattgcgggttagagacggggttttggattgggagaggggcgta

SEQ ID NO: 15816 - DNA, 947 bp, Artificial Sequence
  chemically treated genomic DNA (Homo sapiens) CpG-island No: 15816
tacgcccctctcccaatccaaaaccccgtctctaacccgcaatatctcgaactatctccgcgtctctaaacccataaactaccgcccctcgcgcgctacgataaccgcgcgaaccgaaacgaaacgaactaaaacgcgacgaccacgacccgaaacgaaaatacgaacccgcgaaaacgacgttaaacgccttccttcgtcaatccctccccgccgacgcgaaaaataaaataaaaaaaaaacgcgaccgccgctcgacgcctttaaaaaaacgaaaaaaaacgacgaaacgacgacgactacgataacgacaaccgaaacgaacgaaacgaaaacgcgaacgcgacgctcgaaatccgttcgaaaccgaaaacgatcgaaaccgaacccgaaaaacgcgaaaaacgcgcgtaacgccgccgaaacccgccgcccgaaacataaccaaaacgaaccgtacaaataaaaacgaacgcgaaaaaaacaaaaccgaaacccgaaaaaaaaactcgcgcgtctaaaaaaaaaaccgccgacccaaataaacccctcgcgcaaataaacgaaaatcccgaaaaaacgtaaaaaacgataacgaaactaaacctcccgcgcgtaaaaaaaaaactccgcgcgccccccgtccttcctacgcccccgatcacctcgaaaaacaccgcgtccccttctccacgaccccgccgaaaaaaaccaaatctactaacgccccgaaccaatcccgccgttaaaaaccctctacaccccgcgaaaaccccgaacaaacccgaacttcgccaccgaaaaaaatatcccgcgaccgccgcttcgtcccacaccccaacgcaaaccgaaacgcgccccctactcctacaactctctccatccaaaacgccacaaccccccgccccaacccccgtcaccaactcaatccaaaaacccaaattcct

SEQ ID NO: 15817 - DNA, 577 bp, Artificial Sequence
  chemically treated genomic DNA (Homo sapiens) CpG-island No: 15817
tttgttcgcgattatgaagagggggagcgacgtttttaatagttggaataaagtttatttgagattggaaatgattttcgggtttgttagaagcgtatttttattcgtagtcgtttttttttcgagtttagcgcggagtagtcgggtttgaggatgttagcgagtagttaattagcgttcgcggtttaaggtaagagatgagtttgtagtttagtttgttaattacgcgtttttttcgttcggtttataattcgggtttcgggaagggtatcgtttagtaaatttgggtaaagttcgcgtttcggacgtcgcggggtttcggggggacgcggtgggtcggattttttgttatcgtcgcggtttttcgttggttagggttagggcgcgggggttttgattcgggcgtttatatggcgagggtttggcgtgggtatgaacgggtggtttttttgttggcggggatcgtgattcgttgggacgtgggttcgcgaggaatcgagggtagaaagtatagggatgtttttagaagtttcgttcgggtaggttaggattagagggtgggggaacgtattttttt

SEQ ID NO: 15818 - DNA, 577 bp, Artificial Sequence
  chemically treated genomic DNA (Homo sapiens) CpG-island No: 15818
aaaaaaatacgttcccccaccctctaatcctaacctacccgaacgaaacttctaaaaacatccctatactttctaccctcgattcctcgcgaacccacgtcccaacgaatcacgatccccgccaacaaaaaaaccacccgttcatacccacgccaaaccctcgccatataaacgcccgaatcaaaacccccgcgccctaaccctaaccaacgaaaaaccgcgacgataacaaaaaatccgacccaccgcgtccccccgaaaccccgcgacgtccgaaacgcgaactttacccaaatttactaaacgatacccttcccgaaacccgaattataaaccgaacgaaaaaaacgcgtaattaacaaactaaactacaaactcatctcttaccttaaaccgcgaacgctaattaactactcgctaacatcctcaaacccgactactccgcgctaaactcgaaaaaaaaacgactacgaataaaaatacgcttctaacaaacccgaaaatcatttccaatctcaaataaactttattccaactattaaaaacgtcgctccccctcttcataatcgcgaacaaa

SEQ ID NO: 15819 - DNA, 577 bp, Artificial Sequence
  chemically treated genomic DNA (Homo sapiens) CpG-island No: 15819
gagggggtgcgtttttttattttttgattttgatttgttcgagcggggtttttggaaatatttttgtgttttttattttcgatttttcgcgggtttacgttttaacgggttacggttttcgttagtaaaggagttattcgtttatgtttacgttaagttttcgttatgtgaacgttcgggttaaagttttcgcgttttaattttggttagcgggggatcgcggcggtagtagagggttcggtttatcgcgttttttcgaagtttcgcggcgttcggggcgcgggttttgtttaagtttgttgggcgatgtttttttcggagttcgagttgtgggtcgggcgggaggggcgcgtgattgataggttgaattatagatttattttttattttaggtcgcgggcgttgattggttgttcgttgatatttttaaattcggttgtttcgcgttgggttcgggaggggggcggttgcgggtggaggtgcgtttttgataagttcgaaagttatttttaattttaagtggattttgttttaattattgggggcgtcgttttttttttttatggtcgcgggtaaa

SEQ ID NO: 15820 - DNA, 577 bp, Artificial Sequence
  chemically treated genomic DNA (Homo sapiens) CpG-island No: 15820
tttacccgcgaccataaaaaaaaaaaacgacgcccccaataattaaaacaaaatccacttaaaattaaaaataactttcgaacttatcaaaaacgcacctccacccgcaaccgcccccctcccgaacccaacgcgaaacaaccgaatttaaaaatatcaacgaacaaccaatcaacgcccgcgacctaaaataaaaaataaatctataattcaacctatcaatcacgcgcccctcccgcccgacccacaactcgaactccgaaaaaaacatcgcccaacaaacttaaacaaaacccgcgccccgaacgccgcgaaacttcgaaaaaacgcgataaaccgaaccctctactaccgccgcgatcccccgctaaccaaaattaaaacgcgaaaactttaacccgaacgttcacataacgaaaacttaacgtaaacataaacgaataactcctttactaacgaaaaccgtaacccgttaaaacgtaaacccgcgaaaaatcgaaaataaaaaacacaaaaatatttccaaaaaccccgctcgaacaaatcaaaatcaaaaaataaaaaaacgcaccccctc

SEQ ID NO: 15821 - DNA, 1247 bp, Artificial Sequence
  chemically treated genomic DNA (Homo sapiens) CpG-island No: 15821
gcgtttttatcgttcgaggttttttttattttttttggacgcgtacgattttttgtttcgagatcgggaatagttcgttttatttatttatttagttttttcggttttcgtttcgtagggcgaaggcggagggtggggaaggagttcgaggtaaggacggttcgtcggaggttaggatggcggtagatagggtatcggcgtgaggatttcgagagggtattagagagcgggattgacgtttgaacgggcggggtcggggcggacggggttagggttcgaggcgtgcgtagagttcgagattcggcgggatgaggagagcggcggttggggggcgattagagattcggatattgaatagggcgatggattcggagtcggggaagttggagatcgaatttagggcgcgaatttcgattgcgaagtgggttgggtcgcgtcgggttagggtttgagttcgagatttcggcggggttaaggatagcgggagggaaaaattggtttagttgtagcgtaggagggagagataggtaggtcggggagcgggcggggggcgcggcgggtattgattcgaagtaggaggcggcggcggcgggtagcgttagtaggtagagttcggttagggttagcgcgggcggggggcgtatggtgttggcggcgttgcgttttttagtattttttcgcgtcgtttaagttcgtagtttcgttattattcgttcgcgggattttaaattcgggtggggcggggtaggcggcgttgggaaaggaggagattgggaggttttttagtttcggcggcgagtttttcgttttattggttttatcgttttcgtttcgtttcgtcgcgggtggggtagtcgtttttggatcgttttcgttttttttttattgtttcgtttttcggttttaggtgagcgtttatttggcgtcgcgttcgttcggggtcgcggtggttgaacgtgaagtttttcgggtttggagaggcggggaggagggtacgaggcggggacggaggagattttgttttttcgggatggggcggaggtaagcgtaatggttttttcgaggtagagaaggtggaggggtaggaggagggacgtatttggagtcggtggaaaattcgggttattgttcgtttttttgtcgggtaagtgcggttttttcgtcgtagttcgtagatttagggtagggtcgggttttggtgtagaatcgttttttggaagcgggggaaatgtatgtttaatggttta

SEQ ID NO: 15822 - DNA, 1247 bp, Artificial Sequence
  chemically treated genomic DNA (Homo sapiens) CpG-island No: 15822
taaaccattaaacatacatttcccccgcttccaaaaaacgattctacaccaaaacccgaccctaccctaaatctacgaactacgacgaaaaaaccgcacttacccgacaaaaaaacgaacaataacccgaattttccaccgactccaaatacgtccctcctcctacccctccaccttctctacctcgaaaaaaccattacgcttacctccgccccatcccgaaaaaacaaaatctcctccgtccccgcctcgtaccctcctccccgcctctccaaacccgaaaaacttcacgttcaaccaccgcgaccccgaacgaacgcgacgccaaataaacgctcacctaaaaccgaaaaacgaaacaataaaaaaaaaacgaaaacgatccaaaaacgactaccccacccgcgacgaaacgaaacgaaaacgataaaaccaataaaacgaaaaactcgccgccgaaactaaaaaacctcccaatctcctcctttcccaacgccgcctaccccgccccacccgaatttaaaatcccgcgaacgaataataacgaaactacgaacttaaacgacgcgaaaaaatactaaaaaacgcaacgccgccaacaccatacgccccccgcccgcgctaaccctaaccgaactctacctactaacgctacccgccgccgccgcctcctacttcgaatcaatacccgccgcgccccccgcccgctccccgacctacctatctctccctcctacgctacaactaaaccaatttttccctcccgctatccttaaccccgccgaaatctcgaactcaaaccctaacccgacgcgacccaacccacttcgcaatcgaaattcgcgccctaaattcgatctccaacttccccgactccgaatccatcgccctattcaatatccgaatctctaatcgccccccaaccgccgctctcctcatcccgccgaatctcgaactctacgcacgcctcgaaccctaaccccgtccgccccgaccccgcccgttcaaacgtcaatcccgctctctaataccctctcgaaatcctcacgccgataccctatctaccgccatcctaacctccgacgaaccgtccttacctcgaactccttccccaccctccgccttcgccctacgaaacgaaaaccgaaaaaactaaataaataaataaaacgaactattcccgatctcgaaacaaaaaatcgtacgcgtccaaaaaaaataaaaaaaacctcgaacgataaaaacgc

SEQ ID NO: 15823 - DNA, 1247 bp, Artificial Sequence
  chemically treated genomic DNA (Homo sapiens) CpG-island No: 15823
tgagttattggatatgtatttttttcgtttttagagagcggttttgtattaggattcggttttgttttgagtttgcgggttgcggcgaagagatcgtatttgttcggtaggagggcggataatgattcgggttttttatcgattttagatgcgtttttttttttatttttttattttttttatttcggagaagttattgcgtttgttttcgttttatttcggagaggtagaatttttttcgttttcgtttcgtattttttttttcgtttttttaggttcggggggttttacgtttagttatcgcgatttcgggcgggcgcggcgttaggtgagcgtttatttggggtcggagggcggggtaatgggggaggggcgggggcggtttaggggcggttgttttattcgcgacggggcggggcgagggcggtggggttaatggggcggggggttcgtcgtcggggttggggagttttttaattttttttttttttagcgtcgtttgtttcgttttattcgggtttaaagtttcgcgggcgggtggtggcggagttgcgagtttgagcggcgcgaggagatgttagagggcgtagcgtcgttagtattatgcgtttttcgttcgcgttggttttggtcgggttttgtttgttggcgttgttcgtcgtcgtcgttttttatttcgggttagtgttcgtcgcgtttttcgttcgtttttcggtttgtttgttttttttttttgcgttatagttgggttaatttttttttttcgttgtttttggtttcgtcgaggtttcgaatttagattttagttcggcgcgatttaatttatttcgtagtcggagttcgcgttttgagttcggtttttagttttttcggtttcgaatttatcgttttgtttagtgttcgagtttttggtcgttttttagtcgtcgttttttttatttcgtcgggtttcggattttgcgtacgtttcggattttggtttcgttcgtttcggtttcgttcgtttaggcgttagtttcgttttttgatgttttttcgggatttttacgtcggtgttttgtttgtcgttattttggttttcggcgagtcgtttttgtttcggattttttttttatttttcgttttcgttttgcggagcggagatcgagagggttgggtggatgggtgggacgggttgttttcggtttcggggtagaggatcgtgcgcgtttagggagaatgggggaaatttcggacggtgagagcgt

SEQ ID NO: 15824 - DNA, 1247 bp, Artificial Sequence
  chemically treated genomic DNA (Homo sapiens) CpG-island No: 15824
acgctctcaccgtccgaaatttcccccattctccctaaacgcgcacgatcctctaccccgaaaccgaaaacaacccgtcccacccatccacccaaccctctcgatctccgctccgcaaaacgaaaacgaaaaataaaaaaaaaatccgaaacaaaaacgactcgccgaaaaccaaaataacgacaaacaaaacaccgacgtaaaaatcccgaaaaaacatcaaaaaacgaaactaacgcctaaacgaacgaaaccgaaacgaacgaaaccaaaatccgaaacgtacgcaaaatccgaaacccgacgaaataaaaaaaacgacgactaaaaaacgaccaaaaactcgaacactaaacaaaacgataaattcgaaaccgaaaaaactaaaaaccgaactcaaaacgcgaactccgactacgaaataaattaaatcgcgccgaactaaaatctaaattcgaaacctcgacgaaaccaaaaacaacgaaaaaaaaaaattaacccaactataacgcaaaaaaaaaaaacaaacaaaccgaaaaacgaacgaaaaacgcgacgaacactaacccgaaataaaaaacgacgacgacgaacaacgccaacaaacaaaacccgaccaaaaccaacgcgaacgaaaaacgcataatactaacgacgctacgccctctaacatctcctcgcgccgctcaaactcgcaactccgccaccacccgcccgcgaaactttaaacccgaataaaacgaaacaaacgacgctaaaaaaaaaaaaaattaaaaaactccccaaccccgacgacgaaccccccgccccattaaccccaccgccctcgccccgccccgtcgcgaataaaacaaccgcccctaaaccgcccccgcccctcccccattaccccgccctccgaccccaaataaacgctcacctaacgccgcgcccgcccgaaatcgcgataactaaacgtaaaaccccccgaacctaaaaaaacgaaaaaaaaaatacgaaacgaaaacgaaaaaaattctacctctccgaaataaaacgaaaacaaacgcaataacttctccgaaataaaaaaaataaaaaaataaaaaaaaaaacgcatctaaaatcgataaaaaacccgaatcattatccgccctcctaccgaacaaatacgatctcttcgccgcaacccgcaaactcaaaacaaaaccgaatcctaatacaaaaccgctctctaaaaacgaaaaaaatacatatccaataactca

SEQ ID NO: 15825 - DNA, 1236 bp, Artificial Sequence
  chemically treated genomic DNA (Homo sapiens) CpG-island No: 15825
gatcgggggtcggggttcggggagtcgtgggcgtcggtacggtggtcgttataggggtggtcggcgtcgggttagtggtcgtcgaaagggtggtcggcgcgggtttggtcggcgtttgagaggtggtcgaagtgcgtttcgtcgtcggaggggtggtcggcgaggggtcgagcggcgtttgaaaggtggtggaagagggtttagtagtcgtttaaagaggggtggttttcggggattgggttggagaagtcgtagttaggggtcggtggacggtggcgcgcgggggttcggttttcggggtttgggtcgtgggagtcgtcgttttagggaaggggtggttgggttcgtttcgtaattcggggttcggcgacgcgtttatttgtttcgcggtttcgtcgttatcggtgatatttttcgtcgaggcggttgaggcgacggcggcggcggcggcggcggcggcgtagtataatagggcgaggtcgtttaggttcggtaggttttttatggcgcgttcggtttcgttatttatttatttagttagtcggttggttagttatttttttttcgttgtaattcgattaaggaagttttcgtaatcgtcgtcgttatcgttatcgggcgtattatcgttatttttttttgataggcggtcggtttcgcgggcgggttttagcgcggagggagcgatcggatcgagcgcggatcgttcgtttttttcgattggtagtcgcgtttaattaatgggaagttatagtcgtttacgtgattcgttcgtttttcggtttttttgtagtttcgtaggttaattagaggacgtttaggagagggggcggttcgtgaggcgggagaagggtggtgcgagtttagttttagttcgtcgggttcgcggcggtttcggttttgtttgtttaaagagtggggcgcgggtttcgggtatcgggcgtcgcggagtagataaaggatgcgtttcgcgcggtagacgtcgggtttagttatttgttttatcgggttgcgagtacgagcggggggtggaattagtattcgggagtattttcgtttttttgaataatggggcgttagcgtcgtattttagttcgggcggggatcgcgcgggaatttcgcgatgggagagggtagcggtagcgacgatgtagagtttggtatgttttttgttgttttagagagtttggtcgtagttttgcgaggtttttgtcgttatttttattttagagatgg

SEQ ID NO: 15826 - DNA, 1236 bp, Artificial Sequence
  chemically treated genomic DNA (Homo sapiens) CpG-island No: 15826
ccatctctaaaataaaaataacgacaaaaacctcgcaaaactacgaccaaactctctaaaacaacaaaaaacataccaaactctacatcgtcgctaccgctaccctctcccatcgcgaaattcccgcgcgatccccgcccgaactaaaatacgacgctaacgccccattattcaaaaaaacgaaaatactcccgaatactaattccaccccccgctcgtactcgcaacccgataaaacaaataactaaacccgacgtctaccgcgcgaaacgcatcctttatctactccgcgacgcccgatacccgaaacccgcgccccactctttaaacaaacaaaaccgaaaccgccgcgaacccgacgaactaaaactaaactcgcaccacccttctcccgcctcacgaaccgccccctctcctaaacgtcctctaattaacctacgaaactacaaaaaaaccgaaaaacgaacgaatcacgtaaacgactataacttcccattaattaaacgcgactaccaatcgaaaaaaacgaacgatccgcgctcgatccgatcgctccctccgcgctaaaacccgcccgcgaaaccgaccgcctatcaaaaaaaaataacgataatacgcccgataacgataacgacgacgattacgaaaacttccttaatcgaattacaacgaaaaaaaaataactaaccaaccgactaactaaataaataaataacgaaaccgaacgcgccataaaaaacctaccgaacctaaacgacctcgccctattatactacgccgccgccgccgccgccgccgccgtcgcctcaaccgcctcgacgaaaaatatcaccgataacgacgaaaccgcgaaacaaataaacgcgtcgccgaaccccgaattacgaaacgaacccaaccaccccttccctaaaacgacgactcccacgacccaaaccccgaaaaccgaacccccgcgcgccaccgtccaccgacccctaactacgacttctccaacccaatccccgaaaaccacccctctttaaacgactactaaaccctcttccaccacctttcaaacgccgctcgacccctcgccgaccacccctccgacgacgaaacgcacttcgaccacctctcaaacgccgaccaaacccgcgccgaccaccctttcgacgaccactaacccgacgccgaccacccctataacgaccaccgtaccgacgcccacgactccccgaaccccgacccccgatc

SEQ ID NO: 15827 - DNA, 1236 bp, Artificial Sequence
  chemically treated genomic DNA (Homo sapiens) CpG-island No: 15827
ttatttttgaaatgggaatggcggtagagatttcgtaaggttgcgattaggttttttggagtagtagagggtatgttaagttttatatcgtcgttgtcgttgtttttttttatcgcggggttttcgcgcggttttcgttcgagttggggtgcggcgttggcgttttattgtttaggagggcggggatgttttcgagtgttgattttatttttcgttcgtgttcgtagttcggtggagtagatgattaggttcggcgtttgtcgcgcggggcgtattttttgtttgtttcgcggcgttcggtgttcgaggttcgcgttttattttttgggtagataaagtcggggtcgtcgcgagttcggcgggttagagttgggttcgtattatttttttttcgttttacggatcgtttttttttttggacgttttttgattggtttacggggttataaagaggtcgggaagcgggcggattacgtgggcgattgtggttttttattggttaggcgcggttgttaatcgaggagggcgggcggttcgcgttcggttcggtcgtttttttcgcgttggggttcgttcgcggggtcggtcgtttgttagagggaggtggcgatggtgcgttcggtggcggtggcggcggcggttgcggaggtttttttggtcggattgtaacgaggagaagatgattgattaatcgattggttgaatgaatgaatggcggagtcgagcgcgttatgaggagtttgtcgagtttgggcggtttcgttttgttgtgttgcgtcgtcgtcgtcgtcgtcgtcgtcgtcgttttagtcgtttcggcggggaatgttatcggtggcggcggggtcgcggggtaggtggacgcgtcgtcgggtttcgggttgcggggcgagtttagttattttttttttagggcgacggtttttacggtttaggtttcgaggatcgggttttcgcgcgttatcgtttatcgatttttggttgcgatttttttagtttagttttcggagattatttttttttgggcgattgttggatttttttttattattttttaggcgtcgttcggtttttcgtcgattattttttcggcggcggaacgtatttcgattattttttaggcgtcgattagattcgcgtcgattattttttcgacgattattggttcggcgtcgattatttttgtagcgattatcgtatcggcgtttacgatttttcggatttcgattttcgatt

SEQ ID NO: 15828 - DNA, 1236 bp, Artificial Sequence
  chemically treated genomic DNA (Homo sapiens) CpG-island No: 15828
aatcgaaaatcgaaatccgaaaaatcgtaaacgccgatacgataatcgctacaaaaataatcgacgccgaaccaataatcgtcgaaaaaataatcgacgcgaatctaatcgacgcctaaaaaataatcgaaatacgttccgccgccgaaaaaataatcgacgaaaaaccgaacgacgcctaaaaaataataaaaaaaaatccaacaatcgcccaaaaaaaaataatctccgaaaactaaactaaaaaaatcgcaaccaaaaatcgataaacgataacgcgcgaaaacccgatcctcgaaacctaaaccgtaaaaaccgtcgccctaaaaaaaaaataactaaactcgccccgcaacccgaaacccgacgacgcgtccacctaccccgcgaccccgccgccaccgataacattccccgccgaaacgactaaaacgacgacgacgacgacgacgacgacgacgcaacacaacaaaacgaaaccgcccaaactcgacaaactcctcataacgcgctcgactccgccattcattcattcaaccaatcgattaatcaatcatcttctcctcgttacaatccgaccaaaaaaacctccgcaaccgccgccgccaccgccaccgaacgcaccatcgccacctccctctaacaaacgaccgaccccgcgaacgaaccccaacgcgaaaaaaacgaccgaaccgaacgcgaaccgcccgccctcctcgattaacaaccgcgcctaaccaataaaaaaccacaatcgcccacgtaatccgcccgcttcccgacctctttataaccccgtaaaccaatcaaaaaacgtccaaaaaaaaaaacgatccgtaaaacgaaaaaaaaataatacgaacccaactctaacccgccgaactcgcgacgaccccgactttatctacccaaaaaataaaacgcgaacctcgaacaccgaacgccgcgaaacaaacaaaaaatacgccccgcgcgacaaacgccgaacctaatcatctactccaccgaactacgaacacgaacgaaaaataaaatcaacactcgaaaacatccccgccctcctaaacaataaaacgccaacgccgcaccccaactcgaacgaaaaccgcgcgaaaaccccgcgataaaaaaaaacaacgacaacgacgatataaaacttaacataccctctactactccaaaaaacctaatcgcaaccttacgaaatctctaccgccattcccatttcaaaaataa

SEQ ID NO: 15829 - DNA, 1161 bp, Artificial Sequence
  chemically treated genomic DNA (Homo sapiens) CpG-island No: 15829
cgagggcggtgtaaggattcggatagaattttttcggtcgtagattttttttagggtatatttggtttggcgcggtcgcgggggtttcggggttgcgcgcgtaattcgttcgaggaattgttaacggtcgcggagtttcggtagtttcggcggtttcgcgcgtttatagtttggggagtttcgggaggtaacggcggtcgcgcggttcgggggtcggggttttaaggcgttttcgtcgttttcggtttttagttcgtttttcggagttcgttacggtttagcgtcgttcgttttatttgtgcggtttcggcgtttttttcgtcgtcggtcgttttcgtagaagtttagcgtttttgtgagttgaggcgtcggcgggggtttttgttcgtcgttgtcgttcggttgtttcgtttcgtcgcggtcgtttcgttgcgggtcgtttacgtcgttatcgtcgttttttttcggagcggtcgcgtcgtcgacgttcgttatgtttcgagtataataaattgttttcgtcgtttttttttagtttttgttttcggtcggtttttttttcgtttcgtttcgtttttcgtcggagttcgagtcgtcgtcgtcgtcgtcgtcgttattcgcggttcgtcgatcggcgcgagttattggcgttagcgacgcgtgtgaggtcgttgtcgtcgtcgtcgtcgttacggtagtcgttattttttttttgttttcgtcgtggcgggcgacggtttttcgcgtcgtggttggttcggtcggtcggggtatcgcgtcgggttttatgtagtcgggttgcgcggtttcgtagagcgggcgtttcggggttcgagtcggggattcggtaggagcgggtcggggatggcggcggcgggcggcgggtcggtcgtggagtttcggagaggcggtcgttattatcgttgttcgtagtttgcgaggtgttcggcggttcgtttagggttttttttgtagattcggtgttcggagtgcgtcggcgtcgttcgttaggttttggtattgttggcgcggtcgcggcggcgggggttcggttttagattatcgatttttacgagcgtcggttttgtttgttcgttattttggttttattttttttgtatatttatgtttgtttgttatattttttggtttttgagtgtt

SEQ ID NO: 15830 - DNA, 1161 bp, Artificial Sequence
  chemically treated genomic DNA (Homo sapiens) CpG-island No: 15830
aacactcaaaaaccaaaaaatataacaaacaaacataaatatacaaaaaaaataaaaccaaaataacgaacaaacaaaaccgacgctcgtaaaaatcgataatctaaaaccgaacccccgccgccgcgaccgcgccaacaataccaaaacctaacgaacgacgccgacgcactccgaacaccgaatctacaaaaaaaaccctaaacgaaccgccgaacacctcgcaaactacgaacaacgataataacgaccgcctctccgaaactccacgaccgacccgccgcccgccgccgccatccccgacccgctcctaccgaatccccgactcgaaccccgaaacgcccgctctacgaaaccgcgcaacccgactacataaaacccgacgcgataccccgaccgaccgaaccaaccacgacgcgaaaaaccgtcgcccgccacgacgaaaacaaaaaaaaaataacgactaccgtaacgacgacgacgacgacaacgacctcacacgcgtcgctaacgccaataactcgcgccgatcgacgaaccgcgaataacgacgacgacgacgacgacgactcgaactccgacgaaaaacgaaacgaaacgaaaaaaaaaccgaccgaaaacaaaaactaaaaaaaaacgacgaaaacaatttattatactcgaaacataacgaacgtcgacgacgcgaccgctccgaaaaaaaacgacgataacgacgtaaacgacccgcaacgaaacgaccgcgacgaaacgaaacaaccgaacgacaacgacgaacaaaaacccccgccgacgcctcaactcacaaaaacgctaaacttctacgaaaacgaccgacgacgaaaaaaacgccgaaaccgcacaaataaaacgaacgacgctaaaccgtaacgaactccgaaaaacgaactaaaaaccgaaaacgacgaaaacgccttaaaaccccgacccccgaaccgcgcgaccgccgttacctcccgaaactccccaaactataaacgcgcgaaaccgccgaaactaccgaaactccgcgaccgttaacaattcctcgaacgaattacgcgcgcaaccccgaaacccccgcgaccgcgccaaaccaaatataccctaaaaaaaatctacgaccgaaaaaattctatccgaatccttacaccgccctcg

SEQ ID NO: 15831 - DNA, 1161 bp, Artificial Sequence
  chemically treated genomic DNA (Homo sapiens) CpG-island No: 15831
gatatttagaggttagggaatgtaataggtaagtataaatatgtagaagagatggaattaaaatagcgggtaggtagggtcggcgttcgtgggggtcggtgatttggagtcgggttttcgtcgtcgcggtcgcgttagtagtgttaagatttggcgggcggcgtcggcgtatttcgggtatcgagtttgtaaaagaggttttgagcggatcgtcggatatttcgtagattgcgggtagcggtggtggcggtcgttttttcggggttttacggtcgattcgtcgttcgtcgtcgttattttcggttcgtttttgtcgggttttcgattcgagtttcggagcgttcgttttgcgggatcgcgtagttcggttgtatggagttcggcgcggtgtttcggtcggtcgagttagttacggcgcgagaaatcgtcgttcgttacggcgagggtaggaagaagatggcggttatcgtggcggcggcggcggcggtagcggttttatacgcgtcgttgacgttaatggttcgcgtcggtcggcgggtcgcggatggcggcggcggcggcggcggcggttcgggtttcggcgaggggcggggcgaggcggggagggggtcggtcggaggtagaggttggagggaggcggcggggatagtttgttgtgttcggaatatggcgggcgtcggcgacgcggtcgtttcgggagaaggcggcggtggcggcgtggacggttcgtagcgggacggtcgcggcgaggcggagtagtcgggcggtagcggcggataggggttttcgtcggcgttttagtttatagagacgttgggtttttacgagagcgatcggcggcgggagaggcgtcggggtcgtataggtgaggcgggcggcgttaggtcgtggcgggtttcgaggggcggattggggatcgagggcggcgggggcgttttggaatttcggttttcgagtcgcgcggtcgtcgttgtttttcggggttttttaggttgtgggcgcgcggagtcgtcgaggttgtcgaggtttcgcggtcgttgatagtttttcgggcgggttgcgcgcgtagtttcgaggttttcgcggtcgcgttaggttaggtgtgttttagaaggggtttgcggtcgggaaagttttgttcgggtttttgtatcgttttcg

SEQ ID NO: 15832 - DNA, 1161 bp, Artificial Sequence
  chemically treated genomic DNA (Homo sapiens) CpG-island No: 15832
cgaaaacgatacaaaaacccgaacaaaactttcccgaccgcaaaccccttctaaaacacacctaacctaacgcgaccgcgaaaacctcgaaactacgcgcgcaacccgcccgaaaaactatcaacgaccgcgaaacctcgacaacctcgacgactccgcgcgcccacaacctaaaaaaccccgaaaaacaacgacgaccgcgcgactcgaaaaccgaaattccaaaacgcccccgccgccctcgatccccaatccgcccctcgaaacccgccacgacctaacgccgcccgcctcacctatacgaccccgacgcctctcccgccgccgatcgctctcgtaaaaacccaacgtctctataaactaaaacgccgacgaaaacccctatccgccgctaccgcccgactactccgcctcgccgcgaccgtcccgctacgaaccgtccacgccgccaccgccgccttctcccgaaacgaccgcgtcgccgacgcccgccatattccgaacacaacaaactatccccgccgcctccctccaacctctacctccgaccgaccccctccccgcctcgccccgcccctcgccgaaacccgaaccgccgccgccgccgccgccgccatccgcgacccgccgaccgacgcgaaccattaacgtcaacgacgcgtataaaaccgctaccgccgccgccgccgccacgataaccgccatcttcttcctaccctcgccgtaacgaacgacgatttctcgcgccgtaactaactcgaccgaccgaaacaccgcgccgaactccatacaaccgaactacgcgatcccgcaaaacgaacgctccgaaactcgaatcgaaaacccgacaaaaacgaaccgaaaataacgacgacgaacgacgaatcgaccgtaaaaccccgaaaaaacgaccgccaccaccgctacccgcaatctacgaaatatccgacgatccgctcaaaacctcttttacaaactcgatacccgaaatacgccgacgccgcccgccaaatcttaacactactaacgcgaccgcgacgacgaaaacccgactccaaatcaccgacccccacgaacgccgaccctacctacccgctattttaattccatctcttctacatatttatacttacctattacattccctaacctctaaatatc

SEQ ID NO: 15833 - DNA, 618 bp, Artificial Sequence
  chemically treated genomic DNA (Homo sapiens) CpG-island No: 15833
acgtcgtgcgtttgcggttaggagtattcggaatgggataagttttttattatgttggagaattcgtagatgagagagcgtatgttgttgtaagttacggacgacgttttgcggggcgagttgtagaggttgcgggaggagttgggtcggttcgcggaaagtttggcgaggtcgtgcgcgtcgggggttttcgtagaggttaggttgattagtgttttggacgagttgttgtaggcgattcgcgacgcgggtcgtaggttggcgcgtatggagggcgcggaggcgtagcgtttagaggaggcggggcgcgttttggtcgcggtgttagaggagttgcggtagacgcgagtcgatttgtacgcggtgtagggttgggttgttcggagttggttgtcggtaggtaaggaggtaagcggggtcgggattttttattgcggttttgtttcgggagcgcgcgtaacggtaagttaagttaggtaattttttaggggaagtttttatgggaagcgcgcgcgcgcgcgcgtatatatatatatatatatatatatatatatatatttttatttttgtatgcgcggttatagagtttaggtatattatataaggcgggaaaattgg

SEQ ID NO: 15834 - DNA, 618 bp, Artificial Sequence
  chemically treated genomic DNA (Homo sapiens) CpG-island No: 15834
ccaattttcccgccttatataatatacctaaactctataaccgcgcatacaaaaataaaaatatatatatatatatatatatatatatatatatacgcgcgcgcgcgcgcgcttcccataaaaacttcccctaaaaaattacctaacttaacttaccgttacgcgcgctcccgaaacaaaaccgcaataaaaaatcccgaccccgcttacctccttacctaccgacaaccaactccgaacaacccaaccctacaccgcgtacaaatcgactcgcgtctaccgcaactcctctaacaccgcgaccaaaacgcgccccgcctcctctaaacgctacgcctccgcgccctccatacgcgccaacctacgacccgcgtcgcgaatcgcctacaacaactcgtccaaaacactaatcaacctaacctctacgaaaacccccgacgcgcacgacctcgccaaactttccgcgaaccgacccaactcctcccgcaacctctacaactcgccccgcaaaacgtcgtccgtaacttacaacaacatacgctctctcatctacgaattctccaacataataaaaaacttatcccattccgaatactcctaaccgcaaacgcacgacgt

SEQ ID NO: 15835 - DNA, 618 bp, Artificial Sequence
  chemically treated genomic DNA (Homo sapiens) CpG-island No: 15835
ttaattttttcgttttgtatggtgtgtttgagttttgtgatcgcgtatgtagaaataggggtgtgtgtgtgtgtgtgtgtgtgtgtgtgtgtgtgcgcgcgcgcgcgcgcgttttttatgaaagttttttttagaaggttgtttggtttggtttgtcgttacgcgcgttttcggaataaagtcgtagtgggaggtttcggtttcgtttgtttttttatttgtcggtagttagtttcgggtagtttagttttgtatcgcgtgtaggtcggttcgcgtttgtcgtagtttttttagtatcgcggttagggcgcgtttcgttttttttgggcgttgcgttttcgcgttttttatacgcgttagtttgcggttcgcgtcgcgggtcgtttgtagtagttcgtttagagtattggttagtttggtttttgcgggagttttcggcgcgtacggtttcgttaggtttttcgcgagtcggtttagtttttttcgtagtttttgtagttcgtttcgtaggacgtcgttcgtggtttgtagtagtatgcgtttttttatttgcgagttttttagtatgatgaagagtttgttttatttcgagtgtttttgatcgtaggcgtacggcgt

SEQ ID NO: 15836 - DNA, 618 bp, Artificial Sequence
  chemically treated genomic DNA (Homo sapiens) CpG-island No: 15836
acgccgtacgcctacgatcaaaaacactcgaaataaaacaaactcttcatcatactaaaaaactcgcaaataaaaaaacgcatactactacaaaccacgaacgacgtcctacgaaacgaactacaaaaactacgaaaaaaactaaaccgactcgcgaaaaacctaacgaaaccgtacgcgccgaaaactcccgcaaaaaccaaactaaccaatactctaaacgaactactacaaacgacccgcgacgcgaaccgcaaactaacgcgtataaaaaacgcgaaaacgcaacgcccaaaaaaaacgaaacgcgccctaaccgcgatactaaaaaaactacgacaaacgcgaaccgacctacacgcgatacaaaactaaactacccgaaactaactaccgacaaataaaaaaacaaacgaaaccgaaacctcccactacgactttattccgaaaacgcgcgtaacgacaaaccaaaccaaacaaccttctaaaaaaaactttcataaaaaacgcgcgcgcgcgcgcgcacacacacacacacacacacacacacacacacacccctatttctacatacgcgatcacaaaactcaaacacaccatacaaaacgaaaaaattaa

SEQ ID NO: 15837 - DNA, 611 bp, Artificial Sequence
  chemically treated genomic DNA (Homo sapiens) CpG-island No: 15837
aggcgggtaggggttgggaggcgggtaggggttgggaggcgggtaggggttgggaggcgggtaaggtttgggaggcgggtaggggttgggaggcgggtaggggttgggaggcgggtaggggttgggaggcgggtaaggtttgggaggcgggtaggggttgggaggcgggtagggtttgggaggcgggtaacgtttgggaggcgggtaggggttgggaggcgggtaggggttgggaggcgggtaggggttgggaggcgggtaaggtttgggaggcgggtaggggttgggaggcgggtagggtttgggaggcgggtagggtttgggaggcgggtaggggttgggaggcgggtaggggttgggaggcgggtaggggttgggaggcgggtagggtttgggaggcgggtaaggtttgggaggcgggtagggtttgggaggcggataaggtttgggaggcgggtaggggttgggaggcgggtagggtttgggaggcgggtagggtttgggaggcgggtaggggttgggaggcgggtaaggtttgggaggcgggtagggtttgggaggcgggtaggggttgggaggcgggtaggttttttatcggttttgtttttttt

SEQ ID NO: 15838 - DNA, 611 bp, Artificial Sequence
  chemically treated genomic DNA (Homo sapiens) CpG-island No: 15838
aaaaaaaacaaaaccgataaaaaacctacccgcctcccaacccctacccgcctcccaaaccctacccgcctcccaaaccttacccgcctcccaacccctacccgcctcccaaaccctacccgcctcccaaaccctacccgcctcccaacccctacccgcctcccaaaccttatccgcctcccaaaccctacccgcctcccaaaccttacccgcctcccaaaccctacccgcctcccaacccctacccgcctcccaacccctacccgcctcccaacccctacccgcctcccaaaccctacccgcctcccaaaccctacccgcctcccaacccctacccgcctcccaaaccttacccgcctcccaacccctacccgcctcccaacccctacccgcctcccaacccctacccgcctcccaaacgttacccgcctcccaaaccctacccgcctcccaacccctacccgcctcccaaaccttacccgcctcccaacccctacccgcctcccaacccctacccgcctcccaacccctacccgcctcccaaaccttacccgcctcccaacccctacccgcctcccaacccctacccgcctcccaacccctacccgcct

SEQ ID NO: 15839 - DNA, 611 bp, Artificial Sequence
  chemically treated genomic DNA (Homo sapiens) CpG-island No: 15839
agaagaagtagagtcgataggaaatttattcgttttttagtttttattcgttttttagattttattcgttttttagattttattcgttttttagtttttattcgttttttaggttttattcgttttttagattttattcgttttttagtttttattcgttttttagattttattcgttttttagattttattcgttttttagattttattcgttttttagattttattcgttttttagtttttattcgttttttagtttttattcgttttttagtttttattcgttttttagattttattcgttttttagattttattcgttttttagtttttattcgttttttagattttattcgttttttagtttttattcgttttttagtttttattcgttttttagtttttattcgttttttagacgttattcgttttttagattttattcgttttttagtttttattcgttttttagattttattcgttttttagtttttattcgttttttagtttttattcgttttttagtttttattcgttttttagattttattcgttttttagtttttattcgttttttagtttttattcgttttttagtttttattcgttt

SEQ ID NO: 15840 - DNA, 611 bp, Artificial Sequence
  chemically treated genomic DNA (Homo sapiens) CpG-island No: 15840
aaacgaataaaaactaaaaaacgaataaaaactaaaaaacgaataaaaactaaaaaacgaataaaatctaaaaaacgaataaaaactaaaaaacgaataaaaactaaaaaacgaataaaaactaaaaaacgaataaaatctaaaaaacgaataaaaactaaaaaacgaataaaatctaaaaaacgaataacgtctaaaaaacgaataaaaactaaaaaacgaataaaaactaaaaaacgaataaaaactaaaaaacgaataaaatctaaaaaacgaataaaaactaaaaaacgaataaaatctaaaaaacgaataaaatctaaaaaacgaataaaaactaaaaaacgaataaaaactaaaaaacgaataaaaactaaaaaacgaataaaatctaaaaaacgaataaaatctaaaaaacgaataaaatctaaaaaacgaataaaatctaaaaaacgaataaaaactaaaaaacgaataaaatctaaaaaacgaataaaacctaaaaaacgaataaaaactaaaaaacgaataaaatctaaaaaacgaataaaatctaaaaaacgaataaaaactaaaaaacgaataaatttcctatcgactctacttcttct

SEQ ID NO: 15841 - DNA, 540 bp, Artificial Sequence
  chemically treated genomic DNA (Homo sapiens) CpG-island No: 15841
tgagggattcgtttttttattcgcgaaattaggacggcgtcgtttatatttcgcggcgttcggggcgggttgaatgggtcgttgagtaggggttatatttacgtttttcgtttttcgttttcggtacggagcgacggttacggtagtgtttttaaggtatcgaaatcgaggcgggggtttcggttttttcgcgtaaggagggaggcggatcgtacgtggtaggatttatcgtttcgtacgtggtaggatttatcgtttcgtacgtggtaggatttatcgtttcgtacgtggtaggatttatcgtttcgcgtcgcgtttttcgagttatggcgttagcgttgtggcgggtttgtaacggatttatggtcgtttttttcgcgttggcggttttggtgtaggttaggcggtcgcggtgggagggggattcgttcggtttttagtttcgttttttggtttagcgggtcgtgtaattgattagcgggtagagtcgtaggggcgtatagttagtggggaggacggaatttgggttttttgtttggg

SEQ ID NO: 15842 - DNA, 540 bp, Artificial Sequence
  chemically treated genomic DNA (Homo sapiens) CpG-island No: 15842
cccaaacaaaaaacccaaattccgtcctccccactaactatacgcccctacgactctacccgctaatcaattacacgacccgctaaaccaaaaaacgaaactaaaaaccgaacgaatccccctcccaccgcgaccgcctaacctacaccaaaaccgccaacgcgaaaaaaacgaccataaatccgttacaaacccgccacaacgctaacgccataactcgaaaaacgcgacgcgaaacgataaatcctaccacgtacgaaacgataaatcctaccacgtacgaaacgataaatcctaccacgtacgaaacgataaatcctaccacgtacgatccgcctccctccttacgcgaaaaaaccgaaacccccgcctcgatttcgataccttaaaaacactaccgtaaccgtcgctccgtaccgaaaacgaaaaacgaaaaacgtaaatataacccctactcaacgacccattcaacccgccccgaacgccgcgaaatataaacgacgccgtcctaatttcgcgaataaaaaaacgaatccctca

SEQ ID NO: 15843 - DNA, 540 bp, Artificial Sequence
  chemically treated genomic DNA (Homo sapiens) CpG-island No: 15843
tttaagtagaaagtttaggtttcgttttttttattaattgtgcgtttttgcgattttgttcgttagttagttatacggttcgttaggttagggggcggagttgggagtcgggcgggttttttttttatcgcggtcgtttgatttgtattaaggtcgttagcgcgaagaaggcggttatgagttcgttgtaggttcgttatagcgttggcgttatggttcggagaacgcggcgcggggcggtgagttttgttacgtgcggggcggtgagttttgttacgtgcggggcggtgagttttgttacgtgcggggcggtgagttttgttacgtacggttcgtttttttttttgcgcggagggatcgagattttcgtttcggtttcggtgttttggggatattgtcgtggtcgtcgtttcgtgtcgggggcggggagcgaagggcgtgggtgtagtttttatttagcgatttatttagttcgtttcgaacgtcgcggggtgtaggcggcgtcgttttggtttcgcggatgggaaagcgagtttttta

SEQ ID NO: 15844 - DNA, 540 bp, Artificial Sequence
  chemically treated genomic DNA (Homo sapiens) CpG-island No: 15844
taaaaaactcgctttcccatccgcgaaaccaaaacgacgccgcctacaccccgcgacgttcgaaacgaactaaataaatcgctaaataaaaactacacccacgcccttcgctccccgcccccgacacgaaacgacgaccacgacaatatccccaaaacaccgaaaccgaaacgaaaatctcgatccctccgcgcaaaaaaaaaaacgaaccgtacgtaacaaaactcaccgccccgcacgtaacaaaactcaccgccccgcacgtaacaaaactcaccgccccgcacgtaacaaaactcaccgccccgcgccgcgttctccgaaccataacgccaacgctataacgaacctacaacgaactcataaccgccttcttcgcgctaacgaccttaatacaaatcaaacgaccgcgataaaaaaaaaacccgcccgactcccaactccgccccctaacctaacgaaccgtataactaactaacgaacaaaatcgcaaaaacgcacaattaataaaaaaaacgaaacctaaactttctacttaaa

SEQ ID NO: 15845 - DNA, 552 bp, Artificial Sequence
  chemically treated genomic DNA (Homo sapiens) CpG-island No: 15845
ttatgaaatgtgttcgaagaagttgacgtagtttgtgacgttcgcggttttttgatggggatcggtagtagcggcgttttcgtcgaggagggacgatttgagtcggcgttcgggtttttttttcgtcggtagtcgcgcgtttcggcgtttagtttgggggtcgttggttcggggcgcgagtatttgttttcggttgcgcgcgtcgttttcgttttgattagtttaggttattatataagatgttacggagaggaaaggggcgagcgagaggcgcgttggggagggcgcggtggtttttcgcgagtggtagggaggggtaggaggtaggattcggcgggatttatttgtacgtttttcgcgttttttgcgggcgttgttcgcgcgcgtgtcggggtggtgggtgtgggggggtacggacggacgtgttcgttgtttttatttttttttcgttaatattcgggtagcggtcgaaacgtgttattttttcgttgttattttttttgggtttataggtttttggttttaggcgtttgtattttgaaatatttgttt

SEQ ID NO: 15846 - DNA, 552 bp, Artificial Sequence
  chemically treated genomic DNA (Homo sapiens) CpG-island No: 15846
aaacaaatatttcaaaatacaaacgcctaaaaccaaaaacctataaacccaaaaaaaataacaacgaaaaaataacacgtttcgaccgctacccgaatattaacgaaaaaaaaataaaaacaacgaacacgtccgtccgtacccccccacacccaccaccccgacacgcgcgcgaacaacgcccgcaaaaaacgcgaaaaacgtacaaataaatcccgccgaatcctacctcctacccctccctaccactcgcgaaaaaccaccgcgccctccccaacgcgcctctcgctcgcccctttcctctccgtaacatcttatataataacctaaactaatcaaaacgaaaacgacgcgcgcaaccgaaaacaaatactcgcgccccgaaccaacgacccccaaactaaacgccgaaacgcgcgactaccgacgaaaaaaaaacccgaacgccgactcaaatcgtccctcctcgacgaaaacgccgctactaccgatccccatcaaaaaaccgcgaacgtcacaaactacgtcaacttcttcgaacacatttcataa

SEQ ID NO: 15847 - DNA, 552 bp, Artificial Sequence
  chemically treated genomic DNA (Homo sapiens) CpG-island No: 15847
aaataaatgttttaaagtataaacgtttggggttagaaatttgtagatttaggagaggtggtagcgaaaaaatagtacgtttcggtcgttgttcgagtgttggcggggaggggatgggagtagcgggtacgttcgttcgtgtttttttatatttattatttcggtacgcgcgcgggtagcgttcgtagggggcgcggagggcgtataggtgggtttcgtcgggttttgttttttgtttttttttgttattcgcggaaggttatcgcgttttttttaacgcgtttttcgttcgtttttttttttttcgtgatattttatataataatttgagttaattaaaacggaagcgacgcgcgtagtcgggagtagatgttcgcgtttcgagttagcggtttttaaattaggcgtcggggcgcgcggttgtcggcgggggaagggttcgagcgtcgatttaggtcgttttttttcggcggaggcgtcgttgttgtcggtttttattaggaagtcgcgagcgttataaattgcgttagttttttcgaatatattttatgg

SEQ ID NO: 15848 - DNA, 552 bp, Artificial Sequence
  chemically treated genomic DNA (Homo sapiens) CpG-island No: 15848
ccataaaatatattcgaaaaaactaacgcaatttataacgctcgcgacttcctaataaaaaccgacaacaacgacgcctccgccgaaaaaaaacgacctaaatcgacgctcgaacccttcccccgccgacaaccgcgcgccccgacgcctaatttaaaaaccgctaactcgaaacgcgaacatctactcccgactacgcgcgtcgcttccgttttaattaactcaaattattatataaaatatcacgaaaaaaaaaaaaacgaacgaaaaacgcgttaaaaaaaacgcgataaccttccgcgaataacaaaaaaaaacaaaaaacaaaacccgacgaaacccacctatacgccctccgcgccccctacgaacgctacccgcgcgcgtaccgaaataataaatataaaaaaacacgaacgaacgtacccgctactcccatcccctccccgccaacactcgaacaacgaccgaaacgtactattttttcgctaccacctctcctaaatctacaaatttctaaccccaaacgtttatactttaaaacatttattt

SEQ ID NO: 15849 - DNA, 2017 bp, Artificial Sequence
  chemically treated genomic DNA (Homo sapiens) CpG-island No: 15849
cgcggagttcgtagtagtcgtagaaggcgttttgtagaatgtgttgcgcgtatacgtagtagtaggtgggttggttgaataggttcgtgtcgcgttattcgtgtttgtttttgcggaagatgtttttgcggtgtagttgtcggcgcgatcgttggaggttatattagaaggtgatgaatatcggtagtaggatcgagtatagcgtttataagattaggtgttcgttcgtaaataggttttcggagggcgagttcggcgtcggtcgttttttcgtttttattttttttaaggacgatatttaattagaaaagaaataggcggtgtatttcgagttcgttatttttttttcgttttttttttgttttttcggggttaaatcgggcgtttttagtgaaggtggtttcgttttttcgagggcgggattgcgtttcgttttttcgtttttcgggatttgtcgcgtcgagaaggcgacgtttagttattacgttttaatttttattttttaattcgttttatttcgggagcgcgtttaggagtttaaggcggttgttgttgtcgtcgtcgttttattttgtcgtcggtttgatttacggaagggcgtaatatataggggtaagttgttttttatcgaaaggtcgggcgtttaggttaggtaacgtcggtcggcgttcgtaatcgtcggtttaggtttcgtattttttttcggggcgtcgttttttttcgggttttattcgtttttacgcgcggttcggcgattttagtttttttcgggaggttttcggagatttgcgtcgcgtcggttttcgaagttttatttcgcgcgggtggaggcgcggtttcgggttagtaggttttggtcgtttcgcgtaggaggagaacgacgttgggtcgttagtagggatgaagtcgggcgggggaaacgtttaaggttttagtcgtacgtacgtcgattcggcgcgcggggtcgcgagttggaggcggggtttgtggcggcgagtttcgtggttgggcggagttagggttgacgggcggggcggaggtgtgaggtgggaggggagacggatcggtttgagggggcggggtcgtggaggaggttggagacggatggaagaggtagggtattgcggttgggggcggggtttaggggaagggggcggagtaatagtggggcgtttgagaggatcgcgagggttgaatgttaaatttcgtaatcgtagaaaattttggaaagtcgtcggcggggtaaggttacgaggatttttttcgtagtatcgcgtcgcgcggggtttaggggtcgcgtttacgttcgtcgttcggcgtagatacgagtgttttcgatttgagtcgaatttttagtcgatgtcggcgtcgtcgtcgtcggggatgcgtaagtcgattgggaagcgagggggggaggcggtttgcgcggtatcgttcgatttggtcgcggcgggttgaggtaggtgtggcggtcgtagtaacgtaaatttgagggttttttcgttgcggagcggcgggcgggcgcggaggtcgagggcgagcggggtagtcgttcgttcgtcgtcgttgatttcgagttcggtcgcggttttcgttttttgtcgtggcgggcgggttttttttgcgttattttttcgttcgcgttcgttagcgttcgaggtcggggagaaaggggagtagcgggagtcggggattatcggagatgggagtacgttttttgttgttgtcgtttagttttaggtttcggaggaatgttcgtttttcgttggagttttattagtttaatacggatttgagtcgcgattacgcgggttgtagtttgtagtatattagttattcggagaacgcggacgcggaagtatcgttgtttagtattttcgaagaaatacggaatttagagaggtataggtatcgtttcggcgcgtatagttgtatttagcggttttttttttattatatatatatataggagtgggagtcgaggattatttgttgtttgcggattttttttagtata

SEQ ID NO: 15850 - DNA, 2017 bp, Artificial Sequence
  chemically treated genomic DNA (Homo sapiens) CpG-island No: 15850
tatactaaaaaaaatccgcaaacaacaaataatcctcgactcccactcctatatatatatataataaaaaaaaaaccgctaaatacaactatacgcgccgaaacgatacctatacctctctaaattccgtatttcttcgaaaatactaaacaacgatacttccgcgtccgcgttctccgaataactaatatactacaaactacaacccgcgtaatcgcgactcaaatccgtattaaactaataaaactccaacgaaaaacgaacattcctccgaaacctaaaactaaacgacaacaacaaaaaacgtactcccatctccgataatccccgactcccgctactcccctttctccccgacctcgaacgctaacgaacgcgaacgaaaaaataacgcaaaaaaaacccgcccgccacgacaaaaaacgaaaaccgcgaccgaactcgaaatcaacgacgacgaacgaacgactaccccgctcgccctcgacctccgcgcccgcccgccgctccgcaacgaaaaaaccctcaaatttacgttactacgaccgccacacctacctcaacccgccgcgaccaaatcgaacgataccgcgcaaaccgcctccccccctcgcttcccaatcgacttacgcatccccgacgacgacgacgccgacatcgactaaaaattcgactcaaatcgaaaacactcgtatctacgccgaacgacgaacgtaaacgcgacccctaaaccccgcgcgacgcgatactacgaaaaaaatcctcgtaaccttaccccgccgacgactttccaaaattttctacgattacgaaatttaacattcaaccctcgcgatcctctcaaacgccccactattactccgcccccttcccctaaaccccgcccccaaccgcaataccctacctcttccatccgtctccaacctcctccacgaccccgccccctcaaaccgatccgtctcccctcccacctcacacctccgccccgcccgtcaaccctaactccgcccaaccacgaaactcgccgccacaaaccccgcctccaactcgcgaccccgcgcgccgaatcgacgtacgtacgactaaaaccttaaacgtttcccccgcccgacttcatccctactaacgacccaacgtcgttctcctcctacgcgaaacgaccaaaacctactaacccgaaaccgcgcctccacccgcgcgaaataaaacttcgaaaaccgacgcgacgcaaatctccgaaaacctcccgaaaaaaactaaaatcgccgaaccgcgcgtaaaaacgaataaaacccgaaaaaaaacgacgccccgaaaaaaaatacgaaacctaaaccgacgattacgaacgccgaccgacgttacctaacctaaacgcccgacctttcgataaaaaacaacttacccctatatattacgcccttccgtaaatcaaaccgacgacaaaataaaacgacgacgacaacaacaaccgccttaaactcctaaacgcgctcccgaaataaaacgaattaaaaaataaaaattaaaacgtaataactaaacgtcgccttctcgacgcgacaaatcccgaaaaacgaaaaaacgaaacgcaatcccgccctcgaaaaaacgaaaccaccttcactaaaaacgcccgatttaaccccgaaaaaacaaaaaaaaaacgaaaaaaaaataacgaactcgaaatacaccgcctatttcttttctaattaaatatcgtccttaaaaaaaataaaaacgaaaaaacgaccgacgccgaactcgccctccgaaaacctatttacgaacgaacacctaatcttataaacgctatactcgatcctactaccgatattcatcaccttctaatataacctccaacgatcgcgccgacaactacaccgcaaaaacatcttccgcaaaaacaaacacgaataacgcgacacgaacctattcaaccaacccacctactactacgtatacgcgcaacacattctacaaaacgccttctacgactactacgaactccgcg

SEQ ID NO: 15851 - DNA, 2017 bp, Artificial Sequence
  chemically treated genomic DNA (Homo sapiens) CpG-island No: 15851
tatgttagaggaagttcgtaagtaataagtggttttcggtttttatttttatgtatgtatgtagtaggaaggaagtcgttgagtgtagttgtgcgcgtcggggcggtgtttgtgtttttttggatttcgtgttttttcgggggtgttgagtagcggtgttttcgcgttcgcgtttttcgggtagttgatgtgttgtaggttgtagttcgcgtggtcgcggtttaggttcgtgttgggttggtaggattttagcggggagcgagtattttttcggaatttggggttggacgatagtagtaggaggcgtgtttttattttcggtagttttcggttttcgttgttttttttttttttcggtttcgggcgttggcgggcgcgggcgagggggtagcgtaggggaggttcgttcgttacggtagggggcggaaatcgcggtcgggttcggggttagcggcgacgagcgggcggttgtttcgttcgttttcggttttcgcgttcgttcgtcgtttcgtagcggaggagtttttaggtttgcgttattgcggtcgttatatttattttagttcgtcgcggttaggtcgggcggtgtcgcgtaggtcgtttttttttttcgttttttagtcggtttacgtattttcggcggcggcggcgtcggtatcggttagaggttcggtttaagtcgggggtattcgtgtttgcgtcgagcggcgggcgtgagcgcggtttttgggtttcgcgcggcgcggtgttgcgaggaggattttcgtggttttgtttcgtcggcggttttttagaattttttacgattacgaagtttggtatttaattttcgcgatttttttaaacgttttattgttatttcgttttttttttttaggtttcgtttttagtcgtagtgttttgttttttttattcgtttttagttttttttacggtttcgtttttttaggtcggttcgtttttttttttattttatattttcgtttcgttcgttagttttggtttcgtttagttacggggttcgtcgttataggtttcgtttttagttcgcggtttcgcgcgtcggatcggcgtgcgtgcggttggagttttaagcgtttttttcgttcggttttatttttgttggcggtttagcgtcgttttttttttgcgcgaggcggttaaggtttgttggttcggagtcgcgtttttattcgcgcgaggtagggtttcgaggatcggcgcggcgtaggttttcggaggtttttcgagaggggttagggtcgtcgggtcgcgcgtgggagcgggtggggttcgggaggagacggcgtttcggaggggagtgcgaggtttgggtcgacggttacgggcgtcgatcggcgttgtttggtttgaacgttcggtttttcggtggagggtagtttgtttttgtatgttgcgttttttcgtgggttagatcggcggtaaggtgaggcggcggcggtagtagtagtcgttttgggtttttggacgcgttttcgaggtggggcgggttggggagtggggattggagcgtgatggttggacgtcgttttttcggcgcggtaggtttcgggagacggggggacgaggcgtagtttcgttttcgggagagcggagttatttttattgagggcgttcggtttggtttcggaaaggtaggaagggggcggggaagggatggcgagttcggggtgtatcgtttgttttttttttggttaggtatcgtttttggagaagatggaagcggagaggcggtcggcgtcgggttcgtttttcgagggtttgtttgcggacgggtatttgattttgtggacgttgtgttcggttttgttgtcggtgtttattattttttggtgtagtttttagcggtcgcgtcggtagttgtatcgtagggatatttttcgtaagagtaagtacgggtggcgcgatacggatttgtttagttagtttatttattgttgcgtgtgcgcgtagtatattttgtagggcgttttttgcgattgttgcgggtttcgcg

SEQ ID NO: 15852 - DNA, 2017 bp, Artificial Sequence
  chemically treated genomic DNA (Homo sapiens) CpG-island No: 15852
cgcgaaacccgcaacaatcgcaaaaaacgccctacaaaatatactacgcgcacacgcaacaataaataaactaactaaacaaatccgtatcgcgccacccgtacttactcttacgaaaaatatccctacgatacaactaccgacgcgaccgctaaaaactacaccaaaaaataataaacaccgacaacaaaaccgaacacaacgtccacaaaatcaaatacccgtccgcaaacaaaccctcgaaaaacgaacccgacgccgaccgcctctccgcttccatcttctccaaaaacgatacctaaccaaaaaaaaaacaaacgatacaccccgaactcgccatcccttccccgcccccttcctacctttccgaaaccaaaccgaacgccctcaataaaaataactccgctctcccgaaaacgaaactacgcctcgtccccccgtctcccgaaacctaccgcgccgaaaaaacgacgtccaaccatcacgctccaatccccactccccaacccgccccacctcgaaaacgcgtccaaaaacccaaaacgactactactaccgccgccgcctcaccttaccgccgatctaacccacgaaaaaacgcaacatacaaaaacaaactaccctccaccgaaaaaccgaacgttcaaaccaaacaacgccgatcgacgcccgtaaccgtcgacccaaacctcgcactcccctccgaaacgccgtctcctcccgaaccccacccgctcccacgcgcgacccgacgaccctaacccctctcgaaaaacctccgaaaacctacgccgcgccgatcctcgaaaccctacctcgcgcgaataaaaacgcgactccgaaccaacaaaccttaaccgcctcgcgcaaaaaaaaaacgacgctaaaccgccaacaaaaataaaaccgaacgaaaaaaacgcttaaaactccaaccgcacgcacgccgatccgacgcgcgaaaccgcgaactaaaaacgaaacctataacgacgaaccccgtaactaaacgaaaccaaaactaacgaacgaaacgaaaatataaaataaaaaaaaaaacgaaccgacctaaaaaaacgaaaccgtaaaaaaaactaaaaacgaataaaaaaaacaaaacactacgactaaaaacgaaacctaaaaaaaaaaaacgaaataacaataaaacgtttaaaaaaatcgcgaaaattaaataccaaacttcgtaatcgtaaaaaattctaaaaaaccgccgacgaaacaaaaccacgaaaatcctcctcgcaacaccgcgccgcgcgaaacccaaaaaccgcgctcacgcccgccgctcgacgcaaacacgaatacccccgacttaaaccgaacctctaaccgataccgacgccgccgccgccgaaaatacgtaaaccgactaaaaaacgaaaaaaaaaaacgacctacgcgacaccgcccgacctaaccgcgacgaactaaaataaatataacgaccgcaataacgcaaacctaaaaactcctccgctacgaaacgacgaacgaacgcgaaaaccgaaaacgaacgaaacaaccgcccgctcgtcgccgctaaccccgaacccgaccgcgatttccgccccctaccgtaacgaacgaacctcccctacgctaccccctcgcccgcgcccgccaacgcccgaaaccgaaaaaaaaaaaaaacaacgaaaaccgaaaactaccgaaaataaaaacacgcctcctactactatcgtccaaccccaaattccgaaaaaatactcgctccccgctaaaatcctaccaacccaacacgaacctaaaccgcgaccacgcgaactacaacctacaacacatcaactacccgaaaaacgcgaacgcgaaaacaccgctactcaacacccccgaaaaaacacgaaatccaaaaaaacacaaacaccgccccgacgcgcacaactacactcaacgacttccttcctactacatacatacataaaaataaaaaccgaaaaccacttattacttacgaacttcctctaacata

SEQ ID NO: 15853 - DNA, 877 bp, Artificial Sequence
  chemically treated genomic DNA (Homo sapiens) CpG-island No: 15853
gtttcgcggtcggttgggttcgttttattacggtagtttttgttttttttggtttgatttatcgagaattttttttttcgcgttttcgttgtcggcggcggtggttaaagaggcggcggtcgcggtgttcgtggttgcgggggtcgcgtttttatcggggttttttgcgacgtgggcggcgggcgtcggggtcgcggtttggggcgtatcgttgtttatcgggtttttgggcgcggggttttggggagtcgcggcggtcgttttcgtcggagtttgcgggagggtggtggtggtggtggtggtggtttcgttcgttttatttatgttttttttttttttgttttcgtttaggcgtttcggtggcggttggtcggcggttagcgcggttggtggtcgcggcggtcggggttcgttttcggggaggtcggggcggatttcgcggcgtaggcggcggcggtcgaggtggggtcgcgcggcggaggcggttcgagtttcgtgttgcgcgtttttttttgggtttttcgttcgattttattgttttaaaaatggtttcgtataagtttttttaggcggcgtatcggttcgggagggaagggcgggcgaggggagagggtggggaaatttggttcgggagtcgggttttggatttttattagtatttaaaggcgttcggtgcgttttttatggttttaattcgtcgggacgcgagcgcgcgggtcgcgttgtagaattaaggaaagttagggtgaacggggcgttcgggttgttttttggagcgtttcgaggagttcgcgttgttgattttttgttggagcggggtgtattggttttttttttttaattcgttttgatattcgtagttgataaggagaggtaa

SEQ ID NO: 15854 - DNA, 877 bp, Artificial Sequence
  chemically treated genomic DNA (Homo sapiens) CpG-island No: 15854
ttacctctccttatcaactacgaatatcaaaacgaattaaaaaaaaaaaaccaatacaccccgctccaacaaaaaatcaacaacgcgaactcctcgaaacgctccaaaaaacaacccgaacgccccgttcaccctaactttccttaattctacaacgcgacccgcgcgctcgcgtcccgacgaattaaaaccataaaaaacgcaccgaacgcctttaaatactaataaaaatccaaaacccgactcccgaaccaaatttccccaccctctcccctcgcccgcccttccctcccgaaccgatacgccgcctaaaaaaacttatacgaaaccatttttaaaacaataaaatcgaacgaaaaacccaaaaaaaaacgcgcaacacgaaactcgaaccgcctccgccgcgcgaccccacctcgaccgccgccgcctacgccgcgaaatccgccccgacctccccgaaaacgaaccccgaccgccgcgaccaccaaccgcgctaaccgccgaccaaccgccaccgaaacgcctaaacgaaaacaaaaaaaaaaaaaacataaataaaacgaacgaaaccaccaccaccaccaccaccaccctcccgcaaactccgacgaaaacgaccgccgcgactccccaaaaccccgcgcccaaaaacccgataaacaacgatacgccccaaaccgcgaccccgacgcccgccgcccacgtcgcaaaaaaccccgataaaaacgcgacccccgcaaccacgaacaccgcgaccgccgcctctttaaccaccgccgccgacaacgaaaacgcgaaaaaaaaaattctcgataaatcaaaccaaaaaaaacaaaaactaccgtaataaaacgaacccaaccgaccgcgaaac

SEQ ID NO: 15855 - DNA, 877 bp, Artificial Sequence
  chemically treated genomic DNA (Homo sapiens) CpG-island No: 15855
ttatttttttttgttagttgcgggtgttaagacgggttgagggaggagagttaatgtatttcgttttaataaagggttagtagcgcgggtttttcggaacgttttagaagataattcgggcgtttcgtttattttggttttttttggttttgtaacgcgattcgcgcgttcgcgtttcggcggattggagttatagaaagcgtatcgggcgtttttaaatgttaatgagagtttagggttcgattttcgagttaagtttttttatttttttttttcgttcgtttttttttttcgggtcggtgcgtcgtttagaaaaatttgtgcggggttatttttggggtagtaagatcgagcgaggagtttaagagagagcgcgtagtacgaagttcgagtcgttttcgtcgcgcgattttatttcggtcgtcgtcgtttgcgtcgcgagattcgtttcggttttttcgagagcgagtttcggtcgtcgcgattattagtcgcgttaatcgtcgattaatcgttatcgaggcgtttgagcgagagtagaggaggaggaggtatgagtgaggcgggcgaggttattattattattattattattttttcgtaggtttcgacggaggcggtcgtcgcggttttttaggatttcgcgtttaagagttcggtgggtagcggtgcgttttaggtcgcggtttcggcgttcgtcgtttacgtcgtaggaaatttcggtggggacgcggttttcgtagttacgggtatcgcggtcgtcgtttttttagttatcgtcgtcggtagcgaagacgcggagaaaaaagttttcggtgagttaggttagggagggtaggggttgtcgtagtggggcgggtttagtcggtcgcggagt

SEQ ID NO: 15856 - DNA, 877 bp, Artificial Sequence
  chemically treated genomic DNA (Homo sapiens) CpG-island No: 15856
actccgcgaccgactaaacccgccccactacgacaacccctaccctccctaacctaactcaccgaaaacttttttctccgcgtcttcgctaccgacgacgataactaaaaaaacgacgaccgcgatacccgtaactacgaaaaccgcgtccccaccgaaatttcctacgacgtaaacgacgaacgccgaaaccgcgacctaaaacgcaccgctacccaccgaactcttaaacgcgaaatcctaaaaaaccgcgacgaccgcctccgtcgaaacctacgaaaaaataataataataataataataacctcgcccgcctcactcatacctcctcctcctctactctcgctcaaacgcctcgataacgattaatcgacgattaacgcgactaataatcgcgacgaccgaaactcgctctcgaaaaaaccgaaacgaatctcgcgacgcaaacgacgacgaccgaaataaaatcgcgcgacgaaaacgactcgaacttcgtactacgcgctctctcttaaactcctcgctcgatcttactaccccaaaaataaccccgcacaaatttttctaaacgacgcaccgacccgaaaaaaaaaaacgaacgaaaaaaaaaaataaaaaaacttaactcgaaaatcgaaccctaaactctcattaacatttaaaaacgcccgatacgctttctataactccaatccgccgaaacgcgaacgcgcgaatcgcgttacaaaaccaaaaaaaaccaaaataaacgaaacgcccgaattatcttctaaaacgttccgaaaaacccgcgctactaaccctttattaaaacgaaatacattaactctcctccctcaacccgtcttaacacccgcaactaacaaaaaaaaataa

SEQ ID NO: 15857 - DNA, 585 bp, Artificial Sequence
  chemically treated genomic DNA (Homo sapiens) CpG-island No: 15857
tgggcgcgtttcgcggtcgtttcggtcgtcgtttattttttttacgttaggttcgcgcggtcgtttcgttttcgcgcgcgtttttcgtttgttcgtttgcgtttgcgcgtaggtgtcggcgtttagggggagggggtttcggcgcgttcgcgttacgttcgcgtttttatttttttagtgcgcggtcgtttcgcgtttgcgtaggagaggtggtaggttcgggtggttggtttcggggagatagcgtttgttagtcggtgggtcggttttcgcgtcggtttttttttttttcggttttcgggggaggcgcggtggagttcgttttcggggtttttcgatgggggagaagcggcgacggcggtagtggagtaatcgagtcggagcgtgagcggtttcggtgtttcgttttttacggaggttatgggcgatttagttttcgttcgtagtttggacgatatcgatttgttcgttttgcgggtgagcgcgtcgttttttagtttcgttttggtttttgttttcgtcgtaagggagggagcggggtggttgtacgttttacgtgttttcgggcgttttttttattagttt

SEQ ID NO: 15858 - DNA, 585 bp, Artificial Sequence
  chemically treated genomic DNA (Homo sapiens) CpG-island No: 15858
aaactaataaaaaaaacgcccgaaaacacgtaaaacgtacaaccaccccgctccctcccttacgacgaaaacaaaaaccaaaacgaaactaaaaaacgacgcgctcacccgcaaaacgaacaaatcgatatcgtccaaactacgaacgaaaactaaatcgcccataacctccgtaaaaaacgaaacaccgaaaccgctcacgctccgactcgattactccactaccgccgtcgccgcttctcccccatcgaaaaaccccgaaaacgaactccaccgcgcctcccccgaaaaccgaaaaaaaaaaaaaccgacgcgaaaaccgacccaccgactaacaaacgctatctccccgaaaccaaccacccgaacctaccacctctcctacgcaaacgcgaaacgaccgcgcactaaaaaaataaaaacgcgaacgtaacgcgaacgcgccgaaaccccctccccctaaacgccgacacctacgcgcaaacgcaaacgaacaaacgaaaaacgcgcgcgaaaacgaaacgaccgcgcgaacctaacgtaaaaaaaataaacgacgaccgaaacgaccgcgaaacgcgccca

SEQ ID NO: 15859 - DNA, 585 bp, Artificial Sequence
  chemically treated genomic DNA (Homo sapiens) CpG-island No: 15859
aagttggtggagggggcgttcgggagtacgtgaggcgtgtagttatttcgtttttttttttgcggcggggataggaattagggcgaggttgggggacggcgcgtttattcgtagggcggataggtcgatgtcgtttaggttgcgggcgggggttgggtcgtttatggttttcgtggggaacggggtatcggggtcgtttacgtttcggttcggttattttattgtcgtcgtcgtcgttttttttttatcggagaatttcgggggcggattttatcgcgtttttttcggagatcggggagggggagggtcggcgcgaggatcgatttatcgattgataggcgttattttttcggagttagttattcgagtttattattttttttgcgtaggcgcggagcgatcgcgtattgggagggtggaagcgcgagcgtgacgcgagcgcgtcggggttttttttttttaggcgtcgatatttgcgcgtaggcgtaggcgagtaggcgaaaggcgcgcgcgaggacggagcgatcgcgcgagtttggcgtgaaagaagtgggcggcggtcgaggcggtcgcggagcgcgttta

SEQ ID NO: 15860 - DNA, 585 bp, Artificial Sequence
  chemically treated genomic DNA (Homo sapiens) CpG-island No: 15860
taaacgcgctccgcgaccgcctcgaccgccgcccacttctttcacgccaaactcgcgcgatcgctccgtcctcgcgcgcgcctttcgcctactcgcctacgcctacgcgcaaatatcgacgcctaaaaaaaaaaaaccccgacgcgctcgcgtcacgctcgcgcttccaccctcccaatacgcgatcgctccgcgcctacgcaaaaaaaataataaactcgaataactaactccgaaaaaataacgcctatcaatcgataaatcgatcctcgcgccgaccctccccctccccgatctccgaaaaaaacgcgataaaatccgcccccgaaattctccgataaaaaaaaaacgacgacgacgacaataaaataaccgaaccgaaacgtaaacgaccccgataccccgttccccacgaaaaccataaacgacccaacccccgcccgcaacctaaacgacatcgacctatccgccctacgaataaacgcgccgtcccccaacctcgccctaattcctatccccgccgcaaaaaaaaaaacgaaataactacacgcctcacgtactcccgaacgccccctccaccaactt

SEQ ID NO: 15861 - DNA, 806 bp, Artificial Sequence
  chemically treated genomic DNA (Homo sapiens) CpG-island No: 15861
tttgtagtcgttattatttttcgaaggtaaatatttcgcggtggagggtgcgcgggtgcggttgtgacgttagggttgttcgagttttcgtcggtttagcgggcggttacgtttttcgggttcggtgcgttcgcgggtggttgtttcgtaggtgcgcgcggtcggggttggcggcgattttttttatcgggtcgttcgggaggtttatgtagcgcggttgggtttcgcggcgttcggatcggggaagtgaaagtgtttcggaggaggagggtcggttcggtagtgtagtcgttttataggtcggcggacgggttaggcgggcggttttttgaatcgaatcgaatcggtttttcgggtcgtcgttttttcgttttttttcgttcgtcgtcggagttttttttcggttttttttaagatttttggttttttttcgacggagtcgggtttagtgcgggggcgtagggcgcgggagttttattttttcggttttttttgcgtttagaggttggtatggcgcgggtcgagtattgagcgtacggtcggggtatagtagggtcggggggtgtagttggttcgcgtttttttttcggtcgtcgtttttttcggttttcggcgaaagttattgagatattagttggacgttacgcgtcggagtatgtttgggagttagagcgaggtggttttattttcgtagagttcgcggagtttcgagatgggacgggatttgcggttcgggtttcgcgtgtttttgtttttgtttttgtttttgttggtgtatttgatttagttaggttagtcgggggcgg

SEQ ID NO: 15862 - DNA, 806 bp, Artificial Sequence
  chemically treated genomic DNA (Homo sapiens) CpG-island No: 15862
ccgcccccgactaacctaactaaatcaaatacaccaacaaaaacaaaaacaaaaacaaaaacacgcgaaacccgaaccgcaaatcccgtcccatctcgaaactccgcgaactctacgaaaataaaaccacctcgctctaactcccaaacatactccgacgcgtaacgtccaactaatatctcaataactttcgccgaaaaccgaaaaaaacgacgaccgaaaaaaaaacgcgaaccaactacaccccccgaccctactataccccgaccgtacgctcaatactcgacccgcgccataccaacctctaaacgcaaaaaaaaccgaaaaaataaaactcccgcgccctacgcccccgcactaaacccgactccgtcgaaaaaaaaccaaaaatcttaaaaaaaaccgaaaaaaaactccgacgacgaacgaaaaaaaacgaaaaaacgacgacccgaaaaaccgattcgattcgattcaaaaaaccgcccgcctaacccgtccgccgacctataaaacgactacactaccgaaccgaccctcctcctccgaaacactttcacttccccgatccgaacgccgcgaaacccaaccgcgctacataaacctcccgaacgacccgataaaaaaaatcgccgccaaccccgaccgcgcgcacctacgaaacaaccacccgcgaacgcaccgaacccgaaaaacgtaaccgcccgctaaaccgacgaaaactcgaacaaccctaacgtcacaaccgcacccgcgcaccctccaccgcgaaatatttaccttcgaaaaataataacgactacaaa

SEQ ID NO: 15863 - DNA, 806 bp, Artificial Sequence
  chemically treated genomic DNA (Homo sapiens) CpG-island No: 15863
tcgttttcggttaatttggttgagttaggtatattagtaggagtagaagtaggagtaggagtacgcgggattcgggtcgtaagtttcgttttatttcggggtttcgcggattttgcggggatggagttatttcgttttgatttttagatatgtttcggcgcgtgacgtttagttggtgttttaatggttttcgtcggggatcggaggagacggcggtcggagaggaggcgcgagttagttgtatttttcggttttgttgtgtttcgatcgtgcgtttagtattcggttcgcgttatgttagtttttggacgtagggaaagtcgaggaggtggagttttcgcgttttgcgttttcgtattgggttcggtttcgtcgagggaaggttaggaattttggaagaaatcgaaagaaaatttcggcggcgggcgaggaggggcgggaggacgacggttcgaggagtcgattcggttcggtttaggaggtcgttcgtttggttcgttcgtcgatttgtgaggcggttgtattgtcggatcggtttttttttttcgaggtatttttattttttcgattcgggcgtcgcgggatttagtcgcgttgtatgagtttttcgggcggttcggtggagagagtcgtcgttagtttcggtcgcgcgtatttgcggggtagttattcgcggacgtatcgagttcggggggcgtggtcgttcgttgagtcggcgagggttcgggtagttttgacgttataatcgtattcgcgtattttttatcgcgaggtatttattttcgaaaagtggtggcggttgtagg

SEQ ID NO: 15864 - DNA, 806 bp, Artificial Sequence
  chemically treated genomic DNA (Homo sapiens) CpG-island No: 15864
cctacaaccgccaccacttttcgaaaataaatacctcgcgataaaaaatacgcgaatacgattataacgtcaaaactacccgaaccctcgccgactcaacgaacgaccacgccccccgaactcgatacgtccgcgaataactaccccgcaaatacgcgcgaccgaaactaacgacgactctctccaccgaaccgcccgaaaaactcatacaacgcgactaaatcccgcgacgcccgaatcgaaaaaataaaaatacctcgaaaaaaaaaaaccgatccgacaatacaaccgcctcacaaatcgacgaacgaaccaaacgaacgacctcctaaaccgaaccgaatcgactcctcgaaccgtcgtcctcccgcccctcctcgcccgccgccgaaattttctttcgatttcttccaaaattcctaaccttccctcgacgaaaccgaacccaatacgaaaacgcaaaacgcgaaaactccacctcctcgactttccctacgtccaaaaactaacataacgcgaaccgaatactaaacgcacgatcgaaacacaacaaaaccgaaaaatacaactaactcgcgcctcctctccgaccgccgtctcctccgatccccgacgaaaaccattaaaacaccaactaaacgtcacgcgccgaaacatatctaaaaatcaaaacgaaataactccatccccgcaaaatccgcgaaaccccgaaataaaacgaaacttacgacccgaatcccgcgtactcctactcctacttctactcctactaatatacctaactcaaccaaattaaccgaaaacga

SEQ ID NO: 15865 - DNA, 1015 bp, Artificial Sequence
  chemically treated genomic DNA (Homo sapiens) CpG-island No: 15865
cgggagcggggtatttatcggtagttttcgtagcggaggcgcgtttttcgggcgtcgaggtagcgttcgcggttggaggggttcggggcgggcgtcgagttcgagggatgcgcgtagcgcggggtgtttcgggaggtagcggtcgggtacgttgggatcgacggcgcgggacgtttcgacgtcgggtagtatttattcgtcgtatcgagagagttacgcggtttcgcggttttgtagggtatagggcggttttttgttcggggttttcggtggcgtattgggcggcggggcgggtcgagggtagcgggggcgggataggatagacgagaatttcgcggaggtgaggtcgggggtcgtttcgttttcgagggtaggttttgagtttcggtttcgtttcggtcggtttcgtttcggtcggggcgtgggtttcggttgtagtttcggtttgtttttttggtttcggaattttcgcgggcgttggtttcgtttgttagggtgagggggtcgggaaggggcgcgcgggggtttcgggtttcggaaatcgggcggggacggaacgggttcgggttgcggggtttttagatttagtcgtacgtttagatttcgggatttttattttcggttgggatcgcgtaatttttttattttcgtttggatttttgttttcggttcgtttggtttggcgtgagtttcgtagtcgcgcgtttttcggattatttagggtcgttttttcgcgtagttgttgcgtcgttttaggtcggagtttttcgggtttggttgggtgtttttcggggttttggttacgggacggggcggggggcggggggcgggattgggattgtggatgaaggattaaggtaggggatgggggttcgaaggggtcggtggggcgttgtaaattggttaggcgttattcgcgggcggttaggaggtcgtgggggaagaggaggatttggaagagatggaggatttgcgggagttaggatggggggcgggttttgtaggatagttcgtt

SEQ ID NO: 15866 - DNA, 1015 bp, Artificial Sequence
  chemically treated genomic DNA (Homo sapiens) CpG-island No: 15866
aacgaactatcctacaaaacccgccccccatcctaactcccgcaaatcctccatctcttccaaatcctcctcttcccccacgacctcctaaccgcccgcgaataacgcctaaccaatttacaacgccccaccgaccccttcgaacccccatcccctaccttaatccttcatccacaatcccaatcccgccccccgccccccgccccgtcccgtaaccaaaaccccgaaaaacacccaaccaaacccgaaaaactccgacctaaaacgacgcaacaactacgcgaaaaaacgaccctaaataatccgaaaaacgcgcgactacgaaactcacgccaaaccaaacgaaccgaaaacaaaaatccaaacgaaaataaaaaaattacgcgatcccaaccgaaaataaaaatcccgaaatctaaacgtacgactaaatctaaaaaccccgcaacccgaacccgttccgtccccgcccgatttccgaaacccgaaacccccgcgcgccccttcccgaccccctcaccctaacaaacgaaaccaacgcccgcgaaaattccgaaaccaaaaaaacaaaccgaaactacaaccgaaacccacgccccgaccgaaacgaaaccgaccgaaacgaaaccgaaactcaaaacctaccctcgaaaacgaaacgacccccgacctcacctccgcgaaattctcgtctatcctatcccgcccccgctaccctcgacccgccccgccgcccaatacgccaccgaaaaccccgaacaaaaaaccgccctataccctacaaaaccgcgaaaccgcgtaactctctcgatacgacgaataaatactacccgacgtcgaaacgtcccgcgccgtcgatcccaacgtacccgaccgctacctcccgaaacaccccgcgctacgcgcatccctcgaactcgacgcccgccccgaacccctccaaccgcgaacgctacctcgacgcccgaaaaacgcgcctccgctacgaaaactaccgataaataccccgctcccg

SEQ ID NO: 15867 - DNA, 1015 bp, Artificial Sequence
  chemically treated genomic DNA (Homo sapiens) CpG-island No: 15867
ggcgagttgttttgtagaattcgttttttattttaattttcgtaggttttttattttttttagatttttttttttttttacggttttttgatcgttcgcggatgacgtttgattagtttgtaacgttttatcgattttttcgagtttttattttttattttagttttttatttataattttagtttcgtttttcgtttttcgtttcgtttcgtaattagagtttcggggaatatttagttaggttcggaaggtttcgatttggggcggcgtagtagttgcgcggggaagcggttttgggtggttcggagagcgcgcggttacggggtttacgttaggttaggcgggtcgggggtaggggtttaggcgggaatgaggaagttacgcgattttagtcgggggtagaaatttcgaaatttgagcgtgcgattgagtttggaggtttcgtagttcgagttcgtttcgttttcgttcgattttcgagattcgggattttcgcgcgttttttttcggtttttttattttggtagacggagttagcgttcgcgggggtttcggagttaagagagtagatcggagttgtagtcggagtttacgtttcggtcgaggcggggtcggtcgaggcggggtcggggtttagggtttgttttcgggggcggggcggttttcggttttattttcgcgggattttcgtttgttttgtttcgttttcgttgttttcggttcgtttcgtcgtttagtgcgttatcgagagtttcgggtagggggtcgttttgtgttttgtagggtcgcggggtcgcgtagttttttcggtgcggcgggtaagtgttgttcggcgtcggggcgtttcgcgtcgtcggttttagcgtgttcggtcgttgtttttcggggtatttcgcgttgcgcgtatttttcgggttcggcgttcgtttcgggtttttttagtcgcgggcgttgtttcggcgttcgggggacgcgttttcgttgcgggagttgtcggtaggtgtttcgttttcg

SEQ ID NO: 15868 - DNA, 1015 bp, Artificial Sequence
  chemically treated genomic DNA (Homo sapiens) CpG-island No: 15868
cgaaaacgaaacacctaccgacaactcccgcaacgaaaacgcgtcccccgaacgccgaaacaacgcccgcgactaaaaaaacccgaaacgaacgccgaacccgaaaaatacgcgcaacgcgaaataccccgaaaaacaacgaccgaacacgctaaaaccgacgacgcgaaacgccccgacgccgaacaacacttacccgccgcaccgaaaaaactacgcgaccccgcgaccctacaaaacacaaaacgaccccctacccgaaactctcgataacgcactaaacgacgaaacgaaccgaaaacaacgaaaacgaaacaaaacaaacgaaaatcccgcgaaaataaaaccgaaaaccgccccgcccccgaaaacaaaccctaaaccccgaccccgcctcgaccgaccccgcctcgaccgaaacgtaaactccgactacaactccgatctactctcttaactccgaaacccccgcgaacgctaactccgtctaccaaaataaaaaaaccgaaaaaaaacgcgcgaaaatcccgaatctcgaaaatcgaacgaaaacgaaacgaactcgaactacgaaacctccaaactcaatcgcacgctcaaatttcgaaatttctacccccgactaaaatcgcgtaacttcctcattcccgcctaaacccctacccccgacccgcctaacctaacgtaaaccccgtaaccgcgcgctctccgaaccacccaaaaccgcttccccgcgcaactactacgccgccccaaatcgaaaccttccgaacctaactaaatattccccgaaactctaattacgaaacgaaacgaaaaacgaaaaacgaaactaaaattataaataaaaaactaaaataaaaaataaaaactcgaaaaaatcgataaaacgttacaaactaatcaaacgtcatccgcgaacgatcaaaaaaccgtaaaaaaaaaaaaaaatctaaaaaaaataaaaaacctacgaaaattaaaataaaaaacgaattctacaaaacaactcgcc

SEQ ID NO: 15869 - DNA, 1102 bp, Artificial Sequence
  chemically treated genomic DNA (Homo sapiens) CpG-island No: 15869
aaggagttcggtcgtcgtttttagtttgttagcgtagtttcgggtgagggggcgttttcgggtttcggttttttcgttcgttcggtagtcgtattttcggcgttcgttgtttagtatatttgcgggttcggtttttagtgttttagtttcgcgttgcggtgttttcgcggtcggttatttcgtttcggtgtagggattagggtatcggtcgttattggtttttatcgtaatgttttgaaagacgttttcggtcgtggttgtttagacgtatttggcgtcgtagtagtcgataatggcggttttttggtagtagttatcgtatattaggttatttacgtagttttgttaatcggttattttcgagtttttcgtattgtagcgcggacggcgaggagtagtaggcgtagcggcggcggcggcggtagcgggcggcggcggcgcggggggaggcggggcgggggcggggaggaggcggttttgcgtaggtatcgatcgttttttttttcgaggagttgcggcgggaggacgcgggtttagcgatgagggacgaattttagagcgcgttcggtcgttcggtcgttcgtagtcgcggggttgataaattagcggcgggaggttgcgaagcggttgtgtttgtggcggttgttttttatcgtagcgtttttcgtttttcgcggatacggttgggcgtgcgcgcgcgcgtgcgtgcgattttttcgcggcgttcgggtacggagggtttcgggaagggcggggggagattgaggcgggggcgcggagggatatcgtttcgggataattacggtcgttacgtgcgggaggcgtcggtcgggagcggtggcgggtcgagtttcggatttcgggtcggcggagagggtggatttcgcgtcgttttcggtattttaggaatagcggcggtacggacgttttggagtttcgcggtcgggtcgcgatgtgttttttttttgtgttcgttgttcgggatgcggaattttgagtttcggtgtcgggttatagagttgttttggtgacgggatgcggagcgtttttttttttttgttgtgggggcggttggtggtaggggtagttggtggtagggttg

SEQ ID NO: 15870 - DNA, 1102 bp, Artificial Sequence
  chemically treated genomic DNA (Homo sapiens) CpG-island No: 15870
caaccctaccaccaactacccctaccaccaaccgcccccacaacaaaaaaaaaaaaacgctccgcatcccgtcaccaaaacaactctataacccgacaccgaaactcaaaattccgcatcccgaacaacgaacacaaaaaaaaaacacatcgcgacccgaccgcgaaactccaaaacgtccgtaccgccgctattcctaaaataccgaaaacgacgcgaaatccaccctctccgccgacccgaaatccgaaactcgacccgccaccgctcccgaccgacgcctcccgcacgtaacgaccgtaattatcccgaaacgatatccctccgcgcccccgcctcaatctccccccgcccttcccgaaaccctccgtacccgaacgccgcgaaaaaatcgcacgcacgcgcgcgcgcacgcccaaccgtatccgcgaaaaacgaaaaacgctacgataaaaaacaaccgccacaaacacaaccgcttcgcaacctcccgccgctaatttatcaaccccgcgactacgaacgaccgaacgaccgaacgcgctctaaaattcgtccctcatcgctaaacccgcgtcctcccgccgcaactcctcgaaaaaaaaaacgatcgatacctacgcaaaaccgcctcctccccgcccccgccccgcctccccccgcgccgccgccgcccgctaccgccgccgccgccgctacgcctactactcctcgccgtccgcgctacaatacgaaaaactcgaaaataaccgattaacaaaactacgtaaataacctaatatacgataactactaccaaaaaaccgccattatcgactactacgacgccaaatacgtctaaacaaccacgaccgaaaacgtctttcaaaacattacgataaaaaccaataacgaccgataccctaatccctacaccgaaacgaaataaccgaccgcgaaaacaccgcaacgcgaaactaaaacactaaaaaccgaacccgcaaatatactaaacaacgaacgccgaaaatacgactaccgaacgaacgaaaaaaccgaaacccgaaaacgccccctcacccgaaactacgctaacaaactaaaaacgacgaccgaactcctt

SEQ ID NO: 15871 - DNA, 1102 bp, Artificial Sequence
  chemically treated genomic DNA (Homo sapiens) CpG-island No: 15871
taattttgttattagttgtttttgttattagtcgtttttataataaaaaggaggaaacgtttcgtatttcgttattaggataattttgtaattcgatatcgaggtttaagatttcgtatttcgggtagcgaatataggagaaaagtatatcgcggttcggtcgcggggttttaaggcgttcgtgtcgtcgttgtttttggggtgtcgagagcgacgcggggtttatttttttcgtcggttcgaggttcgaagttcggttcgttatcgttttcggtcggcgtttttcgtacgtggcggtcgtgattgtttcggggcggtattttttcgcgttttcgttttagttttttttcgtttttttcgggatttttcgtgttcgggcgtcgcggaaggatcgtacgtacgcgcgcgcgtacgtttagtcgtgttcgcggaaaacggagggcgttgcggtaaggagtagtcgttataggtatagtcgtttcgtagtttttcgtcgttggtttgttagtttcgcggttgcgggcggtcgggcggtcgagcgcgttttgaggttcgttttttatcgttgaattcgcgttttttcgtcgtagtttttcggggaggggggcggtcggtgtttgcgtagagtcgtttttttttcgttttcgtttcgttttttttcgcgtcgtcgtcgttcgttatcgtcgtcgtcgtcgttgcgtttgttgtttttcgtcgttcgcgttgtagtgcgaagggttcgaagatggtcggttggtagagttacgtggataatttgatgtgcgatggttgttgttaggaggtcgttattgtcggttattgcgacgttaaatacgtttgggtagttacggtcgggggcgttttttagagtattacggtgaggattagtggcggtcggtattttggtttttgtatcggagcggggtggtcggtcgcgggggtatcgtagcgcggggttggaatattgagggtcgagttcgtaggtgtgttaggtagcgggcgtcgaggatgcggttgtcgggcgggcggggaggtcgaggttcggggacgtttttttattcggggttgcgttgataggttgggggcggcggtcggatttttt

SEQ ID NO: 15872 - DNA, 1102 bp, Artificial Sequence
  chemically treated genomic DNA (Homo sapiens) CpG-island No: 15872
aaaaaatccgaccgccgcccccaacctatcaacgcaaccccgaataaaaaaacgtccccgaacctcgacctccccgcccgcccgacaaccgcatcctcgacgcccgctacctaacacacctacgaactcgaccctcaatattccaaccccgcgctacgatacccccgcgaccgaccaccccgctccgatacaaaaaccaaaataccgaccgccactaatcctcaccgtaatactctaaaaaacgcccccgaccgtaactacccaaacgtatttaacgtcgcaataaccgacaataacgacctcctaacaacaaccatcgcacatcaaattatccacgtaactctaccaaccgaccatcttcgaacccttcgcactacaacgcgaacgacgaaaaacaacaaacgcaacgacgacgacgacgataacgaacgacgacgacgcgaaaaaaaacgaaacgaaaacgaaaaaaaaacgactctacgcaaacaccgaccgcccccctccccgaaaaactacgacgaaaaaacgcgaattcaacgataaaaaacgaacctcaaaacgcgctcgaccgcccgaccgcccgcaaccgcgaaactaacaaaccaacgacgaaaaactacgaaacgactatacctataacgactactccttaccgcaacgccctccgttttccgcgaacacgactaaacgtacgcgcgcgcgtacgtacgatccttccgcgacgcccgaacacgaaaaatcccgaaaaaaacgaaaaaaaactaaaacgaaaacgcgaaaaaataccgccccgaaacaatcacgaccgccacgtacgaaaaacgccgaccgaaaacgataacgaaccgaacttcgaacctcgaaccgacgaaaaaaataaaccccgcgtcgctctcgacaccccaaaaacaacgacgacacgaacgccttaaaaccccgcgaccgaaccgcgatatacttttctcctatattcgctacccgaaatacgaaatcttaaacctcgatatcgaattacaaaattatcctaataacgaaatacgaaacgtttcctcctttttattataaaaacgactaataacaaaaacaactaataacaaaatta

SEQ ID NO: 15873 - DNA, 543 bp, Artificial Sequence
  chemically treated genomic DNA (Homo sapiens) CpG-island No: 15873
tttttgcgtttcgtaggcggtcgtagttcgcgggtcgattcgggggaatggtaggaatgcgcgggcgtcgggcggaagaggtcgcggcggtcgggttagttggggagggagggtcgggtcggcgggcgcggcgtggggcgtgggggcggtcggggttcgggagcgcgagggcgtagggttcgcggaagttaggttagttgacgcgggcgggcgagtcgggtaggggagcggggtttcgagtttatttttcgtattcggtttgcggcgcgttcggggttcggttttgggttttgttacgtggttttattttttttttttttcgcgggaggtttagggtcgtttttattttttttcggtttagaattagtttcgtagtttttttattttcgtttttttcggattttttatttttagttcgttttttttcgtgggttgcgtcgcgcgttgtagagttcggggagcgttagtttgggttatttcggtttttttttttttacgagagtttttgatttttgttgagttttttttgggttttttttagtt

SEQ ID NO: 15874 - DNA, 543 bp, Artificial Sequence
  chemically treated genomic DNA (Homo sapiens) CpG-island No: 15874
aactaaaaaaaacccaaaaaaaactcaacaaaaatcaaaaactctcgtaaaaaaaaaaaaaccgaaataacccaaactaacgctccccgaactctacaacgcgcgacgcaacccacgaaaaaaaacgaactaaaaataaaaaatccgaaaaaaacgaaaataaaaaaactacgaaactaattctaaaccgaaaaaaaataaaaacgaccctaaacctcccgcgaaaaaaaaaaaaaataaaaccacgtaacaaaacccaaaaccgaaccccgaacgcgccgcaaaccgaatacgaaaaataaactcgaaaccccgctcccctacccgactcgcccgcccgcgtcaactaacctaacttccgcgaaccctacgccctcgcgctcccgaaccccgaccgcccccacgccccacgccgcgcccgccgacccgaccctccctccccaactaacccgaccgccgcgacctcttccgcccgacgcccgcgcattcctaccattcccccgaatcgacccgcgaactacgaccgcctacgaaacgcaaaaa

SEQ ID NO: 15875 - DNA, 543 bp, Artificial Sequence
  chemically treated genomic DNA (Homo sapiens) CpG-island No: 15875
aattaagggaagtttagggaaaatttagtagaaattaaggattttcgtgagaaaaaaggaatcgaaatagtttagattggcgtttttcggattttgtagcgcgcggcgtaatttacggaggggggcgggttgggagtgggggattcgggggagacgaaggtgaaggagttgcggggttagttttgagtcgggaaaaggtgagggcggttttgggtttttcgcgggggaaggaagagatgaagttacgtgatagggtttaaagtcgggtttcgagcgcgtcgtagatcggatgcgggaagtgggttcggggtttcgtttttttgttcggttcgttcgttcgcgttagttgatttggttttcgcgggttttgcgttttcgcgttttcgggtttcggtcgtttttacgttttacgtcgcgttcgtcggttcggttttttttttttagttggttcggtcgtcgcggtttttttcgttcggcgttcgcgtatttttgttattttttcgagtcggttcgcgggttacggtcgtttgcggagcgtaggaa

SEQ ID NO: 15876 - DNA, 543 bp, Artificial Sequence
  chemically treated genomic DNA (Homo sapiens) CpG-island No: 15876
ttcctacgctccgcaaacgaccgtaacccgcgaaccgactcgaaaaaataacaaaaatacgcgaacgccgaacgaaaaaaaccgcgacgaccgaaccaactaaaaaaaaaaaaccgaaccgacgaacgcgacgtaaaacgtaaaaacgaccgaaacccgaaaacgcgaaaacgcaaaacccgcgaaaaccaaatcaactaacgcgaacgaacgaaccgaacaaaaaaacgaaaccccgaacccacttcccgcatccgatctacgacgcgctcgaaacccgactttaaaccctatcacgtaacttcatctcttccttcccccgcgaaaaacccaaaaccgccctcaccttttcccgactcaaaactaaccccgcaactccttcaccttcgtctcccccgaatcccccactcccaacccgcccccctccgtaaattacgccgcgcgctacaaaatccgaaaaacgccaatctaaactatttcgattccttttttctcacgaaaatccttaatttctactaaattttccctaaacttcccttaatt

SEQ ID NO: 15877 - DNA, 502 bp, Artificial Sequence
  chemically treated genomic DNA (Homo sapiens) CpG-island No: 15877
gaaggtaatatttgcggtattatttgtattagacgtttattagtaatacgatgtatttttttcggcgttatcgggttagcgtcgttacgatttgttttttatagtagtagtagataacgtaaacgttgtttttttgtagtcggacgcgtttgaattatagtataagcgcgttgggtatcgagttttacggaagagataatcgcgatcggatagtttttcgggaaacgatcgtttagatcggaagttattagtatattattaatacgaatattcgtattcgtcggtagatgtttaagttgtaaattattcgtataatcgttatcggttgtaattacgcggatatcgttgcgtagtatttggattggtagcgcgtgggtcgtattataaattagtagtacgcgattggttagtttagcgacggttattatttgattaataatatttttgtcgttgatgatcggttggtttttataaacgttattaacgttatttttatcgataa

SEQ ID NO: 15878 - DNA, 502 bp, Artificial Sequence
  chemically treated genomic DNA (Homo sapiens) CpG-island No: 15878
ttatcgataaaaataacgttaataacgtttataaaaaccaaccgatcatcaacgacaaaaatattattaatcaaataataaccgtcgctaaactaaccaatcgcgtactactaatttataatacgacccacgcgctaccaatccaaatactacgcaacgatatccgcgtaattacaaccgataacgattatacgaataatttacaacttaaacatctaccgacgaatacgaatattcgtattaataatatactaataacttccgatctaaacgatcgtttcccgaaaaactatccgatcgcgattatctcttccgtaaaactcgatacccaacgcgcttatactataattcaaacgcgtccgactacaaaaaaacaacgtttacgttatctactactactataaaaaacaaatcgtaacgacgctaacccgataacgccgaaaaaaatacatcgtattactaataaacgtctaatacaaataataccgcaaatattaccttc

SEQ ID NO: 15879 - DNA, 502 bp, Artificial Sequence
  chemically treated genomic DNA (Homo sapiens) CpG-island No: 15879
ttatcgataaaggtagcgttaatggcgtttatgaaggttagtcggttattagcgataaaggtgttgttggttaggtggtggtcgtcgttaaattgattagtcgcgtgttgttgatttgtgatgcgatttacgcgttgttaatttaggtgttgcgtaacgatattcgcgtaattgtagtcggtaacggttgtacggatgatttgtagtttgagtatttgtcggcgaatacggatattcgtgttggtgatgtgttggtgattttcggtttgggcggtcgtttttcggaaggttattcggtcgcggttgtttttttcgtaaaattcgatatttagcgcgtttatattgtgatttaggcgcgttcgattgtaggaaagtaacgtttgcgttatttgttgttgttgtggggggtagatcgtaacggcgttaattcgatgacgtcggaagaggtgtatcgtgttgttaatgaacgtttgatgtagatgatgtcgtaggtattgttttt

SEQ ID NO: 15880 - DNA, 502 bp, Artificial Sequence
  chemically treated genomic DNA (Homo sapiens) CpG-island No: 15880
aaaaacaatacctacgacatcatctacatcaaacgttcattaacaacacgatacacctcttccgacgtcatcgaattaacgccgttacgatctaccccccacaacaacaacaaataacgcaaacgttactttcctacaatcgaacgcgcctaaatcacaatataaacgcgctaaatatcgaattttacgaaaaaaacaaccgcgaccgaataaccttccgaaaaacgaccgcccaaaccgaaaatcaccaacacatcaccaacacgaatatccgtattcgccgacaaatactcaaactacaaatcatccgtacaaccgttaccgactacaattacgcgaatatcgttacgcaacacctaaattaacaacgcgtaaatcgcatcacaaatcaacaacacgcgactaatcaatttaacgacgaccaccacctaaccaacaacacctttatcgctaataaccgactaaccttcataaacgccattaacgctacctttatcgataa

SEQ ID NO: 15881 - DNA, 513 bp, Artificial Sequence
  chemically treated genomic DNA (Homo sapiens) CpG-island No: 15881
gcgttttcgtttgcgtatgtgtagttaattttatttttcggtttttttttgttagtgtttgttggtgtagagggttcgtagtttaggtgagagcgtcgggtttttacgcggattgcggatttgtagggagggatgtgttagtgtttagggggcgggaacgcgacgtttcgggaatttttttaaagtaggtcgtcgttttttgtgtttcggtcggttcgggattttagtttgagaagggtcggtgggggcgggtttcgggggcgttaggtggggttgagttttagttggaagatgttcggtgcgggtcgaggtatgggcgttagaatgtagttaggcgtcggaaaacgcggtgttggttttaggaggggaatgcgcgtttattgtattgattatgaatttgttataaagcgcgtatagttcgtgggtttgcggtgagaggtcgagtttaggagttagaaggatttcgtgaattttggttttgttatttgagcgtttgaaaatgaggatattagt

SEQ ID NO: 15882 - DNA, 513 bp, Artificial Sequence
  chemically treated genomic DNA (Homo sapiens) CpG-island No: 15882
actaatatcctcattttcaaacgctcaaataacaaaaccaaaattcacgaaatccttctaactcctaaactcgacctctcaccgcaaacccacgaactatacgcgctttataacaaattcataatcaatacaataaacgcgcattcccctcctaaaaccaacaccgcgttttccgacgcctaactacattctaacgcccatacctcgacccgcaccgaacatcttccaactaaaactcaaccccacctaacgcccccgaaacccgcccccaccgacccttctcaaactaaaatcccgaaccgaccgaaacacaaaaaacgacgacctactttaaaaaaattcccgaaacgtcgcgttcccgccccctaaacactaacacatccctccctacaaatccgcaatccgcgtaaaaacccgacgctctcacctaaactacgaaccctctacaccaacaaacactaacaaaaaaaaaccgaaaaataaaattaactacacatacgcaaacgaaaacgc

SEQ ID NO: 15883 - DNA, 513 bp, Artificial Sequence
  chemically treated genomic DNA (Homo sapiens) CpG-island No: 15883
attaatatttttatttttaaacgtttaagtgatagagttaaaatttacgaggtttttttagtttttaggttcggttttttatcgtagatttacgggttgtacgcgttttgtggtaggtttatggttaatataataaacgcgtattttttttttgaagttagtatcgcgtttttcgacgtttggttgtattttggcgtttatatttcggttcgtatcgagtattttttaattaggatttagttttatttaacgttttcggagttcgtttttatcggttttttttaggttgaggtttcgggtcggtcgaggtatagggagcgacggtttgttttgggggagttttcgggacgtcgcgttttcgttttttggatattagtatatttttttttgtaggttcgtaattcgcgtggaggttcggcgtttttatttgagttgcgaattttttgtattagtaaatattaatagggagaagtcggaaagtggggttgattgtatatgcgtagacgaaaacgt

SEQ ID NO: 15884 - DNA, 513 bp, Artificial Sequence
  chemically treated genomic DNA (Homo sapiens) CpG-island No: 15884
acgttttcgtctacgcatatacaatcaaccccactttccgacttctccctattaatatttactaatacaaaaaattcgcaactcaaataaaaacgccgaacctccacgcgaattacgaacctacaaaaaaaaatatactaatatccaaaaaacgaaaacgcgacgtcccgaaaactcccccaaaacaaaccgtcgctccctatacctcgaccgacccgaaacctcaacctaaaaaaaaccgataaaaacgaactccgaaaacgttaaataaaactaaatcctaattaaaaaatactcgatacgaaccgaaatataaacgccaaaatacaaccaaacgtcgaaaaacgcgatactaacttcaaaaaaaaaatacgcgtttattatattaaccataaacctaccacaaaacgcgtacaacccgtaaatctacgataaaaaaccgaacctaaaaactaaaaaaacctcgtaaattttaactctatcacttaaacgtttaaaaataaaaatattaat

SEQ ID NO: 15885 - DNA, 792 bp, Artificial Sequence
  chemically treated genomic DNA (Homo sapiens) CpG-island No: 15885
gcgcgggcggtttttttttttaataatgtttgttcgtcgtggacggattttattttttttttttgttttttattttgagagttgagttagaatcgttcgtggggtttatttcgatagtttttaggttcgcgtcgcgtcgcggaaatcgtgatttgttaggttttatttttgtacgtttcgtttcgtttttcgcgtttaatttttgcgcgtttcgtttcggttcgcgttgatagagcggatttaggttttcggtcgtttcgcgttatggtcgcgtcggtttcggttacgcggtaggttagcggcgtcgtcgttttggtttcggtttcgagcggtttcgatagcgggtagtttttggcggtcgtcgtggtcgagttgtcggtgttggacgttcgcgggtagcgggtatcgttcggcgcgttgtttcgggagcgtcgcgtcgtggtggtgttcgtgcgggtgagcgggcggcggggttggaagggaagcgcggtttagggtttcgggtaggttgtcgggatgcgagtcgcgttttttgttttttaggacggaaacgggaaggtagtttgtttagtcgcggtcgttttttaattagggcggggtagggagagggcgagggcgaggttcgttttttacgcgtcgggcgttcgagtcgtcggtttcggtttcgcgggcgtcgtttttgttcgcgttacgtacggcgaagtatagggatttttcggggttcgagggtgttgttttattaatttgttttttttgtcgttttggtttttagtattttttgtgttatatttg

SEQ ID NO: 15886 - DNA, 792 bp, Artificial Sequence
  chemically treated genomic DNA (Homo sapiens) CpG-island No: 15886
caaatataacacaaaaaatactaaaaaccaaaacgacaaaaaaaacaaattaataaaacaacaccctcgaaccccgaaaaatccctatacttcgccgtacgtaacgcgaacaaaaacgacgcccgcgaaaccgaaaccgacgactcgaacgcccgacgcgtaaaaaacgaacctcgccctcgccctctccctaccccgccctaattaaaaaacgaccgcgactaaacaaactaccttcccgtttccgtcctaaaaaacaaaaaacgcgactcgcatcccgacaacctacccgaaaccctaaaccgcgcttcccttccaaccccgccgcccgctcacccgcacgaacaccaccacgacgcgacgctcccgaaacaacgcgccgaacgatacccgctacccgcgaacgtccaacaccgacaactcgaccacgacgaccgccaaaaactacccgctatcgaaaccgctcgaaaccgaaaccaaaacgacgacgccgctaacctaccgcgtaaccgaaaccgacgcgaccataacgcgaaacgaccgaaaacctaaatccgctctatcaacgcgaaccgaaacgaaacgcgcaaaaattaaacgcgaaaaacgaaacgaaacgtacaaaaataaaacctaacaaatcacgatttccgcgacgcgacgcgaacctaaaaactatcgaaataaaccccacgaacgattctaactcaactctcaaaataaaaaacaaaaaaaaaaaataaaatccgtccacgacgaacaaacattattaaaaaaaaaaaccgcccgcgc

SEQ ID NO: 15887 - DNA, 792 bp, Artificial Sequence
  chemically treated genomic DNA (Homo sapiens) CpG-island No: 15887
tagatgtaatataggaaatgttgaaagttaaaacggtagaaagggtaagttagtaaagtagtattttcgggtttcgaaggatttttgtatttcgtcgtgcgtgacgcgagtaaaggcgacgttcgcggggtcgggatcggcggttcgggcgttcggcgcgtgggaagcgggtttcgttttcgttttttttttgtttcgttttagttgggaagcggtcgcgattgggtaggttgttttttcgttttcgttttaagaagtaggaggcgcggttcgtatttcggtagtttgttcgggattttgggtcgcgttttttttttagtttcgtcgttcgtttattcgtacgaatattattacggcgcggcgttttcggaatagcgcgtcgaacggtattcgttgttcgcgggcgtttagtatcggtagttcggttacggcggtcgttaggggttgttcgttgtcggggtcgttcggggtcgggattagggcggcggcgtcgttaatttgtcgcgtgatcggggtcggcgcggttatgacgcggggcggtcgagggtttgggttcgttttgttagcgcggatcggggcggggcgcgtagaggttgggcgcggggggcggggcggggcgtgtagaggtggggtttggtaagttacggttttcgcggcgcggcgcgggtttgggagttgtcggagtgaattttacgggcggttttgatttagtttttagggtaggggatagagagagaaagtaaggttcgtttacggcgagtaagtattattgaggaagaaagtcgttcgcgt

SEQ ID NO: 15888 - DNA, 792 bp, Artificial Sequence
  chemically treated genomic DNA (Homo sapiens) CpG-island No: 15888
acgcgaacgactttcttcctcaataatacttactcgccgtaaacgaaccttactttctctctctatcccctaccctaaaaactaaatcaaaaccgcccgtaaaattcactccgacaactcccaaacccgcgccgcgccgcgaaaaccgtaacttaccaaaccccacctctacacgccccgccccgccccccgcgcccaacctctacgcgccccgccccgatccgcgctaacaaaacgaacccaaaccctcgaccgccccgcgtcataaccgcgccgaccccgatcacgcgacaaattaacgacgccgccgccctaatcccgaccccgaacgaccccgacaacgaacaacccctaacgaccgccgtaaccgaactaccgatactaaacgcccgcgaacaacgaataccgttcgacgcgctattccgaaaacgccgcgccgtaataatattcgtacgaataaacgaacgacgaaactaaaaaaaaaacgcgacccaaaatcccgaacaaactaccgaaatacgaaccgcgcctcctacttcttaaaacgaaaacgaaaaaacaacctacccaatcgcgaccgcttcccaactaaaacgaaacaaaaaaaaaacgaaaacgaaacccgcttcccacgcgccgaacgcccgaaccgccgatcccgaccccgcgaacgtcgcctttactcgcgtcacgcacgacgaaatacaaaaatccttcgaaacccgaaaatactactttactaacttaccctttctaccgttttaactttcaacatttcctatattacatcta

SEQ ID NO: 15889 - DNA, 601 bp, Artificial Sequence
  chemically treated genomic DNA (Homo sapiens) CpG-island No: 15889
cggcgagcgtgatagcgttcggttcgattttgtttagatgtttatagaagatggagttgacgaggttgattagaaagattattaattgcgtaagaaattgcggaggcgcggaaagtaaggcgcgtttatagtcgtttttttttttggaagttcgcgtttatttttgcgcggcggtcgtttcggaggcgtcgggttgggcgtgaggacgtcgtatttattattgggttcgcgagcgtcgttagtttagtcgttttttttcgtaggttcgggggtagcgtatttcgtaggttttataagtcgttacgttattcgagggttcggagtcgttatgggggtcggtttttggcggcggcggggagttcggcggggatcggggcgtcggcggtcgtaggggtttttatgcggaggttgggagcggttggcggcggcgcgggcgcgggatcgtagcgcggtgtgggggtgaggggggcgattcgattttatttagtttcgttttttttcgtttcggatcggttttagacgtttagggtaatggtcgtcgttcgtagaattttgggggagggtatcgggagggtttttgggggtttatgaagggggttcg

SEQ ID NO: 15890 - DNA, 601 bp, Artificial Sequence
  chemically treated genomic DNA (Homo sapiens) CpG-island No: 15890
cgaacccccttcataaacccccaaaaaccctcccgataccctcccccaaaattctacgaacgacgaccattaccctaaacgtctaaaaccgatccgaaacgaaaaaaaacgaaactaaataaaatcgaatcgcccccctcacccccacaccgcgctacgatcccgcgcccgcgccgccgccaaccgctcccaacctccgcataaaaacccctacgaccgccgacgccccgatccccgccgaactccccgccgccgccaaaaaccgacccccataacgactccgaaccctcgaataacgtaacgacttataaaacctacgaaatacgctacccccgaacctacgaaaaaaaacgactaaactaacgacgctcgcgaacccaataataaatacgacgtcctcacgcccaacccgacgcctccgaaacgaccgccgcgcaaaaataaacgcgaacttccaaaaaaaaaaacgactataaacgcgccttactttccgcgcctccgcaatttcttacgcaattaataatctttctaatcaacctcgtcaactccatcttctataaacatctaaacaaaatcgaaccgaacgctatcacgctcgccg

SEQ ID NO: 15891 - DNA, 601 bp, Artificial Sequence
  chemically treated genomic DNA (Homo sapiens) CpG-island No: 15891
cgagttttttttataagtttttaagggttttttcggtgtttttttttagagttttgcgggcggcgattattgttttgggcgtttggagtcggttcgggacggggaggggcggggttgggtgggatcgggtcgttttttttatttttatatcgcgttgcggtttcgcgttcgcgtcgtcgttagtcgtttttagttttcgtatggaggtttttgcggtcgtcgacgtttcggttttcgtcgagtttttcgtcgtcgttaaggatcggtttttatagcggtttcgggttttcggatggcgtgacggtttgtggggtttgcggggtgcgttgttttcggatttgcggggggaggcggttgagttggcggcgttcgcgggtttagtggtgagtgcggcgtttttacgtttagttcgacgttttcggagcggtcgtcgcgtaggggtgggcgcgggtttttaggagggagggcggttgtgaacgcgttttgtttttcgcgttttcgtagttttttgcgtagttgatgatttttttaattagtttcgttagttttattttttgtggatatttgggtaaggtcgagtcggacgttgttacgttcgtcg

SEQ ID NO: 15892 - DNA, 601 bp, Artificial Sequence
  chemically treated genomic DNA (Homo sapiens) CpG-island No: 15892
cgacgaacgtaacaacgtccgactcgaccttacccaaatatccacaaaaaataaaactaacgaaactaattaaaaaaatcatcaactacgcaaaaaactacgaaaacgcgaaaaacaaaacgcgttcacaaccgccctccctcctaaaaacccgcgcccacccctacgcgacgaccgctccgaaaacgtcgaactaaacgtaaaaacgccgcactcaccactaaacccgcgaacgccgccaactcaaccgcctccccccgcaaatccgaaaacaacgcaccccgcaaaccccacaaaccgtcacgccatccgaaaacccgaaaccgctataaaaaccgatccttaacgacgacgaaaaactcgacgaaaaccgaaacgtcgacgaccgcaaaaacctccatacgaaaactaaaaacgactaacgacgacgcgaacgcgaaaccgcaacgcgatataaaaataaaaaaaacgacccgatcccacccaaccccgcccctccccgtcccgaaccgactccaaacgcccaaaacaataatcgccgcccgcaaaactctaaaaaaaaacaccgaaaaaacccttaaaaacttataaaaaaaactcg

SEQ ID NO: 15893 - DNA, 666 bp, Artificial Sequence
  chemically treated genomic DNA (Homo sapiens) CpG-island No: 15893
tggttgcgcgtttagtcgggttttcgggcgttaggcgcggggcgggttttgggcgggcggtcggggcggggattgtagagtaggttgtattgcgcggtatttattgtcggtttgcgcggtatttattgtcggttttcgcggtatttattgtcggttttcgcgttattcggtcgtagcgcgcgagttatatggaagtttttgaggagttcgcgttagtgcgcggaggttcggaggttatttttgaggttcgtgggtcgcgttgtttgcggttgttcgtttttcgagaagagttgcgggcgtttttggttttggttggtttcgcggtgagtaaggtggttttagtggtaggtcggtatcggcgggttggggatttggtgatttttgttttcgcgggtgattttggcgggttttggggatcgagcgagttgttcgtcggcgggtttcggggagtatcgtgttaggagtcgggcgggtattttagtttttttgtttgcgtttcggtcgtttttcgtttcgtattattcgattgggggtttcgcggggtattgcgggaacggttggtacgcgttcgggcgtatgttggttcggagaggtcggcggttttagttttttgcgttaggagatatcggagagttgggatttttgtttttaacggggttttattag

SEQ ID NO: 15894 - DNA, 666 bp, Artificial Sequence
  chemically treated genomic DNA (Homo sapiens) CpG-island No: 15894
ctaataaaaccccgttaaaaacaaaaatcccaactctccgatatctcctaacgcaaaaaactaaaaccgccgacctctccgaaccaacatacgcccgaacgcgtaccaaccgttcccgcaataccccgcgaaacccccaatcgaataatacgaaacgaaaaacgaccgaaacgcaaacaaaaaaactaaaatacccgcccgactcctaacacgatactccccgaaacccgccgacgaacaactcgctcgatccccaaaacccgccaaaatcacccgcgaaaacaaaaatcaccaaatccccaacccgccgataccgacctaccactaaaaccaccttactcaccgcgaaaccaaccaaaaccaaaaacgcccgcaactcttctcgaaaaacgaacaaccgcaaacaacgcgacccacgaacctcaaaaataacctccgaacctccgcgcactaacgcgaactcctcaaaaacttccatataactcgcgcgctacgaccgaataacgcgaaaaccgacaataaataccgcgaaaaccgacaataaataccgcgcaaaccgacaataaataccgcgcaatacaacctactctacaatccccgccccgaccgcccgcccaaaacccgccccgcgcctaacgcccgaaaacccgactaaacgcgcaacca

SEQ ID NO: 15895 - DNA, 666 bp, Artificial Sequence
  chemically treated genomic DNA (Homo sapiens) CpG-island No: 15895
ttggtagagtttcgttaggggtaaaggttttagtttttcggtgttttttggcgtaggaggttggagtcgtcggttttttcgagttaatatgcgttcgggcgcgtattagtcgttttcgtagtgtttcgcggggtttttagtcgggtggtgcggagcggaaagcggtcgggacgtaggtagaggagttggggtgttcgttcggtttttggtacgatgtttttcggagttcgtcggcggatagttcgttcggtttttaaagttcgttaaagttattcgcggaggtagaaattattaggtttttagttcgtcggtatcggtttgttattgaggttattttatttatcgcggggttagttaggattaagagcgttcgtagtttttttcggaaggcggatagtcgtaagtagcgcgatttacggattttaagggtggttttcgggttttcgcgtattggcgcgggttttttaggagtttttatgtgattcgcgcgttgcggtcgggtagcgcggaggtcggtagtgggtatcgcggaggtcggtagtgggtatcgcgtaggtcggtagtgggtatcgcgtagtgtagtttgttttgtagttttcgtttcggtcgttcgtttagagttcgtttcgcgtttggcgttcgggggttcgattgagcgcgtagtta

SEQ ID NO: 15896 - DNA, 666 bp, Artificial Sequence
  chemically treated genomic DNA (Homo sapiens) CpG-island No: 15896
taactacgcgctcaatcgaacccccgaacgccaaacgcgaaacgaactctaaacgaacgaccgaaacgaaaactacaaaacaaactacactacgcgatacccactaccgacctacgcgatacccactaccgacctccgcgatacccactaccgacctccgcgctacccgaccgcaacgcgcgaatcacataaaaactcctaaaaaacccgcgccaatacgcgaaaacccgaaaaccacccttaaaatccgtaaatcgcgctacttacgactatccgccttccgaaaaaaactacgaacgctcttaatcctaactaaccccgcgataaataaaataacctcaataacaaaccgataccgacgaactaaaaacctaataatttctacctccgcgaataactttaacgaactttaaaaaccgaacgaactatccgccgacgaactccgaaaaacatcgtaccaaaaaccgaacgaacaccccaactcctctacctacgtcccgaccgctttccgctccgcaccacccgactaaaaaccccgcgaaacactacgaaaacgactaatacgcgcccgaacgcatattaactcgaaaaaaccgacgactccaacctcctacgccaaaaaacaccgaaaaactaaaacctttacccctaacgaaactctaccaa

SEQ ID NO: 15897 - DNA, 859 bp, Artificial Sequence
  chemically treated genomic DNA (Homo sapiens) CpG-island No: 15897
ttcggcggagcgcgtagaagataattttgggttcgttaaattaatttaggatatttaggtaaggcgagaatttacggcgtcgttagcggttcgtttaaattgaggcgcggttggcgggggattttcgttcgaaaattagtttggaagaatgaattgttcggagcgaagtttgcgtttattcggggtttagattttacgcgggtgatttttacgcgcgtcgcgttttcgtcgcgtttcggattattcgagagagcggcgaggattcgatcgcggaaagttggcgttcgcgtcgtttttcgcgcgttttggggcgttttttttttattcgagcgttacgtgtcgcgcgtttttcgttttcgggtcgcggcgggacgttttcgtttttatcgtagcgcgtagtgcgtaggcgttttttcgcgggtcgcggcggcgggagcgggaggcggcggcggcggcggtagcggcgggagcggtttttgtttcggttggagattgaggcgaaggcggtagcggcggaggaggtggaggagaggcgagggtgaaggcgatggcgacgcggggtatatgaggtcgcgatcggcgggacgggtcgaggttcggcggaggaggcggtttcgggggaattcgtcgtcgggtgaggggcggtcgtagggtcggttgaggagaagcgggttaggggcggggttttagggggaggcgggagaatttttggggagttcggggaggggtcgaggagaattttcggaggttcggggaggagcgcggtcggagcggagagggaaggggggagtttattgatggattaggagaaattaagaatttaaattttgtaattcgaattggagggttgttgtttgtt

SEQ ID NO: 15898 - DNA, 859 bp, Artificial Sequence
  chemically treated genomic DNA (Homo sapiens) CpG-island No: 15898
aacaaacaacaaccctccaattcgaattacaaaatttaaattcttaatttctcctaatccatcaataaactccccccttccctctccgctccgaccgcgctcctccccgaacctccgaaaattctcctcgacccctccccgaactccccaaaaattctcccgcctccccctaaaaccccgcccctaacccgcttctcctcaaccgaccctacgaccgcccctcacccgacgacgaattcccccgaaaccgcctcctccgccgaacctcgacccgtcccgccgatcgcgacctcatataccccgcgtcgccatcgccttcaccctcgcctctcctccacctcctccgccgctaccgccttcgcctcaatctccaaccgaaacaaaaaccgctcccgccgctaccgccgccgccgccgcctcccgctcccgccgccgcgacccgcgaaaaaacgcctacgcactacgcgctacgataaaaacgaaaacgtcccgccgcgacccgaaaacgaaaaacgcgcgacacgtaacgctcgaataaaaaaaaaacgccccaaaacgcgcgaaaaacgacgcgaacgccaactttccgcgatcgaatcctcgccgctctctcgaataatccgaaacgcgacgaaaacgcgacgcgcgtaaaaatcacccgcgtaaaatctaaaccccgaataaacgcaaacttcgctccgaacaattcattcttccaaactaattttcgaacgaaaatcccccgccaaccgcgcctcaatttaaacgaaccgctaacgacgccgtaaattctcgccttacctaaatatcctaaattaatttaacgaacccaaaattatcttctacgcgctccgccgaa

SEQ ID NO: 15899 - DNA, 859 bp, Artificial Sequence
  chemically treated genomic DNA (Homo sapiens) CpG-island No: 15899
agtaagtagtagttttttaattcgaattatagaatttgaatttttaattttttttaatttattagtgagtttttttttttttttttcgtttcggtcgcgttttttttcggattttcggaggtttttttcggttttttttcgggttttttaagagttttttcgtttttttttgggatttcgtttttggttcgtttttttttagtcggttttgcggtcgttttttattcggcggcgggttttttcggagtcgtttttttcgtcgggtttcggttcgtttcgtcggtcgcggttttatgtgtttcgcgtcgttatcgtttttattttcgttttttttttatttttttcgtcgttgtcgttttcgttttagtttttagtcgaggtagaagtcgttttcgtcgttgtcgtcgtcgtcgtcgtttttcgttttcgtcgtcgcgattcgcgggaaggcgtttgcgtattgcgcgttgcggtgggggcgggggcgtttcgtcgcggttcgggagcggggggcgcgcggtacgtggcgttcgagtgggaggggggcgttttagaacgcgcgggaagcgacgcgagcgttaatttttcgcggtcgagttttcgtcgttttttcggatagttcgggacgcggcggaggcgcggcgcgcgtgggagttattcgcgtggagtttggatttcgggtgggcgtagatttcgtttcggatagtttatttttttaagttgattttcgggcgagagtttttcgttagtcgcgttttagtttgagcgggtcgttaacggcgtcgtgggttttcgttttatttgggtattttgggttggtttagcgggtttagagttgttttttgcgcgtttcgtcgag

SEQ ID NO: 15900 - DNA, 859 bp, Artificial Sequence
  chemically treated genomic DNA (Homo sapiens) CpG-island No: 15900
ctcgacgaaacgcgcaaaaaacaactctaaacccgctaaaccaacccaaaatacccaaataaaacgaaaacccacgacgccgttaacgacccgctcaaactaaaacgcgactaacgaaaaactctcgcccgaaaatcaacttaaaaaaataaactatccgaaacgaaatctacgcccacccgaaatccaaactccacgcgaataactcccacgcgcgccgcgcctccgccgcgtcccgaactatccgaaaaaacgacgaaaactcgaccgcgaaaaattaacgctcgcgtcgcttcccgcgcgttctaaaacgcccccctcccactcgaacgccacgtaccgcgcgccccccgctcccgaaccgcgacgaaacgcccccgcccccaccgcaacgcgcaatacgcaaacgccttcccgcgaatcgcgacgacgaaaacgaaaaacgacgacgacgacgacaacgacgaaaacgacttctacctcgactaaaaactaaaacgaaaacgacaacgacgaaaaaaataaaaaaaaaacgaaaataaaaacgataacgacgcgaaacacataaaaccgcgaccgacgaaacgaaccgaaacccgacgaaaaaaacgactccgaaaaaacccgccgccgaataaaaaacgaccgcaaaaccgactaaaaaaaaacgaaccaaaaacgaaatcccaaaaaaaaacgaaaaaactcttaaaaaacccgaaaaaaaaccgaaaaaaacctccgaaaatccgaaaaaaaacgcgaccgaaacgaaaaaaaaaaaaaaaaactcactaataaattaaaaaaaattaaaaattcaaattctataattcgaattaaaaaactactacttact

SEQ ID NO: 15901 - DNA, 727 bp, Artificial Sequence
  chemically treated genomic DNA (Homo sapiens) CpG-island No: 15901
  misc_feature (659)..(659): n is either a, c, g or t
ggtggtatcggttgtggcggcggtggtggtggtatcggttgtggcggcggtggtggtggtatcggttgtggcggcggtggtggtggtatcggttgtggcggcggtggtggtggtatcggttgtggcggcggtggtggtggtatcggttgtggcggcggtggtggtggtatcggttgtggcggcggtggtggtggtatcggttgtggcggcggtggtggtggtatcggttgtggcggcggaggtggtggtatcggttgtggcggcggtggtggtggtatcggttgtggcggcggaggtggtggtatcggttgtggcggcggaggtggtggtatcggttgtggcggcggtggtggtggtatcggttgtggcggcggaggtggtggtatcggttgtggcggcggaggtggtggtatcggttgtggcggcggaggtggtggtatcggttgtggcggcggtggtggtggtatcggttgtgtcggcggtggtggtggtatcggttgtgtcggcggtggtggtggtatcggttgtggcggcggtggtggtggtatcggttgtggcggcggaggtggtggtatcggttgtgtcggcggtggtggtggtatcggttgtggcggcggaggtggtggtatcggttgtggcggcggaggtggtggtatttnttgtggcggcggaggtggtggtatcggttgtggcggcggaggtggtggtataaaaaattagtcgggta

SEQ ID NO: 15902 - DNA, 727 bp, Artificial Sequence
  chemically treated genomic DNA (Homo sapiens) CpG-island No: 15902
  misc_feature (69)..(69): n is either a, c, g or t
tacccgactaattttttataccaccacctccgccgccacaaccgataccaccacctccgccgccacaanaaataccaccacctccgccgccacaaccgataccaccacctccgccgccacaaccgataccaccaccaccgccgacacaaccgataccaccacctccgccgccacaaccgataccaccaccaccgccgccacaaccgataccaccaccaccgccgacacaaccgataccaccaccaccgccgacacaaccgataccaccaccaccgccgccacaaccgataccaccacctccgccgccacaaccgataccaccacctccgccgccacaaccgataccaccacctccgccgccacaaccgataccaccaccaccgccgccacaaccgataccaccacctccgccgccacaaccgataccaccacctccgccgccacaaccgataccaccaccaccgccgccacaaccgataccaccacctccgccgccacaaccgataccaccaccaccgccgccacaaccgataccaccaccaccgccgccacaaccgataccaccaccaccgccgccacaaccgataccaccaccaccgccgccacaaccgataccaccaccaccgccgccacaaccgataccaccaccaccgccgccacaaccgataccaccaccaccgccgccacaaccgataccaccaccaccgccgccacaaccgataccacc

SEQ ID NO: 15903 - DNA, 727 bp, Artificial Sequence
  chemically treated genomic DNA (Homo sapiens) CpG-island No: 15903
  misc_feature (69)..(69): n is either a, c, g or t
tgttcggttaattttttgtattattattttcgtcgttataatcgatattattattttcgtcgttataanagatattattattttcgtcgttataatcgatattattattttcgtcgttataatcgatattattattatcgtcggtataatcgatattattattttcgtcgttataatcgatattattattatcgtcgttataatcgatattattattatcgtcggtataatcgatattattattatcgtcggtataatcgatattattattatcgtcgttataatcgatattattattttcgtcgttataatcgatattattattttcgtcgttataatcgatattattattttcgtcgttataatcgatattattattatcgtcgttataatcgatattattattttcgtcgttataatcgatattattattttcgtcgttataatcgatattattattatcgtcgttataatcgatattattattttcgtcgttataatcgatattattattatcgtcgttatagtcgatattattattatcgtcgttatagtcgatattattattatcgtcgttatagtcgatattattattatcgtcgttatagtcgatattattattatcgtcgttatagtcgatattattattatcgtcgttatagtcgatattattattatcgtcgttatagtcgatattattattatcgtcgttatagtcgatattatt

SEQ ID NO: 15904 - DNA, 727 bp, Artificial Sequence
  chemically treated genomic DNA (Homo sapiens) CpG-island No: 15904
  misc_feature (659)..(659): n is either a, c, g or t
aataatatcgactataacgacgataataataatatcgactataacgacgataataataatatcgactataacgacgataataataatatcgactataacgacgataataataatatcgactataacgacgataataataatatcgactataacgacgataataataatatcgactataacgacgataataataatatcgactataacgacgataataataatatcgattataacgacgaaaataataatatcgattataacgacgataataataatatcgattataacgacgaaaataataatatcgattataacgacgaaaataataatatcgattataacgacgataataataatatcgattataacgacgaaaataataatatcgattataacgacgaaaataataatatcgattataacgacgaaaataataatatcgattataacgacgataataataatatcgattataccgacgataataataatatcgattataccgacgataataataatatcgattataacgacgataataataatatcgattataacgacgaaaataataatatcgattataccgacgataataataatatcgattataacgacgaaaataataatatcgattataacgacgaaaataataatatctnttataacgacgaaaataataatatcgattataacgacgaaaataataatacaaaaaattaaccgaaca

SEQ ID NO: 15905 - DNA, 570 bp, Artificial Sequence
  chemically treated genomic DNA (Homo sapiens) CpG-island No: 15905
  misc_feature (441)..(441): n is either a, c, g or t
ttagttttcgaacgaatttttttttaattttcgggaggtaggagttttagcggggagatgcgggaagttttagacgagttcgtacgtcgtcggagacgtagggatcgaggtcggggagataaagagtagttcgcgaagagttcgggcggcgaggggcggttcggtttcgttttgcgtttttaatcgttcgggtagttgtcggtatcgtcggggcgtcgtcgagtgcgcgtcgtttttgttcgggtttttcgatcgtcgttcgatattttcgcggtttaggatattttcgagtcgtttttttttcgatttgggagtcgcgcgtttggggataaagagggagggtgcgtcggggatagtggtaggacgcgggttcggcgacgttttttcggattcggcgggaatttttcggcggcgtttttttttttttttcgtttcggtcgngttttttttcggaatttcggaagtttttttcggttttttttcgggttttttaagaatttttcgtttttttttgggatttcgtttttaatttgaaatgttaaatttaatataattaaagttttatagaaa

SEQ ID NO: 15906 - DNA, 570 bp, Artificial Sequence
  chemically treated genomic DNA (Homo sapiens) CpG-island No: 15906
  misc_feature (130)..(130): n is either a, c, g or t
tttctataaaactttaattatattaaatttaacatttcaaattaaaaacgaaatcccaaaaaaaaacgaaaaattcttaaaaaacccgaaaaaaaaccgaaaaaaacttccgaaattccgaaaaaaaacncgaccgaaacgaaaaaaaaaaaaaaacgccgccgaaaaattcccgccgaatccgaaaaaacgtcgccgaacccgcgtcctaccactatccccgacgcaccctccctctttatccccaaacgcgcgactcccaaatcgaaaaaaaaacgactcgaaaatatcctaaaccgcgaaaatatcgaacgacgatcgaaaaacccgaacaaaaacgacgcgcactcgacgacgccccgacgataccgacaactacccgaacgattaaaaacgcaaaacgaaaccgaaccgcccctcgccgcccgaactcttcgcgaactactctttatctccccgacctcgatccctacgtctccgacgacgtacgaactcgtctaaaacttcccgcatctccccgctaaaactcctacctcccgaaaattaaaaaaaaattcgttcgaaaactaa

SEQ ID NO: 15907 - DNA, 570 bp, Artificial Sequence
  chemically treated genomic DNA (Homo sapiens) CpG-island No: 15907
  misc_feature (130)..(130): n is either a, c, g or t
tttttatgagattttagttatgttaaatttggtattttaaattgggggcggggttttaggggagggcggaaaatttttggggagttcgggaaggggtcgaggagaattttcgaagtttcggggaggagtncggtcggagcggaaaaagaaggggggcgtcgtcgaggggttttcgtcgagttcggaggggcgtcgtcgggttcgcgttttgttattgttttcggcgtattttttttttttgtttttaggcgcgcggtttttaaatcgggagggaaacggttcgggggtgttttgggtcgcggaggtgtcgggcgacggtcggggagttcggatagaagcggcgcgtattcggcggcgtttcggcggtgtcgataattattcgggcggttaggggcgtagggcggagtcgggtcgtttttcgtcgttcgggtttttcgcgggttgttttttgttttttcgatttcgatttttgcgttttcggcggcgtgcgggttcgtttgaggtttttcgtattttttcgttggaatttttgtttttcgggggttagaggagggttcgttcgagggttgg

SEQ ID NO: 15908 - DNA, 570 bp, Artificial Sequence
  chemically treated genomic DNA (Homo sapiens) CpG-island No: 15908
  misc_feature (441)..(441): n is either a, c, g or t
ccaaccctcgaacgaaccctcctctaacccccgaaaaacaaaaattccaacgaaaaaatacgaaaaacctcaaacgaacccgcacgccgccgaaaacgcaaaaatcgaaatcgaaaaaacaaaaaacaacccgcgaaaaacccgaacgacgaaaaacgacccgactccgccctacgcccctaaccgcccgaataattatcgacaccgccgaaacgccgccgaatacgcgccgcttctatccgaactccccgaccgtcgcccgacacctccgcgacccaaaacacccccgaaccgtttccctcccgatttaaaaaccgcgcgcctaaaaacaaaaaaaaaaaatacgccgaaaacaataacaaaacgcgaacccgacgacgcccctccgaactcgacgaaaacccctcgacgacgccccccttctttttccgctccgaccgnactcctccccgaaacttcgaaaattctcctcgaccccttcccgaactccccaaaaattttccgccctcccctaaaaccccgcccccaatttaaaataccaaatttaacataactaaaatctcataaaaa

SEQ ID NO: 15909 - DNA, 585 bp, Artificial Sequence
  chemically treated genomic DNA (Homo sapiens) CpG-island No: 15909
gtttttcgtttagtttaaaggggtttatgtagatagagtttgtcggggcggtagtaaagttcgtttttcgcgtcgtattttgacgtttagtataaaagaggtttggtataggtttttcgttcggagtagttgggtttgcgcgttcgagatttgagagtaggcgttcgcgcggtcggtttcgtcgtgggttaggatttatttttcgtcggtttttcgtcgttggcgtcgttgtttgtttacgggttttatagttatattatagatagtagtatttatatcgggagagagcgttttatatttttttttattcgcgttaatttttattcggcgttttgcgtttaaattagtcgggcgggtcggatcgtgttttttattggttagcgttcgtatcgttgattggttgttttttaagtaataaagtgttgcgagagtcgtttatagtgggtttgtttattttttttttttgtcggttgtagttttttaggcggtgttttcggggttgggtatacgagagtagcgggtagaagttaacgtagggttgggatacgtggggttatagttagtttttgtggttttcgggtttag

SEQ ID NO: 15910 - DNA, 585 bp, Artificial Sequence
  chemically treated genomic DNA (Homo sapiens) CpG-island No: 15910
ctaaacccgaaaaccacaaaaactaactataaccccacgtatcccaaccctacgttaacttctacccgctactctcgtatacccaaccccgaaaacaccgcctaaaaaactacaaccgacaaaaaaaaaaaataaacaaacccactataaacgactctcgcaacactttattacttaaaaaacaaccaatcaacgatacgaacgctaaccaataaaaaacacgatccgacccgcccgactaatttaaacgcaaaacgccgaataaaaattaacgcgaataaaaaaaaatataaaacgctctctcccgatataaatactactatctataatataactataaaacccgtaaacaaacaacgacgccaacgacgaaaaaccgacgaaaaataaatcctaacccacgacgaaaccgaccgcgcgaacgcctactctcaaatctcgaacgcgcaaacccaactactccgaacgaaaaacctataccaaacctcttttatactaaacgtcaaaatacgacgcgaaaaacgaactttactaccgccccgacaaactctatctacataaacccctttaaactaaacgaaaaac

SEQ ID NO: 15911 - DNA, 585 bp, Artificial Sequence
  chemically treated genomic DNA (Homo sapiens) CpG-island No: 15911
ttagattcggggattatagagattggttgtggttttacgtattttaattttgcgttggtttttgttcgttattttcgtgtgtttaatttcggagatatcgtttgggaaattgtagtcgataggaagaggaagtgagtaagtttattgtgaacggttttcgtaatattttgttatttaggaaatagttaattagcgatacggacgttgattaataggaagtacggttcggttcgttcggttaatttgaacgtaaggcgtcgggtggaggttggcgcgggtaggggagggtgtggggcgttttttttcggtgtgggtattgttgtttgtggtgtggttgtgggattcgtgagtaagtagcgacgttagcggcggagaatcgacgaaaggtaagttttggtttacggcggaatcgatcgcgcgaacgtttgtttttaggtttcggacgcgtagatttagttgtttcgggcgggaggtttgtgttaggttttttttgtgttggacgttaaggtgcggcgcggagaacgagttttgttgtcgtttcggtaggttttgtttgtatggatttttttaaattgggcgggaagt

SEQ ID NO: 15912 - DNA, 585 bp, Artificial Sequence
  chemically treated genomic DNA (Homo sapiens) CpG-island No: 15912
acttcccgcccaatttaaaaaaatccatacaaacaaaacctaccgaaacgacaacaaaactcgttctccgcgccgcaccttaacgtccaacacaaaaaaaacctaacacaaacctcccgcccgaaacaactaaatctacgcgtccgaaacctaaaaacaaacgttcgcgcgatcgattccgccgtaaaccaaaacttacctttcgtcgattctccgccgctaacgtcgctacttactcacgaatcccacaaccacaccacaaacaacaatacccacaccgaaaaaaaacgccccacaccctcccctacccgcgccaacctccacccgacgccttacgttcaaattaaccgaacgaaccgaaccgtacttcctattaatcaacgtccgtatcgctaattaactatttcctaaataacaaaatattacgaaaaccgttcacaataaacttactcacttcctcttcctatcgactacaatttcccaaacgatatctccgaaattaaacacacgaaaataacgaacaaaaaccaacgcaaaattaaaatacgtaaaaccacaaccaatctctataatccccgaatctaa

SEQ ID NO: 15913 - DNA, 505 bp, Artificial Sequence
  chemically treated genomic DNA (Homo sapiens) CpG-island No: 15913
ataaatatatagcgcgggttgggcgggggcggttaatttcggttttttggtacggggatagggcgcgttgggttcggttttgtagcgagtcggtgggagggtttagttgtggtttaggcggtgttgagtacgggtcgggggcgttatagtcggggagggtcgggtagcgagcgggtgggcgaggggcgagttatcgtttgtttcgttcggaggggatttcggcgggtgagggacgtgggtggagggagacgtggggagtttagtcggagtagatgatgaagttagagaacgtgttgtatttgttgttgttgtcgtcgtgtgttttgtttttatttagtttgatgaagatttcgtcgtcggcgtttaggtgtaggattacgttgttgttggcgtagtcgtagttttggttcgcgttttgggtaatagtattggttcgtatttgcgggtgggggatacgggagggagggcgagaggagagagaggatgagaagggagggaggtgagg

SEQ ID NO: 15914 - DNA, 505 bp, Artificial Sequence
  chemically treated genomic DNA (Homo sapiens) CpG-island No: 15914
cctcacctccctcccttctcatcctctctctcctctcgccctccctcccgtatcccccacccgcaaatacgaaccaatactattacccaaaacgcgaaccaaaactacgactacgccaacaacaacgtaatcctacacctaaacgccgacgacgaaatcttcatcaaactaaataaaaacaaaacacacgacgacaacaacaacaaatacaacacgttctctaacttcatcatctactccgactaaactccccacgtctccctccacccacgtccctcacccgccgaaatcccctccgaacgaaacaaacgataactcgcccctcgcccacccgctcgctacccgaccctccccgactataacgcccccgacccgtactcaacaccgcctaaaccacaactaaaccctcccaccgactcgctacaaaaccgaacccaacgcgccctatccccgtaccaaaaaaccgaaattaaccgcccccgcccaacccgcgctatatatttat

SEQ ID NO: 15915 - DNA, 505 bp, Artificial Sequence
  chemically treated genomic DNA (Homo sapiens) CpG-island No: 15915
ttttatttttttttttttttatttttttttttttttcgttttttttttcgtgttttttattcgtaggtgcgggttagtgttattgtttaggacgcggattagaattacgattacgttagtaatagcgtgattttgtatttggacgtcggcgacgaggtttttattaagttggatggaggtaaagtatacggcggtaatagtaataaatatagtacgttttttggttttattatttatttcgattgagttttttacgtttttttttatttacgttttttattcgtcggggtttttttcgggcggggtagacgatgattcgtttttcgtttattcgttcgttgttcggtttttttcggttatgacgttttcggttcgtgtttaatatcgtttgggttatagttaggtttttttatcggttcgttgtagagtcgggtttagcgcgttttgttttcgtgttagggaatcggggttgatcgttttcgtttagttcgcgttatatatttgt

SEQ ID NO: 15916 - DNA, 505 bp, Artificial Sequence
  chemically treated genomic DNA (Homo sapiens) CpG-island No: 15916
acaaatatataacgcgaactaaacgaaaacgatcaaccccgattccctaacacgaaaacaaaacgcgctaaacccgactctacaacgaaccgataaaaaaacctaactataacccaaacgatattaaacacgaaccgaaaacgtcataaccgaaaaaaaccgaacaacgaacgaataaacgaaaaacgaatcatcgtctaccccgcccgaaaaaaaccccgacgaataaaaaacgtaaataaaaaaaaacgtaaaaaactcaatcgaaataaataataaaaccaaaaaacgtactatatttattactattaccgccgtatactttacctccatccaacttaataaaaacctcgtcgccgacgtccaaatacaaaatcacgctattactaacgtaatcgtaattctaatccgcgtcctaaacaataacactaacccgcacctacgaataaaaaacacgaaaaaaaaaacgaaaaaaaaaaaaaaataaaaaaaaaaaaaaataaaa

SEQ ID NO: 15917 - DNA, 629 bp, Artificial Sequence
  chemically treated genomic DNA (Homo sapiens) CpG-island No: 15917
gcggcggtcgttagtagcgtttttcggttcgcgcggagtttggggagcgtcgggtcgttcggtcgcgtcgtcggggtaatggtgtcggcgggtagggggcgcgggttaggcgttcgcgtttaaggacggttcggcggggttgcgggtatggggtcgggttcggggcgtcgcgttgcgttggttgcgttgcggagtttagtcgtcggtttttgtttcgcgttttttttttgttgcgttgtcggattgagcgtcgcggtcgtcgtttttcgtttttcgtttttcgtttgtagtttttcgtttgatttttttcgtttttttgagtcgggttatcgttttttcggtcgggtttcgtttcgttagtttcgcgcggttttgggttttttaggggtggggttgcgggcggggtcggcgtttaattgggtcgcgggcgtttcgaggtgggcggggtataagggggcggggtcgcggagatttcgggcggggagtagggagaggaaagaagagattgagtacgcggagatcgagattcggaaatggggtgggggtcggggttcgagagattcgagaggcgttttaagggaaggggagagtagggattaaaatgcgaaagggagagagggttataggga

SEQ ID NO: 15918 - DNA, 629 bp, Artificial Sequence
  chemically treated genomic DNA (Homo sapiens) CpG-island No: 15918
tccctataaccctctctccctttcgcattttaatccctactctccccttcccttaaaacgcctctcgaatctctcgaaccccgacccccaccccatttccgaatctcgatctccgcgtactcaatctcttctttcctctccctactccccgcccgaaatctccgcgaccccgcccccttataccccgcccacctcgaaacgcccgcgacccaattaaacgccgaccccgcccgcaaccccacccctaaaaaacccaaaaccgcgcgaaactaacgaaacgaaacccgaccgaaaaaacgataacccgactcaaaaaaacgaaaaaaatcaaacgaaaaactacaaacgaaaaacgaaaaacgaaaaacgacgaccgcgacgctcaatccgacaacgcaacaaaaaaaaaacgcgaaacaaaaaccgacgactaaactccgcaacgcaaccaacgcaacgcgacgccccgaacccgaccccatacccgcaaccccgccgaaccgtccttaaacgcgaacgcctaacccgcgccccctacccgccgacaccattaccccgacgacgcgaccgaacgacccgacgctccccaaactccgcgcgaaccgaaaaacgctactaacgaccgccgc

SEQ ID NO: 15919 - DNA, 629 bp, Artificial Sequence
  chemically treated genomic DNA (Homo sapiens) CpG-island No: 15919
tttttgtggttttttttttttttcgtattttggtttttatttttttttttttttggagcgtttttcgggtttttcggatttcggtttttattttattttcgaatttcggttttcgcgtatttagtttttttttttttttttttgtttttcgttcggggttttcgcggtttcgtttttttatgtttcgtttatttcgaggcgttcgcggtttaattaggcgtcggtttcgttcgtagttttatttttagagagtttagagtcgcgcggagttggcggggcggggttcggtcgagggggcggtggttcggtttaaggaggcgggaggagttaggcgggaggttgtaggcgggaggcgggaggcgggaggcggcggtcgcggcgtttagttcggtagcgtagtaggagggaggcgcgaggtaggagtcggcggttgggtttcgtagcgtagttagcgtagcgcggcgtttcgggttcggttttatgttcgtagtttcgtcggatcgtttttgagcgcgggcgtttagttcgcgttttttgttcgtcggtattattgtttcgacggcgcggtcgggcggttcggcgttttttaggtttcgcgcgggtcgaaagacgttgttagcggtcgtcgt

SEQ ID NO: 15920 - DNA, 629 bp, Artificial Sequence
  chemically treated genomic DNA (Homo sapiens) CpG-island No: 15920
acgacgaccgctaacaacgtctttcgacccgcgcgaaacctaaaaaacgccgaaccgcccgaccgcgccgtcgaaacaataataccgacgaacaaaaaacgcgaactaaacgcccgcgctcaaaaacgatccgacgaaactacgaacataaaaccgaacccgaaacgccgcgctacgctaactacgctacgaaacccaaccgccgactcctacctcgcgcctccctcctactacgctaccgaactaaacgccgcgaccgccgcctcccgcctcccgcctcccgcctacaacctcccgcctaactcctcccgcctccttaaaccgaaccaccgccccctcgaccgaaccccgccccgccaactccgcgcgactctaaactctctaaaaataaaactacgaacgaaaccgacgcctaattaaaccgcgaacgcctcgaaataaacgaaacataaaaaaacgaaaccgcgaaaaccccgaacgaaaaacaaaaaaaaaaaaaaaaaaactaaatacgcgaaaaccgaaattcgaaaataaaataaaaaccgaaatccgaaaaacccgaaaaacgctccaaaaaaaaaaaaaaataaaaaccaaaatacgaaaaaaaaaaaaaaccacaaaaa

SEQ ID NO: 15921 - DNA, 530 bp, Artificial Sequence
  chemically treated genomic DNA (Homo sapiens) CpG-island No: 15921
taagttcgcgcggcggagtgggaggcgtagagatcgaaagtattgtagcgttagagcgcgggttgattaggttggcgtgatcgttttttcgacgtttgttacgtttcgcggcggtttttttaagtagcggagtcgcgggcggggtcggttggcgtttacgtgattcggcgttattggttcgttcgcggaagtagttttatattcgcggttagcgcggggttttcgggcgttttgtagggcgggtaggttgtgttatttcgtcggacgtcgggatggtgtagttgtataatttgtattcgttcgggtcgtagtaggtggtgttttgtaagttggagtcggatcggttttgtggcggggggcgtgacgcgtttttcgtggcggcgggttgtaaggtggaggcgttcgcggtggtcggttaggagttgtgttagtcgcggtgcgttttttttacgttgggtcgggtgttgcgtttggtttatagcgaggttggtgagtaatttagagagttaggggtcgtttggggtttagtt

SEQ ID NO: 15922 - DNA, 530 bp, Artificial Sequence
  chemically treated genomic DNA (Homo sapiens) CpG-island No: 15922
aactaaaccccaaacgacccctaactctctaaattactcaccaacctcgctataaaccaaacgcaacacccgacccaacgtaaaaaaaacgcaccgcgactaacacaactcctaaccgaccaccgcgaacgcctccaccttacaacccgccgccacgaaaaacgcgtcacgccccccgccacaaaaccgatccgactccaacttacaaaacaccacctactacgacccgaacgaatacaaattatacaactacaccatcccgacgtccgacgaaataacacaacctacccgccctacaaaacgcccgaaaaccccgcgctaaccgcgaatataaaactacttccgcgaacgaaccaataacgccgaatcacgtaaacgccaaccgaccccgcccgcgactccgctacttaaaaaaaccgccgcgaaacgtaacaaacgtcgaaaaaacgatcacgccaacctaatcaacccgcgctctaacgctacaatactttcgatctctacgcctcccactccgccgcgcgaactta

SEQ ID NO: 15923 - DNA, 530 bp, Artificial Sequence
  chemically treated genomic DNA (Homo sapiens) CpG-island No: 15923
agttggattttaggcggtttttggttttttagattatttattagtttcgttgtaggttaggcgtaatattcggtttagcgtggagaaggcgtatcgcggttggtatagtttttggtcggttatcgcgaacgtttttattttgtagttcgtcgttacgaaaagcgcgttacgtttttcgttatagaatcggttcggttttagtttgtagggtattatttgttgcgattcgaacgggtgtaggttgtatagttgtattatttcgacgttcggcgggatggtatagtttgttcgttttgtagggcgttcggagatttcgcgttgatcgcgaatgtaggattattttcgcgagcgagttaatgacgtcgggttacgtgaacgttagtcggtttcgttcgcggtttcgttatttaaagaggtcgtcgcggggcgtggtaggcgtcgggaaagcggttacgttagtttggttagttcgcgttttggcgttgtagtgttttcggtttttgcgttttttatttcgtcgcgcgagtttg

SEQ ID NO: 15924 - DNA, 530 bp, Artificial Sequence
  chemically treated genomic DNA (Homo sapiens) CpG-island No: 15924
caaactcgcgcgacgaaataaaaaacgcaaaaaccgaaaacactacaacgccaaaacgcgaactaaccaaactaacgtaaccgctttcccgacgcctaccacgccccgcgacgacctctttaaataacgaaaccgcgaacgaaaccgactaacgttcacgtaacccgacgtcattaactcgctcgcgaaaataatcctacattcgcgatcaacgcgaaatctccgaacgccctacaaaacgaacaaactataccatcccgccgaacgtcgaaataatacaactatacaacctacacccgttcgaatcgcaacaaataataccctacaaactaaaaccgaaccgattctataacgaaaaacgtaacgcgcttttcgtaacgacgaactacaaaataaaaacgttcgcgataaccgaccaaaaactataccaaccgcgatacgccttctccacgctaaaccgaatattacgcctaacctacaacgaaactaataaataatctaaaaaaccaaaaaccgcctaaaatccaact

SEQ ID NO: 15925 - DNA, 790 bp, Artificial Sequence
  chemically treated genomic DNA (Homo sapiens) CpG-island No: 15925
gtcgagtttcggtgttattaagaggcgtaagagcggtttcgggttttttagttttcgtttcgtttcgtttcgttacgttacgtcggatttattttcgggttgtttttcgtaggaggtcgagtatcgattttcgttcgtttttcgaaggaatttgtgggagaataaggagcgtattgggcgtaggagtagcgatttcgggggatttcggagggcggtttcggaggacgcggagtagtagggagcggggggcgcgcggcggggcgggcgcgggaagagggaggcgggggtcgaggggcggggttgagattttcgcggtgggttcggtgggtcgcgaggttgttcgggagtacgggaggagggtttcggttcggtttttcgtttttttcgtcgcggcgtttagttttttcgttcgtttttttcgcggttttttatttcgtcgcgtcgggatgtgtgtttcgcgaacgggagtcgcgcgagtgtttagagtttgggtcgtcgttggtttcgttttttcggatttttttttgcggttgtcgcgtcgggcgggggtggcggagtttgaggaggcgcggcgcggggaggaggcgcggcgcggggaggaggcgggggaggagcggaggtcgtttttcgcgtttggtatcgtcgtatttttcgggtcgggtttcgttagtcggcgtcgtattcgttttcgttttttcgttttttgagttttttgtttgtgttttttcgtattttggtatatagttagatttttttttcgttcgcgtaatttatttttcgcgagtggagg

SEQ ID NO: 15926 - DNA, 790 bp, Artificial Sequence
  chemically treated genomic DNA (Homo sapiens) CpG-island No: 15926
cctccactcgcgaaaaataaattacgcgaacgaaaaaaaaatctaactatataccaaaatacgaaaaaacacaaacaaaaaactcaaaaaacgaaaaaacgaaaacgaatacgacgccgactaacgaaacccgacccgaaaaatacgacgataccaaacgcgaaaaacgacctccgctcctcccccgcctcctccccgcgccgcgcctcctccccgcgccgcgcctcctcaaactccgccacccccgcccgacgcgacaaccgcaaaaaaaaatccgaaaaaacgaaaccaacgacgacccaaactctaaacactcgcgcgactcccgttcgcgaaacacacatcccgacgcgacgaaataaaaaaccgcgaaaaaaacgaacgaaaaaactaaacgccgcgacgaaaaaaacgaaaaaccgaaccgaaaccctcctcccgtactcccgaacaacctcgcgacccaccgaacccaccgcgaaaatctcaaccccgcccctcgacccccgcctccctcttcccgcgcccgccccgccgcgcgccccccgctccctactactccgcgtcctccgaaaccgccctccgaaatcccccgaaatcgctactcctacgcccaatacgctccttattctcccacaaattccttcgaaaaacgaacgaaaatcgatactcgacctcctacgaaaaacaacccgaaaataaatccgacgtaacgtaacgaaacgaaacgaaacgaaaactaaaaaacccgaaaccgctcttacgcctcttaataacaccgaaactcgac

SEQ ID NO: 15927 - DNA, 790 bp, Artificial Sequence
  chemically treated genomic DNA (Homo sapiens) CpG-island No: 15927
tttttattcgcggagggtgggttgcgcgggcggaagggaagtttggttgtgtgttagggtgcggggggatataggtaggggatttagggagcgggagagcgggagcgggtacgacgtcggttagcggagttcggttcggagggtgcggcggtgttagacgcggagggcggttttcgtttttttttcgtttttttttcgcgtcgcgtttttttttcgcgtcgcgtttttttaggtttcgttattttcgttcggcgcggtagtcgtagggaggggttcgggaaggcggagttagcggcggtttaggttttgggtattcgcgcggttttcgttcgcggagtatatatttcggcgcgacgaggtaggaggtcgcgaggggaacggacgagggagttgggcgtcgcggcgggaggggcgggaggtcgggtcgagatttttttttcgtgttttcggatagtttcgcggtttatcgagtttatcgcgggagttttaatttcgtttttcggttttcgttttttttttttcgcgttcgtttcgtcgcgcgtttttcgttttttgttgtttcgcgtttttcgggatcgtttttcgaggtttttcggggtcgttgtttttgcgtttagtgcgttttttgtttttttataggttttttcggagagcgagcgggagtcggtgttcggttttttgcggggagtagttcgagggtgagttcggcgtggcgtggcggggcggggcggggcggaggttggagggttcggggtcgtttttacgttttttagtggtatcggggttcggt

SEQ ID NO: 15928 - DNA, 790 bp, Artificial Sequence
  chemically treated genomic DNA (Homo sapiens) CpG-island No: 15928
accgaaccccgataccactaaaaaacgtaaaaacgaccccgaaccctccaacctccgccccgccccgccccgccacgccacgccgaactcaccctcgaactactccccgcaaaaaaccgaacaccgactcccgctcgctctccgaaaaaacctataaaaaaacaaaaaacgcactaaacgcaaaaacaacgaccccgaaaaacctcgaaaaacgatcccgaaaaacgcgaaacaacaaaaaacgaaaaacgcgcgacgaaacgaacgcgaaaaaaaaaaaacgaaaaccgaaaaacgaaattaaaactcccgcgataaactcgataaaccgcgaaactatccgaaaacacgaaaaaaaaatctcgacccgacctcccgcccctcccgccgcgacgcccaactccctcgtccgttcccctcgcgacctcctacctcgtcgcgccgaaatatatactccgcgaacgaaaaccgcgcgaatacccaaaacctaaaccgccgctaactccgccttcccgaacccctccctacgactaccgcgccgaacgaaaataacgaaacctaaaaaaacgcgacgcgaaaaaaaaacgcgacgcgaaaaaaaaacgaaaaaaaaacgaaaaccgccctccgcgtctaacaccgccgcaccctccgaaccgaactccgctaaccgacgtcgtacccgctcccgctctcccgctccctaaatcccctacctatatccccccgcaccctaacacacaaccaaacttcccttccgcccgcgcaacccaccctccgcgaataaaaa

SEQ ID NO: 15929 - DNA, 559 bp, Artificial Sequence
  chemically treated genomic DNA (Homo sapiens) CpG-island No: 15929
gtttttttatgtttttttacgtttttttttacgtttttttacgtttttttttacgtttttttacgtttttttttacgtttttttacgtttttttacgtttttttttacgtttttttacgtttttttacgttttttttcgtttttttttacgtttttttacgtttttttttacgtttttttatttttttttttacgtttttttacgtttttttttacgtttttttacgtttttttttacgtttttttacgtttttttttacgtttttttacgtttttttacgtttttttttacgtttttttacgtttttttttacgttttttttcgtttttttttacgtttttttacgtttttttttacgtttttttacgtttttttttacgtttttttttacgtttttttacgtttttttttacgtttttttacgtttttttttacgtttttttacgtttttttttacgtttttttacgtttttttttatatttttttacgtttttttttatgtttttgttgatttgattgatgaatgttgaaggaggaataaggcgtgtgtaattcgg

SEQ ID NO: 15930 - DNA, 559 bp, Artificial Sequence
  chemically treated genomic DNA (Homo sapiens) CpG-island No: 15930
ccgaattacacacgccttattcctccttcaacattcatcaatcaaatcaacaaaaacataaaaaaaaacgtaaaaaaatataaaaaaaaacgtaaaaaaacgtaaaaaaaaacgtaaaaaaacgtaaaaaaaaacgtaaaaaaacgtaaaaaaaaacgtaaaaaaacgtaaaaaaaaacgtaaaaaaaaacgtaaaaaaacgtaaaaaaaaacgtaaaaaaacgtaaaaaaaaacgaaaaaaaacgtaaaaaaaaacgtaaaaaaacgtaaaaaaaaacgtaaaaaaacgtaaaaaaacgtaaaaaaaaacgtaaaaaaacgtaaaaaaaaacgtaaaaaaacgtaaaaaaaaacgtaaaaaaacgtaaaaaaaaaaataaaaaaacgtaaaaaaaaacgtaaaaaaacgtaaaaaaaaacgaaaaaaaacgtaaaaaaacgtaaaaaaacgtaaaaaaaaacgtaaaaaaacgtaaaaaaacgtaaaaaaaaacgtaaaaaaacgtaaaaaaaaacgtaaaaaaacgtaaaaaaaaacgtaaaaaaacataaaaaaac

SEQ ID NO: 15931 - DNA, 559 bp, Artificial Sequence
  chemically treated genomic DNA (Homo sapiens) CpG-island No: 15931
tcgggttatatacgttttgttttttttttaatatttattaattaaattagtagaggtatggagaaaggcgtggagaggtgtagagagaggcgtggagaggcgtggagagaggcgtggagaggcgtggagagaggcgtggagaggcgtggagagaggcgtggagaggcgtggagagaggcgtggagagaggcgtggagaggcgtggagagaggcgtggagaggcgtggagagaggcggggagaggcgtggagagaggcgtggagaggcgtggagagaggcgtggagaggcgtggagaggcgtggagagaggcgtggagaggcgtggagagaggcgtggagaggcgtggagagaggcgtggagaggcgtggagagaggggtggagaggcgtagagagaggcgtggagaggcgtggagagaggcggggagaggcgtggagaggcgtggagaggcgtggagagaggcgtggagaggcgtggagaggcgtagagagaggcgtggagaggcgtggagagaggcgtggagaggcgtggagagaggcgtggagaggtatggagaggt

SEQ ID NO: 15932 - DNA, 559 bp, Artificial Sequence
  chemically treated genomic DNA (Homo sapiens) CpG-island No: 15932
acctctccatacctctccacgcctctctccacgcctctccacgcctctctccacgcctctccacgcctctctctacgcctctccacgcctctccacgcctctctccacgcctctccacgcctctccacgcctctccccgcctctctccacgcctctccacgcctctctctacgcctctccacccctctctccacgcctctccacgcctctctccacgcctctccacgcctctctccacgcctctccacgcctctctccacgcctctccacgcctctccacgcctctctccacgcctctccacgcctctctccacgcctctccccgcctctctccacgcctctccacgcctctctccacgcctctccacgcctctctccacgcctctctccacgcctctccacgcctctctccacgcctctccacgcctctctccacgcctctccacgcctctctccacgcctctccacgcctctctctacacctctccacgcctttctccatacctctactaatttaattaataaatattaaaaaaaaaacaaaacgtatataacccga

SEQ ID NO: 15933 - DNA, 539 bp, Artificial Sequence
  chemically treated genomic DNA (Homo sapiens) CpG-island No: 15933
ttcggcgcgtttaacgtggttaaaggtaaagtagttcgttcggttcgggttagcgtcgcgggaatggagcgcggcgaggtcgagaggcgaggcgaggcggatataaaggagaggcgagggaggcgagcgcgcggcgtcggcgttttggttaaggcgtatcggataattttcgggttaattcgtgttagggtcggttttttatttttcgttcggtttttcggtcgttgataaaattgaagtggaaatgaagttggatgttttggagtattcgcgcggttgtgggggtggcgggggtttcgttcggggtagttgcgtttttcgcgggcgtttttggcgttgtttttggttaggtcgcggggatggagcgggagagtcgggcggggaggggaggacgtcgtcgcgtagattttttgttcggcggttttcgattttgttttcgtttagatgaatatttatttagtagtgggagcggggtggaaatgcggggagcggttcgaatgcgggagacggtaaggtaaggatattttcgtttaatgagt

SEQ ID NO: 15934 - DNA, 539 bp, Artificial Sequence
  chemically treated genomic DNA (Homo sapiens) CpG-island No: 15934
actcattaaacgaaaatatccttaccttaccgtctcccgcattcgaaccgctccccgcatttccaccccgctcccactactaaataaatattcatctaaacgaaaacaaaatcgaaaaccgccgaacaaaaaatctacgcgacgacgtcctcccctccccgcccgactctcccgctccatccccgcgacctaaccaaaaacaacgccaaaaacgcccgcgaaaaacgcaactaccccgaacgaaacccccgccacccccacaaccgcgcgaatactccaaaacatccaacttcatttccacttcaattttatcaacgaccgaaaaaccgaacgaaaaataaaaaaccgaccctaacacgaattaacccgaaaattatccgatacgccttaaccaaaacgccgacgccgcgcgctcgcctccctcgcctctcctttatatccgcctcgcctcgcctctcgacctcgccgcgctccattcccgcgacgctaacccgaaccgaacgaactactttacctttaaccacgttaaacgcgccgaa

SEQ ID NO: 15935 - DNA, 539 bp, Artificial Sequence
  chemically treated genomic DNA (Homo sapiens) CpG-island No: 15935
gtttattaaacgagggtgtttttgttttgtcgtttttcgtattcgggtcgtttttcgtatttttatttcgtttttattgttgggtaaatgtttatttggacggggataggatcgggaatcgtcgggtagggggtttgcgcggcggcgttttttttttttcgttcggttttttcgttttattttcgcggtttggttaagggtagcgttaagggcgttcgcggagggcgtagttgtttcggacggagttttcgttatttttatagtcgcgcgggtgttttagagtatttaattttatttttattttaattttattagcggtcggggagtcgggcgggagataggaggtcggttttgatacgaattagttcggagattgttcgatacgttttggttagggcgtcggcgtcgcgcgttcgtttttttcgttttttttttgtgttcgtttcgtttcgtttttcggtttcgtcgcgttttattttcgcggcgttggttcgggtcgagcgaattgttttgtttttggttacgttgagcgcgtcgag

SEQ ID NO: 15936 - DNA, 539 bp, Artificial Sequence
  chemically treated genomic DNA (Homo sapiens) CpG-island No: 15936
ctcgacgcgctcaacgtaaccaaaaacaaaacaattcgctcgacccgaaccaacgccgcgaaaataaaacgcgacgaaaccgaaaaacgaaacgaaacgaacacaaaaaaaaaacgaaaaaaacgaacgcgcgacgccgacgccctaaccaaaacgtatcgaacaatctccgaactaattcgtatcaaaaccgacctcctatctcccgcccgactccccgaccgctaataaaattaaaataaaaataaaattaaatactctaaaacacccgcgcgactataaaaataacgaaaactccgtccgaaacaactacgccctccgcgaacgcccttaacgctacccttaaccaaaccgcgaaaataaaacgaaaaaaccgaacgaaaaaaaaaaaacgccgccgcgcaaaccccctacccgacgattcccgatcctatccccgtccaaataaacatttacccaacaataaaaacgaaataaaaatacgaaaaacgacccgaatacgaaaaacgacaaaacaaaaacaccctcgtttaataaac

SEQ ID NO: 15937 - DNA, 534 bp, Artificial Sequence
  chemically treated genomic DNA (Homo sapiens) CpG-island No: 15937
gtacggcgtggttattttttagttataaaagtggtcgttgtcggggttcggcgattcggggtgttaggcggagttttggtgaggtaggcgcgcgttcggtcgttttcgggtagagacgtttaaagagtatgtgagcgtgataagtgtttgttcgtaacgtgttagatttcgaaattgttttgtaatttagttcggaattcgtagttttagttcgggggaatagacgttcgtttaggttgtgttttattattttttttcgttttattttcgtcgattttttattgtcgttgttggaggaagagtttcgggaggagaagggtgcgtcgcgtcgcgttcgcgtgttaatggtagtcgcgtattttggaagaagttggtttttgtttcgaatattttttttttcgtgtttcgttttttgaattagaggcggttgtttcgtgcggttagagtagggttagtagagttcggggtagttgttaaaaacgagacggggaggttttttttttcgggggtggaggagggaaggagggaggtgtt

SEQ ID NO: 15938 - DNA, 534 bp, Artificial Sequence
  chemically treated genomic DNA (Homo sapiens) CpG-island No: 15938
aacacctccctccttccctcctccacccccgaaaaaaaaaacctccccgtctcgtttttaacaactaccccgaactctactaaccctactctaaccgcacgaaacaaccgcctctaattcaaaaaacgaaacacgaaaaaaaaaatattcgaaacaaaaaccaacttcttccaaaatacgcgactaccattaacacgcgaacgcgacgcgacgcacccttctcctcccgaaactcttcctccaacaacgacaataaaaaatcgacgaaaataaaacgaaaaaaaataataaaacacaacctaaacgaacgtctattcccccgaactaaaactacgaattccgaactaaattacaaaacaatttcgaaatctaacacgttacgaacaaacacttatcacgctcacatactctttaaacgtctctacccgaaaacgaccgaacgcgcgcctacctcaccaaaactccgcctaacaccccgaatcgccgaaccccgacaacgaccacttttataactaaaaaataaccacgccgtac

SEQ ID NO: 15939 - DNA, 534 bp, Artificial Sequence
  chemically treated genomic DNA (Homo sapiens) CpG-island No: 15939
gatattttttttttttttttttttattttcgggaagaaaagttttttcgtttcgtttttgatagttgtttcgaattttattggttttgttttagtcgtacgagatagtcgtttttgatttaaggggcggggtacgggaggaaaagtattcgagataagaattaattttttttagaatgcgcggttgttattgatacgcgggcgcggcgcggcgtattttttttttttcggggttttttttttagtagcgatagtgggaggtcggcgggggtggggcgggggggaatgatgagatatagtttaaacgaacgtttgttttttcgggttaaagttgcgagtttcggattggattgtaaggtagtttcgaaatttgatacgttgcggatagatatttgttacgtttatatgttttttaaacgtttttgttcggggacggtcgggcgcgcgtttgttttattaagatttcgtttgatatttcgagtcgtcgaatttcggtagcggttatttttatagttaaggggtgattacgtcgtgt

SEQ ID NO: 15940 - DNA, 534 bp, Artificial Sequence
  chemically treated genomic DNA (Homo sapiens) CpG-island No: 15940
acacgacgtaatcaccccttaactataaaaataaccgctaccgaaattcgacgactcgaaatatcaaacgaaatcttaataaaacaaacgcgcgcccgaccgtccccgaacaaaaacgtttaaaaaacatataaacgtaacaaatatctatccgcaacgtatcaaatttcgaaactaccttacaatccaatccgaaactcgcaactttaacccgaaaaaacaaacgttcgtttaaactatatctcatcattcccccccgccccacccccgccgacctcccactatcgctactaaaaaaaaaaccccgaaaaaaaaaaaatacgccgcgccgcgcccgcgtatcaataacaaccgcgcattctaaaaaaaattaattcttatctcgaatacttttcctcccgtaccccgccccttaaatcaaaaacgactatctcgtacgactaaaacaaaaccaataaaattcgaaacaactatcaaaaacgaaacgaaaaaacttttcttcccgaaaataaaaaaaaaaaaaaaaaaaatatc

SEQ ID NO: 15941 - DNA, 512 bp, Artificial Sequence
  chemically treated genomic DNA (Homo sapiens) CpG-island No: 15941
gcgggttgcgcgtattagaagacgcgagttcggggaaacgtgttggtcgggtcgcgtcgcgcggagttatttggtggattttttcgtttaggggtttttatgttggagtggcggtcgtgttttttgttgaggttgcgtttgaaacggtagcggttgtttttttgttagatataatacgaggggttgttgtggggcgagtttttttacgttgttggtacgttgttaagaaatacgtttagcgttttgtttgtgcgtttgtaagttttattgttttcgtcgatattttacgttcggtttagtcgtcgcgtggtttttcgttttttttcgcgtgttggggatatggggttcgagtagggaggatttagtttttcgtttttttcgattcggatttaggcggtcggggtcgcgggatcgtcgcggttttgtttgaaagttttatttttaggtttttttcgttttcgttttcgtcgtttttttatttttagtcgggttttagtattgttttttaggga

SEQ ID NO: 15942 - DNA, 512 bp, Artificial Sequence
  chemically treated genomic DNA (Homo sapiens) CpG-island No: 15942
tccctaaaaaacaatactaaaacccgactaaaaataaaaaaacgacgaaaacgaaaacgaaaaaaacctaaaaataaaactttcaaacaaaaccgcgacgatcccgcgaccccgaccgcctaaatccgaatcgaaaaaaacgaaaaactaaatcctccctactcgaaccccatatccccaacacgcgaaaaaaaacgaaaaaccacgcgacgactaaaccgaacgtaaaatatcgacgaaaacaataaaacttacaaacgcacaaacaaaacgctaaacgtatttcttaacaacgtaccaacaacgtaaaaaaactcgccccacaacaacccctcgtattatatctaacaaaaaaacaaccgctaccgtttcaaacgcaacctcaacaaaaaacacgaccgccactccaacataaaaacccctaaacgaaaaaatccaccaaataactccgcgcgacgcgacccgaccaacacgtttccccgaactcgcgtcttctaatacgcgcaacccgc

SEQ ID NO: 15943 - DNA, 512 bp, Artificial Sequence
  chemically treated genomic DNA (Homo sapiens) CpG-island No: 15943
tttttaaagaatagtgttagggttcggttgggagtaggggggcggcgggggcgggggcggggggagtttaggagtggaatttttagataaagtcgcggcggtttcgcggtttcggtcgtttgggttcggatcgggaaaaacgaggggttgggttttttttattcggattttatatttttagtacgcgagaaagagcgagaagttacgcggcggttgggtcgagcgtggggtgtcggcggagataatgaaatttgtaggcgtataaataaggcgttgagcgtgttttttgataacgtgttagtagcgtggagaggttcgttttataatagtttttcgtgttgtgtttagtaggaaaatagtcgttgtcgttttagacgtagttttaataaagagtacggtcgttattttagtatgagagtttttgggcggaaaagtttattaagtgatttcgcgcggcgcggttcggttagtacgttttttcggattcgcgttttttggtgcgcgtagttcgt

SEQ ID NO: 15944 - DNA, 512 bp, Artificial Sequence
  chemically treated genomic DNA (Homo sapiens) CpG-island No: 15944
acgaactacgcgcaccaaaaaacgcgaatccgaaaaaacgtactaaccgaaccgcgccgcgcgaaatcacttaataaacttttccgcccaaaaactctcatactaaaataacgaccgtactctttattaaaactacgtctaaaacgacaacgactattttcctactaaacacaacacgaaaaactattataaaacgaacctctccacgctactaacacgttatcaaaaaacacgctcaacgccttatttatacgcctacaaatttcattatctccgccgacaccccacgctcgacccaaccgccgcgtaacttctcgctctttctcgcgtactaaaaatataaaatccgaataaaaaaaacccaacccctcgtttttcccgatccgaacccaaacgaccgaaaccgcgaaaccgccgcgactttatctaaaaattccactcctaaactccccccgcccccgcccccgccgcccccctactcccaaccgaaccctaacactattctttaaaaa

SEQ ID NO: 15945 - DNA, 558 bp, Artificial Sequence
  chemically treated genomic DNA (Homo sapiens) CpG-island No: 15945
agcgagagtgaaattaaatttgaaattcggattaattggtagtcgttgttggtagaacgttttaaggattttttttcgcgggacggagggaggattcgggatagggaattggttttgggagaaaacgcgcggggggcgttcgagacgtttcgtgaaagtcgtgtcgatttttgggaggattgataggtttagagatacgcgttgtttgttgtggtgggtttttcgggaataagtgaggggttttgtgtttcgaggatggttttagcgtagagtcgggtgtttgtcggggtgggtttttcgtattgttcgggtttcggcgggggcggttttgatttttttttatggttcgttttttatttcgggaatttttagtgttttttttttacggtttttttggcgttttttcgattttttcgcggtattttggtttatttttttttagcgtcgtggttttttttggcgattttttttgcgtttttggggtttttttgcgtttttttttttttatcggcgcgttgtttatagtcgcgtgtttttttttcggagttggggattaag

SEQ ID NO: 15946 - DNA, 558 bp, Artificial Sequence
  chemically treated genomic DNA (Homo sapiens) CpG-island No: 15946
cttaatccccaactccgaaaaaaaaacacgcgactataaacaacgcgccgataaaaaaaaaaaaacgcaaaaaaaccccaaaaacgcaaaaaaaatcgccaaaaaaaaccacgacgctaaaaaaaaataaaccaaaataccgcgaaaaaatcgaaaaaacgccaaaaaaaccgtaaaaaaaaaacactaaaaattcccgaaataaaaaacgaaccataaaaaaaaatcaaaaccgcccccgccgaaacccgaacaatacgaaaaacccaccccgacaaacacccgactctacgctaaaaccatcctcgaaacacaaaacccctcacttattcccgaaaaacccaccacaacaaacaacgcgtatctctaaacctatcaatcctcccaaaaatcgacacgactttcacgaaacgtctcgaacgccccccgcgcgttttctcccaaaaccaattccctatcccgaatcctccctccgtcccgcgaaaaaaaatccttaaaacgttctaccaacaacgactaccaattaatccgaatttcaaatttaatttcactctcgct

SEQ ID NO: 15947 - DNA, 558 bp, Artificial Sequence
  chemically treated genomic DNA (Homo sapiens) CpG-island No: 15947
tttggtttttagtttcggggagagggtacgcggttgtgggtagcgcgtcggtggaggagggggggcgtaggaggattttaggagcgtagagggggtcgttagggaggattacggcgttgggggaaggtaggttaaagtgtcgcgggagagtcggggggacgttagaaaagtcgtggaaaaggagtattggggattttcggggtgggaggcgggttatggaaaggaattagagtcgttttcgtcggagttcgaataatgcggggagtttatttcggtagatattcggttttgcgttagaattattttcgaaatatagagttttttatttattttcgggaggtttattataatagatagcgcgtgtttttagatttgttagtttttttaagggtcggtacggtttttacggggcgtttcggacgtttttcgcgcgtttttttttagggttaattttttgtttcgagtttttttttcgtttcgcggggaggggtttttagggcgttttattaataacgattgttagttgattcgagttttaagtttaattttattttcgtt

SEQ ID NO: 15948 - DNA, 558 bp, Artificial Sequence
  chemically treated genomic DNA (Homo sapiens) CpG-island No: 15948
aacgaaaataaaattaaacttaaaactcgaatcaactaacaatcgttattaataaaacgccctaaaaacccctccccgcgaaacgaaaaaaaaactcgaaacaaaaaattaaccctaaaaaaaaacgcgcgaaaaacgtccgaaacgccccgtaaaaaccgtaccgacccttaaaaaaactaacaaatctaaaaacacgcgctatctattataataaacctcccgaaaataaataaaaaactctatatttcgaaaataattctaacgcaaaaccgaatatctaccgaaataaactccccgcattattcgaactccgacgaaaacgactctaattcctttccataacccgcctcccaccccgaaaatccccaatactccttttccacgacttttctaacgtccccccgactctcccgcgacactttaacctaccttcccccaacgccgtaatcctccctaacgaccccctctacgctcctaaaatcctcctacgccccccctcctccaccgacgcgctacccacaaccgcgtaccctctccccgaaactaaaaaccaaa

SEQ ID NO: 15949 - DNA, 661 bp, Artificial Sequence
  chemically treated genomic DNA (Homo sapiens) CpG-island No: 15949
cgcgttttttgtacggttcgggagggttgtaattcggttgttttcgttcgttttttttttttttttcgcgtcggttgtaaaggaaaattgtttttaatttattggggtttaggtcggtttttttttttttgtgtttgttgtcggcgagcgcgttcgtttcgggcgagggtagtgtttgcggggcgcggtcgcgtagtttttcgggcgagtcgtatatgtagttcgggtagttgcggtttttttttgggtcgtagttcgcgcggcgttcggggtaggcgttcggtttgagggcgtagtgacggttttcggtcgggaagttggggaaggagacggcgtcggatagcggttcgagttaagttcgtatgtagcgcgtgtcggcgtcgaggtggggttgggggtcgtacgggtgatatattacggacgattgagagggtacgggcgtttacgacgtgttgaatattgtcggtttgggcgcgaagttataggacggaaaatcgttatagttcggtattaaatcgttgggtttggcggcggcgggatgagtttcggtggtcggaaatttggacgttaggaggtttttattgtcgtgagagatgagcgagtttacgtaatagttattgatgggtttcgtcgtcgatatcgtaacggggttttatatata

SEQ ID NO: 15950 - DNA, 661 bp, Artificial Sequence
  chemically treated genomic DNA (Homo sapiens) CpG-island No: 15950
tatatataaaaccccgttacgatatcgacgacgaaacccatcaataactattacgtaaactcgctcatctctcacgacaataaaaacctcctaacgtccaaatttccgaccaccgaaactcatcccgccgccgccaaacccaacgatttaataccgaactataacgattttccgtcctataacttcgcgcccaaaccgacaatattcaacacgtcgtaaacgcccgtaccctctcaatcgtccgtaatatatcacccgtacgacccccaaccccacctcgacgccgacacgcgctacatacgaacttaactcgaaccgctatccgacgccgtctccttccccaacttcccgaccgaaaaccgtcactacgccctcaaaccgaacgcctaccccgaacgccgcgcgaactacgacccaaaaaaaaaccgcaactacccgaactacatatacgactcgcccgaaaaactacgcgaccgcgccccgcaaacactaccctcgcccgaaacgaacgcgctcgccgacaacaaacacaaaaaaaaaaaaaccgacctaaaccccaataaattaaaaacaattttcctttacaaccgacgcgaaaaaaaaaaaaaaaacgaacgaaaacaaccgaattacaaccctcccgaaccgtacaaaaaacgcg

SEQ ID NO: 15951 - DNA, 661 bp, Artificial Sequence
  chemically treated genomic DNA (Homo sapiens) CpG-island No: 15951
tgtatgtaaaatttcgttacgatgtcggcgacggggtttattagtaattattacgtggattcgtttattttttacgataatgaagattttttagcgtttaggttttcggttatcggggtttatttcgtcgtcgttagatttagcggtttggtgtcggattgtagcgatttttcgttttgtagtttcgcgtttaagtcggtagtgtttagtacgtcgtgggcgttcgtgtttttttagtcgttcgtggtatattattcgtacggtttttagttttatttcggcgtcgatacgcgttatatgcggatttggttcgagtcgttgttcggcgtcgtttttttttttagtttttcggtcgggggtcgttattacgtttttaagtcggacgtttatttcgggcgtcgcgcggattgcggtttaggggagggtcgtagttattcggattatatgtacggttcgttcggggagttgcgcgatcgcgtttcgtagatattgttttcgttcgaggcggacgcgttcgtcggtagtaagtataaagaggagaaggtcgatttggattttagtaagttgggagtaatttttttttataatcggcgcgggaggggaggggaggacgggcgggggtagtcgaattatagttttttcgaatcgtgtagggagcgcg

SEQ ID NO: 15952 - DNA, 661 bp, Artificial Sequence
  chemically treated genomic DNA (Homo sapiens) CpG-island No: 15952
cgcgctccctacacgattcgaaaaaactataattcgactacccccgcccgtcctcccctcccctcccgcgccgattataaaaaaaaattactcccaacttactaaaatccaaatcgaccttctcctctttatacttactaccgacgaacgcgtccgcctcgaacgaaaacaatatctacgaaacgcgatcgcgcaactccccgaacgaaccgtacatataatccgaataactacgaccctcccctaaaccgcaatccgcgcgacgcccgaaataaacgtccgacttaaaaacgtaataacgacccccgaccgaaaaactaaaaaaaaaaacgacgccgaacaacgactcgaaccaaatccgcatataacgcgtatcgacgccgaaataaaactaaaaaccgtacgaataatataccacgaacgactaaaaaaacacgaacgcccacgacgtactaaacactaccgacttaaacgcgaaactacaaaacgaaaaatcgctacaatccgacaccaaaccgctaaatctaacgacgacgaaataaaccccgataaccgaaaacctaaacgctaaaaaatcttcattatcgtaaaaaataaacgaatccacgtaataattactaataaaccccgtcgccgacatcgtaacgaaattttacataca

SEQ ID NO: 15953 - DNA, 560 bp, Artificial Sequence
  chemically treated genomic DNA (Homo sapiens) CpG-island No: 15953
tttcgtttcggtttacggtttgatttcggttcggagatgtagtttttttcgagaataggtgaagaagacggcggtagcggggattgggggtttcgggtgggaacgttagggtttagggttttgtgtgggtcgtgtagggggcgaggttcgaagttttgggttggatcgtagtacgagtgtggttcggacggttgcgtggttagaaggggtgttcgggtagggtgcgagagtatcggtaaggtggattgtgtatggattttggtcgtagatagagtagagcgggttttcgggttgtggtcggcggcgaggcgggtaatcgtatgttgagtttatagaaaggattttgaggtttgttgggtgtttgggttgttttgggggcggcggtttagagtgtggagtaagcggcgcgcggggcgcggcggttagcgtgggagaggttgtaggttttgtacgtttttgtagttgtcgggtcgtgttcgggacgtttgaattgaggtcgattaatggttatagtatgaaaaataaatgtaatggaaggtttttttgttttttttttttcg

SEQ ID NO: 15954 - DNA, 560 bp, Artificial Sequence
  chemically treated genomic DNA (Homo sapiens) CpG-island No: 15954
cgaaaaaaaaaaaacaaaaaaaccttccattacatttatttttcatactataaccattaatcgacctcaattcaaacgtcccgaacacgacccgacaactacaaaaacgtacaaaacctacaacctctcccacgctaaccgccgcgccccgcgcgccgcttactccacactctaaaccgccgcccccaaaacaacccaaacacccaacaaacctcaaaatcctttctataaactcaacatacgattacccgcctcgccgccgaccacaacccgaaaacccgctctactctatctacgaccaaaatccatacacaatccaccttaccgatactctcgcaccctacccgaacaccccttctaaccacgcaaccgtccgaaccacactcgtactacgatccaacccaaaacttcgaacctcgccccctacacgacccacacaaaaccctaaaccctaacgttcccacccgaaacccccaatccccgctaccgccgtcttcttcacctattctcgaaaaaaactacatctccgaaccgaaatcaaaccgtaaaccgaaacgaaa

SEQ ID NO: 15955 - DNA, 560 bp, Artificial Sequence
  chemically treated genomic DNA (Homo sapiens) CpG-island No: 15955
cggaaaagaaaagatagaaagattttttattgtatttattttttatgttgtgattattggtcggttttagtttagacgtttcggatacggttcggtagttgtagaggcgtgtagggtttgtagttttttttacgttgatcgtcgcgtttcgcgcgtcgtttgttttatattttgggtcgtcgtttttagggtagtttaaatatttagtagattttaaggttttttttatagatttaatatgcggttgttcgtttcgtcgtcggttatagttcgggagttcgttttgttttgtttgcggttaaagtttatatataatttattttgtcggtgttttcgtattttgttcgaatattttttttggttacgtagtcgttcgggttatattcgtgttgcggtttagtttaggatttcgaatttcgttttttgtacgatttatataaagttttgagttttggcgtttttattcgaagtttttagttttcgttgtcgtcgttttttttatttgttttcgggaagggttgtattttcgagtcgaagttaggtcgtgggtcggggcgagg

SEQ ID NO: 15956 - DNA, 560 bp, Artificial Sequence
  chemically treated genomic DNA (Homo sapiens) CpG-island No: 15956
cctcgccccgacccacgacctaacttcgactcgaaaatacaacccttcccgaaaacaaataaaaaaaacgacgacaacgaaaactaaaaacttcgaataaaaacgccaaaactcaaaactttatataaatcgtacaaaaaacgaaattcgaaatcctaaactaaaccgcaacacgaatataacccgaacgactacgtaaccaaaaaaaatattcgaacaaaatacgaaaacaccgacaaaataaattatatataaactttaaccgcaaacaaaacaaaacgaactcccgaactataaccgacgacgaaacgaacaaccgcatattaaatctataaaaaaaaccttaaaatctactaaatatttaaactaccctaaaaacgacgacccaaaatataaaacaaacgacgcgcgaaacgcgacgatcaacgtaaaaaaaactacaaaccctacacgcctctacaactaccgaaccgtatccgaaacgtctaaactaaaaccgaccaataatcacaacataaaaaataaatacaataaaaaatctttctatcttttcttttccg

SEQ ID NO: 15957 - DNA, 690 bp, Artificial Sequence
  chemically treated genomic DNA (Homo sapiens) CpG-island No: 15957
atttacgttggtcggagagttttatgtacgtttatgaggatagcgcggcggagagcggtatcggcggcggcggcggaggaggaggcggcggtacgggcggagcggggggtggttgtagcggagcgagtttcggtaaagtttcgagtatggatggtttgggtagtagttgttcggttagttattgtcgcgatttgttttcgtatttcgtgttgggtcgttcgtcggtttttttgggcgtttttttagggcgtcgtttatacggatatttcggtttcggagcggggcgcgttagtgtgtttcgtcgtcgggtattttttatttcgtttagcgttattttgggttacggttattttttcgggggtagttattacggttgtcgtttgtcgtataacgtgaatttgtagtagaagttttgcgtttattattcgggcgataaatattcggagtcgtcgggcgttttgttcggtgacgatttgttttttagggttaaggagttcgttttttattttagtttcgttagtttttattaggcgatgttcggttatttggacgtgtcggtggtgttcgggattagcgggtattcggagtcgcgttacgacgtttttattttcgtcgaaggttattagtattgggttttttttaatggttgggatagttaggtgtattgttttaaggagtagtcgtagttcg

SEQ ID NO: 15958 - DNA, 690 bp, Artificial Sequence
  chemically treated genomic DNA (Homo sapiens) CpG-island No: 15958
cgaactacgactactccttaaaacaatacacctaactatcccaaccattaaaaaaaacccaatactaataaccttcgacgaaaataaaaacgtcgtaacgcgactccgaatacccgctaatcccgaacaccaccgacacgtccaaataaccgaacatcgcctaataaaaactaacgaaactaaaataaaaaacgaactccttaaccctaaaaaacaaatcgtcaccgaacaaaacgcccgacgactccgaatatttatcgcccgaataataaacgcaaaacttctactacaaattcacgttatacgacaaacgacaaccgtaataactacccccgaaaaaataaccgtaacccaaaataacgctaaacgaaataaaaaatacccgacgacgaaacacactaacgcgccccgctccgaaaccgaaatatccgtataaacgacgccctaaaaaaacgcccaaaaaaaccgacgaacgacccaacacgaaatacgaaaacaaatcgcgacaataactaaccgaacaactactacccaaaccatccatactcgaaactttaccgaaactcgctccgctacaaccaccccccgctccgcccgtaccgccgcctcctcctccgccgccgccgccgataccgctctccgccgcgctatcctcataaacgtacataaaactctccgaccaacgtaaat

SEQ ID NO: 15959 - DNA, 690 bp, Artificial Sequence
  chemically treated genomic DNA (Homo sapiens) CpG-island No: 15959
cggattgcgattgttttttggagtagtatatttgattgttttagttattggagagagtttagtgttggtagttttcgacggggatgagggcgtcgtgacgcggtttcgggtgttcgttgatttcgggtattatcgatacgtttaggtagtcgggtatcgtttggtaggagttggcgaagttggggtagaaggcgaattttttggttttagaggataggtcgttatcgggtagggcgttcgacggtttcgggtatttatcgttcgggtggtaggcgtaaggtttttgttgtaggtttacgttgtgcgataggcggtagtcgtagtagttgttttcgaaggggtagtcgtagtttagggtggcgttggacgaggtggggggtgttcggcggcggggtatattggcgcgtttcgtttcggggtcgggatgttcgtatagacggcgttttgggggggcgtttaggggagtcggcgggcggtttagtacggggtgcggaagtaggtcgcggtagtggttggtcgggtagttgttgtttagattatttatgttcggggttttgtcggggttcgtttcgttgtagttatttttcgtttcgttcgtgtcgtcgttttttttttcgtcgtcgtcgtcgatgtcgtttttcgtcgcgttgtttttatagacgtatataaggtttttcggttagcgtggat

SEQ ID NO: 15960 - DNA, 690 bp, Artificial Sequence
  chemically treated genomic DNA (Homo sapiens) CpG-island No: 15960
atccacgctaaccgaaaaaccttatatacgtctataaaaacaacgcgacgaaaaacgacatcgacgacgacgacgaaaaaaaaaacgacgacacgaacgaaacgaaaaataactacaacgaaacgaaccccgacaaaaccccgaacataaataatctaaacaacaactacccgaccaaccactaccgcgacctacttccgcaccccgtactaaaccgcccgccgactcccctaaacgcccccccaaaacgccgtctatacgaacatcccgaccccgaaacgaaacgcgccaatataccccgccgccgaacaccccccacctcgtccaacgccaccctaaactacgactaccccttcgaaaacaactactacgactaccgcctatcgcacaacgtaaacctacaacaaaaaccttacgcctaccacccgaacgataaatacccgaaaccgtcgaacgccctacccgataacgacctatcctctaaaaccaaaaaattcgccttctaccccaacttcgccaactcctaccaaacgatacccgactacctaaacgtatcgataatacccgaaatcaacgaacacccgaaaccgcgtcacgacgccctcatccccgtcgaaaactaccaacactaaactctctccaataactaaaacaatcaaatatactactccaaaaaacaatcgcaatccg

SEQ ID NO: 15961 - DNA, 761 bp, Artificial Sequence
  chemically treated genomic DNA (Homo sapiens) CpG-island No: 15961
ttttaacgtttagggtgtttagggacgagcgattggatagattcgggtttcggcgaggtaatttttatagtttcggttagtaggggttatttcgtttttcgcgggggtatagtagttttttcggaggagattagagttgtcggcgttgtcgggcgcgggagttgttcgagttagtcggggttgtgggcgcgtcgggttttttttttttggattttggagaggatcgtagtcgggattacgacggtcggggaattggattaaggttttataattttcgttatagggtcgggatgttgagtattttaggcgcgagttagggagtgttttaggcgttcgggtcgtttattagtgttcggcgcgtttttgtttcgaggtttcggttagagtggtaatcgagagtatcgcgtagggttgtagcgcggagcggagggcgaagttggggagttttgtagcggcggacgcgggttacggtttttttttggaaaatcggtagcgtcgtttggatcgaggtatacgtaggagggcggtcgttcggattaaaggttgagtataggcgcgttgtgggatcggggtttgttttttatttttcgttgaattatatcggaatttttcgcgtttttaggtgttatgtagagaggattggcggttttagagtgcgtttttcgcgcggtttggggtcgaaaaatcgtttttgtttttttggatatagtagggagggtgggtaggggtttcggtttggtcggaattttaagttttcggag

SEQ ID NO: 15962 - DNA, 761 bp, Artificial Sequence
  chemically treated genomic DNA (Homo sapiens) CpG-island No: 15962
ctccgaaaacttaaaattccgaccaaaccgaaacccctacccaccctccctactatatccaaaaaaacaaaaacgatttttcgaccccaaaccgcgcgaaaaacgcactctaaaaccgccaatcctctctacataacacctaaaaacgcgaaaaattccgatataattcaacgaaaaataaaaaacaaaccccgatcccacaacgcgcctatactcaacctttaatccgaacgaccgccctcctacgtatacctcgatccaaacgacgctaccgattttccaaaaaaaaaccgtaacccgcgtccgccgctacaaaactccccaacttcgccctccgctccgcgctacaaccctacgcgatactctcgattaccactctaaccgaaacctcgaaacaaaaacgcgccgaacactaataaacgacccgaacgcctaaaacactccctaactcgcgcctaaaatactcaacatcccgaccctataacgaaaattataaaaccttaatccaattccccgaccgtcgtaatcccgactacgatcctctccaaaatccaaaaaaaaaaaacccgacgcgcccacaaccccgactaactcgaacaactcccgcgcccgacaacgccgacaactctaatctcctccgaaaaaactactatacccccgcgaaaaacgaaataacccctactaaccgaaactataaaaattacctcgccgaaacccgaatctatccaatcgctcgtccctaaacaccctaaacgttaaaa

SEQ ID NO: 15963 - DNA, 761 bp, Artificial Sequence
  chemically treated genomic DNA (Homo sapiens) CpG-island No: 15963
tttcggggatttggggtttcggttaggtcggagtttttgtttattttttttgttatatttaggaaagtagaagcggtttttcggttttaggtcgcgcgagaaacgtattttggagtcgttaattttttttgtatggtatttggaggcgcggaaggtttcggtgtaatttagcgggaggtggaaggtaggtttcgattttatagcgcgtttatgtttagtttttggttcgagcggtcgtttttttgcgtgtgtttcggtttagacggcgttgtcgattttttaaggagaggtcgtggttcgcgttcgtcgttgtaggattttttagtttcgtttttcgtttcgcgttgtagttttgcgcggtgttttcggttgttattttagtcgaggtttcgagataaagacgcgtcgggtattggtggacgattcgggcgtttgggatattttttgattcgcgtttggagtgtttagtatttcggttttgtggcgaaggttgtgagattttggtttaatttttcgatcgtcgtggtttcggttgcggttttttttagggtttagggagaggaaattcggcgcgtttatagtttcggttgattcgagtagttttcgcgttcgatagcgtcggtagttttggtttttttcggaggggttgttgtgttttcgcgaaggacgagatgatttttgttggtcggagttgtggaggttgtttcgtcgagattcggatttgtttagtcgttcgtttttgagtattttaggcgttgggg

SEQ ID NO: 15964 - DNA, 761 bp, Artificial Sequence
  chemically treated genomic DNA (Homo sapiens) CpG-island No: 15964
ccccaacgcctaaaatactcaaaaacgaacgactaaacaaatccgaatctcgacgaaacaacctccacaactccgaccaacaaaaatcatctcgtccttcgcgaaaacacaacaacccctccgaaaaaaaccaaaactaccgacgctatcgaacgcgaaaactactcgaatcaaccgaaactataaacgcgccgaatttcctctccctaaaccctaaaaaaaaccgcaaccgaaaccacgacgatcgaaaaattaaaccaaaatctcacaaccttcgccacaaaaccgaaatactaaacactccaaacgcgaatcaaaaaatatcccaaacgcccgaatcgtccaccaatacccgacgcgtctttatctcgaaacctcgactaaaataacaaccgaaaacaccgcgcaaaactacaacgcgaaacgaaaaacgaaactaaaaaatcctacaacgacgaacgcgaaccacgacctctccttaaaaaatcgacaacgccgtctaaaccgaaacacacgcaaaaaaacgaccgctcgaaccaaaaactaaacataaacgcgctataaaatcgaaacctaccttccacctcccgctaaattacaccgaaaccttccgcgcctccaaataccatacaaaaaaaattaacgactccaaaatacgtttctcgcgcgacctaaaaccgaaaaaccgcttctactttcctaaatataacaaaaaaaataaacaaaaactccgacctaaccgaaaccccaaatccccgaaa

SEQ ID NO: 15965 - DNA, 649 bp, Artificial Sequence
  chemically treated genomic DNA (Homo sapiens) CpG-island No: 15965
  misc_feature (249)..(249): n is either a, c, g or t
tttgaattcgtcgtttgagtggtcggggtttttatcgttggtcgagagttcgtcgtcggggtttaacggcgatattaagttgtcggggtcgtttgcgtcggcgtttttgttgttttcgttgagtagggacgaattggagtcggattttagcgattggtaggagggcgggtcgtgtcggaggttttgcgtcgtcgtcgtcgtcgttatcgtcgtcgttcggcggtgtagtcgatttgaagtcgagcgtangcggtttttcgaacgttttagcgggagtagcgttgtttcgggttcggttttcgggtcgcgttcgcgttttttacgttttaggttttcgtcgttattttcggcgtacggttcgcggtagtaatttttgtcgttttttacgcgcgttagttcgtacgtgcggtcgaagggagggttgagagatattgggttgtcgaggtagggttgcgggtagttattgtacggtttcgtcgacggttaggatagggagtatacgttgtcgcggcgtgggtaggatagcgaaggtagttcgggaagttgcgtttcggacgcgcggaagttggggaagtagaaggtgtttttcggatttttggtaaaattaatttttaatattttttttttttttaattattttttatttttg

SEQ ID NO: 15966 - DNA, 649 bp, Artificial Sequence
  chemically treated genomic DNA (Homo sapiens) CpG-island No: 15966
  misc_feature (401)..(401): n is either a, c, g or t
caaaaataaaaaataattaaaaaaaaaaaaaatattaaaaattaattttaccaaaaatccgaaaaacaccttctacttccccaacttccgcgcgtccgaaacgcaacttcccgaactaccttcgctatcctacccacgccgcgacaacgtatactccctatcctaaccgtcgacgaaaccgtacaataactacccgcaaccctacctcgacaacccaatatctctcaaccctcccttcgaccgcacgtacgaactaacgcgcgtaaaaaacgacaaaaattactaccgcgaaccgtacgccgaaaataacgacgaaaacctaaaacgtaaaaaacgcgaacgcgacccgaaaaccgaacccgaaacaacgctactcccgctaaaacgttcgaaaaaccgcntacgctcgacttcaaatcgactacaccgccgaacgacgacgataacgacgacgacgacgacgcaaaacctccgacacgacccgccctcctaccaatcgctaaaatccgactccaattcgtccctactcaacgaaaacaacaaaaacgccgacgcaaacgaccccgacaacttaatatcgccgttaaaccccgacgacgaactctcgaccaacgataaaaaccccgaccactcaaacgacgaattcaaa

SEQ ID NO: 15967 - DNA, 649 bp, Artificial Sequence
  chemically treated genomic DNA (Homo sapiens) CpG-island No: 15967
  misc_feature (401)..(401): n is either a, c, g or t
taggaatgaaaggtaattgggggggggggaggtgttgaaaattaattttgttaaaggttcgggagatattttttatttttttaattttcgcgcgttcggggcgtagtttttcgggttgttttcgttgttttatttacgtcgcgataacgtgtgttttttgttttggtcgtcggcggagtcgtgtaatggttattcgtagttttatttcggtagtttagtgttttttaatttttttttcggtcgtacgtgcgagttggcgcgcgtggaggacggtaagggttattatcgcgagtcgtgcgtcgagggtggcggcgggggtttgaagcgtgaggagcgcgggcgcgattcgggagtcgggttcggggtagcgttgttttcgttggagcgttcggggggtcgtntgcgttcggttttaagtcgattatatcgtcgggcggcggcggtggcgacggcggcggcggcgtaggattttcggtacgattcgtttttttgttagtcgttggaattcgattttagttcgtttttgtttaacgagggtaataagggcgtcggcgtaggcgatttcggtagtttggtatcgtcgttgaatttcggcggcgggttttcggttagcggtaaggatttcggttatttaagcggcggatttaaa

SEQ ID NO: 15968 - DNA, 649 bp, Artificial Sequence
  chemically treated genomic DNA (Homo sapiens) CpG-island No: 15968
  misc_feature (249)..(249): n is either a, c, g or t
tttaaatccgccgcttaaataaccgaaatccttaccgctaaccgaaaacccgccgccgaaattcaacgacgataccaaactaccgaaatcgcctacgccgacgcccttattaccctcgttaaacaaaaacgaactaaaatcgaattccaacgactaacaaaaaaacgaatcgtaccgaaaatcctacgccgccgccgccgtcgccaccgccgccgcccgacgatataatcgacttaaaaccgaacgcanacgaccccccgaacgctccaacgaaaacaacgctaccccgaacccgactcccgaatcgcgcccgcgctcctcacgcttcaaacccccgccgccaccctcgacgcacgactcgcgataataacccttaccgtcctccacgcgcgccaactcgcacgtacgaccgaaaaaaaaattaaaaaacactaaactaccgaaataaaactacgaataaccattacacgactccgccgacgaccaaaacaaaaaacacacgttatcgcgacgtaaataaaacaacgaaaacaacccgaaaaactacgccccgaacgcgcgaaaattaaaaaaataaaaaatatctcccgaacctttaacaaaattaattttcaacacctcccccccccccaattacctttcattccta

SEQ ID NO: 15969 - DNA, 536 bp, Artificial Sequence
  chemically treated genomic DNA (Homo sapiens) CpG-island No: 15969
gttttggagcgttttttcgcgttttggacgcgtttcgttcgcggggtcggtttatttggggttataggtgcgtagtcgcggggcgtagtggggttgcgcgcgggcgttcgcggtcggttggaggtgttcggcgatcggtttcgttcgagcgggggatatttatcgagcggttggagagtttttttcgggagtttcggttgaatatggtcggacgttttttgttcgtagcgtcgttcgtcggttcgttcgcgtcgcggtcgggagggcgggtagtttgggcgggtattttcggcggtcgttggtttggttgttttcgttttgtagttttcggttcgtttcggagcgtacgtttatttttttttttttttttttgtttttttttttacgttcgtaggtttttttttttttttcggtattttttcgttttttcgggttcgtttcgcggtttatcggttttttttatttttttttcgtattcggttggggttattttttttttttttttggtttttaggtttattgggtataattttcgg

SEQ ID NO: 15970 - DNA, 536 bp, Artificial Sequence
  chemically treated genomic DNA (Homo sapiens) CpG-island No: 15970
ccgaaaattatacccaataaacctaaaaaccaaaaaaaaaaaaaaaataaccccaaccgaatacgaaaaaaaaataaaaaaaaccgataaaccgcgaaacgaacccgaaaaaacgaaaaaataccgaaaaaaaaaaaaaaacctacgaacgtaaaaaaaaaaacaaaaaaaaaaaaaaaaaaataaacgtacgctccgaaacgaaccgaaaactacaaaacgaaaacaaccaaaccaacgaccgccgaaaatacccgcccaaactacccgccctcccgaccgcgacgcgaacgaaccgacgaacgacgctacgaacaaaaaacgtccgaccatattcaaccgaaactcccgaaaaaaactctccaaccgctcgataaatatcccccgctcgaacgaaaccgatcgccgaacacctccaaccgaccgcgaacgcccgcgcgcaaccccactacgccccgcgactacgcacctataaccccaaataaaccgaccccgcgaacgaaacgcgtccaaaacgcgaaaaaacgctccaaaac

SEQ ID NO: 15971 - DNA, 536 bp, Artificial Sequence
  chemically treated genomic DNA (Homo sapiens) CpG-island No: 15971
tcgggagttgtgtttagtgggtttagaagttagggaaagggagaaagtggttttagtcgggtgcgggggagggatgggaagagtcggtggatcgcggggcgaattcgggagggcggggggatgtcgggagagagggagggatttgcgggcgtggagggagaggtagagggaagggaggaggggtaggcgtgcgtttcggagcgagtcggggattgtaaggcggagatagttaggttagcggtcgtcgagggtgttcgtttaggttattcgttttttcggtcgcggcgcggacggatcgacggacggcgttgcgagtaggaggcgttcggttatgtttagtcggagttttcggaaaagattttttagtcgttcggtgagtgtttttcgttcgagcggggtcgatcgtcgggtatttttagtcggtcgcgagcgttcgcgcgtagttttattgcgtttcgcggttgcgtatttgtggttttaggtaagtcggtttcgcgggcggggcgcgtttagggcgcgagagagcgttttaaggt

SEQ ID NO: 15972 - DNA, 536 bp, Artificial Sequence
  chemically treated genomic DNA (Homo sapiens) CpG-island No: 15972
accttaaaacgctctctcgcgccctaaacgcgccccgcccgcgaaaccgacttacctaaaaccacaaatacgcaaccgcgaaacgcaataaaactacgcgcgaacgctcgcgaccgactaaaaatacccgacgatcgaccccgctcgaacgaaaaacactcaccgaacgactaaaaaatcttttccgaaaactccgactaaacataaccgaacgcctcctactcgcaacgccgtccgtcgatccgtccgcgccgcgaccgaaaaaacgaataacctaaacgaacaccctcgacgaccgctaacctaactatctccgccttacaatccccgactcgctccgaaacgcacgcctacccctcctcccttccctctacctctccctccacgcccgcaaatccctccctctctcccgacatccccccgccctcccgaattcgccccgcgatccaccgactcttcccatccctcccccgcacccgactaaaaccactttctccctttccctaacttctaaacccactaaacacaactcccga

SEQ ID NO: 15973 - DNA, 549 bp, Artificial Sequence
  chemically treated genomic DNA (Homo sapiens) CpG-island No: 15973
ttcgtcgcggagttaggcggtagtatcgacgtcgtcgtagtttttgttcgtatcgcgttaattcgcgttttcggtttatacgtagtcggagcgattgagtcggtagtttcgggtttacgttgcgtatcgtgtgtacggcggggttggttgagttgatttgcgttgggtttcggcgtcgtaggcggttggggagggcggcgtgggagaggacgttgagacgtaggggcggtcgcgtcgaggtgataagttgcgtatttggaaagttattcggttgtttggtgaggttcgtgggtcgggggttttgggcgtcggggtgtgagggcgcgcggggagggacggggtcggggtgcgcgcgtgtgtatgttgtgaatgcgttgcgcgatgtgcgtttttattttatatttagtcggttttttgtttgtgttgttcgagtgtggacgtgtgtacgcgttgtattcgttcggtgtggtagcgtttcgtgagtttttggaggtagggaaaggttatttgtgtttagaggttttgttgagggcgggaggggtttagttt

SEQ ID NO: 15974 - DNA, 549 bp, Artificial Sequence
  chemically treated genomic DNA (Homo sapiens) CpG-island No: 15974
aaactaaacccctcccgccctcaacaaaacctctaaacacaaataacctttccctacctccaaaaactcacgaaacgctaccacaccgaacgaatacaacgcgtacacacgtccacactcgaacaacacaaacaaaaaaccgactaaatataaaataaaaacgcacatcgcgcaacgcattcacaacatacacacgcgcgcaccccgaccccgtccctccccgcgcgccctcacaccccgacgcccaaaacccccgacccacgaacctcaccaaacaaccgaataactttccaaatacgcaacttatcacctcgacgcgaccgcccctacgtctcaacgtcctctcccacgccgccctccccaaccgcctacgacgccgaaacccaacgcaaatcaactcaaccaaccccgccgtacacacgatacgcaacgtaaacccgaaactaccgactcaatcgctccgactacgtataaaccgaaaacgcgaattaacgcgatacgaacaaaaactacgacgacgtcgatactaccgcctaactccgcgacgaa

SEQ ID NO: 15975 - DNA, 549 bp, Artificial Sequence
  chemically treated genomic DNA (Homo sapiens) CpG-island No: 15975
gggttgagtttttttcgtttttaatagaatttttaaatataagtagtttttttttgtttttaggagtttacgaaacgttgttatatcgagcgaatgtaacgcgtatatacgtttatattcgaatagtataagtaagagatcggttgggtgtggaatagaggcgtatatcgcgtaacgtatttatagtatgtatacgcgcgtatttcgatttcgttttttttcgcgcgtttttatatttcggcgtttaagattttcggtttacgaattttattagatagtcgggtaattttttaggtgcgtagtttgttatttcggcgcggtcgtttttgcgttttagcgtttttttttacgtcgttttttttagtcgtttgcggcgtcggagtttagcgtaggttagtttagttagtttcgtcgtgtatacggtgcgtagcgtgggttcggggttgtcggtttagtcgtttcggttacgtgtgagtcgggggcgcgggttagcgcgatgcgggtaggagttgcggcggcgtcggtgttgtcgtttggtttcgcggcggg

SEQ ID NO: 15976 - DNA, 549 bp, Artificial Sequence
  chemically treated genomic DNA (Homo sapiens) CpG-island No: 15976
cccgccgcgaaaccaaacgacaacaccgacgccgccgcaactcctacccgcatcgcgctaacccgcgcccccgactcacacgtaaccgaaacgactaaaccgacaaccccgaacccacgctacgcaccgtatacacgacgaaactaactaaactaacctacgctaaactccgacgccgcaaacgactaaaaaaaacgacgtaaaaaaaaacgctaaaacgcaaaaacgaccgcgccgaaataacaaactacgcacctaaaaaattacccgactatctaataaaattcgtaaaccgaaaatcttaaacgccgaaatataaaaacgcgcgaaaaaaaacgaaatcgaaatacgcgcgtatacatactataaatacgttacgcgatatacgcctctattccacacccaaccgatctcttacttatactattcgaatataaacgtatatacgcgttacattcgctcgatataacaacgtttcgtaaactcctaaaaacaaaaaaaaactacttatatttaaaaattctattaaaaacgaaaaaaactcaaccc

SEQ ID NO: 15977 - DNA, 800 bp, Artificial Sequence
  chemically treated genomic DNA (Homo sapiens) CpG-island No: 15977
ttttcgtcgtgttttacgtattgtgcgttggggtcgatttttaggttgaggggcgtgaggaggttttcgttgatcgatacggtggcgatgtatggggggttgggttcgtatacgttttcggagcggtagtcgaagttgcgttcgtaggagtcggcgcggaagttttcgtatacgttgtggttgtcgaagttttcggtgaggtcgcggtagtaggagacgtcgcggtagggggcggcggtgatgtagtagcggtcgggtcggggtttataagtcgagatgtagttgaaggcgcggatttcgtagggggcgttgaggcgggagtagaggtaggatatggtgcggtggcggtaggggcgggcggttggattttaagtcggcgttgcgttttatatgacggttcgcgggttcggggagggagttcgcggtaaaggcgtttacgagtttggagggttcggttttcgcgtttcgcggagtcgggaatgaaagcgagttaggtcgttcggtcgtttgtataaaacggcgttcgtttttcgttcgagttttatggggtcgggaagcgtttggttagtttcgttgttcgtgcgttgcggttagtgcgagtggaatttttttatttgttcgttttttcgtcgggatttcgagttttgttttgttggattcggtttttatttcggttttagttttatagtttcggtttttcgtagcgggtatcgtgtgtggggcgagtgtgtgcgtgtgtcgagagtgtggggtttttgaagttagtttcgtaggtttatgttatgattttgggtagttga

SEQ ID NO: 15978 - DNA, 800 bp, Artificial Sequence
  chemically treated genomic DNA (Homo sapiens) CpG-island No: 15978
tcaactacccaaaatcataacataaacctacgaaactaacttcaaaaaccccacactctcgacacacgcacacactcgccccacacacgatacccgctacgaaaaaccgaaactataaaactaaaaccgaaataaaaaccgaatccaacaaaacaaaactcgaaatcccgacgaaaaaacgaacaaataaaaaaattccactcgcactaaccgcaacgcacgaacaacgaaactaaccaaacgcttcccgaccccataaaactcgaacgaaaaacgaacgccgttttatacaaacgaccgaacgacctaactcgctttcattcccgactccgcgaaacgcgaaaaccgaaccctccaaactcgtaaacgcctttaccgcgaactccctccccgaacccgcgaaccgtcatataaaacgcaacgccgacttaaaatccaaccgcccgcccctaccgccaccgcaccatatcctacctctactcccgcctcaacgccccctacgaaatccgcgccttcaactacatctcgacttataaaccccgacccgaccgctactacatcaccgccgccccctaccgcgacgtctcctactaccgcgacctcaccgaaaacttcgacaaccacaacgtatacgaaaacttccgcgccgactcctacgaacgcaacttcgactaccgctccgaaaacgtatacgaacccaaccccccatacatcgccaccgtatcgatcaacgaaaacctcctcacgcccctcaacctaaaaatcgaccccaacgcacaatacgtaaaacacgacgaaaa

SEQ ID NO: 15979 - DNA, 800 bp, Artificial Sequence
  chemically treated genomic DNA (Homo sapiens) CpG-island No: 15979
ttagttgtttaaggttatgatatgaatttgcgggattgattttagaggttttatattttcgatatacgtatatattcgttttatatacggtgttcgttgcgggggatcggggttatgggattgggatcgaagtggaggtcggatttaataaggtaaagttcggagtttcggcggaggggcggataggtggaggggttttattcgtattgatcgtagcgtacgggtagcggggttgattaggcgtttttcggttttataaaattcgggcgggaggcgaacgtcgttttatgtaggcggtcgggcggtttggttcgtttttattttcggtttcgcgaggcgcgagggtcgagttttttaagttcgtaaacgtttttgtcgcgagtttttttttcgggttcgcgggtcgttatataaggcgtagcgtcggtttggggtttagtcgttcgtttttgtcgttatcgtattatgttttgtttttattttcgttttagcgttttttgcggggttcgcgtttttagttgtatttcggtttgtgggtttcggttcggtcgttgttgtattatcgtcgttttttatcgcggcgttttttgttatcgcggttttatcggaggtttcggtagttatagcgtgtgcgggggttttcgcgtcggtttttgcggacgtagtttcggttatcgtttcgggggcgtgtgcggatttagttttttatgtatcgttatcgtgtcggttaacgagagtttttttacgttttttaatttggagatcgattttaacgtatagtgcgtgaagtacgacgagaa

SEQ ID NO: 15980 - DNA, 800 bp, Artificial Sequence
  chemically treated genomic DNA (Homo sapiens) CpG-island No: 15980
ttctcgtcgtacttcacgcactatacgttaaaatcgatctccaaattaaaaaacgtaaaaaaactctcgttaaccgacacgataacgatacataaaaaactaaatccgcacacgcccccgaaacgataaccgaaactacgtccgcaaaaaccgacgcgaaaacccccgcacacgctataactaccgaaacctccgataaaaccgcgataacaaaaaacgccgcgataaaaaacgacgataatacaacaacgaccgaaccgaaacccacaaaccgaaatacaactaaaaacgcgaaccccgcaaaaaacgctaaaacgaaaataaaaacaaaacataatacgataacgacaaaaacgaacgactaaaccccaaaccgacgctacgccttatataacgacccgcgaacccgaaaaaaaaactcgcgacaaaaacgtttacgaacttaaaaaactcgaccctcgcgcctcgcgaaaccgaaaataaaaacgaaccaaaccgcccgaccgcctacataaaacgacgttcgcctcccgcccgaattttataaaaccgaaaaacgcctaatcaaccccgctacccgtacgctacgatcaatacgaataaaacccctccacctatccgcccctccgccgaaactccgaactttaccttattaaatccgacctccacttcgatcccaatcccataaccccgatcccccgcaacgaacaccgtatataaaacgaatatatacgtatatcgaaaatataaaacctctaaaatcaatcccgcaaattcatatcataaccttaaacaactaa

SEQ ID NO: 15981 - DNA, 946 bp, Artificial Sequence
  chemically treated genomic DNA (Homo sapiens) CpG-island No: 15981
gtttttgtagagcggtgttagggtttcgaaggcgtcggacgtttcgcgaggtagaggtcggtagcggtgtgggggatcgggtattcggaattatttttatttcggttcggtcgacgcgggttgcggaggacgcgggtcggtttagagatggtttggattaaagcggcgtagagatgttgttggttttcggcgttcggtttgtgcgttcgcgtttagtatttttattttgtttttcgcgtagtcgggtttaggtttttttcggttttcgcgaagttcgtcgcggtttcgggtttttagagggtcgagttcggcgttcggtttttttttaattaagaggttaagaggttgtataattttttagtcgtttttatttattatgcgttacggtttcgcgaagtcgtttatttttagattttcgtcgggtcggtcgagttcggggcgcgttgcggcggttttgagtgcgaggttaggtcgcgtttttcgtcgtttttttagcgtagcgttcgcgagtttcgggtattttaaagagataggttcgttcgtcgtttttttttcggttttttgtttttcgtttttgttttttttttttttttcgttttcgttggggtttatagtcgttagttttcgttaggaggcgttttttattttttcggcgtttttgttagcgcgtacgttttttatttcggtttcgtttatttttttcgttttttttaacgttacgtttttttcgcgttattcggtttcgtttttttttcgtgttacgtttttatcgtaggttttcgttcgttcgtcggttcgtaggttacgtttttaggcgtatttattttagttgtttaacgcgattttttttcgcgttttttcgtatcgggatttttagttttttaggtttcgatagatttttttgttaggtttatttttcgggtttttttagttgtagtgttaagat

SEQ ID NO: 15982 - DNA, 946 bp, Artificial Sequence
  chemically treated genomic DNA (Homo sapiens) CpG-island No: 15982
atcttaacactacaactaaaaaaacccgaaaaataaacctaacaaaaaaatctatcgaaacctaaaaaactaaaaatcccgatacgaaaaaacgcgaaaaaaaatcgcgttaaacaactaaaataaatacgcctaaaaacgtaacctacgaaccgacgaacgaacgaaaacctacgataaaaacgtaacacgaaaaaaaaacgaaaccgaataacgcgaaaaaaacgtaacgttaaaaaaaacgaaaaaaataaacgaaaccgaaataaaaaacgtacgcgctaacaaaaacgccgaaaaaataaaaaacgcctcctaacgaaaactaacgactataaaccccaacgaaaacgaaaaaaaaaaaaaaaacaaaaacgaaaaacaaaaaaccgaaaaaaaaacgacgaacgaacctatctctttaaaatacccgaaactcgcgaacgctacgctaaaaaaacgacgaaaaacgcgacctaacctcgcactcaaaaccgccgcaacgcgccccgaactcgaccgacccgacgaaaatctaaaaataaacgacttcgcgaaaccgtaacgcataataaataaaaacgactaaaaaattatacaacctcttaacctcttaattaaaaaaaaaccgaacgccgaactcgaccctctaaaaacccgaaaccgcgacgaacttcgcgaaaaccgaaaaaaacctaaacccgactacgcgaaaaacaaaataaaaatactaaacgcgaacgcacaaaccgaacgccgaaaaccaacaacatctctacgccgctttaatccaaaccatctctaaaccgacccgcgtcctccgcaacccgcgtcgaccgaaccgaaataaaaataattccgaatacccgatcccccacaccgctaccgacctctacctcgcgaaacgtccgacgccttcgaaaccctaacaccgctctacaaaaac

SEQ ID NO: 15983 - DNA, 946 bp, Artificial Sequence
  chemically treated genomic DNA (Homo sapiens) CpG-island No: 15983
attttaatattgtaattgagggggttcggagaatgggtttgataggagggtttgtcggaatttgagggattggggatttcggtgcggagaagcgcgaagggaaatcgcgttgagtagttggggtgggtgcgtttgggggcgtggtttgcgggtcggcgggcgggcgggagtttgcggtggaggcgtggtacgagggaggggcgaaatcgggtggcgcggagggggcgtggcgttgggaggggcggggggagtgggcggggtcgagatggggggcgtgcgcgttgataggagcgtcgggggagtgagagacgttttttggcgggagttggcggttgtggattttagcgggggcggaggggaagaggggagtaggggcggggagtaaggagtcgggaggagggcggcgggcgggtttgtttttttaaggtgttcgaggttcgcgggcgttgcgttgaggggacggcgggaggcgcggtttggtttcgtatttaaagtcgtcgtagcgcgtttcgggttcggtcgattcggcggggatttaggggtgggcgatttcgcgggatcgtggcgtatggtgagtgggagcggttggggggttgtgtagttttttggttttttggttgggaaggggtcgggcgtcgagttcggttttttagaggttcggggtcgcggcgagtttcgcgggggtcgggagaagtttgggttcggttgcgcggaggataaagtgggggtgttgggcgcgggcgtataggtcggacgtcgggagttagtagtatttttgcgtcgttttggtttagattatttttgggtcggttcgcgtttttcgtagttcgcgtcggtcgagtcggggtgggggtggtttcgggtgttcggttttttatatcgttatcggtttttgtttcgcggggcgttcggcgttttcggggttttggtatcgttttatagaggt

SEQ ID NO: 15984 - DNA, 946 bp, Artificial Sequence
  chemically treated genomic DNA (Homo sapiens) CpG-island No: 15984
acctctataaaacgataccaaaaccccgaaaacgccgaacgccccgcgaaacaaaaaccgataacgatataaaaaaccgaacacccgaaaccacccccaccccgactcgaccgacgcgaactacgaaaaacgcgaaccgacccaaaaataatctaaaccaaaacgacgcaaaaatactactaactcccgacgtccgacctatacgcccgcgcccaacacccccactttatcctccgcgcaaccgaacccaaacttctcccgacccccgcgaaactcgccgcgaccccgaacctctaaaaaaccgaactcgacgcccgaccccttcccaaccaaaaaaccaaaaaactacacaaccccccaaccgctcccactcaccatacgccacgatcccgcgaaatcgcccacccctaaatccccgccgaatcgaccgaacccgaaacgcgctacgacgactttaaatacgaaaccaaaccgcgcctcccgccgtcccctcaacgcaacgcccgcgaacctcgaacaccttaaaaaaacaaacccgcccgccgccctcctcccgactccttactccccgcccctactcccctcttcccctccgcccccgctaaaatccacaaccgccaactcccgccaaaaaacgtctctcactcccccgacgctcctatcaacgcgcacgccccccatctcgaccccgcccactccccccgcccctcccaacgccacgccccctccgcgccacccgatttcgcccctccctcgtaccacgcctccaccgcaaactcccgcccgcccgccgacccgcaaaccacgcccccaaacgcacccaccccaactactcaacgcgatttcccttcgcgcttctccgcaccgaaatccccaatccctcaaattccgacaaaccctcctatcaaacccattctccgaaccccctcaattacaatattaaaat

SEQ ID NO: 15985 - DNA, 538 bp, Artificial Sequence
  chemically treated genomic DNA (Homo sapiens) CpG-island No: 15985
atttagtcgttttttttattttcgggaatttaattattcgagaagttttatggattttagttcgattttttataattagtcgtatcggcgggcgttatttattagaatgggtttttttttttcgttttttttatttgcgatcggaatattattttatttttttcgtttttattttattttatttttttttaatagtagagcgattcggatacgtagttcgtattcgatttttttttcgaaacgtattttaatcggtatcgattcgttttttttttcgatatcgttcggatcgggtttcgttcgaattcgatttgcgtcgattcggttcgattttaacgtttttttaattattcgtgttcgtatttaaatgtttttagtttattttatttatttcgatcgttattaaattttttttttttttcggtttacgttaatcggtattatttatttgattaaattgatttttttttttcgttttttttgttgcgattgttatcgttttatcgtttgtatcgttcgttttgattttatttcgttt

SEQ ID NO: 15986 - DNA, 538 bp, Artificial Sequence
  chemically treated genomic DNA (Homo sapiens) CpG-island No: 15986
aaacgaaataaaatcaaaacgaacgatacaaacgataaaacgataacaatcgcaacaaaaaaaacgaaaaaaaaaaatcaatttaatcaaataaataataccgattaacgtaaaccgaaaaaaaaaaaaaatttaataacgatcgaaataaataaaataaactaaaaacatttaaatacgaacacgaataattaaaaaaacgttaaaatcgaaccgaatcgacgcaaatcgaattcgaacgaaacccgatccgaacgatatcgaaaaaaaaaacgaatcgataccgattaaaatacgtttcgaaaaaaaaatcgaatacgaactacgtatccgaatcgctctactattaaaaaaaaataaaataaaataaaaacgaaaaaaataaaataatattccgatcgcaaataaaaaaaacgaaaaaaaaaaacccattctaataaataacgcccgccgatacgactaattataaaaaatcgaactaaaatccataaaacttctcgaataattaaattcccgaaaataaaaaaaacgactaaat

SEQ ID NO: 15987 - DNA, 538 bp, Artificial Sequence
  chemically treated genomic DNA (Homo sapiens) CpG-island No: 15987
ggacgggatggagttagagcgggcggtataggcggtggggcggtggtaatcgtagtaggggaggcggagggggggggttaatttgattaggtgggtggtgtcgattgacgtaggtcgggaaggggggagggtttggtggcggtcggggtgggtggggtggattggaagtatttggatgcgagtacgagtagttgggaaagcgttgaggtcggatcgggtcgacgtaaatcgagttcgaacggagttcggttcgagcggtgtcgggagggagggcgaatcgatgtcggttggagtgcgtttcgggggagagatcgggtacggattacgtgttcggatcgttttgttattgggagaaggtgaagtgaggtgagggcggagagagtggaatggtgtttcggtcgtagataggggaggcggaggagggaagtttattttgataggtggcgttcgtcgatacgattggttgtgagaggtcgggttggggtttatgaggtttttcggatagttgggttttcgaaggtggaagaggcggttaggt

SEQ ID NO: 15988 - DNA, 538 bp, Artificial Sequence
  chemically treated genomic DNA (Homo sapiens) CpG-island No: 15988
acctaaccgcctcttccaccttcgaaaacccaactatccgaaaaacctcataaaccccaacccgacctctcacaaccaatcgtatcgacgaacgccacctatcaaaataaacttccctcctccgcctcccctatctacgaccgaaacaccattccactctctccgccctcacctcacttcaccttctcccaataacaaaacgatccgaacacgtaatccgtacccgatctctcccccgaaacgcactccaaccgacatcgattcgccctccctcccgacaccgctcgaaccgaactccgttcgaactcgatttacgtcgacccgatccgacctcaacgctttcccaactactcgtactcgcatccaaatacttccaatccaccccacccaccccgaccgccaccaaaccctccccccttcccgacctacgtcaatcgacaccacccacctaatcaaattaaccccccccctccgcctcccctactacgattaccaccgccccaccgcctataccgcccgctctaactccatcccgtcc

SEQ ID NO: 15989 - DNA, 1201 bp, Artificial Sequence
  chemically treated genomic DNA (Homo sapiens) CpG-island No: 15989
ggtttcgacgatttcggagtcgttttcggtttcggatcgtcgacgacgtacgtgtaggtttggggatggggcgttggttgcgagcggcgcgttcgtcgagatggttgcggttggtagggcggtgggcgaggtcggtgatttaataaagcggtcgggtcgcgggaggtttcgttcggtcgggtttcggtattcgtcgtagggtttcggtcggcggtaggttgcgcgttttcgttcgtagcgttcggcgtgagggcggttcgggaggagggtgtgagcgcgcgtcgtcgggtcgggattcggtaagtagcgggaaaggcgggaggcgggagcgtcggtcgttcgggagtcgcgcggaggggtaggcggggcggggcggggcgcggttgggggttcgggcggtcgggagtcgcgtcgttcgcggtaggttcgggttttcggttcgtttcgcgcgcgcgttttcgttagttcggtttttttttttttcgtcgtttttttcgcgcgcgtttatcggtttttcggttcgcgtcgttttatgtagtttcggtttttcgggcggtcgcggaggagggggcgattataagatggcgggtacgtggttttttgtttttcgggcggcggcggtttttcgagtttattcgtttttcgtcgtagttttgagtggttgtcgggtcggggtcggcgtggggtttcggcgcgggaaggcgttttcggggcgggggggaggcgggcggggggggggcgtcgcgtcgggtttcggggcgttgatcgggtttttttttttttttttcggcgtagatttttcgttgttttaggaggatttgtaggaggacgtagacggatgtgagtggttcggtttcgcggtggtttggtagttcgcggggagcggtcggggagggcgggcggcggcgaggtttgggtcgggttttggttggttgaggggacggtgggcgagggcggttttaggcgggttggggtggcgatcgggggggaaaatttcgcgttcgtgaggaaacggcgcgtttaggtttcgttgggggagggagacgttcggagtaacgtttaagttcgtttttcgtttttcgtttttttttttcggcgttttcgaatcgtttgcgggtttagtagtggcgcggttgttttggaaggagaagcggtggggtaggatttgaagtggggtttgggtgtgtttttgtttttggtg

SEQ ID NO: 15990 - DNA, 1201 bp, Artificial Sequence
  chemically treated genomic DNA (Homo sapiens) CpG-island No: 15990
caccaaaaacaaaaacacacccaaaccccacttcaaatcctaccccaccgcttctccttccaaaacaaccgcgccactactaaacccgcaaacgattcgaaaacgccgaaaaaaaaaaacgaaaaacgaaaaacgaacttaaacgttactccgaacgtctccctcccccaacgaaacctaaacgcgccgtttcctcacgaacgcgaaattttcccccccgatcgccaccccaacccgcctaaaaccgccctcgcccaccgtcccctcaaccaaccaaaacccgacccaaacctcgccgccgcccgccctccccgaccgctccccgcgaactaccaaaccaccgcgaaaccgaaccactcacatccgtctacgtcctcctacaaatcctcctaaaacaacgaaaaatctacgccgaaaaaaaaaaaaaaaaacccgatcaacgccccgaaacccgacgcgacgccccccccccgcccgcctcccccccgccccgaaaacgccttcccgcgccgaaaccccacgccgaccccgacccgacaaccactcaaaactacgacgaaaaacgaataaactcgaaaaaccgccgccgcccgaaaaacaaaaaaccacgtacccgccatcttataatcgccccctcctccgcgaccgcccgaaaaaccgaaactacataaaacgacgcgaaccgaaaaaccgataaacgcgcgcgaaaaaaacgacgaaaaaaaaaaaaaccgaactaacgaaaacgcgcgcgcgaaacgaaccgaaaacccgaacctaccgcgaacgacgcgactcccgaccgcccgaacccccaaccgcgccccgccccgccccgcctacccctccgcgcgactcccgaacgaccgacgctcccgcctcccgcctttcccgctacttaccgaatcccgacccgacgacgcgcgctcacaccctcctcccgaaccgccctcacgccgaacgctacgaacgaaaacgcgcaacctaccgccgaccgaaaccctacgacgaataccgaaacccgaccgaacgaaacctcccgcgacccgaccgctttattaaatcaccgacctcgcccaccgccctaccaaccgcaaccatctcgacgaacgcgccgctcgcaaccaacgccccatccccaaacctacacgtacgtcgtcgacgatccgaaaccgaaaacgactccgaaatcgtcgaaacc

SEQ ID NO: 15991 - DNA, 1201 bp, Artificial Sequence
  chemically treated genomic DNA (Homo sapiens) CpG-island No: 15991
tattaggggtagaaatatatttaaattttattttaaattttgttttatcgtttttttttttaaaatagtcgcgttattgttgagttcgtaggcgattcgggggcgtcgggagaagagagcgaagggcggaaagcgaatttgggcgttatttcgggcgttttttttttttagcggaatttgggcgcgtcgtttttttacggacgcgagattttttttttcgatcgttattttagttcgtttggggtcgttttcgtttatcgtttttttagttagttagggttcggtttaggtttcgtcgtcgttcgtttttttcggtcgtttttcgcggattgttaggttatcgcgaggtcgggttatttatattcgtttgcgtttttttgtaggtttttttgaagtagcgagaggtttgcgtcgaggggagagaagaaaggttcggttagcgtttcggggttcggcgcgacgtttttttttcgttcgtttttttttcgtttcgggggcgttttttcgcgtcgggattttacgtcggtttcggttcggtagttatttagggttgcggcggagggcgggtgggttcgaggagtcgtcgtcgttcggagaatagggggttacgtattcgttattttgtggtcgttttttttttcgcggtcgttcggggagtcggggttatatggagcggcgcgagtcggggagtcggtggacgcgcgcgggaggggcggcggggaggaggagggtcgggttggcgggggcgcgcgcgcggggcgggtcgagggttcgggtttgtcgcgggcggcgcggttttcggtcgttcgggtttttagtcgcgtttcgtttcgtttcgtttgttttttcgcgcggttttcgggcgatcggcgttttcgtttttcgtttttttcgttgtttgtcgggtttcggttcggcgacgcgcgtttatatttttttttcgagtcgtttttacgtcgagcgttgcggacgggggcgcgtaatttgtcgtcggtcgggattttgcggcgagtgtcggaattcggtcgggcggggtttttcgcggttcggtcgttttattgggttatcggtttcgtttatcgttttgttagtcgtagttatttcggcgggcgcgtcgttcgtagttagcgttttatttttaggtttgtacgtacgtcgtcggcgattcggggtcgggggcggtttcgaggtcgtcggggtt

SEQ ID NO: 15992 - DNA, 1201 bp, Artificial Sequence
  chemically treated genomic DNA (Homo sapiens) CpG-island No: 15992
aaccccgacgacctcgaaaccgcccccgaccccgaatcgccgacgacgtacgtacaaacctaaaaataaaacgctaactacgaacgacgcgcccgccgaaataactacgactaacaaaacgataaacgaaaccgataacccaataaaacgaccgaaccgcgaaaaaccccgcccgaccgaattccgacactcgccgcaaaatcccgaccgacgacaaattacgcgcccccgtccgcaacgctcgacgtaaaaacgactcgaaaaaaaaatataaacgcgcgtcgccgaaccgaaacccgacaaacaacgaaaaaaacgaaaaacgaaaacgccgatcgcccgaaaaccgcgcgaaaaaacaaacgaaacgaaacgaaacgcgactaaaaacccgaacgaccgaaaaccgcgccgcccgcgacaaacccgaaccctcgacccgccccgcgcgcgcgcccccgccaacccgaccctcctcctccccgccgcccctcccgcgcgcgtccaccgactccccgactcgcgccgctccatataaccccgactccccgaacgaccgcgaaaaaaaaaacgaccacaaaataacgaatacgtaaccccctattctccgaacgacgacgactcctcgaacccacccgccctccgccgcaaccctaaataactaccgaaccgaaaccgacgtaaaatcccgacgcgaaaaaacgcccccgaaacgaaaaaaaaacgaacgaaaaaaaaacgtcgcgccgaaccccgaaacgctaaccgaacctttcttctctcccctcgacgcaaacctctcgctacttcaaaaaaacctacaaaaaaacgcaaacgaatataaataacccgacctcgcgataacctaacaatccgcgaaaaacgaccgaaaaaaacgaacgacgacgaaacctaaaccgaaccctaactaactaaaaaaacgataaacgaaaacgaccccaaacgaactaaaataacgatcgaaaaaaaaaatctcgcgtccgtaaaaaaacgacgcgcccaaattccgctaaaaaaaaaaaacgcccgaaataacgcccaaattcgctttccgcccttcgctctcttctcccgacgcccccgaatcgcctacgaactcaacaataacgcgactattttaaaaaaaaaaacgataaaacaaaatttaaaataaaatttaaatatatttctacccctaata

SEQ ID NO: 15993 - DNA, 738 bp, Artificial Sequence
  chemically treated genomic DNA (Homo sapiens) CpG-island No: 15993
aaattcgagcgttgcgagtatcgagttttatacgttgtttgatagacgcgggcgcgaggtcggcgcgggagagggtttttcgggtattttaggggtatcgtcgcgattttagtacgcgatcgttttttgcgattgatttgtgtttgtcgtcgcgcgatcgttcgtttcgtcgtagttttcgttttttcgcgtttacgttgtcgtcgtagttatcggagtcgttttttgcgttgcgttttaggtcggtttcgggcgttttatttttatttcgtttagtttttgtttgtttataatgattgggacggaacgggacgaggcggtttagcgcgtacgcgtatttttttttttcgtcgtagtcggtttttcggattttttttttcgtttagacggttgaagtcgttaagggtaggcgatttgggttttcgcgcggggcgcgttgggaggcgtagtttttaaggtttcggcgtttagttagttcgaaggtttttcgttaaggaagtaaattataatatttaggaggtatcgcgtttttttcgtttttaggttcgttgaggagattgaagaagagcgcgagagaacgcgtcgagggttagtgttttgtaggcgtttgcgtagtcggtggttttgcgggtttcggggacggacggtttatttcggtgtggtgttggcgaaggtggtttacgggtattttttgtaacggttttgaggatggaaagggtttttttttttacgttttgg

SEQ ID NO: 15994 - DNA, 738 bp, Artificial Sequence
  chemically treated genomic DNA (Homo sapiens) CpG-island No: 15994
ccaaaacgtaaaaaaaaaaaccctttccatcctcaaaaccgttacaaaaaatacccgtaaaccaccttcgccaacaccacaccgaaataaaccgtccgtccccgaaacccgcaaaaccaccgactacgcaaacgcctacaaaacactaaccctcgacgcgttctctcgcgctcttcttcaatctcctcaacgaacctaaaaacgaaaaaaacgcgatacctcctaaatattataatttacttccttaacgaaaaaccttcgaactaactaaacgccgaaaccttaaaaactacgcctcccaacgcgccccgcgcgaaaacccaaatcgcctacccttaacgacttcaaccgtctaaacgaaaaaaaaaatccgaaaaaccgactacgacgaaaaaaaaaaatacgcgtacgcgctaaaccgcctcgtcccgttccgtcccaatcattataaacaaacaaaaactaaacgaaataaaaataaaacgcccgaaaccgacctaaaacgcaacgcaaaaaacgactccgataactacgacgacaacgtaaacgcgaaaaaacgaaaactacgacgaaacgaacgatcgcgcgacgacaaacacaaatcaatcgcaaaaaacgatcgcgtactaaaatcgcgacgatacccctaaaatacccgaaaaaccctctcccgcgccgacctcgcgcccgcgtctatcaaacaacgtataaaactcgatactcgcaacgctcgaattt

SEQ ID NO: 15995 - DNA, 738 bp, Artificial Sequence
  chemically treated genomic DNA (Homo sapiens) CpG-island No: 15995
ttagagcgtggagaggaaagttttttttatttttaaggtcgttgtaggagatgttcgtgagttattttcgttagtattatatcggggtaagtcgttcgttttcgaaattcgtaaggttatcgattgcgtaggcgtttgtagagtattggttttcggcgcgttttttcgcgtttttttttagtttttttagcgagtttggggacgaagggggcgcggtgttttttgggtgttgtagtttgtttttttggcgagaggttttcgggttggttggacgtcggggttttgggaattacgttttttagcgcgtttcgcgcgagagtttaggtcgtttgtttttgacggttttagtcgtttgagcggagaggaggattcgggaagtcggttgcggcgggaggagggaatgcgcgtgcgcgttggatcgtttcgtttcgtttcgttttaattattgtaaataggtagaggttgggcggggtgggaatggggcgttcgaggtcggtttggggcgtagcgtaggaggcggtttcggtggttgcggcggtagcgtgagcgcgaggaggcggaggttgcggcggggcggacggtcgcgcggcggtaggtataggttagtcgtagggagcggtcgcgtgttagggtcgcggcgatatttttggagtgttcgaggaattttttttcgcgtcggtttcgcgttcgcgtttgttaggtagcgtgtggggttcggtgttcgtagcgttcgggttt

SEQ ID NO: 15996 - DNA, 738 bp, Artificial Sequence
  chemically treated genomic DNA (Homo sapiens) CpG-island No: 15996
aaacccgaacgctacgaacaccgaaccccacacgctacctaacaaacgcgaacgcgaaaccgacgcgaaaaaaaattcctcgaacactccaaaaatatcgccgcgaccctaacacgcgaccgctccctacgactaacctatacctaccgccgcgcgaccgtccgccccgccgcaacctccgcctcctcgcgctcacgctaccgccgcaaccaccgaaaccgcctcctacgctacgccccaaaccgacctcgaacgccccattcccaccccgcccaacctctacctatttacaataattaaaacgaaacgaaacgaaacgatccaacgcgcacgcgcattccctcctcccgccgcaaccgacttcccgaatcctcctctccgctcaaacgactaaaaccgtcaaaaacaaacgacctaaactctcgcgcgaaacgcgctaaaaaacgtaattcccaaaaccccgacgtccaaccaacccgaaaacctctcgccaaaaaaacaaactacaacacccaaaaaacaccgcgcccccttcgtccccaaactcgctaaaaaaactaaaaaaaaacgcgaaaaaacgcgccgaaaaccaatactctacaaacgcctacgcaatcgataaccttacgaatttcgaaaacgaacgacttaccccgatataatactaacgaaaataactcacgaacatctcctacaacgaccttaaaaataaaaaaaactttcctctccacgctctaa

SEQ ID NO: 15997 - DNA, 969 bp, Artificial Sequence
  chemically treated genomic DNA (Homo sapiens) CpG-island No: 15997
tagagacggtgcgggggtcggtggttttaggttttttttagttatttgcgacgtattcgcggttttcgcgtgttgtgaaatcgggaattgttggatgtcggagttaagagtgaggtcggtttggaaagtgtagtcgtttgcgtcggagaggttggaaacgtttcggtttcgggtaggggttttcggcggcgttcgggtggttcgcggcgttttcggaagatgcgggcggacgttcgtgtgtttcgttggtttgacgtcgtaggggtggtcgtagagtttttacggggatttcgttcgtcgggatttatggaggggattttgacggggtagttagggttgaggttttttaatttcgtgtgttttttttttttcgacgttcggtagaggcgttttcgttttcgtcgttcgtagaggtttcgaaggagtcgttgtagttcgagttcgtttcgtcgaggtttagcggtttcgtaatcgtagaggattttgggcgacggttcgttttgttttagcggtttttcgaggagaggtcgttttagtcgttaggttttatcggggttatcgcggagacgggttaggtcgggtttttcgtaggcgtaggcgtgtttgggcggggtttgtcgcggggcgtggacggttagatcgggagcggtatcgttttcggcgtagaaggtttcgcgggcgtattaggtgaggttcggggttgcgcggggaggagcgcggggttttttcggaattttcgtttgagtttcggggtttgttgaggggcgtggcggttcggggtttagttttcgggggggtaagtttcgaaatgtagttttggaaggatgtcgaggttcgagggatcgtttatgttagtttagtatacggaggtcggggtattttagggatagtgtagtcgtttgtatttagatatattgagtggtttcgtcggttggagtacgagtgttatacgggtagtttattgatttt

SEQ ID NO: 15998 - DNA, 969 bp, Artificial Sequence
  chemically treated genomic DNA (Homo sapiens) CpG-island No: 15998
aaaatcaataaactacccgtataacactcgtactccaaccgacgaaaccactcaatatatctaaatacaaacgactacactatccctaaaataccccgacctccgtatactaaactaacataaacgatccctcgaacctcgacatccttccaaaactacatttcgaaacttacccccccgaaaactaaaccccgaaccgccacgcccctcaacaaaccccgaaactcaaacgaaaattccgaaaaaaccccgcgctcctccccgcgcaaccccgaacctcacctaatacgcccgcgaaaccttctacgccgaaaacgataccgctcccgatctaaccgtccacgccccgcgacaaaccccgcccaaacacgcctacgcctacgaaaaacccgacctaacccgtctccgcgataaccccgataaaacctaacgactaaaacgacctctcctcgaaaaaccgctaaaacaaaacgaaccgtcgcccaaaatcctctacgattacgaaaccgctaaacctcgacgaaacgaactcgaactacaacgactccttcgaaacctctacgaacgacgaaaacgaaaacgcctctaccgaacgtcgaaaaaaaaaaaacacacgaaattaaaaaacctcaaccctaactaccccgtcaaaatcccctccataaatcccgacgaacgaaatccccgtaaaaactctacgaccacccctacgacgtcaaaccaacgaaacacacgaacgtccgcccgcatcttccgaaaacgccgcgaaccacccgaacgccgccgaaaacccctacccgaaaccgaaacgtttccaacctctccgacgcaaacgactacactttccaaaccgacctcactcttaactccgacatccaacaattcccgatttcacaacacgcgaaaaccgcgaatacgtcgcaaataactaaaaaaaacctaaaaccaccgacccccgcaccgtctcta

SEQ ID NO: 15999 - DNA, 969 bp, Artificial Sequence
  chemically treated genomic DNA (Homo sapiens) CpG-island No: 15999
ggaattaatgagttgttcgtgtggtattcgtattttaatcggcggggttatttagtatgtttaagtatagacgattgtattgtttttgaggtgtttcggttttcgtgtgttggattagtatgagcggtttttcgggtttcggtatttttttaaagttgtatttcggaatttgttttttcgaaggttggatttcgaatcgttacgttttttagtagatttcgaggtttaggcggaagtttcgggagagtttcgcgttttttttcgcgtagtttcgggttttatttggtgcgttcgcgaagttttttgcgtcggggacggtgtcgttttcggtttggtcgtttacgtttcgcggtagatttcgtttagatacgtttgcgtttgcggggggttcggtttggttcgttttcgcgatgatttcggtggagtttggcggttggggcggttttttttcggggggtcgttggggtaggacgggtcgtcgtttagggttttttgcggttgcggggtcgttgggtttcggcggggcgggttcgggttgtagcggttttttcggggtttttgcgggcggcgggggcgagggcgtttttgtcgggcgtcggggagaaagaaatatacgggattaggaaattttagttttgattgtttcgttagggttttttttatgagtttcggcgagcggggttttcgtgaggattttgcggttatttttgcgacgttaggttagcgggatatacgggcgttcgttcgtatttttcgaggacgtcgcgggttattcggacgtcgtcggggatttttgttcggggtcggggcgtttttagttttttcggcgtagacggttgtattttttaaatcggttttatttttggtttcggtatttaataattttcgattttatagtacgcggaaatcgcgggtgcgtcgtaagtgattgaaagggatttgaggttatcgattttcgtatcgtttttg

SEQ ID NO: 16000 - DNA, 969 bp, Artificial Sequence
  chemically treated genomic DNA (Homo sapiens) CpG-island No: 16000
caaaaacgatacgaaaatcgataacctcaaatccctttcaatcacttacgacgcacccgcgatttccgcgtactataaaatcgaaaattattaaataccgaaaccaaaaataaaaccgatttaaaaaatacaaccgtctacgccgaaaaaactaaaaacgccccgaccccgaacaaaaatccccgacgacgtccgaataacccgcgacgtcctcgaaaaatacgaacgaacgcccgtatatcccgctaacctaacgtcgcaaaaataaccgcaaaatcctcacgaaaaccccgctcgccgaaactcataaaaaaaaccctaacgaaacaatcaaaactaaaatttcctaatcccgtatatttctttctccccgacgcccgacaaaaacgccctcgcccccgccgcccgcaaaaaccccgaaaaaaccgctacaacccgaacccgccccgccgaaacccaacgaccccgcaaccgcaaaaaaccctaaacgacgacccgtcctaccccaacgaccccccgaaaaaaaaccgccccaaccgccaaactccaccgaaatcatcgcgaaaacgaaccaaaccgaaccccccgcaaacgcaaacgtatctaaacgaaatctaccgcgaaacgtaaacgaccaaaccgaaaacgacaccgtccccgacgcaaaaaacttcgcgaacgcaccaaataaaacccgaaactacgcgaaaaaaaacgcgaaactctcccgaaacttccgcctaaacctcgaaatctactaaaaaacgtaacgattcgaaatccaaccttcgaaaaaacaaattccgaaatacaactttaaaaaaataccgaaacccgaaaaaccgctcatactaatccaacacacgaaaaccgaaacacctcaaaaacaatacaatcgtctatacttaaacatactaaataaccccgccgattaaaatacgaataccacacgaacaactcattaattcc

SEQ ID NO: 16001 - DNA, 756 bp, Artificial Sequence
  chemically treated genomic DNA (Homo sapiens) CpG-island No: 16001
gcggagcgcgcgaggtttagcggttttttcgttaagtttttgttatcggcgcgcggtcgttcgcgttgcggtagcggcggcggcgcggttgattgcggcggtagcgcggtagcggtgattgggtatcgcgcggtgcgggtgttttcgtcgtcgtcgttttcggagcgggaggtggggatgtgcgagtcgaggcgcggagggagggacgggcgtatcgaggaagggcgggggttttttaggttagggtttcgcggtcgtttcgggggatagagttgttttttgtttcgagtttcgtattattttttttttcgggtcgtcgtagttcgggtcgtttcgttaatgattgatgcgggggtcgtaggttggtcggcgacgcggcggcgcgcgcgtcgagtattagagtcggttttggggttcgaaattcgatagttacgcgggcgttttggaggatattggggagtcgcgttcgcggggggcggggagttgcggttgcggggggaggggagggcgtcggagtcgggtagggcggagagatgcgttagcggtaattttcggaggtcgtcggggaggggggtatttcggaagtcggggggttttaagttcgcgttcggatcggggtcgtgttattgttagttatttggggatgcgtttttcgtttttttattgtttttgcgtgtgtgttagtgtgtgtgtgtgtgtgtgtgtgtgtgtgtcggtttgtttacgtattatacgaaggtttagttggtttttttt

SEQ ID NO: 16002 - DNA, 756 bp, Artificial Sequence
  chemically treated genomic DNA (Homo sapiens) CpG-island No: 16002
aaaaaaaaccaactaaaccttcgtataatacgtaaacaaaccgacacacacacacacacacacacacacacactaacacacacgcaaaaacaataaaaaaacgaaaaacgcatccccaaataactaacaataacacgaccccgatccgaacgcgaacttaaaaccccccgacttccgaaatacccccctccccgacgacctccgaaaattaccgctaacgcatctctccgccctacccgactccgacgccctcccctccccccgcaaccgcaactccccgccccccgcgaacgcgactccccaatatcctccaaaacgcccgcgtaactatcgaatttcgaaccccaaaaccgactctaatactcgacgcgcgcgccgccgcgtcgccgaccaacctacgacccccgcatcaatcattaacgaaacgacccgaactacgacgacccgaaaaaaaaaataatacgaaactcgaaacaaaaaacaactctatcccccgaaacgaccgcgaaaccctaacctaaaaaacccccgcccttcctcgatacgcccgtccctccctccgcgcctcgactcgcacatccccacctcccgctccgaaaacgacgacgacgaaaacacccgcaccgcgcgatacccaatcaccgctaccgcgctaccgccgcaatcaaccgcgccgccgccgctaccgcaacgcgaacgaccgcgcgccgataacaaaaacttaacgaaaaaaccgctaaacctcgcgcgctccgc

SEQ ID NO: 16003 - DNA, 756 bp, Artificial Sequence
  chemically treated genomic DNA (Homo sapiens) CpG-island No: 16003
aaagaagattaattaagttttcgtgtagtgcgtagataggtcgatatatatatatatatatatatatatatattaatatatacgtaaagatagtgagggagcgagaggcgtatttttaggtagttgataatgatacggtttcgattcggacgcgggtttaaagtttttcgattttcggagtgttttttttttcggcgattttcggagattatcgttggcgtattttttcgttttgttcggtttcggcgttttttttttttttcgtagtcgtagtttttcgtttttcgcgaacgcggttttttagtgttttttagaacgttcgcgtggttgtcgggtttcgaattttagggtcgattttagtattcggcgcgcgcgtcgtcgcgtcgtcgattagtttgcggttttcgtattaattattaacggggcggttcgggttgcggcggttcgaggagggggatggtacggaattcgagataggggataattttatttttcgaagcggtcgcgaaattttagtttgggaggttttcgttttttttcggtgcgttcgttttttttttcgcgtttcggttcgtatatttttatttttcgtttcgggggcggcggcggcggaggtattcgtatcgcgcgatgtttagttatcgttgtcgcgttgtcgtcgtagttagtcgcgtcgtcgtcgttgtcgtagcgcgggcggtcgcgcgtcggtagtaggggtttggcgaggaagtcgttgagtttcgcgcgtttcgt

SEQ ID NO: 16004 - DNA, 756 bp, Artificial Sequence
  chemically treated genomic DNA (Homo sapiens) CpG-island No: 16004
acgaaacgcgcgaaactcaacgacttcctcgccaaacccctactaccgacgcgcgaccgcccgcgctacgacaacgacgacgacgcgactaactacgacgacaacgcgacaacgataactaaacatcgcgcgatacgaatacctccgccgccgccgcccccgaaacgaaaaataaaaatatacgaaccgaaacgcgaaaaaaaaaacgaacgcaccgaaaaaaaacgaaaacctcccaaactaaaatttcgcgaccgcttcgaaaaataaaattatcccctatctcgaattccgtaccatccccctcctcgaaccgccgcaacccgaaccgccccgttaataattaatacgaaaaccgcaaactaatcgacgacgcgacgacgcgcgcgccgaatactaaaatcgaccctaaaattcgaaacccgacaaccacgcgaacgttctaaaaaacactaaaaaaccgcgttcgcgaaaaacgaaaaactacgactacgaaaaaaaaaaaaaacgccgaaaccgaacaaaacgaaaaaatacgccaacgataatctccgaaaatcgccgaaaaaaaaaacactccgaaaatcgaaaaactttaaacccgcgtccgaatcgaaaccgtatcattatcaactacctaaaaatacgcctctcgctccctcactatctttacgtatatattaatatatatatatatatatatatatatatatcgacctatctacgcactacacgaaaacttaattaatcttcttt

SEQ ID NO: 16005 - DNA, 517 bp, Artificial Sequence
  chemically treated genomic DNA (Homo sapiens) CpG-island No: 16005
gcggtgagagcgtttcgttaattatttcgataattagttttgttattcgtcgggttatttgtattagttgcgcgtcggttagcgatacgggacgttaggtgtttttgtaattcggaagtaattttatttataattatttgtttcggtttatgagcgtaaattacgcgttcgtggttgtcggtttttagtaggcgattatcgacgttgaggtaggtagtgtcgttgattttttcggtatcgaatagggcgtagttcgcggtgttatcgtcgatgtcgatatttagtattcgatatagtcgttgtttagaaagggtttgtgtttcggtttcgtgatcggcgattacggattcgaggtgcggttcggcgttggtaacgataaaatcgtttagcgattgagagagcgttattatcgtcgggcgagtattgcgggttttcgcgtttttatcggtgatgatgatggtattagaattaacgtttttcggtttaatattcgtagtatgatattgttcgagtatta

SEQ ID NO: 16006 - DNA, 517 bp, Artificial Sequence
  chemically treated genomic DNA (Homo sapiens) CpG-island No: 16006
taatactcgaacaatatcatactacgaatattaaaccgaaaaacgttaattctaataccatcatcatcaccgataaaaacgcgaaaacccgcaatactcgcccgacgataataacgctctctcaatcgctaaacgattttatcgttaccaacgccgaaccgcacctcgaatccgtaatcgccgatcacgaaaccgaaacacaaaccctttctaaacaacgactatatcgaatactaaatatcgacatcgacgataacaccgcgaactacgccctattcgataccgaaaaaatcaacgacactacctacctcaacgtcgataatcgcctactaaaaaccgacaaccacgaacgcgtaatttacgctcataaaccgaaacaaataattataaataaaattacttccgaattacaaaaacacctaacgtcccgtatcgctaaccgacgcgcaactaatacaaataacccgacgaataacaaaactaattatcgaaataattaacgaaacgctctcaccgc

SEQ ID NO: 16007 - DNA, 517 bp, Artificial Sequence
  chemically treated genomic DNA (Homo sapiens) CpG-island No: 16007
taatattcgagtaatattatgttgcgggtattgagtcggaaagcgttgattttggtgttattattattatcggtgaaagcgcgaaaattcgtaatgttcgttcggcggtgatggcgtttttttagtcgttgggcgattttgtcgttgttagcgtcgggtcgtatttcgaattcgtgatcgtcggttacggagtcggggtataaattttttttgaataacggttgtgtcgggtattgaatatcgatatcggcggtggtatcgcgaattacgttttgttcgatgtcggaaaaattagcggtattgtttgttttaacgtcggtggtcgtttgttggaaatcgatagttacgggcgcgtggtttacgtttataaatcggggtagatgattgtggatgaggttgttttcgagttgtagggatatttgacgtttcgtatcgttgatcggcgcgtagttggtgtaggtgattcggcggatggtagaattgattgtcgaagtgattgacggaacgtttttatcgt

SEQ ID NO: 16008 - DNA, 517 bp, Artificial Sequence
  chemically treated genomic DNA (Homo sapiens) CpG-island No: 16008
acgataaaaacgttccgtcaatcacttcgacaatcaattctaccatccgccgaatcacctacaccaactacgcgccgatcaacgatacgaaacgtcaaatatccctacaactcgaaaacaacctcatccacaatcatctaccccgatttataaacgtaaaccacgcgcccgtaactatcgatttccaacaaacgaccaccgacgttaaaacaaacaataccgctaatttttccgacatcgaacaaaacgtaattcgcgataccaccgccgatatcgatattcaatacccgacacaaccgttattcaaaaaaaatttataccccgactccgtaaccgacgatcacgaattcgaaatacgacccgacgctaacaacgacaaaatcgcccaacgactaaaaaaacgccatcaccgccgaacgaacattacgaattttcgcgctttcaccgataataataataacaccaaaatcaacgctttccgactcaatacccgcaacataatattactcgaatatta

SEQ ID NO: 16009 - DNA, 595 bp, Artificial Sequence
  chemically treated genomic DNA (Homo sapiens) CpG-island No: 16009
gaagtacgtattttttttttttcgatagcgtgtttaacgttcgtgaagagcgtatggtattgcgttaggagtaggaatagttgtagtttcgtatttagagtttgatgtagcgtgcgtcggtttggttggtagcgtaaaatagttttaattagttgagcgaatagtgcggcgaagagtttatttttagttaggacgttatcgaatatttgtaatagttgttggagcgtgagcgagaggcgattgttgaacgcgatgaagtgggcgcgcgtaaaaacgtcgtcgatgaagagatcgaacgtttaagttagtttggcggttttgaagattagcgtttgaacgcgttggcggagcgttttggtggtgtgttgttgttagaaatttatgacgacgttagtttggaagatgcgtcgtattttttagcgttgtatggttcgttacgttacgttatcgtggtgttagatttgttataggtaattgaatatttggaaggtttgatcgattgttcggaagatttttatttgatcgaaggagattcgtagttattcgatgatagcgtgtttagcgttgatgagttggaaaaagcggtagtggtgaa

SEQ ID NO: 16010 - DNA, 595 bp, Artificial Sequence
  chemically treated genomic DNA (Homo sapiens) CpG-island No: 16010
ttcaccactaccgctttttccaactcatcaacgctaaacacgctatcatcgaataactacgaatctccttcgatcaaataaaaatcttccgaacaatcgatcaaaccttccaaatattcaattacctataacaaatctaacaccacgataacgtaacgtaacgaaccatacaacgctaaaaaatacgacgcatcttccaaactaacgtcgtcataaatttctaacaacaacacaccaccaaaacgctccgccaacgcgttcaaacgctaatcttcaaaaccgccaaactaacttaaacgttcgatctcttcatcgacgacgtttttacgcgcgcccacttcatcgcgttcaacaatcgcctctcgctcacgctccaacaactattacaaatattcgataacgtcctaactaaaaataaactcttcgccgcactattcgctcaactaattaaaactattttacgctaccaaccaaaccgacgcacgctacatcaaactctaaatacgaaactacaactattcctactcctaacgcaataccatacgctcttcacgaacgttaaacacgctatcgaaaaaaaaaaaatacgtacttc

SEQ ID NO: 16011 - DNA, 595 bp, Artificial Sequence
  chemically treated genomic DNA (Homo sapiens) CpG-island No: 16011
tttattattatcgttttttttagtttattaacgttgaatacgttgttatcgaatgattgcggatttttttcgattagatagagatttttcgggtaatcggttaagttttttaggtgtttagttatttgtgatagatttggtattacgatggcgtggcgtgacgggttatatagcgttgagaagtacggcgtattttttaggttaacgtcgttataaatttttgatagtagtatattattaaaacgtttcgttagcgcgtttagacgttgatttttagagtcgttaggttggtttaaacgttcgatttttttatcgacggcgtttttgcgcgcgtttattttatcgcgtttaataatcgtttttcgtttacgttttagtaattgttgtagatattcggtgacgttttggttggaggtaaatttttcgtcgtattgttcgtttaattggttgagattgttttgcgttgttagttaaatcggcgtacgttgtattaaattttgaatgcgagattgtagttgtttttgtttttggcgtagtgttatgcgttttttacgggcgttagatacgttatcggaaagagagggatgcgtgtttt

SEQ ID NO: 16012 - DNA, 595 bp, Artificial Sequence
  chemically treated genomic DNA (Homo sapiens) CpG-island No: 16012
aaaacacgcatccctctctttccgataacgtatctaacgcccgtaaaaaacgcataacactacgccaaaaacaaaaacaactacaatctcgcattcaaaatttaatacaacgtacgccgatttaactaacaacgcaaaacaatctcaaccaattaaacgaacaatacgacgaaaaatttacctccaaccaaaacgtcaccgaatatctacaacaattactaaaacgtaaacgaaaaacgattattaaacgcgataaaataaacgcgcgcaaaaacgccgtcgataaaaaaatcgaacgtttaaaccaacctaacgactctaaaaatcaacgtctaaacgcgctaacgaaacgttttaataatatactactatcaaaaatttataacgacgttaacctaaaaaatacgccgtacttctcaacgctatataacccgtcacgccacgccatcgtaataccaaatctatcacaaataactaaacacctaaaaaacttaaccgattacccgaaaaatctctatctaatcgaaaaaaatccgcaatcattcgataacaacgtattcaacgttaataaactaaaaaaaacgataataataaa

SEQ ID NO: 16013 - DNA, 726 bp, Artificial Sequence
  chemically treated genomic DNA (Homo sapiens) CpG-island No: 16013
ttagtggcgttatttacgtttttcggaagtgtcgttgtttggtcgtgttgcgcgtgaaagtcgtattgaaagtttttatgtcgagcgtgaagtgtttttcgaacgtttcgcgtacgttatttttttgatgtatagaatatttagcgtttgtattaggcgtttagtcgttttatcggtagttatttggcggttgcgtttgagtttgattcggaagtagaaattcgttaattgaatagtcgtcgcgtcgaattggagcgggcgttaagtaattatgaatatgattattagtagtagcgtatttagtttgagtaagcgaaagagggcgttacggcgtatgaatttgttttttgtcgcgtttttaatttgttggttgatgataggtttggcggatcgcgtcgatgaaattcgcgaacgtttggatgaagtttaggaagtcgcgcgtcgtgtttagtaagtttggttattaattggcgaaattggaatcgatggtttcggtattgtcgaacgattcggaatagttcgaattagttagagagaagattacgcgtatttttaggtagatgcgcggcgatgcgcgtagagtaggcgtgtgttttgacggtaattgtgtagtagcgtgcggatttaaggtaagatgggtcggagttatatgttatcggatagcgggaattcgcggatgttttcggtgaattttggaatcggcggcgcggtaggtattcggcgttt

SEQ ID NO: 16014 - DNA, 726 bp, Artificial Sequence
  chemically treated genomic DNA (Homo sapiens) CpG-island No: 16014
aaacgccgaatacctaccgcgccgccgattccaaaattcaccgaaaacatccgcgaattcccgctatccgataacatataactccgacccatcttaccttaaatccgcacgctactacacaattaccgtcaaaacacacgcctactctacgcgcatcgccgcgcatctacctaaaaatacgcgtaatcttctctctaactaattcgaactattccgaatcgttcgacaataccgaaaccatcgattccaatttcgccaattaataaccaaacttactaaacacgacgcgcgacttcctaaacttcatccaaacgttcgcgaatttcatcgacgcgatccgccaaacctatcatcaaccaacaaattaaaaacgcgacaaaaaacaaattcatacgccgtaacgccctctttcgcttactcaaactaaatacgctactactaataatcatattcataattacttaacgcccgctccaattcgacgcgacgactattcaattaacgaatttctacttccgaatcaaactcaaacgcaaccgccaaataactaccgataaaacgactaaacgcctaatacaaacgctaaatattctatacatcaaaaaaataacgtacgcgaaacgttcgaaaaacacttcacgctcgacataaaaactttcaatacgactttcacgcgcaacacgaccaaacaacgacacttccgaaaaacgtaaataacgccactaa

SEQ ID NO: 16015 - DNA, 726 bp, Artificial Sequence
  chemically treated genomic DNA (Homo sapiens) CpG-island No: 16015
gagcgtcgggtatttatcgcgtcgtcggttttagagtttatcgagggtattcgcgaattttcgttgttcggtagtatgtggtttcgatttattttattttaagttcgtacgttgttgtataattgtcgttagggtatacgtttgttttacgcgtatcgtcgcgtatttgtttgagagtacgcgtaattttttttttgattggttcgaattgtttcgggtcgttcggtaatatcgaaattatcggttttagtttcgttagttgatggttaagtttgttgaatacgacgcgcggttttttgggttttatttagacgttcgcggattttatcgacgcgattcgttaggtttgttattagttaataggttgagagcgcggtagaaggtaggtttatgcgtcgtaacgttttttttcgtttgtttaaattgaatacgttgttgttggtgattatgtttatgattatttaacgttcgttttagttcgacgcgacggttgtttagttgacggatttttgttttcgggttagatttaaacgtaatcgttagatgattgtcgataaagcggttgaacgtttgatgtagacgttgagtgttttgtatattaaaggagtagcgtgcgcgaagcgttcggaaagtattttacgttcggtatggaggtttttaatacggtttttacgcgtagtacgattaaatagcggtattttcgggaaacgtgaataacgttattga

SEQ ID NO: 16016 - DNA, 726 bp, Artificial Sequence
  chemically treated genomic DNA (Homo sapiens) CpG-island No: 16016
tcaataacgttattcacgtttcccgaaaataccgctatttaatcgtactacgcgtaaaaaccgtattaaaaacctccataccgaacgtaaaatactttccgaacgcttcgcgcacgctactcctttaatatacaaaacactcaacgtctacatcaaacgttcaaccgctttatcgacaatcatctaacgattacgtttaaatctaacccgaaaacaaaaatccgtcaactaaacaaccgtcgcgtcgaactaaaacgaacgttaaataatcataaacataatcaccaacaacaacgtattcaatttaaacaaacgaaaaaaaacgttacgacgcataaacctaccttctaccgcgctctcaacctattaactaataacaaacctaacgaatcgcgtcgataaaatccgcgaacgtctaaataaaacccaaaaaaccgcgcgtcgtattcaacaaacttaaccatcaactaacgaaactaaaaccgataatttcgatattaccgaacgacccgaaacaattcgaaccaatcaaaaaaaaaattacgcgtactctcaaacaaatacgcgacgatacgcgtaaaacaaacgtataccctaacgacaattatacaacaacgtacgaacttaaaataaaataaatcgaaaccacatactaccgaacaacgaaaattcgcgaataccctcgataaactctaaaaccgacgacgcgataaatacccgacgctc

SEQ ID NO: 16017 - DNA, 503 bp, Artificial Sequence
  chemically treated genomic DNA (Homo sapiens) CpG-island No: 16017
  misc_feature (74)..(74): n is either a, c, g or t
  misc_feature (121)..(121): n is either a, c, g or t
  misc_feature (386)..(386): n is either a, c, g or t
  misc_feature (493)..(493): n is either a, c, g or t
tttgcgttagttgaaacgtaaaggttttgtcgatgcgcgtttggtaatatattgggttggggtcgttatcgcgnaaaagcggaaattcgtaagttgcgtgattagtatgatttgtattcgngtttataagcgcgtggatatttgtgcggtagagttcgttatcgatatcgtttatatgtattttatttatgaagaagagtgcgaagcgaattcgtttatcgatcgtgaaaaaattatggtgtttggcggcggttcgaatcgtatcggttagggtatcgaattcgattattgttgcgtatacgtttcgttggcgttgcgcgaagacggttacgaaattattatggttaattgtaattcggaaatcgtttttatcggattacgatatntttcgaatcgtttttatttcgagtcggtaattttggaagatgtgttggaaatcgtgcgtatcgagaagtcgaaaggcgttatcgtttagtacggcggttagattttngttgaaattt

SEQ ID NO: 16018 - DNA, 503 bp, Artificial Sequence
  chemically treated genomic DNA (Homo sapiens) CpG-island No: 16018
  misc_feature (11)..(11): n is either a, c, g or t
  misc_feature (118)..(118): n is either a, c, g or t
  misc_feature (383)..(383): n is either a, c, g or t
  misc_feature (430)..(430): n is either a, c, g or t
aaatttcaacnaaaatctaaccgccgtactaaacgataacgcctttcgacttctcgatacgcacgatttccaacacatcttccaaaattaccgactcgaaataaaaacgattcgaaanatatcgtaatccgataaaaacgatttccgaattacaattaaccataataatttcgtaaccgtcttcgcgcaacgccaacgaaacgtatacgcaacaataatcgaattcgataccctaaccgatacgattcgaaccgccgccaaacaccataattttttcacgatcgataaacgaattcgcttcgcactcttcttcataaataaaatacatataaacgatatcgataacgaactctaccgcacaaatatccacgcgcttataaacncgaatacaaatcatactaatcacgcaacttacgaatttccgcttttncgcgataacgaccccaacccaatatattaccaaacgcgcatcgacaaaacctttacgtttcaactaacgcaaa

SEQ ID NO: 16019 - DNA, 503 bp, Artificial Sequence
  chemically treated genomic DNA (Homo sapiens) CpG-island No: 16019
  misc_feature (11)..(11): n is either a, c, g or t
  misc_feature (118)..(118): n is either a, c, g or t
  misc_feature (383)..(383): n is either a, c, g or t
  misc_feature (430)..(430): n is either a, c, g or t
aagttttagtnggggtttgatcgtcgtattggacgataacgtttttcggtttttcgatacgtacgatttttagtatattttttagagttatcggttcgaagtagaggcggttcggaangtgtcgtagttcggtggagacggttttcgggttatagttaattataatggtttcgtaatcgttttcgcgtagcgttagcgaggcgtgtacgtaatagtagtcgaattcgatattttgatcgatacggttcgggtcgtcgttaagtattatgatttttttacggtcggtagacggattcgtttcgtatttttttttataagtggagtatatgtaagcggtgtcggtggcgaattttgtcgtataggtatttacgcgtttataaatncgggtgtaggttatattggttacgtagtttacggattttcgtttttncgcggtagcggttttagtttagtgtgttgttaagcgcgtatcggtaaagtttttgcgttttagttggcgtagg

SEQ ID NO: 16020 - DNA, 503 bp, Artificial Sequence
  chemically treated genomic DNA (Homo sapiens) CpG-island No: 16020
  misc_feature (74)..(74): n is either a, c, g or t
  misc_feature (121)..(121): n is either a, c, g or t
  misc_feature (386)..(386): n is either a, c, g or t
  misc_feature (493)..(493): n is either a, c, g or t
cctacgccaactaaaacgcaaaaactttaccgatacgcgcttaacaacacactaaactaaaaccgctaccgcgnaaaaacgaaaatccgtaaactacgtaaccaatataacctacacccgnatttataaacgcgtaaatacctatacgacaaaattcgccaccgacaccgcttacatatactccacttataaaaaaaaatacgaaacgaatccgtctaccgaccgtaaaaaaatcataatacttaacgacgacccgaaccgtatcgatcaaaatatcgaattcgactactattacgtacacgcctcgctaacgctacgcgaaaacgattacgaaaccattataattaactataacccgaaaaccgtctccaccgaactacgacacnttccgaaccgcctctacttcgaaccgataactctaaaaaatatactaaaaatcgtacgtatcgaaaaaccgaaaaacgttatcgtccaatacgacgatcaaaccccnactaaaactt

SEQ ID NO: 16021 - DNA, 504 bp, Artificial Sequence
  chemically treated genomic DNA (Homo sapiens) CpG-island No: 16021
gcggcggcgtaatgtaggtatttcggatttatcgtagatatatagttgatacgcgtaatttttcggtattattagcgaatcgcgcggatttgttatcgtaagtttatcgttcggttgcgtttgtatcgtttagtcgttggcgattttatcgtcgtgaataaagaaattaatcgttagtttatggcgtagttcgttatatagcggcgtatagttacgcgacggtgggcgtggttttttcggttagacgatgttttttttcgttatcgttggcggtataaagtgagcgttaggttgaggaaagaagagtttgttgtgatcgttaaagttacgcgatgtaaaatcgtttagcgtttcgtcgtcgaggataatgcgttgaaaatcggcgttgatgcgtttaacgcgtaatatagttagtttacggaagcgtagattattgcgaacgcgttgcgggtagcggggggtgttatttattgttatcgttttcgtgatggttattagatatat

SEQ ID NO: 16022 - DNA, 504 bp, Artificial Sequence
  chemically treated genomic DNA (Homo sapiens) CpG-island No: 16022
atatatctaataaccatcacgaaaacgataacaataaataacaccccccgctacccgcaacgcgttcgcaataatctacgcttccgtaaactaactatattacgcgttaaacgcatcaacgccgattttcaacgcattatcctcgacgacgaaacgctaaacgattttacatcgcgtaactttaacgatcacaacaaactcttctttcctcaacctaacgctcactttataccgccaacgataacgaaaaaaaacatcgtctaaccgaaaaaaccacgcccaccgtcgcgtaactatacgccgctatataacgaactacgccataaactaacgattaatttctttattcacgacgataaaatcgccaacgactaaacgatacaaacgcaaccgaacgataaacttacgataacaaatccgcgcgattcgctaataataccgaaaaattacgcgtatcaactatatatctacgataaatccgaaatacctacattacgccgccgc

SEQ ID NO: 16023 - DNA, 504 bp, Artificial Sequence
  chemically treated genomic DNA (Homo sapiens) CpG-island No: 16023
atatatttgatgattattacgaaggcgataataatgaataatatttttcgttattcgtagcgcgttcgtaatgatttgcgttttcgtgaattgattgtgttacgcgttgagcgtattagcgtcggtttttagcgtattgttttcggcggcgaggcgttggacggttttatatcgcgtggttttgacgattatagtaaatttttttttttttaatttgacgtttattttgtgtcgttaacggtaacggaagagggtatcgtttggtcggaaggattacgtttatcgtcgcgtgattatacgtcgttgtatgacgaattacgttatgaattggcgattgatttttttatttacgacggtggggtcgttagcggttgggcgatgtaggcgtaatcgggcgataaatttacggtggtaggttcgcgcggttcgttggtggtgtcggaagattacgcgtattagttgtatgtttgcgatgaattcggaatgtttgtattgcgtcgtcgt

SEQ ID NO: 16024 - DNA, 504 bp, Artificial Sequence
  chemically treated genomic DNA (Homo sapiens) CpG-island No: 16024
acgacgacgcaatacaaacattccgaattcatcgcaaacatacaactaatacgcgtaatcttccgacaccaccaacgaaccgcgcgaacctaccaccgtaaatttatcgcccgattacgcctacatcgcccaaccgctaacgaccccaccgtcgtaaataaaaaaatcaatcgccaattcataacgtaattcgtcatacaacgacgtataatcacgcgacgataaacgtaatccttccgaccaaacgataccctcttccgttaccgttaacgacacaaaataaacgtcaaattaaaaaaaaaaaaatttactataatcgtcaaaaccacgcgatataaaaccgtccaacgcctcgccgccgaaaacaatacgctaaaaaccgacgctaatacgctcaacgcgtaacacaatcaattcacgaaaacgcaaatcattacgaacgcgctacgaataacgaaaaatattattcattattatcgccttcgtaataatcatcaaatatat

SEQ ID NO: 16025 - DNA, 1070 bp, Artificial Sequence
  chemically treated genomic DNA (Homo sapiens) CpG-island No: 16025
tgtcgtcgtgtttatggtttatatgttttcgtcggtggtttagtaacgtttttagcgttatagtcgttagggtaaatttttcggtttattcgggagattatcgagttgattttcgtatttgggttaatgttggttaacgtattgtagcgtgtattaagtttttcgatagttagcgttttttttgtaatatttaggttttcgttatttgttagtttattttgattgattttatttttatttatcgttagcgttttttttttgaataaaatagtcgaatttatttgttcggtgaatgtttttatcgtttgcgtcgatttattaagatcgacgatggtcgcgttgttgatgtttagttttcgggtgttgttaagtgtattattcgtatcggtacgtaatgtttttatttgaacgtaggttgttttttgatagtcgttttgatcgttggaaagcgaaatttgtcgtatcgtattgattgttagattttttttattatcgatttttgtcgatatatcggtcgttgcgttataggtttcgttatgttcggttaacgttagtttttgtttattatggatgtttagcgtttttagtttatagttaacgtataaattattatttggtgcggtcgtgaggcggaatttataattattttcggcgattatcgtttcgttttgcgtaatgtgtaacgttttgttcgtttttatttcgtcgttttgtaaattacgtaacgttaatgagttattcgatttaataatcgtttgcgtttttattagttgaacgtcgatatggttatcgtcgtgttttagtaaattgagcgtcgttagagggttattcgttatgggattattttacggtttaggtacgtcgataagtacgtcgttcgtttcgtttatttgatagttacggtttttttaggtgtagttattcgcgtcgataattagcgtatcgacgttgatatattttttcgcgagcgtcgtagtaagaatattcgtatcgaatatgatggtatttttttttatgggtagtttatttatggattgttttttatttttatcgattggtattttttgtcg

SEQ ID NO: 16026 - DNA, 1070 bp, Artificial Sequence
  chemically treated genomic DNA (Homo sapiens) CpG-island No: 16026
cgacaaaaaataccaatcgataaaaataaaaaacaatccataaataaactacccataaaaaaaaataccatcatattcgatacgaatattcttactacgacgctcgcgaaaaaatatatcaacgtcgatacgctaattatcgacgcgaataactacacctaaaaaaaccgtaactatcaaataaacgaaacgaacgacgtacttatcgacgtacctaaaccgtaaaataatcccataacgaataaccctctaacgacgctcaatttactaaaacacgacgataaccatatcgacgttcaactaataaaaacgcaaacgattattaaatcgaataactcattaacgttacgtaatttacaaaacgacgaaataaaaacgaacaaaacgttacacattacgcaaaacgaaacgataatcgccgaaaataattataaattccgcctcacgaccgcaccaaataataatttatacgttaactataaactaaaaacgctaaacatccataataaacaaaaactaacgttaaccgaacataacgaaacctataacgcaacgaccgatatatcgacaaaaatcgataataaaaaaaatctaacaatcaatacgatacgacaaatttcgctttccaacgatcaaaacgactatcaaaaaacaacctacgttcaaataaaaacattacgtaccgatacgaataatacacttaacaacacccgaaaactaaacatcaacaacgcgaccatcgtcgatcttaataaatcgacgcaaacgataaaaacattcaccgaacaaataaattcgactattttattcaaaaaaaaaacgctaacgataaataaaaataaaatcaatcaaaataaactaacaaataacgaaaacctaaatattacaaaaaaaacgctaactatcgaaaaacttaatacacgctacaatacgttaaccaacattaacccaaatacgaaaatcaactcgataatctcccgaataaaccgaaaaatttaccctaacgactataacgctaaaaacgttactaaaccaccgacgaaaacatataaaccataaacacgacgaca

SEQ ID NO: 16027 - DNA, 1070 bp, Artificial Sequence
  chemically treated genomic DNA (Homo sapiens) CpG-island No: 16027
cgatagggaatattaatcggtaaaagtgggagataatttatgggtggattgtttatgaaggggggtattattatgttcgatacggatatttttgttgcgacgttcgcggaggaatatattagcgtcgatacgttggttgtcggcgcgggtgattatatttggaaaggtcgtaattattaggtaaacgggacgggcgacgtgtttatcgacgtgtttaaatcgtggaatgattttatggcgaataattttttgacgacgtttaatttgttggaatacgacgatagttatgtcggcgtttaattggtgaaggcgtaaacggttattgggtcgggtggtttattaacgttacgtgatttatagggcgacgaggtggaagcggataaaacgttatatattgcgtaaaacggaacggtggtcgtcgagggtgattatggatttcgttttacgatcgtattaggtaatggtttgtacgttaattatgggttgaaagcgttgaatatttatggtgggtaaaagttgacgttagtcgaatatggcggagtttatggcgtaacggtcgatatgtcggtaaaaatcggtggtgaaggggatttggtaattaatacggtgcgataggtttcgttttttaacggttagaacgattattagggggtaatttacgtttagatggggatattacgtatcgatgcggatggtgtatttggtaatattcgggaattgaatattagtaacgcggttatcgtcgattttaatggatcgacgtagacggtagagatatttatcgggtagatgggttcgattgttttgtttaaagagggggcgttgacggtaaataaaggtgggattagttagggtgaattgataggtggcggaaatttgaatgttatagggggaacgttggttatcgaggggtttaatgtacgttataatgcgttaattagtattagtttaaatgcggaagttagttcgataatttttcgggtaagtcgaggaatttgttttgacggttgtaacgttaaaaacgttgttgggttatcggcgggaatatataggttataaatacggcggta

SEQ ID NO: 16028 - DNA, 1070 bp, Artificial Sequence
  chemically treated genomic DNA (Homo sapiens) CpG-island No: 16028
taccgccgtatttataacctatatattcccgccgataacccaacaacgtttttaacgttacaaccgtcaaaacaaattcctcgacttacccgaaaaattatcgaactaacttccgcatttaaactaatactaattaacgcattataacgtacattaaacccctcgataaccaacgttccccctataacattcaaatttccgccacctatcaattcaccctaactaatcccacctttatttaccgtcaacgccccctctttaaacaaaacaatcgaacccatctacccgataaatatctctaccgtctacgtcgatccattaaaatcgacgataaccgcgttactaatattcaattcccgaatattaccaaatacaccatccgcatcgatacgtaatatccccatctaaacgtaaattaccccctaataatcgttctaaccgttaaaaaacgaaacctatcgcaccgtattaattaccaaatccccttcaccaccgatttttaccgacatatcgaccgttacgccataaactccgccatattcgactaacgtcaacttttacccaccataaatattcaacgctttcaacccataattaacgtacaaaccattacctaatacgatcgtaaaacgaaatccataatcaccctcgacgaccaccgttccgttttacgcaatatataacgttttatccgcttccacctcgtcgccctataaatcacgtaacgttaataaaccacccgacccaataaccgtttacgccttcaccaattaaacgccgacataactatcgtcgtattccaacaaattaaacgtcgtcaaaaaattattcgccataaaatcattccacgatttaaacacgtcgataaacacgtcgcccgtcccgtttacctaataattacgacctttccaaatataatcacccgcgccgacaaccaacgtatcgacgctaatatattcctccgcgaacgtcgcaacaaaaatatccgtatcgaacataataataccccccttcataaacaatccacccataaattatctcccacttttaccgattaatattccctatcg

SEQ ID NO: 16029 - DNA, 954 bp, Artificial Sequence
  chemically treated genomic DNA (Homo sapiens) CpG-island No: 16029
tcgtttatagtcgggtgtcgttcggtaaaaagtcgtgggcgtgtaggttcgggtgcgtttgtcgtcgcgttagttcgcgcgcgttttttttcggcgttagcgggttgttcgcggtgtcgatgaagtttacgttgttagttaacgttagacgatttacggtaatttcgatgatgtcgttatcgcgtagtttgttaatcggttcgttcgttagcgttttcggcgatacgtggtcgaagtaggcgttcgtcgatacgttcgagaagcgcgtatcggtgatgagcgatatcgttttgttttacgagatatgttttagcgcggaggtgagttggtaggttttttttatgtcggtgtcggacggttcgtcgtcgattattattatgatatcgttttgtataattttttttcgtttgatcgttttgatcgtttgcgttttcgagataaatattcgtattcggtcggtgtggtggtatacgttattttcgtttattatcgacgggtcgatcgtcgtggttttgattatcgaatttttcggcgcgatgttgttcgtcgggaagtagatcgtcgaggttagttttttcgtttttgtttttttcggcggtaggattacgttattcggttttacgtcgttttgttcgcgtaggtattggcggaagcgcgttcggcgttcggacgtttgttattatttaaggttttcgtttatcgtttggtcggttacggttatggcgtttagatgtagtaggtcgaggtcgcgtaggttgagtattattttcggtacgtcgttcgcgatgaaagcgcgttcgtcgggtgatagtttcggtcgtggtgcgtatcgtattagagcgggggatttcgggggtggtcgtttcgggtacgattcgggtgttgtgtttttcgtttggaatgcggaaggttgcggttttggtggcgggttatcgcggttattttacgttttgg

SEQ ID NO: 16030 - DNA, 954 bp, Artificial Sequence
  chemically treated genomic DNA (Homo sapiens) CpG-island No: 16030
ccaaaacgtaaaataaccgcgataacccgccaccaaaaccgcaaccttccgcattccaaacgaaaaacacaacacccgaatcgtacccgaaacgaccacccccgaaatcccccgctctaatacgatacgcaccacgaccgaaactatcacccgacgaacgcgctttcatcgcgaacgacgtaccgaaaataatactcaacctacgcgacctcgacctactacatctaaacgccataaccgtaaccgaccaaacgataaacgaaaaccttaaataataacaaacgtccgaacgccgaacgcgcttccgccaatacctacgcgaacaaaacgacgtaaaaccgaataacgtaatcctaccgccgaaaaaaacaaaaacgaaaaaactaacctcgacgatctacttcccgacgaacaacatcgcgccgaaaaattcgataatcaaaaccacgacgatcgacccgtcgataataaacgaaaataacgtataccaccacaccgaccgaatacgaatatttatctcgaaaacgcaaacgatcaaaacgatcaaacgaaaaaaaattatacaaaacgatatcataataataatcgacgacgaaccgtccgacaccgacataaaaaaaacctaccaactcacctccgcgctaaaacatatctcgtaaaacaaaacgatatcgctcatcaccgatacgcgcttctcgaacgtatcgacgaacgcctacttcgaccacgtatcgccgaaaacgctaacgaacgaaccgattaacaaactacgcgataacgacatcatcgaaattaccgtaaatcgtctaacgttaactaacaacgtaaacttcatcgacaccgcgaacaacccgctaacgccgaaaaaaaacgcgcgcgaactaacgcgacgacaaacgcacccgaacctacacgcccacgactttttaccgaacgacacccgactataaacga

SEQ ID NO: 16031 - DNA, 954 bp, Artificial Sequence
  chemically treated genomic DNA (Homo sapiens) CpG-island No: 16031
ttaaagcgtggagtaatcgcggtggttcgttattaaggtcgtaatttttcgtattttaaacggggggtataatattcgggtcgtgttcgggacggttattttcgaaatttttcgttttggtgcggtgcgtattacggtcggaattattattcgacgggcgcgtttttatcgcgggcggcgtgtcggaggtgatgtttaatttgcgcgatttcggtttgttgtatttggacgttatgatcgtgatcggttagacggtgggcgagaattttgaatggtggtaggcgttcgagcgtcgggcgcgttttcgttagtgtttgcgcgagtaggacggcgtagagtcggatgacgtgattttgtcgtcggagaaggtaaaagcgaaagggttgatttcgacggtttgtttttcgacgggtaatatcgcgtcggaaggttcggtgattaaggttacggcgatcgattcgtcggtggtgggcgaagatggcgtatattattatatcggtcgggtgcgggtgtttgtttcggaagcgtaggcgattaaggcgattaagcgggaagagattgtgtagggcgatattatggtggtgatcggcggcgggtcgttcggtatcggtatggaagagatttattagtttattttcgcgttaaagtatatttcgtggggtaagacggtgtcgtttattatcgatgcgcgtttttcgggcgtgtcgacgggcgtttgtttcggttacgtgtcgtcggaggcgttggcgggcgggtcgattggtaagttgcgcgataacgatattatcgagattgtcgtggatcgtttgacgttaattggtagcgtgaattttatcggtatcgcggataattcgttgacgtcggaagagggcgcgcgcgagttggcgcggcggtagacgtattcggatttgtacgtttacgattttttgtcggacgatattcggttgtgggcgg

SEQ ID NO: 16032 - DNA, 954 bp, Artificial Sequence
  chemically treated genomic DNA (Homo sapiens) CpG-island No: 16032
ccgcccacaaccgaatatcgtccgacaaaaaatcgtaaacgtacaaatccgaatacgtctaccgccgcgccaactcgcgcgcgccctcttccgacgtcaacgaattatccgcgataccgataaaattcacgctaccaattaacgtcaaacgatccacgacaatctcgataatatcgttatcgcgcaacttaccaatcgacccgcccgccaacgcctccgacgacacgtaaccgaaacaaacgcccgtcgacacgcccgaaaaacgcgcatcgataataaacgacaccgtcttaccccacgaaatatactttaacgcgaaaataaactaataaatctcttccataccgataccgaacgacccgccgccgatcaccaccataatatcgccctacacaatctcttcccgcttaatcgccttaatcgcctacgcttccgaaacaaacacccgcacccgaccgatataataatatacgccatcttcgcccaccaccgacgaatcgatcgccgtaaccttaatcaccgaaccttccgacgcgatattacccgtcgaaaaacaaaccgtcgaaatcaaccctttcgcttttaccttctccgacgacaaaatcacgtcatccgactctacgccgtcctactcgcgcaaacactaacgaaaacgcgcccgacgctcgaacgcctaccaccattcaaaattctcgcccaccgtctaaccgatcacgatcataacgtccaaatacaacaaaccgaaatcgcgcaaattaaacatcacctccgacacgccgcccgcgataaaaacgcgcccgtcgaataataattccgaccgtaatacgcaccgcaccaaaacgaaaaatttcgaaaataaccgtcccgaacacgacccgaatattataccccccgtttaaaatacgaaaaattacgaccttaataacgaaccaccgcgattactccacgctttaa

SEQ ID NO: 16033 - DNA, 623 bp, Artificial Sequence
  chemically treated genomic DNA (Homo sapiens) CpG-island No: 16033
ggtatcgttttgggtaatgttaagtttattcgttagcgatttttcgatttttataaattgttttggttgtaaaatcgcgtttaatagcgcgtgtttggtttagtagtggaagtgttcggttagacgataggtggtttcgatatacgggaatttatcggttttatttaatgtttcggcgtcgtttttaaagatacgtgtagtcgggttcgagataacgtttggatgtagcgggttagtttttagcggcgttttaaacggttcgtagtgtttcgggaacggatttttcgttattttatcgagggtaaatagacgttttatgtttttttgttgtatgataaacggttcgacgtcgttattcggaggcgttgcgttgtagttcggaatattttagtcggtttatttagtgtcgttttattttagtaattgacgtttcggattttacgggttattttgcggatttgcggaggcgcggttatatagaatgcggcggttaagcggttatgtttatgtttagtttagcgtgttatcgaggttagacggatcggcgttattacggcgtgttatttggttgtttttcggcgtttagttatcggcgaaaatttagtagatataggaggttgtat

SEQ ID NO: 16034 - DNA, 623 bp, Artificial Sequence
  chemically treated genomic DNA (Homo sapiens) CpG-island No: 16034
atacaacctcctatatctactaaattttcgccgataactaaacgccgaaaaacaaccaaataacacgccgtaataacgccgatccgtctaacctcgataacacgctaaactaaacataaacataaccgcttaaccgccgcattctatataaccgcgcctccgcaaatccgcaaaataacccgtaaaatccgaaacgtcaattactaaaataaaacgacactaaataaaccgactaaaatattccgaactacaacgcaacgcctccgaataacgacgtcgaaccgtttatcatacaacaaaaaaacataaaacgtctatttaccctcgataaaataacgaaaaatccgttcccgaaacactacgaaccgtttaaaacgccgctaaaaactaacccgctacatccaaacgttatctcgaacccgactacacgtatctttaaaaacgacgccgaaacattaaataaaaccgataaattcccgtatatcgaaaccacctatcgtctaaccgaacacttccactactaaaccaaacacgcgctattaaacgcgattttacaaccaaaacaatttataaaaatcgaaaaatcgctaacgaataaacttaacattacccaaaacgatacc

SEQ ID NO: 16035 - DNA, 623 bp, Artificial Sequence
  chemically treated genomic DNA (Homo sapiens) CpG-island No: 16035
gtataattttttgtgtttgttggattttcgtcggtagttggacgtcggaaggtaattagatggtacgtcgtgataacgtcgattcgtttggtttcggtaatacgttgggttgggtatgggtatggtcgtttaatcgtcgtattttgtataatcgcgttttcgtagattcgtagggtaattcgtgggattcgaagcgttagttgttgaaatgggacggtattaagtggatcggttgggatatttcggattatagcgtagcgttttcgggtagcggcgtcgggtcgtttattatgtagtaggaaggtatggggcgtttgtttgttttcgataagatggcggaaggttcgttttcggaatattacgagtcgtttgaaacgtcgttgggaattaattcgttgtatttaaacgttatttcgaattcggttgtacgtatttttaaagacgacgtcgaagtattgggtaaagtcgataagttttcgtatgtcggaattatttatcgtttgatcgagtatttttattattggattaaatacgcgttgttgaacgcgattttgtagttagagtagtttgtggaaatcggggagtcgttggcgaataaatttggtattgtttagggcgatatt

SEQ ID NO: 16036 - DNA, 623 bp, Artificial Sequence
  chemically treated genomic DNA (Homo sapiens) CpG-island No: 16036
aatatcgccctaaacaataccaaatttattcgccaacgactccccgatttccacaaactactctaactacaaaatcgcgttcaacaacgcgtatttaatccaataataaaaatactcgatcaaacgataaataattccgacatacgaaaacttatcgactttacccaatacttcgacgtcgtctttaaaaatacgtacaaccgaattcgaaataacgtttaaatacaacgaattaattcccaacgacgtttcaaacgactcgtaatattccgaaaacgaaccttccgccatcttatcgaaaacaaacaaacgccccataccttcctactacataataaacgacccgacgccgctacccgaaaacgctacgctataatccgaaatatcccaaccgatccacttaataccgtcccatttcaacaactaacgcttcgaatcccacgaattaccctacgaatctacgaaaacgcgattatacaaaatacgacgattaaacgaccatacccatacccaacccaacgtattaccgaaaccaaacgaatcgacgttatcacgacgtaccatctaattaccttccgacgtccaactaccgacgaaaatccaacaaacacaaaaaattatac

SEQ ID NO: 16037 - DNA, 856 bp, Artificial Sequence
  chemically treated genomic DNA (Homo sapiens) CpG-island No: 16037
gtggttagcgtgggaataatcgatagattgatattcgcggtatgggttcggaaaatacgttgattttgattgacggtaagtcggtaagtagtcgtaattcggtgcgttagggttggcgtggcgagcgcgatattcgtggtgatattttttgggtgttatttgaaatgattgaacgtattgaagttttgcgtggttcggtagttgcgcgttatggtaacggcgcggcgggcggcgtggttaatattattattaaaaaaggtagcggcgagtggtacggtttttgggacgtatattttaatgcgttagaatataaagaggaaggtgttattaaacgtattaattttagtttgatcggttcgttgggcgacgaatttagttttcgtttgtatggtaatttcgataaaatttaggttgacgcgtgggatattaattagggttattagttcgcgcgtgtcggaacgtatgttacgacgttattagtcgggcgcgaaggggtaattaataaagatattaatggcgtggtgcgttgggatttcgcgttattgtaatcgttggaattggaagtaggttatagtcgttagggtaatttgtatgcgggcgatatttagaatattaatttcgatttttatattcgttcgaaatatggcgatgaaattaagcgtttgtatcgttagaattacgcgttgattggaacggtggtgcgatacggcgtgataataatattggtgcgaagaaaattcgtagtgcgatttcggaggcgcggcggattaaggaattacgaaatttatcggttgtgataagtttaacgatttttttaagaattcgaagatttttttaatttcgtttgcggtttatt

SEQ ID NO: 16038 - DNA, 856 bp, Artificial Sequence
  chemically treated genomic DNA (Homo sapiens) CpG-island No: 16038
aataaaccgcaaacgaaattaaaaaaatcttcgaattcttaaaaaaatcgttaaacttatcacaaccgataaatttcgtaattccttaatccgccgcgcctccgaaatcgcactacgaattttcttcgcaccaatattattatcacgccgtatcgcaccaccgttccaatcaacgcgtaattctaacgatacaaacgcttaatttcatcgccatatttcgaacgaatataaaaatcgaaattaatattctaaatatcgcccgcatacaaattaccctaacgactataacctacttccaattccaacgattacaataacgcgaaatcccaacgcaccacgccattaatatctttattaattaccccttcgcgcccgactaataacgtcgtaacatacgttccgacacgcgcgaactaataaccctaattaatatcccacgcgtcaacctaaattttatcgaaattaccatacaaacgaaaactaaattcgtcgcccaacgaaccgatcaaactaaaattaatacgtttaataacaccttcctctttatattctaacgcattaaaatatacgtcccaaaaaccgtaccactcgccgctaccttttttaataataatattaaccacgccgcccgccgcgccgttaccataacgcgcaactaccgaaccacgcaaaacttcaatacgttcaatcatttcaaataacacccaaaaaatatcaccacgaatatcgcgctcgccacgccaaccctaacgcaccgaattacgactacttaccgacttaccgtcaatcaaaatcaacgtattttccgaacccataccgcgaatatcaatctatcgattattcccacgctaaccac

SEQ ID NO: 16039 - DNA, 856 bp, Artificial Sequence
  chemically treated genomic DNA (Homo sapiens) CpG-island No: 16039
ggtgaatcgtagacggggttgaagagattttcgaatttttgggaagatcgttaagtttattataatcggtgggtttcgtaattttttggttcgtcgcgttttcggaatcgtattacgggtttttttcgtattagtgttgttgttacgtcgtatcgtattatcgttttagttagcgcgtagttttggcgatatagacgtttggttttatcgttatatttcgagcgggtataggaatcggagttggtattttgggtgtcgttcgtatataggttattttggcggttgtaatttgtttttagttttagcgattgtaatggcgcgaaattttagcgtattacgttattaatatttttgttgattattttttcgcgttcggttggtaacgtcgtggtatacgtttcggtacgcgcggattgatggttttggttgatattttacgcgttagtttgggttttgtcgaggttgttatataaacggaagttgaattcgtcgtttagcggatcggttaggttaaagttagtgcgtttggtggtatttttttttttatgttttggcgtattgaaatatgcgttttaggagtcgtgttattcgtcgttgttttttttggtaatgatgttaattacgtcgttcgtcgcgtcgttgttataacgcgtagttgtcggattacgtagaattttaatacgtttaattattttaggtggtatttaggaagtattattacgggtatcgcgttcgttacgttagttttgacgtatcgagttacggttgtttatcggtttgtcgttaattaaaattagcgtgtttttcggatttatatcgcgaatattaatttgtcggttatttttacgttgattat

SEQ ID NO: 16040 - DNA, 856 bp, Artificial Sequence
  chemically treated genomic DNA (Homo sapiens) CpG-island No: 16040
ataatcaacgtaaaaataaccgacaaattaatattcgcgatataaatccgaaaaacacgctaattttaattaacgacaaaccgataaacaaccgtaactcgatacgtcaaaactaacgtaacgaacgcgatacccgtaataatacttcctaaataccacctaaaataattaaacgtattaaaattctacgtaatccgacaactacgcgttataacaacgacgcgacgaacgacgtaattaacatcattaccaaaaaaaacaacgacgaataacacgactcctaaaacgcatatttcaatacgccaaaacataaaaaaaaaaataccaccaaacgcactaactttaacctaaccgatccgctaaacgacgaattcaacttccgtttatataacaacctcgacaaaacccaaactaacgcgtaaaatatcaaccaaaaccatcaatccgcgcgtaccgaaacgtataccacgacgttaccaaccgaacgcgaaaaaataatcaacaaaaatattaataacgtaatacgctaaaatttcgcgccattacaatcgctaaaactaaaaacaaattacaaccgccaaaataacctatatacgaacgacacccaaaataccaactccgattcctatacccgctcgaaatataacgataaaaccaaacgtctatatcgccaaaactacgcgctaactaaaacgataatacgatacgacgtaacaacaacactaatacgaaaaaaacccgtaatacgattccgaaaacgcgacgaaccaaaaaattacgaaacccaccgattataataaacttaacgatcttcccaaaaattcgaaaatctcttcaaccccgtctacgattcacc

SEQ ID NO: 16041 - DNA, 682 bp, Artificial Sequence
  chemically treated genomic DNA (Homo sapiens) CpG-island No: 16041
  misc_feature (366)..(366): n is either a, c, g or t
  misc_feature (368)..(368): n is either a, c, g or t
  misc_feature (372)..(372): n is either a, c, g or t
  misc_feature (570)..(570): n is either a, c, g or t
  misc_feature (620)..(622): n is either a, c, g or t
  misc_feature (624)..(624): n is either a, c, g or t
  misc_feature (637)..(637): n is either a, c, g or t
  misc_feature (653)..(653): n is either a, c, g or t
ttttcgagcgtacgttttcgagtgattcgtgcgcggtgtgtagggattttagggtcgtgtgtattaagggcgttcgtgttcgtttttttgtattaaggaacgtatttttatatgtttgagtgtacgtttttttttatgtgtgtacgtttcgtgtttacgtcgtttatgtttgtgtaggggcgttttacgcgcgtttttttcgtcgcgggcggatagggattcgcgttgggttttacgttttcgtggggttgatttttttttcgcgtttcgtagcgggtcgtatcgattggtcgtcggtttttttttagtcgttattttttttttttttcgttattcgcgcgtttttttttttcggtagttggggtngntttngcgaggtttaataaaaataattttcgttgggattggttgcgcgcgtttttgtgtggcggtagttgcggttttagcgtttttgaatgtcgagaggggtcgggaagggagtttttttatgggttatttgttttttcgttagtcgtcgttttatcgtcgttcgcgtttcgcgtttcgtttttcgtttcggcggttttcgtngtttcgtcgtcgttcgcgttcgcgttttttttttttgcggggggggtgtnnntnttttttttttttnttttaaaaattttttnttttgggggggagggtttttttttttttg

SEQ ID NO: 16042 - DNA, 682 bp, Artificial Sequence
  chemically treated genomic DNA (Homo sapiens) CpG-island No: 16042
  misc_feature (30)..(30): n is either a, c, g or t
  misc_feature (46)..(46): n is either a, c, g or t
  misc_feature (59)..(59): n is either a, c, g or t
  misc_feature (61)..(63): n is either a, c, g or t
  misc_feature (113)..(113): n is either a, c, g or t
  misc_feature (311)..(311): n is either a, c, g or t
  misc_feature (315)..(315): n is either a, c, g or t
  misc_feature (317)..(317): n is either a, c, g or t
caaaaaaaaaaaaaccctcccccccaaaanaaaaaatttttaaaanaaaaaaaaaaaanannnacaccccccccgcaaaaaaaaaaaacgcgaacgcgaacgacgacgaaacnacgaaaaccgccgaaacgaaaaacgaaacgcgaaacgcgaacgacgataaaacgacgactaacgaaaaaacaaataacccataaaaaaactcccttcccgacccctctcgacattcaaaaacgctaaaaccgcaactaccgccacacaaaaacgcgcgcaaccaatcccaacgaaaattatttttattaaacctcgcnaaancnaccccaactaccgaaaaaaaaaaacgcgcgaataacgaaaaaaaaaaaaaataacgactaaaaaaaaaccgacgaccaatcgatacgacccgctacgaaacgcgaaaaaaaaatcaaccccacgaaaacgtaaaacccaacgcgaatccctatccgcccgcgacgaaaaaaacgcgcgtaaaacgcccctacacaaacataaacgacgtaaacacgaaacgtacacacataaaaaaaaacgtacactcaaacatataaaaatacgttccttaatacaaaaaaacgaacacgaacgcccttaatacacacgaccctaaaatccctacacaccgcgcacgaatcactcgaaaacgtacgctcgaaaa

SEQ ID NO: 16043 - DNA, 682 bp, Artificial Sequence
  chemically treated genomic DNA (Homo sapiens) CpG-island No: 16043
  misc_feature (30)..(30): n is either a, c, g or t
  misc_feature (46)..(46): n is either a, c, g or t
  misc_feature (59)..(59): n is either a, c, g or t
  misc_feature (61)..(63): n is either a, c, g or t
  misc_feature (113)..(113): n is either a, c, g or t
  misc_feature (311)..(311): n is either a, c, g or t
  misc_feature (315)..(315): n is either a, c, g or t
  misc_feature (317)..(317): n is either a, c, g or t
taaaaaaaaaggggtttttttttttaaggnggggggtttttaaagnagaaaaagggggngnnngtatttttttcgtaaaaaaaaaaagcgcgggcgcgggcggcggcggggtngcgggagtcgtcggggcgggaggcggagcgcggggcgcgggcggcggtggggcggcggttggcggggagatagatggtttatggaaaggtttttttttcggtttttttcgatatttaaaggcgttggggtcgtagttgtcgttatataaaagcgcgcgtagttaattttagcggagattatttttgttaggtttcgtnggantngttttaattatcgaaaaaaaagggcgcgcgggtggcggagggagggaggggtgacggttggaagggggtcggcggttaatcgatacggttcgttgcggggcgcgagggaggggttagttttacggaagcgtggagtttagcgcgggtttttgttcgttcgcggcggagagggcgcgcgtgaagcgtttttgtatagatatgggcggcgtgaatacggaacgtgtatatatggagagggacgtgtatttagatatgtggaggtgcgttttttagtgtagagagacgggtacgagcgtttttagtgtatacgattttgaggtttttgtatatcgcgtacgggttattcggggacgtgcgttcggagg

SEQ ID NO: 16044 - DNA, 682 bp, Artificial Sequence
  chemically treated genomic DNA (Homo sapiens) CpG-island No: 16044
  misc_feature (366)..(366): n is either a, c, g or t
  misc_feature (368)..(368): n is either a, c, g or t
  misc_feature (372)..(372): n is either a, c, g or t
  misc_feature (570)..(570): n is either a, c, g or t
  misc_feature (620)..(622): n is either a, c, g or t
  misc_feature (624)..(624): n is either a, c, g or t
  misc_feature (637)..(637): n is either a, c, g or t
  misc_feature (653)..(653): n is either a, c, g or t
cctccgaacgcacgtccccgaataacccgtacgcgatatacaaaaacctcaaaatcgtatacactaaaaacgctcgtacccgtctctctacactaaaaaacgcacctccacatatctaaatacacgtccctctccatatatacacgttccgtattcacgccgcccatatctatacaaaaacgcttcacgcgcgccctctccgccgcgaacgaacaaaaacccgcgctaaactccacgcttccgtaaaactaacccctccctcgcgccccgcaacgaaccgtatcgattaaccgccgacccccttccaaccgtcacccctccctccctccgccacccgcgcgcccttttttttcgataattaaaacnantccnacgaaacctaacaaaaataatctccgctaaaattaactacgcgcgcttttatataacgacaactacgaccccaacgcctttaaatatcgaaaaaaaccgaaaaaaaaacctttccataaaccatctatctccccgccaaccgccgccccaccgccgcccgcgccccgcgctccgcctcccgccccgacgactcccgcnaccccgccgccgcccgcgcccgcgctttttttttttacgaaaaaaatacnnncnccccctttttctnctttaaaaaccccccnccttaaaaaaaaaaaccccttttttttta

SEQ ID NO: 16045 - DNA, 550 bp, Artificial Sequence
  chemically treated genomic DNA (Homo sapiens) CpG-island No: 16045
gaggcgagtaataggtaatatttgttgagtcgtcgtcgatcggaagtggaagagagttcgggacgggggtgaggataggtcgcggtacgtttgcgtagttagtaggagttgtagcgtttatgcgtagttgggcggtgatagggtgacgttcggagcgtgggtcgcgatttttacggattcggtttcgttttttcgttgtcgatttttcggagcgagcgttcgagattttttttttagagtgttttgcgtcgtgaagaagcggttttcggggattgggggtattttgtgttggttggagttggagtaataagatggcgtcgttcgcggagtgataggggtttttttgggtcggagtcggcggtagtggtggtagcggtatcgtcgttttagtttatcgcgttttttttttagttcgcgacgtcgtcgcgtaagcgaggtagcggcggtcgtcgagaaataagtggtttagtttggtaatcgtcgagaagttttttataaattgcggtttggtaaaaagaaatttgattgagcggcggtgattaggtttttt

SEQ ID NO: 16046 - DNA, 550 bp, Artificial Sequence
  chemically treated genomic DNA (Homo sapiens) CpG-island No: 16046
aaaaaacctaatcaccgccgctcaatcaaatttctttttaccaaaccgcaatttataaaaaacttctcgacgattaccaaactaaaccacttatttctcgacgaccgccgctacctcgcttacgcgacgacgtcgcgaactaaaaaaaaaacgcgataaactaaaacgacgataccgctaccaccactaccgccgactccgacccaaaaaaacccctatcactccgcgaacgacgccatcttattactccaactccaaccaacacaaaatacccccaatccccgaaaaccgcttcttcacgacgcaaaacactctaaaaaaaaaatctcgaacgctcgctccgaaaaatcgacaacgaaaaaacgaaaccgaatccgtaaaaatcgcgacccacgctccgaacgtcaccctatcaccgcccaactacgcataaacgctacaactcctactaactacgcaaacgtaccgcgacctatcctcacccccgtcccgaactctcttccacttccgatcgacgacgactcaacaaatattacctattactcgcctc

SEQ ID NO: 16047 - DNA, 550 bp, Artificial Sequence
  chemically treated genomic DNA (Homo sapiens) CpG-island No: 16047
ggggaatttgattatcgtcgtttagttaggtttttttttgttaggtcgtagtttgtgaagggtttttcggcggttattaggttgggttatttgtttttcggcggtcgtcgttgtttcgtttgcgcggcgacgtcgcgggttggaaaaggggcgcggtgagttagggcggcgatatcgttgttattattgtcgtcggtttcggtttagagggatttttgttatttcgcggacgacgttattttgttattttagttttagttaatataaaatgtttttagttttcgggagtcgtttttttacggcgtagagtattttgggaaagggatttcgggcgttcgtttcgaaggatcggtagcgagagggcggaatcggattcgtgagagtcgcggtttacgtttcgagcgttattttgttatcgtttagttgcgtatgagcgttgtaatttttgttgattgcgtaggcgtgtcgcggtttgtttttattttcgtttcgggtttttttttattttcggtcggcggcggtttagtaggtgttatttgttattcgtttt

SEQ ID NO: 16048 - DNA, 550 bp, Artificial Sequence
  chemically treated genomic DNA (Homo sapiens) CpG-island No: 16048
aaaacgaataacaaataacacctactaaaccgccgccgaccgaaaataaaaaaaaacccgaaacgaaaataaaaacaaaccgcgacacgcctacgcaatcaacaaaaattacaacgctcatacgcaactaaacgataacaaaataacgctcgaaacgtaaaccgcgactctcacgaatccgattccgccctctcgctaccgatccttcgaaacgaacgcccgaaatccctttcccaaaatactctacgccgtaaaaaaacgactcccgaaaactaaaaacattttatattaactaaaactaaaataacaaaataacgtcgtccgcgaaataacaaaaatccctctaaaccgaaaccgacgacaataataacaacgatatcgccgccctaactcaccgcgccccttttccaacccgcgacgtcgccgcgcaaacgaaacaacgacgaccgccgaaaaacaaataacccaacctaataaccgccgaaaaacccttcacaaactacgacctaacaaaaaaaaacctaactaaacgacgataatcaaattcccc

SEQ ID NO: 16049 - DNA, 861 bp, Artificial Sequence
  chemically treated genomic DNA (Homo sapiens) CpG-island No: 16049
tgtggaataggtgttggttgatgtattttacgtataggttgcggcgttggtgtagggcgcggggattggcgcgattcgcgtcgggttggcggttttgtttaaatcggggtagcgttttttggtgtatgacgcgtttgtttattcgacgatacgggttattattgagtagatggggttgacgtttattattgttgattttaatgatttgtcggtattgaagtaggtcgtcgacgagtaataatcggatgcggcgttggtgtagtatacgcgttagtagtcgtaggatagttacgtgttggtagatgtgttggtaacgttgcgcgcggtaggtgttttagcgttaatcgatgataattatgcggtgattgataggtgcgttcgaatcggttgtgaatgcggcgcgaatgtttcgatatttttttgttttaagttatttgggttagagggtgttggtgtagtgggtcgggcgatgttgatgttattaatcgtattcgcgttacgttttatttcggcggtagttagattttagggcgtataggcgttggaagtattgcgtggtttggtgtttgcgttagtgatgtacgcggtgtaggtaggggtatttgaacggttgttggttttgtttaacggtggtgcggtgtcggaagtgaaaagcgcggtgattgttaatgcgtagtcgaaggtgttgattgtcgagttttattagtcgattgtcgttagagtgttggaagaggcgtaaaagcgcggtgttttgttttattcggtgggtgtagagtcgaaatatgaaatttcgtcgtttttttatcgttttttcggaacgtttcgttaggcgaatttataattagaatattgtgcgattcg

SEQ ID NO: 16050 - DNA, 861 bp, Artificial Sequence
  chemically treated genomic DNA (Homo sapiens) CpG-island No: 16050
cgaatcgcacaatattctaattataaattcgcctaacgaaacgttccgaaaaaacgataaaaaaacgacgaaatttcatatttcgactctacacccaccgaataaaacaaaacaccgcgcttttacgcctcttccaacactctaacgacaatcgactaataaaactcgacaatcaacaccttcgactacgcattaacaatcaccgcgcttttcacttccgacaccgcaccaccgttaaacaaaaccaacaaccgttcaaatacccctacctacaccgcgtacatcactaacgcaaacaccaaaccacgcaatacttccaacgcctatacgccctaaaatctaactaccgccgaaataaaacgtaacgcgaatacgattaataacatcaacatcgcccgacccactacaccaacaccctctaacccaaataacttaaaacaaaaaaatatcgaaacattcgcgccgcattcacaaccgattcgaacgcacctatcaatcaccgcataattatcatcgattaacgctaaaacacctaccgcgcgcaacgttaccaacacatctaccaacacgtaactatcctacgactactaacgcgtatactacaccaacgccgcatccgattattactcgtcgacgacctacttcaataccgacaaatcattaaaatcaacaataataaacgtcaaccccatctactcaataataacccgtatcgtcgaataaacaaacgcgtcatacaccaaaaaacgctaccccgatttaaacaaaaccgccaacccgacgcgaatcgcgccaatccccgcgccctacaccaacgccgcaacctatacgtaaaatacatcaaccaacacctattccaca

SEQ ID NO: 16051 - DNA, 861 bp, Artificial Sequence
  chemically treated genomic DNA (Homo sapiens) CpG-island No: 16051
cgaatcgtataatgttttgattgtggattcgtttggcgaaacgtttcggaaaggcgataaaagagcggcgggattttatatttcgattttgtatttatcgggtaaggtaaggtatcgcgtttttgcgttttttttagtattttggcggtaatcggttgatgaaattcgataattaatattttcgattgcgtattagtaattatcgcgttttttattttcggtatcgtattatcgttaagtaaagttagtaatcgtttagatatttttgtttgtatcgcgtgtattattggcgtaaatattagattacgtaatatttttagcgtttgtgcgttttgggatttggttatcgtcggagtaaagcgtggcgcgaatacggttgataatattagtatcgttcggtttattgtattaatattttttggtttaaatagtttgaagtaggaaaatgtcgagatattcgcgtcgtatttatagtcgattcgagcgtatttgttagttatcgtatagttgttatcggttaacgttggaatatttgtcgcgcgtaacgttgttagtatatttgttagtacgtagttgttttgcggttgttggcgcgtatgttgtattagcgtcgtattcggttgttgttcgtcgacgatttgttttagtgtcgataggttattgaaattaatagtaataagcgttagttttatttgtttaataataattcgtgtcgtcgggtaaataggcgcgttatgtattagaagacgttgtttcggtttgagtaaagtcgttagttcggcgcgaatcgcgttagttttcgcgttttgtattagcgtcgtagtttgtgcgtgaaatgtattagttagtatttgttttata

SEQ ID NO: 16052 - DNA, 861 bp, Artificial Sequence
  chemically treated genomic DNA (Homo sapiens) CpG-island No: 16052
tataaaacaaatactaactaatacatttcacgcacaaactacgacgctaatacaaaacgcgaaaactaacgcgattcgcgccgaactaacgactttactcaaaccgaaacaacgtcttctaatacataacgcgcctatttacccgacgacacgaattattattaaacaaataaaactaacgcttattactattaatttcaataacctatcgacactaaaacaaatcgtcgacgaacaacaaccgaatacgacgctaatacaacatacgcgccaacaaccgcaaaacaactacgtactaacaaatatactaacaacgttacgcgcgacaaatattccaacgttaaccgataacaactatacgataactaacaaatacgctcgaatcgactataaatacgacgcgaatatctcgacattttcctacttcaaactatttaaaccaaaaaatattaatacaataaaccgaacgatactaatattatcaaccgtattcgcgccacgctttactccgacgataaccaaatcccaaaacgcacaaacgctaaaaatattacgtaatctaatatttacgccaataatacacgcgatacaaacaaaaatatctaaacgattactaactttacttaacgataatacgataccgaaaataaaaaacgcgataattactaatacgcaatcgaaaatattaattatcgaatttcatcaaccgattaccgccaaaatactaaaaaaaacgcaaaaacgcgataccttaccttacccgataaatacaaaatcgaaatataaaatcccgccgctcttttatcgcctttccgaaacgtttcgccaaacgaatccacaatcaaaacattatacgattcg

SEQ ID NO: 16053 - DNA, 598 bp, Artificial Sequence
  chemically treated genomic DNA (Homo sapiens) CpG-island No: 16053
tattatcggataggttttcgggtgaacggtagacgcgtttagcgggttattatcgtggttaatgcgtaagaagttcgcgtattgttcgaaggttttcggttttagacggtttatttttaatagttgttgacggttttggaattgatcgtttttatcgcgttaggtaacgatgttttgcgttattatgcgcgttaggttcgttacgcgggttaatagcggaatagaagtagtgttgagatcgacgttaacggcgtttacgtagttttttattattgcgtttagtttgcgggttagttgcgtttggttgacgttatgttgatattgatttacgtcgatagatttcggatcgatttttattagtttcgttagcggattttgtaaacggcgggcgatagatatcgcgttacgtagcgaaacgtcgagattcgggaatttttgtgtagttagttcggaagtcgagtaaatcgacgcgtttgtttcgttgacgattattttttgcgcggttattttcgggaattgtttttgtatatcgagatagaaacgtttagtttcgcgggaagttgtatcgttatcgatcgttattagttttacgttatgt

SEQ ID NO: 16054 - DNA, 598 bp, Artificial Sequence
  chemically treated genomic DNA (Homo sapiens) CpG-island No: 16054
acataacgtaaaactaataacgatcgataacgatacaacttcccgcgaaactaaacgtttctatctcgatatacaaaaacaattcccgaaaataaccgcgcaaaaaataatcgtcaacgaaacaaacgcgtcgatttactcgacttccgaactaactacacaaaaattcccgaatctcgacgtttcgctacgtaacgcgatatctatcgcccgccgtttacaaaatccgctaacgaaactaataaaaatcgatccgaaatctatcgacgtaaatcaatatcaacataacgtcaaccaaacgcaactaacccgcaaactaaacgcaataataaaaaactacgtaaacgccgttaacgtcgatctcaacactacttctattccgctattaacccgcgtaacgaacctaacgcgcataataacgcaaaacatcgttacctaacgcgataaaaacgatcaattccaaaaccgtcaacaactattaaaaataaaccgtctaaaaccgaaaaccttcgaacaatacgcgaacttcttacgcattaaccacgataataacccgctaaacgcgtctaccgttcacccgaaaacctatccgataata

SEQ ID NO: 16055 - DNA, 598 bp, Artificial Sequence
  chemically treated genomic DNA (Homo sapiens) CpG-island No: 16055
atataacgtggaattggtagcgatcggtaacggtatagtttttcgcgaaattgagcgtttttatttcgatgtgtagaagtagttttcgaaagtgatcgcgtagaaagtaatcgttagcgaagtaggcgcgtcggtttattcggttttcgagttggttgtataggagttttcggatttcgacgtttcgttgcgtggcgcggtgtttatcgttcgtcgtttgtaggattcgttggcggagttggtgaaaatcgattcgaaatttatcggcgtaggttagtattagtatgacgttagttagacgtaattggttcgtaaattggacgtagtagtagaagattgcgtaaacgtcgttggcgtcgattttaatattgtttttgtttcgttgttaattcgcgtggcgggtttgacgcgtatgatggcgtaaaatatcgttgtttggcgcgatgagaacggttagttttagaatcgttagtaattgttaaaagtgagtcgtttggggtcgaaagttttcgagtagtgcgcgggttttttgcgtattaattacggtgataattcgttggacgcgtttatcgtttattcggaagtttattcggtggtg

SEQ ID NO: 16056 - DNA, 598 bp, Artificial Sequence
  chemically treated genomic DNA (Homo sapiens) CpG-island No: 16056
caccaccgaataaacttccgaataaacgataaacgcgtccaacgaattatcaccgtaattaatacgcaaaaaacccgcgcactactcgaaaactttcgaccccaaacgactcacttttaacaattactaacgattctaaaactaaccgttctcatcgcgccaaacaacgatattttacgccatcatacgcgtcaaacccgccacgcgaattaacaacgaaacaaaaacaatattaaaatcgacgccaacgacgtttacgcaatcttctactactacgtccaatttacgaaccaattacgtctaactaacgtcatactaatactaacctacgccgataaatttcgaatcgattttcaccaactccgccaacgaatcctacaaacgacgaacgataaacaccgcgccacgcaacgaaacgtcgaaatccgaaaactcctatacaaccaactcgaaaaccgaataaaccgacgcgcctacttcgctaacgattactttctacgcgatcactttcgaaaactacttctacacatcgaaataaaaacgctcaatttcgcgaaaaactataccgttaccgatcgctaccaattccacgttatat

SEQ ID NO: 16057 - DNA, 809 bp, Artificial Sequence
  chemically treated genomic DNA (Homo sapiens) CpG-island No: 16057
attagtttagtcgggaatattacgtcgtggtcgtttttattttttttttgttggagcgtttttgttaggttgcgtcgttgcgttttttttcgttcgtcgttttttgtttcgattcggatgagcggcgtgaagtttttcggttcgtatatcgtttggatacgtgtggtgttagtttgtatcgtcgttagtttgttttcgttttagttatattacgttattttcggtttacgcgatagcgatatttatttcgttaggttacgttttcgtcgttagattcgttttgttattcgtcgttttagcgggtcgtagaggtagcggttttcgattagtggttcgttatgttgtattcgcgtgtagaatattaggcggtgttggttgtcgtagtggtagtggtgggttcgttcgtcgttcgttcgtattatattcgtcgggatgcggttcgtttttttcgttagtttgtcgtatttatcgtggcggtagatatagtgcgtatttttcgcgatgcggttattcggttatattgtgagtgtattgttcgggtgtagtttcgggttcggtagtcggttgttcgtcgggttcgtggtatacgggatgcggatgtttaggtttggtgcgagggtgcgtatattttttagtttgttcgtggcgttgtagtcgtattttcgcgtttgtcgcgggtcgttgatgcgtattaggtcgtcgttgttattttattcgtagttacggttatatattaggttgtttaggtgttggttttgtaattggtttgcgggggtgtatgtgttggttagttcgtatgcggtattatt

SEQ ID NO: 16058 - DNA, 809 bp, Artificial Sequence
  chemically treated genomic DNA (Homo sapiens) CpG-island No: 16058
aataataccgcatacgaactaaccaacacatacacccccgcaaaccaattacaaaaccaacacctaaacaacctaatatataaccgtaactacgaataaaataacaacgacgacctaatacgcatcaacgacccgcgacaaacgcgaaaatacgactacaacgccacgaacaaactaaaaaatatacgcaccctcgcaccaaacctaaacatccgcatcccgtataccacgaacccgacgaacaaccgactaccgaacccgaaactacacccgaacaatacactcacaatataaccgaataaccgcatcgcgaaaaatacgcactatatctaccgccacgataaatacgacaaactaacgaaaaaaacgaaccgcatcccgacgaatataatacgaacgaacgacgaacgaacccaccactaccactacgacaaccaacaccgcctaatattctacacgcgaatacaacataacgaaccactaatcgaaaaccgctacctctacgacccgctaaaacgacgaataacaaaacgaatctaacgacgaaaacgtaacctaacgaaataaatatcgctatcgcgtaaaccgaaaataacgtaatataactaaaacgaaaacaaactaacgacgatacaaactaacaccacacgtatccaaacgatatacgaaccgaaaaacttcacgccgctcatccgaatcgaaacaaaaaacgacgaacgaaaaaaaacgcaacgacgcaacctaacaaaaacgctccaacaaaaaaaaaataaaaacgaccacgacgtaatattcccgactaaactaat

SEQ ID NO: 16059 - DNA, 809 bp, Artificial Sequence
  chemically treated genomic DNA (Homo sapiens) CpG-island No: 16059
agtaatgtcgtatacgaattgattagtatatatattttcgtaggttagttatagagttagtatttgaatagtttggtatatgatcgtgattacgggtggagtgataacggcgatttggtgcgtattagcggttcgcgatagacgcgggaatacggttatagcgttacgggtaggttggagagtgtgcgtattttcgtattagatttggatattcgtatttcgtatgttacggattcggcgggtaatcggttgtcggattcggagttgtattcggatagtatatttatagtgtggtcggataatcgtatcgcggaggatgcgtattatgtttatcgttacgatgaatacggtaggttgacggagaagacggatcgtatttcggcgggtgtgatacggacggacgacgagcggatttattattattattacgatagttagtatcgtttggtgttttatacgcggatatagtatggcgagttattggtcgagagtcgttatttttacgattcgttgggacggcgaatggtaaaacgggtttggcggcgggagcgtgatttgacggggtggatgtcgttgtcgcgtaaatcggaggtgacgtggtatggttgggacggagataggttgacgacggtgtagattgatattatacgtatttagacggtatacgagtcgggaagttttacgtcgtttattcgggtcgagatagagaacggcgagcgggaaaaagcgtagcggcgtagtttggtagagacgttttagtaggaagggagtgagaacggttacggcgtggtgttttcggttgaattggt

SEQ ID NO: 16060 - DNA, 809 bp, Artificial Sequence
  chemically treated genomic DNA (Homo sapiens) CpG-island No: 16060
accaattcaaccgaaaacaccacgccgtaaccgttctcactcccttcctactaaaacgtctctaccaaactacgccgctacgctttttcccgctcgccgttctctatctcgacccgaataaacgacgtaaaacttcccgactcgtataccgtctaaatacgtataatatcaatctacaccgtcgtcaacctatctccgtcccaaccataccacgtcacctccgatttacgcgacaacgacatccaccccgtcaaatcacgctcccgccgccaaacccgttttaccattcgccgtcccaacgaatcgtaaaaataacgactctcgaccaataactcgccatactatatccgcgtataaaacaccaaacgatactaactatcgtaataataataataaatccgctcgtcgtccgtccgtatcacacccgccgaaatacgatccgtcttctccgtcaacctaccgtattcatcgtaacgataaacataatacgcatcctccgcgatacgattatccgaccacactataaatatactatccgaatacaactccgaatccgacaaccgattacccgccgaatccgtaacatacgaaatacgaatatccaaatctaatacgaaaatacgcacactctccaacctacccgtaacgctataaccgtattcccgcgtctatcgcgaaccgctaatacgcaccaaatcgccgttatcactccacccgtaatcacgatcatataccaaactattcaaatactaactctataactaacctacgaaaatatatatactaatcaattcgtatacgacattact

SEQ ID NO: 16061 - DNA, 725 bp, Artificial Sequence
  chemically treated genomic DNA (Homo sapiens) CpG-island No: 16061
agatcggtcgttagtagtaatagcgtttcgtatagcgtcgtttgggttagtttttagcgagcggtgtcgttaatgcgtcgggtaatgtgcggtgcgattaaagtaataaaggaaatcggttcggtaagcgttgttgtcgtagcggtaagtattattgtaattagtattattaatagacgcgaacgttcgacgttgacgtttagcgtatacgcggtattatcgtttatttttagtaagtcgtattcggcgtattagtaaggcggcggtaatgagtattaatataatgatgggtgcggaaggcgaggtttttgtttacgttaggtcgttgagcgattcggtattttataaatttgttgttagcgtcgtttttaaaagacgtttttagtaattagttaggtattaacggttattagtatggcgcgaacgtcgatatcgataataattaatcgttcggtgtcgatgtcgtagcgttaggcgagtagttagataggagcgaagtgataaagacgattattattgttgaagcgcgatagtcggtaggtttgattaaaagattatcgtattatacgcggttaagttcggtgtaacgtttacgttaggatgcgaaggttttataggattaaatcgtttgagtatggtgtataagtcgtacggtgaagtatcgattttgaagtggtatatacggggaaagaataaaattcgttattatgttagatagaggtacg

SEQ ID NO: 16062 - DNA, 725 bp, Artificial Sequence
  chemically treated genomic DNA (Homo sapiens) CpG-island No: 16062
cgtacctctatctaacataataacgaattttattctttccccgtatataccacttcaaaatcgatacttcaccgtacgacttatacaccatactcaaacgatttaatcctataaaaccttcgcatcctaacgtaaacgttacaccgaacttaaccgcgtataatacgataatcttttaatcaaacctaccgactatcgcgcttcaacaataataatcgtctttatcacttcgctcctatctaactactcgcctaacgctacgacatcgacaccgaacgattaattattatcgatatcgacgttcgcgccatactaataaccgttaatacctaactaattactaaaaacgtcttttaaaaacgacgctaacaacaaatttataaaataccgaatcgctcaacgacctaacgtaaacaaaaacctcgccttccgcacccatcattatattaatactcattaccgccgccttactaatacgccgaatacgacttactaaaaataaacgataataccgcgtatacgctaaacgtcaacgtcgaacgttcgcgtctattaataatactaattacaataatacttaccgctacgacaacaacgcttaccgaaccgatttcctttattactttaatcgcaccgcacattacccgacgcattaacgacaccgctcgctaaaaactaacccaaacgacgctatacgaaacgctattactactaacgaccgatct

SEQ ID NO: 16063 - DNA, 725 bp, Artificial Sequence
  chemically treated genomic DNA (Homo sapiens) CpG-island No: 16063
cgtatttttgtttggtatggtaacgggttttatttttttttcgtgtatgttattttagggtcgatgttttatcgtgcggtttatgtattatgtttaggcgatttagttttatggaattttcgtattttgacgtaggcgttatatcgggtttgatcgcgtgtggtgcgatggttttttggttagatttgtcggttatcgcgttttagtaatggtggtcgtttttgttatttcgtttttgtttggttgttcgtttggcgttacggtatcgatatcgggcggttgattattatcggtatcggcgttcgcgttatgttggtggtcgttaatatttggttggttgttgaaagcgttttttagaaacggcgttaatagtaggtttgtggaatgtcggatcgtttaacggtttgacgtgggtagaaatttcgtttttcgtatttattattatattgatgtttattgtcgtcgttttattggtacgtcggatgcggtttgttggaaatgggcgatgatatcgcgtgtgcgttgggcgttagcgtcgaacgttcgcgtttgttaatgatgttggttgtagtggtgtttatcgttgcggtaatagcgtttgtcgggtcgattttttttattgttttagtcgtatcgtatattgttcgacgtattagcggtatcgttcgttgggggttaatttaggcggcgttatgcggggcgttgttattgttggcggtcgattt

SEQ ID NO: 16064 - DNA, 725 bp, Artificial Sequence
  chemically treated genomic DNA (Homo sapiens) CpG-island No: 16064
aaatcgaccgccaacaataacaacgccccgcataacgccgcctaaattaacccccaacgaacgataccgctaatacgtcgaacaatatacgatacgactaaaacaataaaaaaaatcgacccgacaaacgctattaccgcaacgataaacaccactacaaccaacatcattaacaaacgcgaacgttcgacgctaacgcccaacgcacacgcgatatcatcgcccatttccaacaaaccgcatccgacgtaccaataaaacgacgacaataaacatcaatataataataaatacgaaaaacgaaatttctacccacgtcaaaccgttaaacgatccgacattccacaaacctactattaacgccgtttctaaaaaacgctttcaacaaccaaccaaatattaacgaccaccaacataacgcgaacgccgataccgataataatcaaccgcccgatatcgataccgtaacgccaaacgaacaaccaaacaaaaacgaaataacaaaaacgaccaccattactaaaacgcgataaccgacaaatctaaccaaaaaaccatcgcaccacacgcgatcaaacccgatataacgcctacgtcaaaatacgaaaattccataaaactaaatcgcctaaacataatacataaaccgcacgataaaacatcgaccctaaaataacatacacgaaaaaaaaataaaacccgttaccataccaaacaaaaatacg

SEQ ID NO: 16065 - DNA, 537 bp, Artificial Sequence
  chemically treated genomic DNA (Homo sapiens) CpG-island No: 16065
gtcggttaatataagttttcgttatattgcggaatgggcgggaattatgtaatacggattcgttagtttatgtttcgaattggttcggatttaggtgttattaggtaattagttagtattagcgttcgtttttggggcgtaatatagttacgggttatgtagtatagatttagtataacgttttgagacggaacgatgattgtttcgtcgttcgtcggggataggatgttgttggtagatattattagcgtacgcgtttttagttgggtttttagcgttagcggtacgtgaatagttatttggttattatcgaagtcggcgttatatgtcgtataaattagcgggtgtagttggatagttttattttcgattagtatcggtttaaatgtttggatatttagacggtgtagagtcggtgtacggtttagtagtatcgggtgttcgcggataatttcgtttaggatattttaaacgatagttttttcgcgtttaattatttttttcgtagttttaatggtggtagtaagattacgtagt

SEQ ID NO: 16066 - DNA, 537 bp, Artificial Sequence
  chemically treated genomic DNA (Homo sapiens) CpG-island No: 16066
actacgtaatcttactaccaccattaaaactacgaaaaaaataattaaacgcgaaaaaactatcgtttaaaatatcctaaacgaaattatccgcgaacacccgatactactaaaccgtacaccgactctacaccgtctaaatatccaaacatttaaaccgatactaatcgaaaataaaactatccaactacacccgctaatttatacgacatataacgccgacttcgataataaccaaataactattcacgtaccgctaacgctaaaaacccaactaaaaacgcgtacgctaataatatctaccaacaacatcctatccccgacgaacgacgaaacaatcatcgttccgtctcaaaacgttatactaaatctatactacataacccgtaactatattacgccccaaaaacgaacgctaatactaactaattacctaataacacctaaatccgaaccaattcgaaacataaactaacgaatccgtattacataattcccgcccattccgcaatataacgaaaacttatattaaccgac

SEQ ID NO: 16067 - DNA, 537 bp, Artificial Sequence
  chemically treated genomic DNA (Homo sapiens) CpG-island No: 16067
attgcgtggttttgttattattattaaagttgcgaagaaaatggttgagcgcgaagaagttgtcgtttgggatattttggacgaagttattcgcgaatattcggtattgttgaatcgtgtatcgattttgtatcgtttgggtatttaggtatttgaatcggtattgatcgaaggtaaagttatttagttgtattcgttggtttgtgcggtatataacgtcgatttcgatggtgattagatggttgtttacgtatcgttgacgttggaagtttagttggaagcgcgtgcgttgatgatgtttattaataatattttgttttcggcgaacggcgaaataattatcgtttcgttttaggacgttgtattgggtttgtattatatgattcgtgattgtgttacgttttaagggcgaacgttggtgttgattggttatttggtggtatttgggttcgggttaattcggaatatgggttaacgggttcgtgttatatggttttcgtttatttcgtaatatggcgggaatttatgttaatcggt

SEQ ID NO: 16068 - DNA, 537 bp, Artificial Sequence
  chemically treated genomic DNA (Homo sapiens) CpG-island No: 16068
accgattaacataaattcccgccatattacgaaataaacgaaaaccatataacacgaacccgttaacccatattccgaattaacccgaacccaaataccaccaaataaccaatcaacaccaacgttcgcccttaaaacgtaacacaatcacgaatcatataatacaaacccaatacaacgtcctaaaacgaaacgataattatttcgccgttcgccgaaaacaaaatattattaataaacatcatcaacgcacgcgcttccaactaaacttccaacgtcaacgatacgtaaacaaccatctaatcaccatcgaaatcgacgttatataccgcacaaaccaacgaatacaactaaataactttaccttcgatcaataccgattcaaatacctaaatacccaaacgatacaaaatcgatacacgattcaacaataccgaatattcgcgaataacttcgtccaaaatatcccaaacgacaacttcttcgcgctcaaccattttcttcgcaactttaataataataacaaaaccacgcaat

SEQ ID NO: 16069 - DNA, 521 bp, Artificial Sequence
  chemically treated genomic DNA (Homo sapiens) CpG-island No: 16069
gtatgcggtgtgtgtggcgtgtgtgtgtgcgtgtgtggtgtgtgtggtgtatggtgtgtgtgtggtgtgtgcggtgtgtgtgtgtggtgtgtgtggtgtgtgtgtgtggtgtgtgtggtgtgtgggtgtgtggtgtgtggtgtgtatttgtgcgtgtgtggtgtgtgttgtgtgtgagtgtggggtgtgtgtgtgtgtgtgtgtgtgtgtgtgtgtgtgtgtgtgtgtcgggggaggtatatacgtagttttcgtgcggaaagatggtgttttttttttatagggttgcgcgggtatttattttcgttgtaaagcgttcgggttaggcgcggtttgtttcgggtcggggcgagttcgttgttttttgcggtagatagcgatgcgcgtttttcgttttagttttcggttcgttcgcggttcgcgcgttttttcggtgtagtatgcgggcgttgtgacgttttcggataaatgtcgtgtaattgtgtaggcgaatgagagttaaaaataagaacggaaaattt

SEQ ID NO: 16070 - DNA, 521 bp, Artificial Sequence
  chemically treated genomic DNA (Homo sapiens) CpG-island No: 16070
aaattttccgttcttatttttaactctcattcgcctacacaattacacgacatttatccgaaaacgtcacaacgcccgcatactacaccgaaaaaacgcgcgaaccgcgaacgaaccgaaaactaaaacgaaaaacgcgcatcgctatctaccgcaaaaaacaacgaactcgccccgacccgaaacaaaccgcgcctaacccgaacgctttacaacgaaaataaatacccgcgcaaccctataaaaaaaaaacaccatctttccgcacgaaaactacgtatatacctcccccgacacacacacacacacacacacacacacacacacacacacacaccccacactcacacacaacacacaccacacacgcacaaatacacaccacacaccacacacccacacaccacacacaccacacacacacaccacacacaccacacacacacaccgcacacaccacacacacaccatacaccacacacaccacacacgcacacacacacgccacacacaccgcatac

SEQ ID NO: 16071 - DNA, 521 bp, Artificial Sequence
  chemically treated genomic DNA (Homo sapiens) CpG-island No: 16071
agatttttcgtttttatttttagtttttattcgtttatatagttatacggtatttattcgagaacgttatagcgttcgtatgttgtatcgggagggcgcgcgggtcgcgggcgagtcgggagttggggcggggagcgcgtatcgttgtttgtcgtagagggtagcgagttcgtttcgattcggagtaagtcgcgtttggttcgggcgttttgtagcggggatgggtgttcgcgtagttttgtgaaggaaagatattattttttcgtacggaaattgcgtatatatttttttcgatatatatatatatatatatatatatatatatatatatatatattttatatttatatatagtatatattatatacgtatagatatatattatatattatatatttatatattatatatattatatatatatattatatatattatatatatatatcgtatatattatatatatattatatattatatatattatatacgtatatatatacgttatatatatcgtatat

SEQ ID NO: 16072 - DNA, 521 bp, Artificial Sequence
  chemically treated genomic DNA (Homo sapiens) CpG-island No: 16072
atatacgatatatataacgtatatatatacgtatataatatatataatatataatatatatataatatatacgatatatatatataatatatataatatatatatataatatatataatatataaatatataatatataatatatatctatacgtatataatatatactatatataaatataaaatatatatatatatatatatatatatatatatatatatatatatcgaaaaaaatatatacgcaatttccgtacgaaaaaataatatctttccttcacaaaactacgcgaacacccatccccgctacaaaacgcccgaaccaaacgcgacttactccgaatcgaaacgaactcgctaccctctacgacaaacaacgatacgcgctccccgccccaactcccgactcgcccgcgacccgcgcgccctcccgatacaacatacgaacgctataacgttctcgaataaataccgtataactatataaacgaataaaaactaaaaataaaaacgaaaaatct

SEQ ID NO: 16073 - DNA, 875 bp, Artificial Sequence
  chemically treated genomic DNA (Homo sapiens) CpG-island No: 16073
tcgaacgttgagtttttagacgcgcggtcggacgtagggaggttaggacgcgacgttcgttttatttgtttttttagcggttttttggcgatagcgtcggtttgggggagggcgcgcggtcgtagacgtagttttttagtaggtaaagtttcgaggcgcgcgagttcgagtcgttttcgaagtagaagagtaggttttgtagtagcgcgaattatttggtttgttattttgtgttgttcgaatttcgtttgtttaggtagtttttgcgcgtgtcgtttttgcgcgttagtagttttagggacgcgacgtggttattatttagtcggatttttttttgtatggtgtttagaggttagcgagattttacgcgtttatatttttttcgcgtagtagtttttcgttcgtgcgcgttgcgttgtttttttttggcgttcgttcgttcgttttttttagtttttttttttttttaaatatttatattttaggatttggcgtcgagtcgcggttttttgaatttagatatattatttttcgttggaatttttttttcgtttcgtagagttttagtattcggaagatgtcgttcgattttttttcggtgtcgggtaaattgagggattggcgatttgcgcgttggcgaggggtaggcggagttatgtgacgtcgatttttcgaagagttcgttttagtagcgcggatagggatatacgtacgtagtttcgtcgagggtagagtcgcgcgtaggttgtaatttggtgttttttttttttttttagatatatatatacgtatacgtatacgtatatatttaaattttgttttttttttttttatttcgttttttttcgttcggatgttaaaaagtaattagatta

SEQ ID NO: 16074 - DNA, 875 bp, Artificial Sequence
  chemically treated genomic DNA (Homo sapiens) CpG-island No: 16074
taatctaattactttttaacatccgaacgaaaaaaaacgaaataaaaaaaaaaaaaacaaaatttaaatatatacgtatacgtatacgtatatatatatctaaaaaaaaaaaaaaaacaccaaattacaacctacgcgcgactctaccctcgacgaaactacgtacgtatatccctatccgcgctactaaaacgaactcttcgaaaaatcgacgtcacataactccgcctacccctcgccaacgcgcaaatcgccaatccctcaatttacccgacaccgaaaaaaaatcgaacgacatcttccgaatactaaaactctacgaaacgaaaaaaaaattccaacgaaaaataatatatctaaattcaaaaaaccgcgactcgacgccaaatcctaaaatataaatatttaaaaaaaaaaaaaaactaaaaaaaacgaacgaacgaacgccaaaaaaaaacaacgcaacgcgcacgaacgaaaaactactacgcgaaaaaaatataaacgcgtaaaatctcgctaacctctaaacaccatacaaaaaaaaatccgactaaataataaccacgtcgcgtccctaaaactactaacgcgcaaaaacgacacgcgcaaaaactacctaaacaaacgaaattcgaacaacacaaaataacaaaccaaataattcgcgctactacaaaacctactcttctacttcgaaaacgactcgaactcgcgcgcctcgaaactttacctactaaaaaactacgtctacgaccgcgcgccctcccccaaaccgacgctatcgccaaaaaaccgctaaaaaaacaaataaaacgaacgtcgcgtcctaacctccctacgtccgaccgcgcgtctaaaaactcaacgttcga

SEQ ID NO: 16075 - DNA, 875 bp, Artificial Sequence
  chemically treated genomic DNA (Homo sapiens) CpG-island No: 16075
tgatttgattgttttttaatattcgagcgagagaaggcgagatgaggggagggagggtagggtttgagtgtgtgcgtgtgcgtgtgcgtgtgtgtgtgtttggggagggggaggaggtattaagttgtagtttgcgcgcggttttgttttcggcggggttgcgtgcgtgtgtttttgttcgcgttgttgaaacgggtttttcgagggatcggcgttatatgatttcgtttgtttttcgttagcgcgtagatcgttagttttttagtttgttcggtatcggaggagggtcgggcggtatttttcgggtattggggttttgcggagcggagaagaggttttagcggggaatggtatatttggatttaagaagtcgcggttcggcgttagattttggagtgtagatatttggggggaggggagagttagagggagcgagcgagcgagcgttagagagaggtagcgtagcgcgtacggacggggggttgttgcgcggagaagatgtaagcgcgtggggtttcgttggtttttgagtattatgtagaaggggattcggttgaatgatggttacgtcgcgtttttgggattgttggcgcgtaaggacggtacgcgtaaaggttatttgagtaagcggagttcggataatataaaatggtaaattaagtggttcgcgttgttgtagaatttgtttttttatttcgagagcgattcgagttcgcgcgtttcggggttttatttgttggagggttgcgtttgcgatcgcgcgtttttttttaagtcggcgttgtcgttaaggagtcgttggagaaataggtgaggcgagcgtcgcgttttgatttttttgcgttcggtcgcgcgtttgggggtttagcgttcgg

SEQ ID NO: 16076 - DNA, 875 bp, Artificial Sequence
  chemically treated genomic DNA (Homo sapiens) CpG-island No: 16076
ccgaacgctaaacccccaaacgcgcgaccgaacgcaaaaaaatcaaaacgcgacgctcgcctcacctatttctccaacgactccttaacgacaacgccgacttaaaaaaaaacgcgcgatcgcaaacgcaaccctccaacaaataaaaccccgaaacgcgcgaactcgaatcgctctcgaaataaaaaaacaaattctacaacaacgcgaaccacttaatttaccattttatattatccgaactccgcttactcaaataacctttacgcgtaccgtccttacgcgccaacaatcccaaaaacgcgacgtaaccatcattcaaccgaatccccttctacataatactcaaaaaccaacgaaaccccacgcgcttacatcttctccgcgcaacaaccccccgtccgtacgcgctacgctacctctctctaacgctcgctcgctcgctccctctaactctcccctccccccaaatatctacactccaaaatctaacgccgaaccgcgacttcttaaatccaaatataccattccccgctaaaacctcttctccgctccgcaaaaccccaatacccgaaaaataccgcccgaccctcctccgataccgaacaaactaaaaaactaacgatctacgcgctaacgaaaaacaaacgaaatcatataacgccgatccctcgaaaaacccgtttcaacaacgcgaacaaaaacacacgcacgcaaccccgccgaaaacaaaaccgcgcgcaaactacaacttaatacctcctccccctccccaaacacacacacacgcacacgcacacgcacacactcaaaccctaccctccctcccctcatctcgccttctctcgctcgaatattaaaaaacaatcaaatca

SEQ ID NO: 16077 - DNA, 548 bp, Artificial Sequence
  chemically treated genomic DNA (Homo sapiens) CpG-island No: 16077
  misc_feature (484)..(485): n is either a, c, g or t
  misc_feature (496)..(496): n is either a, c, g or t
  misc_feature (502)..(503): n is either a, c, g or t
  misc_feature (514)..(515): n is either a, c, g or t
  misc_feature (517)..(517): n is either a, c, g or t
  misc_feature (525)..(525): n is either a, c, g or t
  misc_feature (533)..(533): n is either a, c, g or t
  misc_feature (539)..(539): n is either a, c, g or t
tagattggtgcgtcgtcgtcgcggtcgttttttttcgtcgggcggggtggggggtggtgagggacgcgatttaggtcgtggtttggcggcggtttcggttatagttttcgtatttcggtcgcgcgttttcggaggtgacgttttgaggaagttgtatttttttgggggggagtcgtagggaatcgttgggagaggggttttgtgtgtgtttttttaagagtcggagcgttgttttcgtttcgtaggcgttcggagttttataaaagaataggatgtcgttgatttgttattaaattatagagagaaatgatgtaatttttttaatatttttcgcgtttcggtcgttttcgttttcgtttttttcgttttcgttcgttcgtatagcggggttttagcgttttcgcggggcgtttgtttttcggtcgggttacgggtcgagcggtttttgggcgtttgcgggaggagttttcggtttaggtcgttnnggtttttaagnttcgtnnggtttttagtnntngttttgtnttgtttanttacgntttggttaa

SEQ ID NO: 16078 - DNA, 548 bp, Artificial Sequence
  chemically treated genomic DNA (Homo sapiens) CpG-island No: 16078
  misc_feature (10)..(10): n is either a, c, g or t
  misc_feature (16)..(16): n is either a, c, g or t
  misc_feature (24)..(24): n is either a, c, g or t
  misc_feature (32)..(32): n is either a, c, g or t
  misc_feature (34)..(35): n is either a, c, g or t
  misc_feature (46)..(47): n is either a, c, g or t
  misc_feature (53)..(53): n is either a, c, g or t
  misc_feature (64)..(65): n is either a, c, g or t
ttaaccaaancgtaantaaacaanacaaaacnannactaaaaaccnnacgaancttaaaaaccnnaacgacctaaaccgaaaactcctcccgcaaacgcccaaaaaccgctcgacccgtaacccgaccgaaaaacaaacgccccgcgaaaacgctaaaaccccgctatacgaacgaacgaaaacgaaaaaaacgaaaacgaaaacgaccgaaacgcgaaaaatattaaaaaaattacatcatttctctctataatttaataacaaatcaacgacatcctattcttttataaaactccgaacgcctacgaaacgaaaacaacgctccgactcttaaaaaaacacacacaaaacccctctcccaacgattccctacgactcccccccaaaaaaatacaacttcctcaaaacgtcacctccgaaaacgcgcgaccgaaatacgaaaactataaccgaaaccgccgccaaaccacgacctaaatcgcgtccctcaccaccccccaccccgcccgacgaaaaaaaacgaccgcgacgacgacgcaccaatcta

SEQ ID NO: 16079 - DNA, 548 bp, Artificial Sequence
  chemically treated genomic DNA (Homo sapiens) CpG-island No: 16079
  misc_feature (10)..(10): n is either a, c, g or t
  misc_feature (16)..(16): n is either a, c, g or t
  misc_feature (24)..(24): n is either a, c, g or t
  misc_feature (32)..(32): n is either a, c, g or t
  misc_feature (34)..(35): n is either a, c, g or t
  misc_feature (46)..(47): n is either a, c, g or t
  misc_feature (53)..(53): n is either a, c, g or t
  misc_feature (64)..(65): n is either a, c, g or t
ttggttaaancgtggntaggtaanataaagtnannattgggaattnngcgagntttgggggttnnagcggtttgggtcgggggtttttttcgtaggcgtttaggagtcgttcggttcgtggttcggtcggggagtaggcgtttcgcgggagcgttgaggtttcgttgtgcgaacgggcgggggcggaggaggcggaagcgggggcggtcggagcgcgggggatgttaaggaaattatattatttttttttgtggtttggtgataaattaacgatattttgtttttttgtgaggtttcgggcgtttgcgaggcggaggtagcgtttcggtttttaaagggatatatatagggttttttttttaacggttttttgcggtttttttttaaaaaaatatagtttttttaaggcgttattttcgggggcgcgcggtcggaatgcgggggttgtggtcggagtcgtcgttaggttacgatttggatcgcgttttttattattttttatttcgttcgacgggaggagacggtcgcggcggcggcgtattaatttg

SEQ ID NO: 16080 - DNA, 548 bp, Artificial Sequence
  chemically treated genomic DNA (Homo sapiens) CpG-island No: 16080
  misc_feature (484)..(485): n is either a, c, g or t
  misc_feature (496)..(496): n is either a, c, g or t
  misc_feature (502)..(503): n is either a, c, g or t
  misc_feature (514)..(515): n is either a, c, g or t
  misc_feature (517)..(517): n is either a, c, g or t
  misc_feature (525)..(525): n is either a, c, g or t
  misc_feature (533)..(533): n is either a, c, g or t
  misc_feature (539)..(539): n is either a, c, g or t
caaattaatacgccgccgccgcgaccgtctcctcccgtcgaacgaaataaaaaataataaaaaacgcgatccaaatcgtaacctaacgacgactccgaccacaacccccgcattccgaccgcgcgcccccgaaaataacgccttaaaaaaactatatttttttaaaaaaaaaccgcaaaaaaccgttaaaaaaaaaaccctatatatatccctttaaaaaccgaaacgctacctccgcctcgcaaacgcccgaaacctcacaaaaaaacaaaatatcgttaatttatcaccaaaccacaaaaaaaaataatataatttccttaacatcccccgcgctccgaccgcccccgcttccgcctcctccgcccccgcccgttcgcacaacgaaacctcaacgctcccgcgaaacgcctactccccgaccgaaccacgaaccgaacgactcctaaacgcctacgaaaaaaacccccgacccaaaccgctnnaacccccaaanctcgcnnaattcccaatnntnactttatnttacctanccacgntttaaccaa

SEQ ID NO: 16081 - DNA, 660 bp, Artificial Sequence
  chemically treated genomic DNA (Homo sapiens) CpG-island No: 16081
atattcgacgtataatagaattaagttttggatgaatttcggttattcgtggtaggtttgttcgtgttgtttataaaagcggtatttttttatcggattaatttattcgtaataacgatagtcgagaaacgtaataggggttttcggaggaatattcgttatcgtttttttattaggggattatatgtttttatggattataataattgaggatatttttacgaattatttacgttgggttattttatatcgcggagaatattgtttgcgtcgttaaatttttttatttttggttttcgtttttgattttatattattattttatagtattgatattttaggtttatttatgcgtatatagtaaattcgttggcgcgtaatggtttttatattattatattcgtaaaataagggttcgacgttatgttattagtgttatagatattatcgggaaaatcgatatttttatttttttatatttaagtcgtcgtaattacgcgtattatttggtattaagtaatatttttagatatagatatattataacgtattacgaagtttgattatattatttgataatgtataaatcggttattcgtcgatcgtcgaatttaattacgtcggataaatttagattatatatcgcgtagataaaacgtt

SEQ ID NO: 16082 - DNA, 660 bp, Artificial Sequence
  chemically treated genomic DNA (Homo sapiens) CpG-island No: 16082
aacgttttatctacgcgatatataatctaaatttatccgacgtaattaaattcgacgatcgacgaataaccgatttatacattatcaaataatataatcaaacttcgtaatacgttataatatatctatatctaaaaatattacttaataccaaataatacgcgtaattacgacgacttaaatataaaaaaataaaaatatcgattttcccgataatatctataacactaataacataacgtcgaacccttattttacgaatataataatataaaaaccattacgcgccaacgaatttactatatacgcataaataaacctaaaatatcaatactataaaataataatataaaatcaaaaacgaaaaccaaaaataaaaaaatttaacgacgcaaacaatattctccgcgatataaaataacccaacgtaaataattcgtaaaaatatcctcaattattataatccataaaaacatataatcccctaataaaaaaacgataacgaatattcctccgaaaacccctattacgtttctcgactatcgttattacgaataaattaatccgataaaaaaataccgcttttataaacaacacgaacaaacctaccacgaataaccgaaattcatccaaaacttaattctattatacgtcgaatat

SEQ ID NO: 16083 - DNA, 660 bp, Artificial Sequence
  chemically treated genomic DNA (Homo sapiens) CpG-island No: 16083
ggcgttttgtttgcgcgatgtgtggtttgggtttgttcggcgtggttaggttcgacggtcgacgggtggtcggtttgtgtattgttaggtggtgtggttaggtttcgtggtgcgttgtaatatgtttgtgtttgggggtgttgtttggtattaggtggtgcgcgtgattgcggcggtttgggtatgggggggtaagggtgtcgattttttcggtaatgtttgtggtattagtggtatgacgtcgggtttttgttttgcgagtatggtggtgtagaggttattgcgcgttagcgggtttattgtgtgcgtatgggtgggtttggagtattaatattgtggaatggtaatgtgaggttagagacgggaattaagagtaggggggtttggcggcgtaagtaatgtttttcgcggtgtgaggtggtttagcgtggatggttcgtagaggtatttttagttattgtagtttatgggagtatgtaattttttagtgagaagacgatggcgggtattttttcgagggtttttgttgcgtttttcggttgtcgttgttgcgggtggattgattcggtggagaaatgtcgtttttgtgagtagtacgggtaggtttattacggatgatcggggtttatttaggatttggttttgttatacgtcggatgt

SEQ ID NO: 16084 - DNA, 660 bp, Artificial Sequence
  chemically treated genomic DNA (Homo sapiens) CpG-island No: 16084
acatccgacgtataacaaaaccaaatcctaaataaaccccgatcatccgtaataaacctacccgtactactcacaaaaacgacatttctccaccgaatcaatccacccgcaacaacgacaaccgaaaaacgcaacaaaaaccctcgaaaaaatacccgccatcgtcttctcactaaaaaattacatactcccataaactacaataactaaaaatacctctacgaaccatccacgctaaaccacctcacaccgcgaaaaacattacttacgccgccaaacccccctactcttaattcccgtctctaacctcacattaccattccacaatattaatactccaaacccacccatacgcacacaataaacccgctaacgcgcaataacctctacaccaccatactcgcaaaacaaaaacccgacgtcataccactaataccacaaacattaccgaaaaaatcgacacccttacccccccatacccaaaccgccgcaatcacgcgcaccacctaataccaaacaacacccccaaacacaaacatattacaacgcaccacgaaacctaaccacaccacctaacaatacacaaaccgaccacccgtcgaccgtcgaacctaaccacgccgaacaaacccaaaccacacatcgcgcaaacaaaacgcc

SEQ ID NO: 16085 - DNA, 501 bp, Artificial Sequence
  chemically treated genomic DNA (Homo sapiens) CpG-island No: 16085
  misc_feature (41)..(41): n is either a, c, g or t
  misc_feature (147)..(147): n is either a, c, g or t
  misc_feature (463)..(463): n is either a, c, g or t
atcgcgggaggcgatttattatttacgagggcgaagttagntggggaagtcgtcgttttacgatattaatcgtggatgtattcgaatcgagtttacgtttaaaggatatacgatatgataggcgatatcgatataatcgtatcgtangtatttatattacgcgtagtgagggaataagatcgcgagcgaatagtagaatattacgggagttagcgatagataggttttatataggttatagttagcgatagtttattaataacggtggtaatataagatacgcgtattggcgaggtattatattaaacgtacgattatacgtatattagttaatattatatatcgaagatataggcgatcgaatagttacggcgaagtatattcgcgtagtagcggatataatcgttttaacgtatcgtagagtagttatttattacggcgggcgtattattattataggtgnggggttattcgcgggggaataaaattatgacgttttag

SEQ ID NO: 16086 - DNA, 501 bp, Artificial Sequence
  chemically treated genomic DNA (Homo sapiens) CpG-island No: 16086
  misc_feature (39)..(39): n is either a, c, g or t
  misc_feature (355)..(355): n is either a, c, g or t
  misc_feature (461)..(461): n is either a, c, g or t
ctaaaacgtcataattttattcccccgcgaataaccccncacctataataataatacgcccgccgtaataaataactactctacgatacgttaaaacgattatatccgctactacgcgaatatacttcgccgtaactattcgatcgcctatatcttcgatatataatattaactaatatacgtataatcgtacgtttaatataatacctcgccaatacgcgtatcttatattaccaccgttattaataaactatcgctaactataacctatataaaacctatctatcgctaactcccgtaatattctactattcgctcgcgatcttattccctcactacgcgtaatataaatacntacgatacgattatatcgatatcgcctatcatatcgtatatcctttaaacgtaaactcgattcgaatacatccacgattaatatcgtaaaacgacgacttccccanctaacttcgccctcgtaaataataaatcgcctcccgcgat

SEQ ID NO: 16087 - DNA, 501 bp, Artificial Sequence
  chemically treated genomic DNA (Homo sapiens) CpG-island No: 16087
  misc_feature (39)..(39): n is either a, c, g or t
  misc_feature (355)..(355): n is either a, c, g or t
  misc_feature (461)..(461): n is either a, c, g or t
ttggggcgttatgattttgttttttcgcgggtgattttntatttgtggtggtggtgcgttcgtcgtgatgggtggttgttttgcggtgcgttgaggcggttgtgttcgttgttgcgcgagtgtgtttcgtcgtagttgttcggtcgtttgtgttttcgatgtgtggtgttgattagtgtgcgtgtagtcgtgcgtttagtgtggtatttcgttagtgcgcgtgttttgtgttgttatcgttgttagtagattgtcgttggttgtggtttgtgtggggtttgtttatcgttggttttcgtggtgttttgttattcgttcgcggttttgtttttttattgcgcgtggtgtgagtatntacgatgcggttgtgtcggtgtcgtttattatgtcgtgtgttttttgggcgtgggttcgattcgggtgtatttacgattggtatcgtggagcggcggtttttttanttggtttcgttttcgtgggtagtggatcgtttttcgcggt

SEQ ID NO: 16088 - DNA, 501 bp, Artificial Sequence
  chemically treated genomic DNA (Homo sapiens) CpG-island No: 16088
  misc_feature (41)..(41): n is either a, c, g or t
  misc_feature (147)..(147): n is either a, c, g or t
  misc_feature (463)..(463): n is either a, c, g or t
accgcgaaaaacgatccactacccacgaaaacgaaaccaantaaaaaaaccgccgctccacgataccaatcgtaaatacacccgaatcgaacccacgcccaaaaaacacacgacataataaacgacaccgacacaaccgcatcgtanatactcacaccacgcgcaataaaaaaacaaaaccgcgaacgaataacaaaacaccacgaaaaccaacgataaacaaaccccacacaaaccacaaccaacgacaatctactaacaacgataacaacacaaaacacgcgcactaacgaaataccacactaaacgcacgactacacgcacactaatcaacaccacacatcgaaaacacaaacgaccgaacaactacgacgaaacacactcgcgcaacaacgaacacaaccgcctcaacgcaccgcaaaacaaccacccatcacgacgaacgcaccaccaccacaaatanaaaatcacccgcgaaaaaacaaaatcataacgccccaa

SEQ ID NO: 16089 - DNA, 664 bp, Artificial Sequence
  chemically treated genomic DNA (Homo sapiens) CpG-island No: 16089
  misc_feature (385)..(385): n is either a, c, g or t
  misc_feature (414)..(415): n is either a, c, g or t
  misc_feature (448)..(448): n is either a, c, g or t
  misc_feature (453)..(453): n is either a, c, g or t
  misc_feature (456)..(456): n is either a, c, g or t
  misc_feature (509)..(510): n is either a, c, g or t
  misc_feature (522)..(522): n is either a, c, g or t
  misc_feature (531)..(531): n is either a, c, g or t
  misc_feature (533)..(533): n is either a, c, g or t
  misc_feature (538)..(538): n is either a, c, g or t
  misc_feature (541)..(541): n is either a, c, g or t
  misc_feature (543)..(543): n is either a, c, g or t
  misc_feature (545)..(546): n is either a, c, g or t
  misc_feature (592)..(593): n is either a, c, g or t
  misc_feature (604)..(604): n is either a, c, g or t
  misc_feature (609)..(609): n is either a, c, g or t
  misc_feature (611)..(611): n is either a, c, g or t
  misc_feature (613)..(614): n is either a, c, g or t
  misc_feature (617)..(617): n is either a, c, g or t
  misc_feature (619)..(619): n is either a, c, g or t
  misc_feature (621)..(621): n is either a, c, g or t
  misc_feature (625)..(625): n is either a, c, g or t
  misc_feature (627)..(627): n is either a, c, g or t
  misc_feature (629)..(629): n is either a, c, g or t
  misc_feature (631)..(631): n is either a, c, g or t
  misc_feature (633)..(633): n is either a, c, g or t
  misc_feature (635)..(635): n is either a, c, g or t
  misc_feature (639)..(640): n is either a, c, g or t
  misc_feature (642)..(642): n is either a, c, g or t
  misc_feature (648)..(648): n is either a, c, g or t
  misc_feature (650)..(650): n is either a, c, g or t
  misc_feature (652)..(652): n is either a, c, g or t
  misc_feature (654)..(655): n is either a, c, g or t
  misc_feature (659)..(659): n is either a, c, g or t
ggtgaggacggttatcgtcgttgcgagtttttgtggttggtgcgcggcggtgtggcgaaattggattaaggttatcggttggtcgtattttggtaggcgttgtcggaagaatttcggttaatttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtangaagaagttcggtagtaggttattttcgnngcgggacggtaatcgttcgttttttttgatatntttgnttncgggtatatacgcgaatatggtcgggataacggtatcgcgtcgtggtcgtggnntcggtgataggntatagaatngnttatngantntnncggaattattcgtgagattttatttgtcgcgtcgttgtgtgcggtnntaattgcggtnttggnantnngtntntntcgntngngntngnatanntnttgggntngngnntggntcgta

SEQ ID NO: 16090 - DNA, 664 bp, Artificial Sequence
  chemically treated genomic DNA (Homo sapiens) CpG-island No: 16090
  misc_feature (6)..(6): n is either a, c, g or t
  misc_feature (10)..(11): n is either a, c, g or t
  misc_feature (13)..(13): n is either a, c, g or t
  misc_feature (15)..(15): n is either a, c, g or t
  misc_feature (17)..(17): n is either a, c, g or t
  misc_feature (23)..(23): n is either a, c, g or t
  misc_feature (25)..(26): n is either a, c, g or t
  misc_feature (30)..(30): n is either a, c, g or t
  misc_feature (32)..(32): n is either a, c, g or t
  misc_feature (34)..(34): n is either a, c, g or t
  misc_feature (36)..(36): n is either a, c, g or t
  misc_feature (38)..(38): n is either a, c, g or t
  misc_feature (40)..(40): n is either a, c, g or t
  misc_feature (44)..(44): n is either a, c, g or t
  misc_feature (46)..(46): n is either a, c, g or t
  misc_feature (48)..(48): n is either a, c, g or t
  misc_feature (51)..(52): n is either a, c, g or t
  misc_feature (54)..(54): n is either a, c, g or t
  misc_feature (56)..(56): n is either a, c, g or t
  misc_feature (61)..(61): n is either a, c, g or t
  misc_feature (72)..(73): n is either a, c, g or t
  misc_feature (119)..(120): n is either a, c, g or t
  misc_feature (122)..(122): n is either a, c, g or t
  misc_feature (124)..(124): n is either a, c, g or t
  misc_feature (127)..(127): n is either a, c, g or t
  misc_feature (132)..(132): n is either a, c, g or t
  misc_feature (134)..(134): n is either a, c, g or t
  misc_feature (143)..(143): n is either a, c, g or t
  misc_feature (155)..(156): n is either a, c, g or t
  misc_feature (209)..(209): n is either a, c, g or t
  misc_feature (212)..(212): n is either a, c, g or t
  misc_feature (217)..(217): n is either a, c, g or t
  misc_feature (250)..(251): n is either a, c, g or t
  misc_feature (280)..(280): n is either a, c, g or t
tacganccanncncnancccaananntatncnancncnancganananacnnantnccaanaccgcaattannaccgcacacaacgacgcgacaaataaaatctcacgaataattccgnnanantcnataancnattctatancctatcaccgannccacgaccacgacgcgataccgttatcccgaccatattcgcgtatatacccgnaancaaanatatcaaaaaaaacgaacgattaccgtcccgcnncgaaaataacctactaccgaacttcttcntacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaaattaaccgaaattcttccgacaacgcctaccaaaatacgaccaaccgataaccttaatccaatttcgccacaccgccgcgcaccaaccacaaaaactcgcaacgacgataaccgtcctcacc

SEQ ID NO: 16091 - DNA, 664 bp, Artificial Sequence
  chemically treated genomic DNA (Homo sapiens) CpG-island No: 16091
  misc_feature (6)..(6): n is either a, c, g or t
  misc_feature (10)..(11): n is either a, c, g or t
  misc_feature (13)..(13): n is either a, c, g or t
  misc_feature (15)..(15): n is either a, c, g or t
  misc_feature (17)..(17): n is either a, c, g or t
  misc_feature (23)..(23): n is either a, c, g or t
  misc_feature (25)..(26): n is either a, c, g or t
  misc_feature (30)..(30): n is either a, c, g or t
  misc_feature (32)..(32): n is either a, c, g or t
  misc_feature (34)..(34): n is either a, c, g or t
  misc_feature (36)..(36): n is either a, c, g or t
  misc_feature (38)..(38): n is either a, c, g or t
  misc_feature (40)..(40): n is either a, c, g or t
  misc_feature (44)..(44): n is either a, c, g or t
  misc_feature (46)..(46): n is either a, c, g or t
  misc_feature (48)..(48): n is either a, c, g or t
  misc_feature (51)..(52): n is either a, c, g or t
  misc_feature (54)..(54): n is either a, c, g or t
  misc_feature (56)..(56): n is either a, c, g or t
  misc_feature (61)..(61): n is either a, c, g or t
  misc_feature (72)..(73): n is either a, c, g or t
  misc_feature (119)..(120): n is either a, c, g or t
  misc_feature (122)..(122): n is either a, c, g or t
  misc_feature (124)..(124): n is either a, c, g or t
  misc_feature (127)..(127): n is either a, c, g or t
  misc_feature (132)..(132): n is either a, c, g or t
  misc_feature (134)..(134): n is either a, c, g or t
  misc_feature (143)..(143): n is either a, c, g or t
  misc_feature (155)..(156): n is either a, c, g or t
  misc_feature (209)..(209): n is either a, c, g or t
  misc_feature (212)..(212): n is either a, c, g or t
  misc_feature (217)..(217): n is either a, c, g or t
  misc_feature (250)..(251): n is either a, c, g or t
  misc_feature (280)..(280): n is either a, c, g or t
tacganttanntntngntttaangnntatntngntntngncggngngngtnngntnttaangtcgtaattanngtcgtatatagcggcgcggtaggtaaagttttacgggtagtttcgnngngnttngtggntngttttatgntttattatcggnnttacgattacgacgcgatgtcgttgtttcggttatattcgcgtgtatattcgnagntaggngtattaggaaaagcggacggttatcgtttcgtnncggaaatggtttgttgtcgggtttttttntgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggagttaatcggagttttttcgatagcgtttgttagagtgcggttagtcggtgattttgatttagtttcgttatatcgtcgcgtattagttatagagattcgtagcggcggtaatcgtttttatt

SEQ ID NO: 16092 - DNA, 664 bp, Artificial Sequence
  chemically treated genomic DNA (Homo sapiens) CpG-island No: 16092
  misc_feature (385)..(385): n is either a, c, g or t
  misc_feature (414)..(415): n is either a, c, g or t
  misc_feature (448)..(448): n is either a, c, g or t
  misc_feature (453)..(453): n is either a, c, g or t
  misc_feature (456)..(456): n is either a, c, g or t
  misc_feature (509)..(510): n is either a, c, g or t
  misc_feature (522)..(522): n is either a, c, g or t
  misc_feature (531)..(531): n is either a, c, g or t
  misc_feature (533)..(533): n is either a, c, g or t
  misc_feature (538)..(538): n is either a, c, g or t
  misc_feature (541)..(541): n is either a, c, g or t
  misc_feature (543)..(543): n is either a, c, g or t
  misc_feature (545)..(546): n is either a, c, g or t
  misc_feature (592)..(593): n is either a, c, g or t
  misc_feature (604)..(604): n is either a, c, g or t
  misc_feature (609)..(609): n is either a, c, g or t
  misc_feature (611)..(611): n is either a, c, g or t
  misc_feature (613)..(614): n is either a, c, g or t
  misc_feature (617)..(617): n is either a, c, g or t
  misc_feature (619)..(619): n is either a, c, g or t
  misc_feature (621)..(621): n is either a, c, g or t
  misc_feature (625)..(625): n is either a, c, g or t
  misc_feature (627)..(627): n is either a, c, g or t
  misc_feature (629)..(629): n is either a, c, g or t
  misc_feature (631)..(631): n is either a, c, g or t
  misc_feature (633)..(633): n is either a, c, g or t
  misc_feature (635)..(635): n is either a, c, g or t
  misc_feature (639)..(640): n is either a, c, g or t
  misc_feature (642)..(642): n is either a, c, g or t
  misc_feature (648)..(648): n is either a, c, g or t
  misc_feature (650)..(650): n is either a, c, g or t
  misc_feature (652)..(652): n is either a, c, g or t
  misc_feature (654)..(655): n is either a, c, g or t
  misc_feature (659)..(659): n is either a, c, g or t
aataaaaacgattaccgccgctacgaatctctataactaatacgcgacgatataacgaaactaaatcaaaatcaccgactaaccgcactctaacaaacgctatcgaaaaaactccgattaactccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacanaaaaaaacccgacaacaaaccatttccgnnacgaaacgataaccgtccgcttttcctaatacncctanctncgaatatacacgcgaatataaccgaaacaacgacatcgcgtcgtaatcgtaannccgataataaancataaaacnanccacnaancncnncgaaactacccgtaaaactttacctaccgcgccgctatatacgacnntaattacgacnttaanancnnacncncnccgncnanancnanatanncnttaaancnananntaantcgta

SEQ ID NO: 16093 - DNA, 741 bp, Artificial Sequence
  chemically treated genomic DNA (Homo sapiens) CpG-island No: 16093
gcgattcggttcgttttaaataacgtttcgggtaggagaaggtttttcgggtggttcgtagtcgggttggaggggtggggtttacgttgggaaaaggtttcgggcgggtcgtattaacgcgcgtagggggaagaggttttcgaggttaggacggtgtcgttgtttacgcgtttagtggcgaggtggagaaattttttatttattttcggttatttgttcgagagttatggtattaggagttttcgcgttttatagtcgatttttaaagatttttttttcggtttttttgtcgagtgggagttttcggaaatgggggtcgggcggtatcgggtaggcggtggggagaagagtgttttgttatttattaattttattacgttttatatagatttattcgtttatttgtcgtcgtcgtagtttttattagttttttgggcggttttttttgggtttttttaaatagttttatgacgaattgaattcgttttgtttttttcggtttttagtttttcgcgtttaggtaggttacgggtagtcgtttgggcggggttcgcggaaaaggaggtagttttaatttttagagtagggagcggcggtattaggggatgttgcgtatgcgttatacgtttgcgtagaatcgagtgagtgggagattagttaaaaaggttgacgttatcgtatatgttttggttatgtttgtgtgggggagattacggattcggtgtttttcgtaaggtgtag

SEQ ID NO: 16094 - DNA, 741 bp, Artificial Sequence
  chemically treated genomic DNA (Homo sapiens) CpG-island No: 16094
ctacaccttacgaaaaacaccgaatccgtaatctcccccacacaaacataaccaaaacatatacgataacgtcaacctttttaactaatctcccactcactcgattctacgcaaacgtataacgcatacgcaacatcccctaataccgccgctccctactctaaaaattaaaactacctccttttccgcgaaccccgcccaaacgactacccgtaacctacctaaacgcgaaaaactaaaaaccgaaaaaaacaaaacgaattcaattcgtcataaaactatttaaaaaaacccaaaaaaaaccgcccaaaaaactaataaaaactacgacgacgacaaataaacgaataaatctatataaaacgtaataaaattaataaataacaaaacactcttctccccaccgcctacccgataccgcccgacccccatttccgaaaactcccactcgacaaaaaaaccgaaaaaaaaatctttaaaaatcgactataaaacgcgaaaactcctaataccataactctcgaacaaataaccgaaaataaataaaaaatttctccacctcgccactaaacgcgtaaacaacgacaccgtcctaacctcgaaaacctcttccccctacgcgcgttaatacgacccgcccgaaaccttttcccaacgtaaaccccacccctccaacccgactacgaaccacccgaaaaaccttctcctacccgaaacgttatttaaaacgaaccgaatcgc

SEQ ID NO: 16095 - DNA, 741 bp, Artificial Sequence
  chemically treated genomic DNA (Homo sapiens) CpG-island No: 16095
ttatattttacgaaaagtatcgaattcgtggttttttttatatagatatgattagaatatgtgcgatgacgttagtttttttgattagttttttatttattcgattttgcgtaggcgtatggcgtatgcgtaatattttttagtgtcgtcgttttttattttgggggttgggattattttttttttcgcgggtttcgtttaggcggttgttcgtgatttgtttgggcgcggggaattgaaagtcggaaggggtaagacgggtttagttcgttatggggttgtttggaaagatttaggagaagtcgtttaaagaattggtaagggttacggcggcggtagataagcgggtggatttgtgtggggcgtagtgaagttggtaaatgataggatatttttttttttatcgtttgttcgatatcgttcggtttttattttcggggatttttattcgataggggggtcggaggaagagtttttaggagtcggttgtgggacgcgagagtttttggtgttatggttttcgaataggtagtcgagggtggatgaagagtttttttatttcgttattgagcgcgtaggtagcgatatcgttttggtttcggaaattttttttttttgcgcgcgttggtacgattcgttcggaatttttttttagcgtaggttttatttttttagttcggttgcggattattcggagaatttttttttgttcgaagcgttgtttggagcgggtcgggtcgt

SEQ ID NO: 16096 - DNA, 741 bp, Artificial Sequence
  chemically treated genomic DNA (Homo sapiens) CpG-island No: 16096
acgacccgacccgctccaaacaacgcttcgaacaaaaaaaaattctccgaataatccgcaaccgaactaaaaaaataaaacctacgctaaaaaaaaattccgaacgaatcgtaccaacgcgcgcaaaaaaaaaaaatttccgaaaccaaaacgatatcgctacctacgcgctcaataacgaaataaaaaaactcttcatccaccctcgactacctattcgaaaaccataacaccaaaaactctcgcgtcccacaaccgactcctaaaaactcttcctccgacccccctatcgaataaaaatccccgaaaataaaaaccgaacgatatcgaacaaacgataaaaaaaaaaatatcctatcatttaccaacttcactacgccccacacaaatccacccgcttatctaccgccgccgtaacccttaccaattctttaaacgacttctcctaaatctttccaaacaaccccataacgaactaaacccgtcttaccccttccgactttcaattccccgcgcccaaacaaatcacgaacaaccgcctaaacgaaacccgcgaaaaaaaaaataatcccaacccccaaaataaaaaacgacgacactaaaaaatattacgcatacgccatacgcctacgcaaaatcgaataaataaaaaactaatcaaaaaaactaacgtcatcgcacatattctaatcatatctatataaaaaaaaccacgaattcgatacttttcgtaaaatataa

SEQ ID NO: 16097 - DNA, 975 bp, Artificial Sequence
  chemically treated genomic DNA (Homo sapiens) CpG-island No: 16097
ggataagcgggtagggagtaggaggtgaggagaagcgggtagggagtaggaggtgaggataagcgggtagggagtaggagtgtgaggataagcgggtagggattaggaggtgaggataagcgggtagggagtaggaggtgaggataagcgggtagggagtaggaggtgaggataagcgggtagggagtaggaggtgaggaaaagcgggtagggagtaggaggtgaggataagcgggtagggagtaggaggtgaggataagcgggtagggagtaggaggtgaggaaaagcgggtagggagtaggaggtgaggaaaagcgggtagggagtaggaggtgaggataagcgggtagggagtaggacgtgaggataagcgggtagggagtaggaggtgaggagaagcgggtagggagtaggaggtgaggagaagcgggtagggagtaggaggtgaggataagcgggtagggagtaggaggtgaggagaagcgggtagggagtaggaggtgaggagaagcgggtagggagtaggaggtgaggataagcgggtagggagtaggaggtgaggagaagcgggtagggagtaggaggtgaggagaagcgggtagggagtaggaggtgaggataagcgggtagggagtaggaggtgaggaaaagcgggtagggagtaggaggtgaggagaagcgggtagggagtaggaggtgaggataagcgggtagggagtaggaggtgaggagaggtgggtagggagtaggaggtgaggagaagcgggtagggagtaggaggtgaggataagcgggtagggagtaggaggtgaggagaagcgggtagggagtaggaggtgaggagaggtgggtagggagtaggaggtgaggatagcgagtagggagtaggaggtgaggaaaagtgggttggggagtaggaggtgaaataggaggtaggagagtgaaggatagtaagaaatagaggatgttgacgt

SEQ ID NO: 16098 - DNA, 975 bp, Artificial Sequence
  chemically treated genomic DNA (Homo sapiens) CpG-island No: 16098
acgtcaacatcctctatttcttactatccttcactctcctacctcctatttcacctcctactccccaacccacttttcctcacctcctactccctactcgctatcctcacctcctactccctacccacctctcctcacctcctactccctacccgcttctcctcacctcctactccctacccgcttatcctcacctcctactccctacccgcttctcctcacctcctactccctacccacctctcctcacctcctactccctacccgcttatcctcacctcctactccctacccgcttctcctcacctcctactccctacccgcttttcctcacctcctactccctacccgcttatcctcacctcctactccctacccgcttctcctcacctcctactccctacccgcttctcctcacctcctactccctacccgcttatcctcacctcctactccctacccgcttctcctcacctcctactccctacccgcttctcctcacctcctactccctacccgcttatcctcacctcctactccctacccgcttctcctcacctcctactccctacccgcttctcctcacctcctactccctacccgcttatcctcacgtcctactccctacccgcttatcctcacctcctactccctacccgcttttcctcacctcctactccctacccgcttttcctcacctcctactccctacccgcttatcctcacctcctactccctacccgcttatcctcacctcctactccctacccgcttttcctcacctcctactccctacccgcttatcctcacctcctactccctacccgcttatcctcacctcctactccctacccgcttatcctcacctcctaatccctacccgcttatcctcacactcctactccctacccgcttatcctcacctcctactccctacccgcttctcctcacctcctactccctacccgcttatcc

SEQ ID NO: 16099 - DNA, 975 bp, Artificial Sequence
  chemically treated genomic DNA (Homo sapiens) CpG-island No: 16099
acgttagtattttttattttttattgttttttatttttttattttttattttattttttattttttaatttatttttttttattttttattttttattcgttgtttttattttttattttttatttatttttttttattttttattttttattcgtttttttttattttttattttttattcgtttgtttttattttttattttttattcgtttttttttattttttattttttatttatttttttttattttttattttttattcgtttgtttttattttttattttttattcgtttttttttattttttattttttattcgtttttttttattttttattttttattcgtttgtttttattttttattttttattcgtttttttttattttttattttttattcgtttttttttattttttattttttattcgtttgtttttattttttattttttattcgtttttttttattttttattttttattcgtttttttttattttttattttttattcgtttgtttttattttttattttttattcgtttttttttattttttattttttattcgtttttttttattttttattttttattcgtttgtttttacgttttattttttattcgtttgtttttattttttattttttattcgtttttttttattttttattttttattcgtttttttttattttttattttttattcgtttgtttttattttttattttttattcgtttgtttttattttttattttttattcgtttttttttattttttattttttattcgtttgtttttattttttattttttattcgtttgtttttattttttattttttattcgtttgtttttattttttagtttttattcgtttgtttttatatttttattttttattcgtttgtttttattttttattttttattcgtttttttttattttttattttttattcgtttgttt

SEQ ID NO: 16100 - DNA, 975 bp, Artificial Sequence
  chemically treated genomic DNA (Homo sapiens) CpG-island No: 16100
aaacaaacgaataaaaaataaaaaataaaaaaaaacgaataaaaaataaaaaataaaaacaaacgaataaaaaataaaaatataaaaacaaacgaataaaaactaaaaaataaaaacaaacgaataaaaaataaaaaataaaaacaaacgaataaaaaataaaaaataaaaacaaacgaataaaaaataaaaaataaaaaaaaacgaataaaaaataaaaaataaaaacaaacgaataaaaaataaaaaataaaaacaaacgaataaaaaataaaaaataaaaaaaaacgaataaaaaataaaaaataaaaaaaaacgaataaaaaataaaaaataaaaacaaacgaataaaaaataaaacgtaaaaacaaacgaataaaaaataaaaaataaaaaaaaacgaataaaaaataaaaaataaaaaaaaacgaataaaaaataaaaaataaaaacaaacgaataaaaaataaaaaataaaaaaaaacgaataaaaaataaaaaataaaaaaaaacgaataaaaaataaaaaataaaaacaaacgaataaaaaataaaaaataaaaaaaaacgaataaaaaataaaaaataaaaaaaaacgaataaaaaataaaaaataaaaacaaacgaataaaaaataaaaaataaaaaaaaacgaataaaaaataaaaaataaaaaaaaacgaataaaaaataaaaaataaaaacaaacgaataaaaaataaaaaataaaaaaaaataaataaaaaataaaaaataaaaaaaaacgaataaaaaataaaaaataaaaacaaacgaataaaaaataaaaaataaaaaaaaacgaataaaaaataaaaaataaaaaaaaataaataaaaaataaaaaataaaaacaacgaataaaaaataaaaaataaaaaaaaataaattaaaaaataaaaaataaaataaaaaataaaaaaataaaaaacaataaaaaataaaaaatactaacgt

SEQ ID NO: 16101 - DNA, 561 bp, Artificial Sequence
  chemically treated genomic DNA (Homo sapiens) CpG-island No: 16101
tgattagtattttggtttgtttttttcgaaaataggattcgatgatgttttttaattgttacggtgtttcgtatttatttacgaaagtttattagattttgagttatagtttgagggtttttgacggattattcgggaaggttatttgtcgtatgaattcggtattggcgttgcggacgggtagttcggggggaacgagttttttgttttgtaaggtgcgttcgtttattttcgtttagtgtatttatttgcgagtgtatagtgtttgcgtttcgtaattcgttgggtgtttggcggtttggatatcggattgcggttgggacggttttggtgtgcgttcgtgggtgtaattttgggggtttcgttaggatataaatatgattagacgggaaacgtttttatagttaagtgcgacgtaaaaagagtagtacgattggggggcggtgttataggtttttcgtttgtttcgcggttaaaaatcggaattaggttaaaagtaggttaaaagtattttagaataaattagcgaatattttagtaatagaggtatttcgataattt

SEQ ID NO: 16102 - DNA, 561 bp, Artificial Sequence
  chemically treated genomic DNA (Homo sapiens) CpG-island No: 16102
aaattatcgaaatacctctattactaaaatattcgctaatttattctaaaatacttttaacctacttttaacctaattccgatttttaaccgcgaaacaaacgaaaaacctataacaccgccccccaatcgtactactctttttacgtcgcacttaactataaaaacgtttcccgtctaatcatatttatatcctaacgaaacccccaaaattacacccacgaacgcacaccaaaaccgtcccaaccgcaatccgatatccaaaccgccaaacacccaacgaattacgaaacgcaaacactatacactcgcaaataaatacactaaacgaaaataaacgaacgcaccttacaaaacaaaaaactcgttccccccgaactacccgtccgcaacgccaataccgaattcatacgacaaataaccttcccgaataatccgtcaaaaaccctcaaactataactcaaaatctaataaactttcgtaaataaatacgaaacaccgtaacaattaaaaaacatcatcgaatcctattttcgaaaaaaacaaaccaaaatactaatca

SEQ ID NO: 16103 - DNA, 561 bp, Artificial Sequence
  chemically treated genomic DNA (Homo sapiens) CpG-island No: 16103
ggattatcggaatatttttgttattggggtattcgttggtttgttttagagtgtttttggtttgtttttggtttggtttcgatttttggtcgcgaagtaggcgaaaaatttatggtatcgttttttagtcgtgttattttttttacgtcgtatttgattgtggaggcgtttttcgtttggttatatttgtattttggcgaaatttttagggttgtatttacgagcgtatattagaatcgttttagtcgtaattcggtatttagatcgttaaatatttaacgggttgcgaggcgtaaatattatgtattcgtagatggatatattgaacggagatggacgaacgtattttgtagggtagagagttcgtttttttcgaattgttcgttcgtagcgttaatatcggatttatacgataagtgattttttcggatagttcgttaaaaatttttaggttgtggtttaggatttggtaagttttcgtggatagatgcggggtatcgtgatagttgaggagtattatcggattttgttttcggaaaggataggttagaatgttgatta

SEQ ID NO: 16104 - DNA, 561 bp, Artificial Sequence
  chemically treated genomic DNA (Homo sapiens) CpG-island No: 16104
taatcaacattctaacctatcctttccgaaaacaaaatccgataatactcctcaactatcacgataccccgcatctatccacgaaaacttaccaaatcctaaaccacaacctaaaaatttttaacgaactatccgaaaaaatcacttatcgtataaatccgatattaacgctacgaacgaacaattcgaaaaaaacgaactctctaccctacaaaatacgttcgtccatctccgttcaatatatccatctacgaatacataatatttacgcctcgcaacccgttaaatatttaacgatctaaataccgaattacgactaaaacgattctaatatacgctcgtaaatacaaccctaaaaatttcgccaaaatacaaatataaccaaacgaaaaacgcctccacaatcaaatacgacgtaaaaaaaataacacgactaaaaaacgataccataaatttttcgcctacttcgcgaccaaaaatcgaaaccaaaccaaaaacaaaccaaaaacactctaaaacaaaccaacgaataccccaataacaaaaatattccgataatcc

SEQ ID NO: 16105 - DNA, 871 bp, Artificial Sequence
  chemically treated genomic DNA (Homo sapiens) CpG-island No: 16105
gatggcgcgttttaaagagattttcgatattaatttcgttggtcgtcgcgcgcgcgtgtagttaggcgtgcgtaatttggcgattttttaggtcgttgtatcgtataatttttattacgtatcggatttttttttataaatcgtttgttttattggcggtaatgtggttgaaaatgtcggcggcgtttattgtttgaaatatggtttgatcgtatataatttgttgaaaattgaagtgtaaacgttggacggcgaggtattgacgtttggatcggacgcgttggatttatttggttttgatttgttggcgttgtttatcggatcggaaggtatgttcggcgtgattatcgaagtgacggtaaaattgttgtcgaagtcgttcgtggcgcgggttttgttagttagttttgattcggtagaaaaagtcggatttgcggttggtgatattatcgttaatggtattattttcggcgggttggagatgatggataatttgtcgattcgcgcggcggaagattttatttatgtcggttatttcgtcgacgtcgaagcgattttgttatgcgagttggacggcgtggagtttgacgtataggaagattgcgagcgggttaacgatattttgttgaaagcgggcgcgattgacgttcgtttggtataggacgaagtagagcgcgtacgtttttgggtcggtcgtaaaaatgcgttttcggcggtaggacgtattttttcggattattattgtatggatggtattatttcgcgtcgcgttttgtttggcgtattggaaggtattgttcgtttatcgtagtaatatgatttacgtgttgttaacgttttttatgtcggagatggtaatatgtattcgtta

SEQ ID NO: 16106 - DNA, 871 bp, Artificial Sequence
  chemically treated genomic DNA (Homo sapiens) CpG-island No: 16106
taacgaatacatattaccatctccgacataaaaaacgttaacaacacgtaaatcatattactacgataaacgaacaataccttccaatacgccaaacaaaacgcgacgcgaaataataccatccatacaataataatccgaaaaaatacgtcctaccgccgaaaacgcatttttacgaccgacccaaaaacgtacgcgctctacttcgtcctataccaaacgaacgtcaatcgcgcccgctttcaacaaaatatcgttaacccgctcgcaatcttcctatacgtcaaactccacgccgtccaactcgcataacaaaatcgcttcgacgtcgacgaaataaccgacataaataaaatcttccgccgcgcgaatcgacaaattatccatcatctccaacccgccgaaaataataccattaacgataatatcaccaaccgcaaatccgactttttctaccgaatcaaaactaactaacaaaacccgcgccacgaacgacttcgacaacaattttaccgtcacttcgataatcacgccgaacataccttccgatccgataaacaacgccaacaaatcaaaaccaaataaatccaacgcgtccgatccaaacgtcaatacctcgccgtccaacgtttacacttcaattttcaacaaattatatacgatcaaaccatatttcaaacaataaacgccgccgacattttcaaccacattaccgccaataaaacaaacgatttataaaaaaaaatccgatacgtaataaaaattatacgatacaacgacctaaaaaatcgccaaattacgcacgcctaactacacgcgcgcgcgacgaccaacgaaattaatatcgaaaatctctttaaaacgcgccatc

SEQ ID NO: 16107 - DNA, 871 bp, Artificial Sequence
  chemically treated genomic DNA (Homo sapiens) CpG-island No: 16107
taacgggtgtatgttgttattttcggtatgaaagacgttggtaatacgtaaattatattgttgcgataaacgggtaatgttttttagtacgttaggtagggcgcgacgcgggatggtgttatttatgtagtagtaattcggggagatacgttttatcgtcgggaacgtatttttgcgatcggtttagaaacgtacgcgttttgtttcgttttgtgttagacggacgttagtcgcgttcgtttttaataagatgtcgttaattcgttcgtagtttttttgtacgttagattttacgtcgtttagttcgtataataaaatcgtttcggcgtcgacgggataatcggtatgaataaaatttttcgtcgcgcggatcgataggttatttattatttttagttcgtcggggataatgttattggcgatgatgttattaatcgtaagttcggttttttttatcgagttaaagttggttaatagaattcgcgttacgggcggtttcggtagtagttttatcgttatttcggtggttacgtcgagtatatttttcgattcggtgaatagcgttagtaggttaaaattaggtgaatttagcgcgttcgatttaagcgttagtgtttcgtcgtttagcgtttgtattttaatttttagtaggttatgtacggttagattatattttaggtagtggacgtcgtcggtatttttagttatattgtcgttaatggaataggcgatttgtgaggaagggttcggtgcgtagtagagattatgcggtgtaacggtttgggagatcgttaggttacgtacgtttggttgtacgcgcgcgcggcgattaacggggttaatgtcgaggatttttttaaagcgcgttatt

SEQ ID NO: 16108 - DNA, 871 bp, Artificial Sequence
  chemically treated genomic DNA (Homo sapiens) CpG-island No: 16108
aataacgcgctttaaaaaaatcctcgacattaaccccgttaatcgccgcgcgcgcgtacaaccaaacgtacgtaacctaacgatctcccaaaccgttacaccgcataatctctactacgcaccgaacccttcctcacaaatcgcctattccattaacgacaatataactaaaaataccgacgacgtccactacctaaaatataatctaaccgtacataacctactaaaaattaaaatacaaacgctaaacgacgaaacactaacgcttaaatcgaacgcgctaaattcacctaattttaacctactaacgctattcaccgaatcgaaaaatatactcgacgtaaccaccgaaataacgataaaactactaccgaaaccgcccgtaacgcgaattctattaaccaactttaactcgataaaaaaaaccgaacttacgattaataacatcatcgccaataacattatccccgacgaactaaaaataataaataacctatcgatccgcgcgacgaaaaattttattcataccgattatcccgtcgacgccgaaacgattttattatacgaactaaacgacgtaaaatctaacgtacaaaaaaactacgaacgaattaacgacatcttattaaaaacgaacgcgactaacgtccgtctaacacaaaacgaaacaaaacgcgtacgtttctaaaccgatcgcaaaaatacgttcccgacgataaaacgtatctccccgaattactactacataaataacaccatcccgcgtcgcgccctacctaacgtactaaaaaacattacccgtttatcgcaacaatataatttacgtattaccaacgtctttcataccgaaaataacaacatacacccgtta

SEQ ID NO: 16109 - DNA, 512 bp, Artificial Sequence
  chemically treated genomic DNA (Homo sapiens) CpG-island No: 16109
tagtttaattagcgtggtcgcgataaacgttagttgttcgaacggatgattgaattgttttagattttagttgattgttattattacgattagcgtaattagcggtagatttttttttaggcgtgatgtttgcggtttttcggcggtttgtttatcgcgtagggaatagtttgttttttgtagcgtagatttaatttgtgtacgaatgttattgtcggtatcgattattagtttttcggtggcgaataatatttgtatttgatttacgtttgtaagttggcgtacggtattttttattttgcgcgtataggcggcgtagtttatgtcgttgattttttagttatagcgggtgtcggagacgtttttagagagagttggcgtgttggaatatgcgtcgtcgtagtaatagtcgttggcgttttgtatcgtggttagcggtttgaacgtagtaaattgaggggtttttttgtcgtgattgttaggagtcgatatggtatttttcggttaagttt

SEQ ID NO: 16110 - DNA, 512 bp, Artificial Sequence
  chemically treated genomic DNA (Homo sapiens) CpG-island No: 16110
aaacttaaccgaaaaataccatatcgactcctaacaatcacgacaaaaaaacccctcaatttactacgttcaaaccgctaaccacgatacaaaacgccaacgactattactacgacgacgcatattccaacacgccaactctctctaaaaacgtctccgacacccgctataactaaaaaatcaacgacataaactacgccgcctatacgcgcaaaataaaaaataccgtacgccaacttacaaacgtaaatcaaatacaaatattattcgccaccgaaaaactaataatcgataccgacaataacattcgtacacaaattaaatctacgctacaaaaaacaaactattccctacgcgataaacaaaccgccgaaaaaccgcaaacatcacgcctaaaaaaaaatctaccgctaattacgctaatcgtaataataacaatcaactaaaatctaaaacaattcaatcatccgttcgaacaactaacgtttatcgcgaccacgctaattaaacta

SEQ ID NO: 16111 - DNA, 512 bp, Artificial Sequence
  chemically treated genomic DNA (Homo sapiens) CpG-island No: 16111
aaatttaatcggaggatgttatgtcgatttttgataattacggtaagaaagttttttaatttgttgcgtttaaatcgttaattacggtatagaacgttaacgattgttgttgcgacggcgtatgttttagtacgttaattttttttgaaaacgttttcggtattcgttatagttggaaagttagcggtatggattgcgtcgtttgtgcgcgtaaggtagaaaatgtcgtgcgttagtttgtaggcgtgaattaggtgtaggtgttgttcgttatcgaaaaattggtggtcgatgtcgataatgatattcgtgtataagttgaatttgcgttgtaaaaagtaggttattttttgcgcgatgaataggtcgtcgaagaatcgtaagtattacgtttgaaagagaatttgtcgttgattacgttaatcgtgatgatggtaattagttggggtttggagtagtttaattattcgttcgggtaattggcgtttatcgcgattacgttggttgggttg

SEQ ID NO: 16112 - DNA, 512 bp, Artificial Sequence
  chemically treated genomic DNA (Homo sapiens) CpG-island No: 16112
caacccaaccaacgtaatcgcgataaacgccaattacccgaacgaataattaaactactccaaaccccaactaattaccatcatcacgattaacgtaatcaacgacaaattctctttcaaacgtaatacttacgattcttcgacgacctattcatcgcgcaaaaaataacctactttttacaacgcaaattcaacttatacacgaatatcattatcgacatcgaccaccaatttttcgataacgaacaacacctacacctaattcacgcctacaaactaacgcacgacattttctaccttacgcgcacaaacgacgcaatccataccgctaactttccaactataacgaataccgaaaacgttttcaaaaaaaattaacgtactaaaacatacgccgtcgcaacaacaatcgttaacgttctataccgtaattaacgatttaaacgcaacaaattaaaaaactttcttaccgtaattatcaaaaatcgacataacatcctccgattaaattt

SEQ ID NO: 16113 - DNA, 706 bp, Artificial Sequence
  chemically treated genomic DNA (Homo sapiens) CpG-island No: 16113
ttttaacgagaaatttcgcggcgtacgtttttatgttagcgaaaattagttgaaaattatcgttaataattcggaataggaagaagcggaagagattttcgacgttatttatagcggtgcggagatggaaatcggttttaacgttagttatgtgttggatgttttgaacgcgttgaaatgcgaaaacgttcgtatgatgttgatcgattcggtttttagcgtgtagattgaagatgcggttagttagagcgcggtttatgttgttatgttaatgagattgtaatgttttttattcgtttgttgattcgcgattttcgtaatattgaaatcgcggatttcgttttatttttcggttttaattttttggtaggtgttaacggtagtggtaaaattagcgtgttggaagttatttatacgttcggttatggtcgggcgtttcgtagtttgtagattggtcgcgttattcgttatgagtaggaggcgtttgttttttacgggcgattatagggcgaagagcgcgagatagcgattggtttaattaaagataaatagggcgatagtaaagttcgtatcgacggtatagacgggtataaggtcgcggaattggcgtatttgatgttaatgtagttgataacgttagaagggtttattttatttaacggcggttttaaatatagaagagtatttttcgattggggatgttttt

SEQ ID NO: 16114 - DNA, 706 bp, Artificial Sequence
  chemically treated genomic DNA (Homo sapiens) CpG-island No: 16114
aaaaacatccccaatcgaaaaatactcttctatatttaaaaccgccgttaaataaaataaacccttctaacgttatcaactacattaacatcaaatacgccaattccgcgaccttatacccgtctataccgtcgatacgaactttactatcgccctatttatctttaattaaaccaatcgctatctcgcgctcttcgccctataatcgcccgtaaaaaacaaacgcctcctactcataacgaataacgcgaccaatctacaaactacgaaacgcccgaccataaccgaacgtataaataacttccaacacgctaattttaccactaccgttaacacctaccaaaaaattaaaaccgaaaaataaaacgaaatccgcgatttcaatattacgaaaatcgcgaatcaacaaacgaataaaaaacattacaatctcattaacataacaacataaaccgcgctctaactaaccgcatcttcaatctacacgctaaaaaccgaatcgatcaacatcatacgaacgttttcgcatttcaacgcgttcaaaacatccaacacataactaacgttaaaaccgatttccatctccgcaccgctataaataacgtcgaaaatctcttccgcttcttcctattccgaattattaacgataattttcaactaattttcgctaacataaaaacgtacgccgcgaaatttctcgttaaaa

SEQ ID NO: 16115 - DNA, 706 bp, Artificial Sequence
  chemically treated genomic DNA (Homo sapiens) CpG-island No: 16115
gaaagtatttttagtcgaggaatgtttttttgtatttggggtcgtcgttgagtaaagtaaatttttttggcgttattaattgtattggtattaggtgcgttagtttcgcgattttatgttcgtttgtatcgtcgatgcggattttgttgtcgttttgtttgtttttggttaagttaatcgttgtttcgcgtttttcgttttgtaatcgttcgtggagaataaacgttttttgtttatggcgaatgacgcgattaatttgtaaattgcgaaacgttcgattatggtcgagcgtatagatggtttttagtacgttggttttgttattgtcgttggtatttattagaaagttaaagtcgggagataaggcgagattcgcggttttaatgttgcggaaatcgcggattaataagcgggtgagggatattatagttttattggtatgataatataagtcgcgttttggttggtcgtatttttaatttgtacgttggaaatcgaatcggttagtattatgcggacgttttcgtattttagcgcgtttagaatatttagtatataattgacgttgaagtcgatttttattttcgtatcgttataggtaacgtcgaggatttttttcgtttttttttgtttcgggttgttggcggtgatttttagttggttttcgttgatataaagacgtacgtcgcggaatttttcgttagag

SEQ ID NO: 16116 - DNA, 706 bp, Artificial Sequence
  chemically treated genomic DNA (Homo sapiens) CpG-island No: 16116
ctctaacgaaaaattccgcgacgtacgtctttatatcaacgaaaaccaactaaaaatcaccgccaacaacccgaaacaaaaaaaaacgaaaaaaatcctcgacgttacctataacgatacgaaaataaaaatcgacttcaacgtcaattatatactaaatattctaaacgcgctaaaatacgaaaacgtccgcataatactaaccgattcgatttccaacgtacaaattaaaaatacgaccaaccaaaacgcgacttatattatcataccaataaaactataatatccctcacccgcttattaatccgcgatttccgcaacattaaaaccgcgaatctcgccttatctcccgactttaactttctaataaataccaacgacaataacaaaaccaacgtactaaaaaccatctatacgctcgaccataatcgaacgtttcgcaatttacaaattaatcgcgtcattcgccataaacaaaaaacgtttattctccacgaacgattacaaaacgaaaaacgcgaaacaacgattaacttaaccaaaaacaaacaaaacgacaacaaaatccgcatcgacgatacaaacgaacataaaatcgcgaaactaacgcacctaataccaatacaattaataacgccaaaaaaatttactttactcaacgacgaccccaaatacaaaaaaacattcctcgactaaaaatactttc

SEQ ID NO: 16117 - DNA, 589 bp, Artificial Sequence
  chemically treated genomic DNA (Homo sapiens) CpG-island No: 16117
gcgtatttttatcggtatattatttttattacgggtttttggcgaatttttattaatatagattaatattataatatacggatcgttttattattgcgagtaggcgaatagagaggatttttaaaataaataaaatattttattttttttttttatcgcgtcgcgattatatatttttcgttcgtgcgtaagatttatttatattttatattttgcggaaggtagatttattaagtataaaatattttttatcgcggtaagaagacggatatttaaattaagagaagttaatattacgtttacggtttggttatatttaggattattgtttaatttataggcgatcgttaatttttaatatttatttatattatattaataattattgtttttcgataaatattaatttttttttatgttcgcggttatagggatttaacgatcgagaatcggaaagtaacgacgtttaaatatatttaggtataaagttttcgattcgtaagaattttatattattagagtcgtatttataaaattatttatttttatatagagcgttataatatagaattatatttattttgtagta

SEQ ID NO: 16118 - DNA, 589 bp, Artificial Sequence
  chemically treated genomic DNA (Homo sapiens) CpG-island No: 16118
tactacaaaataaatataattctatattataacgctctatataaaaataaataattttataaatacgactctaataatataaaattcttacgaatcgaaaactttatacctaaatatatttaaacgtcgttactttccgattctcgatcgttaaatccctataaccgcgaacataaaaaaaaattaatatttatcgaaaaacaataattattaatataatataaataaatattaaaaattaacgatcgcctataaattaaacaataatcctaaatataaccaaaccgtaaacgtaatattaacttctcttaatttaaatatccgtcttcttaccgcgataaaaaatattttatacttaataaatctaccttccgcaaaatataaaatataaataaatcttacgcacgaacgaaaaatatataatcgcgacgcgataaaaaaaaaaaataaaatattttatttattttaaaaatcctctctattcgcctactcgcaataataaaacgatccgtatattataatattaatctatattaataaaaattcgccaaaaacccgtaataaaaataatataccgataaaaatacgc

SEQ ID NO: 16119 - DNA, 589 bp, Artificial Sequence
  chemically treated genomic DNA (Homo sapiens) CpG-island No: 16119
tgttgtagggtgggtgtggttttgtgttgtggcgttttgtgtgggggtgggtggttttgtggatgcgattttggtggtgtgaggtttttgcgggtcgggggttttgtatttgggtgtgtttgggcgtcgttgtttttcggttttcggtcgttgggtttttgtgatcgcgagtatgggggggggttggtgtttgtcgggggatagtggttgttggtgtagtgtgagtgggtattgggggttagcgatcgtttgtgggttgagtagtagttttgagtgtggttaggtcgtgggcgtggtgttggttttttttggtttgggtattcgtttttttgtcgcggtggagggtattttgtgtttgatggatttgtttttcgtagggtgtgggatgtaggtgggttttgcgtacgggcggagggtgtgtggtcgcggcgcggtggggggggggggtggaatgttttgtttgttttaagggttttttttgttcgtttgttcgtagtggtggggcggttcgtgtgttgtagtattggtttgtgttggtgagagttcgttagaaattcgtagtaaaggtggtgtgtcggtgggggtgcgt

SEQ ID NO: 16120 - DNA, 589 bp, Artificial Sequence
  chemically treated genomic DNA (Homo sapiens) CpG-island No: 16120
acgcacccccaccgacacaccacctttactacgaatttctaacgaactctcaccaacacaaaccaatactacaacacacgaaccgccccaccactacgaacaaacgaacaaaaaaaacccttaaaacaaacaaaacattccaccccccccccccaccgcgccgcgaccacacaccctccgcccgtacgcaaaacccacctacatcccacaccctacgaaaaacaaatccatcaaacacaaaataccctccaccgcgacaaaaaaacgaatacccaaaccaaaaaaaaccaacaccacgcccacgacctaaccacactcaaaactactactcaacccacaaacgatcgctaacccccaatacccactcacactacaccaacaaccactatcccccgacaaacaccaacccccccccatactcgcgatcacaaaaacccaacgaccgaaaaccgaaaaacaacgacgcccaaacacacccaaatacaaaacccccgacccgcaaaaacctcacaccaccaaaatcgcatccacaaaaccacccacccccacacaaaacgccacaacacaaaaccacacccaccctacaaca

SEQ ID NO: 16121 - DNA, 604 bp, Artificial Sequence
  chemically treated genomic DNA (Homo sapiens) CpG-island No: 16121
gttattggtcggtaagttgttggcggtgttatttggttcggcggggtttgggttggcggtaaattttcgttagttgattatcgtgttcggcgtgtttgtcggggttggtatttttaacggtgtaattaaatacgttgtttagtattatgataattcgtaatagttgcgtcgcgtggtcggtattttattagcgatggtatttggtttttttacgttgatggcgttggtttttgtgttggtagttgcgttaattagttagggattgtttggtaatatcgattattaggggttggtgcgtttagtggcgttggtgtaaatggggatcgtttggggtaatttgttattggcgttgatgaaaggttttcgcgatgtcgtaggtaatgcgttatcgttgattgtcggtagtttgattggcgttttcgcgtattacgttagttatcgtttgggcggttatgaaggggcgttgttgggtttggcgttgattttcgcgttggtggtaatttttgtcgttattatgttgattaaacgtggtgttatttcgttaagttatttgaaatttagttgggataacggtttggtagggtagttgagtaaatttacgttt

SEQ ID NO: 16122 - DNA, 604 bp, Artificial Sequence
  chemically treated genomic DNA (Homo sapiens) CpG-island No: 16122
aaacgtaaatttactcaactaccctaccaaaccgttatcccaactaaatttcaaataacttaacgaaataacaccacgtttaatcaacataataacgacaaaaattaccaccaacgcgaaaatcaacgccaaacccaacaacgccccttcataaccgcccaaacgataactaacgtaatacgcgaaaacgccaatcaaactaccgacaatcaacgataacgcattacctacgacatcgcgaaaacctttcatcaacgccaataacaaattaccccaaacgatccccatttacaccaacgccactaaacgcaccaacccctaataatcgatattaccaaacaatccctaactaattaacgcaactaccaacacaaaaaccaacgccatcaacgtaaaaaaaccaaataccatcgctaataaaataccgaccacgcgacgcaactattacgaattatcataatactaaacaacgtatttaattacaccgttaaaaataccaaccccgacaaacacgccgaacacgataatcaactaacgaaaatttaccgccaacccaaaccccgccgaaccaaataacaccgccaacaacttaccgaccaataac

SEQ ID NO: 16123 - DNA, 604 bp, Artificial Sequence
  chemically treated genomic DNA (Homo sapiens) CpG-island No: 16123
gagcgtaaatttgtttaattgttttgttagatcgttattttagttgggttttagatagtttaacgggatgatattacgtttgattaatatgatggcggtaggaattattattagcgcgggaattagcgttagatttagtaacgtttttttataatcgtttaaacggtaattgacgtagtacgcgagaacgttaattaagttgtcgataattagcgataacgtattatttgcggtatcgcgaaagttttttattagcgttagtaataggttgttttaggcgatttttatttgtattagcgttattaaacgtattagtttttgatagtcggtattattaaataatttttggttgattggcgtagttgttagtataaaaattagcgttattagcgtagagaaattaagtattatcgttgatgaagtgtcgattacgcggcgtagttgttgcggattattatggtattgggtaacgtatttggttatatcgttaaagatgttagtttcggtaagtacgtcgagtacggtaattaattggcggaaatttgtcgttagtttaagtttcgtcggattaaatgatatcgttagtaatttatcgattagtaat

SEQ ID NO: 16124 - DNA, 604 bp, Artificial Sequence
  chemically treated genomic DNA (Homo sapiens) CpG-island No: 16124
attactaatcgataaattactaacgatatcatttaatccgacgaaacttaaactaacgacaaatttccgccaattaattaccgtactcgacgtacttaccgaaactaacatctttaacgatataaccaaatacgttacccaataccataataatccgcaacaactacgccgcgtaatcgacacttcatcaacgataatacttaatttctctacgctaataacgctaatttttatactaacaactacgccaatcaaccaaaaattatttaataataccgactatcaaaaactaatacgtttaataacgctaatacaaataaaaatcgcctaaaacaacctattactaacgctaataaaaaactttcgcgataccgcaaataatacgttatcgctaattatcgacaacttaattaacgttctcgcgtactacgtcaattaccgtttaaacgattataaaaaaacgttactaaatctaacgctaattcccgcgctaataataattcctaccgccatcatattaatcaaacgtaatatcatcccgttaaactatctaaaacccaactaaaataacgatctaacaaaacaattaaacaaatttacgctc

SEQ ID NO: 16125 - DNA, 561 bp, Artificial Sequence
  chemically treated genomic DNA (Homo sapiens) CpG-island No: 16125
  misc_feature (221)..(221): n is either a, c, g or t
  misc_feature (236)..(236): n is either a, c, g or t
  misc_feature (279)..(279): n is either a, c, g or t
  misc_feature (384)..(384): n is either a, c, g or t
  misc_feature (436)..(436): n is either a, c, g or t
  misc_feature (482)..(482): n is either a, c, g or t
  misc_feature (535)..(535): n is either a, c, g or t
ttttttgtcgtcgttattcgggtcgattcgatttgggtgtaatattttgcgtgattattattgtaggtttttttcggatgatcgggtatattaggttgtgttcgtgtatacgttggaatgtttcgtggtagtttagattatagttttttgtttacgggttcgtcgtttttagtcgtgtgtcgtttggttcgtgtgtgtttttgtggtttttggttttggtnaatttgatgcgtcgngttattttacgtagttaaggattttgttattttgtaggagcgntgatattatagtattggttcgggtgtgtgataattatcgttgatatcgacgattggttgtgataggggatgaatatagtatcgcgttattatatggtcgttttantttgcgacgtagtttatacggttatcgtcgttaatttttgttggcgtgatanggcgtagatttcgtgtagtcgtgcgttttgttgtgtcgtttatatnagtcgtattagtttggcgttgaaatagcgcggagaatcgtcgtttcgatatanggtttgatgtaaaagtttagggttat

SEQ ID NO: 16126 - DNA, 561 bp, Artificial Sequence
  chemically treated genomic DNA (Homo sapiens) CpG-island No: 16126
  misc_feature (27)..(27): n is either a, c, g or t
  misc_feature (80)..(80): n is either a, c, g or t
  misc_feature (126)..(126): n is either a, c, g or t
  misc_feature (178)..(178): n is either a, c, g or t
  misc_feature (283)..(283): n is either a, c, g or t
  misc_feature (326)..(326): n is either a, c, g or t
  misc_feature (341)..(341): n is either a, c, g or t
ataaccctaaacttttacatcaaaccntatatcgaaacgacgattctccgcgctatttcaacgccaaactaatacgactnatataaacgacacaacaaaacgcacgactacacgaaatctacgccntatcacgccaacaaaaattaacgacgataaccgtataaactacgtcgcaaantaaaacgaccatataataacgcgatactatattcatcccctatcacaaccaatcgtcgatatcaacgataattatcacacacccgaaccaatactataatatcancgctcctacaaaataacaaaatccttaactacgtaaaataacncgacgcatcaaattnaccaaaaccaaaaaccacaaaaacacacacgaaccaaacgacacacgactaaaaacgacgaacccgtaaacaaaaaactataatctaaactaccacgaaacattccaacgtatacacgaacacaacctaatatacccgatcatccgaaaaaaacctacaataataatcacgcaaaatattacacccaaatcgaatcgacccgaataacgacgacaaaaaa

SEQ ID NO: 16127 - DNA, 561 bp, Artificial Sequence
  chemically treated genomic DNA (Homo sapiens) CpG-island No: 16127
  misc_feature (27)..(27): n is either a, c, g or t
  misc_feature (80)..(80): n is either a, c, g or t
  misc_feature (126)..(126): n is either a, c, g or t
  misc_feature (178)..(178): n is either a, c, g or t
  misc_feature (283)..(283): n is either a, c, g or t
  misc_feature (326)..(326): n is either a, c, g or t
  misc_feature (341)..(341): n is either a, c, g or t
atagttttaagtttttatattaggttntatgtcgagacgacgatttttcgcgttattttagcgttagattagtacggttnatataagcggtatagtagagcgtacggttatacgggatttgcgttntattacgttaataaaggttagcggcgatgatcgtgtgaattgcgtcgtaaantggggcgattatgtgatgacgcggtattatatttattttttattatagttagtcgtcggtgttagcggtaattattatatattcgggttaatattgtggtgttancgtttttatagagtaataaagtttttggttacgtgggatagtncggcgtattagattnattagagttagaagttataggaatatatacgagttagacgatatacggttaggaacgacgagttcgtggatagggggttatggtttaggttattacgaggtattttagcgtatatacgaatatagtttggtgtattcggttattcgaggaagatttgtaatggtggttacgtagggtattatatttaggtcgagtcgattcggataacggcggtagagga

SEQ ID NO: 16128 - DNA, 561 bp, Artificial Sequence
  chemically treated genomic DNA (Homo sapiens) CpG-island No: 16128
  misc_feature (221)..(221): n is either a, c, g or t
  misc_feature (236)..(236): n is either a, c, g or t
  misc_feature (279)..(279): n is either a, c, g or t
  misc_feature (384)..(384): n is either a, c, g or t
  misc_feature (436)..(436): n is either a, c, g or t
  misc_feature (482)..(482): n is either a, c, g or t
  misc_feature (535)..(535): n is either a, c, g or t
tcctctaccgccgttatccgaatcgactcgacctaaatataataccctacgtaaccaccattacaaatcttcctcgaataaccgaatacaccaaactatattcgtatatacgctaaaatacctcgtaataacctaaaccataaccccctatccacgaactcgtcgttcctaaccgtatatcgtctaactcgtatatattcctataacttctaactctaatnaatctaatacgccgnactatcccacgtaaccaaaaactttattactctataaaaacgntaacaccacaatattaacccgaatatataataattaccgctaacaccgacgactaactataataaaaaataaatataataccgcgtcatcacataatcgccccantttacgacgcaattcacacgatcatcgccgctaacctttattaacgtaatanaacgcaaatcccgtataaccgtacgctctactataccgcttatatnaaccgtactaatctaacgctaaaataacgcgaaaaatcgtcgtctcgacatanaacctaatataaaaacttaaaactat

SEQ ID NO: 16129 - DNA, 512 bp, Artificial Sequence
  chemically treated genomic DNA (Homo sapiens) CpG-island No: 16129
cgtggttcgcgttttacggacgagttattgttgtaggaggttcggtggcgcggcgcgttcgtagttgcggtagcggcggattcgcgcggggattttttcgcgcgtattagttttcgtttcgggtagtgttattttgggcgtcgtttcgttatttttacggtgtttcgtcgttttttattattaggatggagggtattttttagtacgagtcgatattttagagggtatcggcgagttttcgaaaaaattagggcggtggggcgaggaagattcgcgtttcggattttagagaaggaaagaaagttagagggagtcggagcggagttgtattttacgtcgaagtttttttttcgaatcgtttggagttgtaagtggtttttgattgaatatagttgtttagttgttggttacggggtgcgcggaggaggcggggttagagggagaaaagggtgggggcgagtagtttggaggtcgagtagaggagatcgtgttgggagagtagagtaggtatt

SEQ ID NO: 16130 - DNA, 512 bp, Artificial Sequence
  chemically treated genomic DNA (Homo sapiens) CpG-island No: 16130
aatacctactctactctcccaacacgatctcctctactcgacctccaaactactcgcccccacccttttctccctctaaccccgcctcctccgcgcaccccgtaaccaacaactaaacaactatattcaatcaaaaaccacttacaactccaaacgattcgaaaaaaaaacttcgacgtaaaatacaactccgctccgactccctctaactttctttccttctctaaaatccgaaacgcgaatcttcctcgccccaccgccctaattttttcgaaaactcgccgataccctctaaaatatcgactcgtactaaaaaataccctccatcctaataataaaaaacgacgaaacaccgtaaaaataacgaaacgacgcccaaaataacactacccgaaacgaaaactaatacgcgcgaaaaaatccccgcgcgaatccgccgctaccgcaactacgaacgcgccgcgccaccgaacctcctacaacaataactcgtccgtaaaacgcgaaccacg

SEQ ID NO: 16131 - DNA, 512 bp, Artificial Sequence
  chemically treated genomic DNA (Homo sapiens) CpG-island No: 16131
gatgtttgttttgtttttttagtacggttttttttgttcggtttttaggttattcgtttttatttttttttttttttagtttcgtttttttcgcgtatttcgtggttagtagttagatagttgtgtttaattagaaattatttataattttagacgattcgaaggggaaatttcggcgtgaagtgtagtttcgtttcggttttttttagttttttttttttttttggaattcgaggcgcggatttttttcgttttatcgttttagttttttcgggagttcgtcggtgttttttagggtgtcggttcgtgttgggaagtgttttttattttggtaatggggggcggcgaggtatcgtaggagtggcgaggcggcgtttagggtggtattgttcggaacgggggttggtgcgcgcgggagggttttcgcgcgggttcgtcgttgtcgtagttgcgagcgcgtcgcgttatcgagttttttgtagtaatggttcgttcgtgaaacgcgagttacg

SEQ ID NO: 16132 - DNA, 512 bp, Artificial Sequence
  chemically treated genomic DNA (Homo sapiens) CpG-island No: 16132
cgtaactcgcgtttcacgaacgaaccattactacaaaaaactcgataacgcgacgcgctcgcaactacgacaacgacgaacccgcgcgaaaaccctcccgcgcgcaccaacccccgttccgaacaataccaccctaaacgccgcctcgccactcctacgatacctcgccgccccccattaccaaaataaaaaacacttcccaacacgaaccgacaccctaaaaaacaccgacgaactcccgaaaaaactaaaacgataaaacgaaaaaaatccgcgcctcgaattccaaaaaaaaaaaaaaaactaaaaaaaaccgaaacgaaactacacttcacgccgaaatttccccttcgaatcgtctaaaattataaataatttctaattaaacacaactatctaactactaaccacgaaatacgcgaaaaaaacgaaactaaaaaaaaaaaaaaataaaaacgaataacctaaaaaccgaacaaaaaaaaccgtactaaaaaaacaaaacaaacatc

SEQ ID NO: 16133 - DNA, 916 bp, Artificial Sequence
  chemically treated genomic DNA (Homo sapiens) CpG-island No: 16133
tttgttttgttcgggttttttcgcggtcgtttttttcgtttttttcgttagtttttttttttttttttcggcgcgtttttttagtttttatttggttgggcgggagggttggcgggaggaggcggtttgcgggcggggggcggggggcgggcgcggggtcggtcgaaggagggcggtgggtggtgttgaagggatagtttcgcggcggcggcggcggcggcggtttcgggcgtttgagcgggtgttcggcgcggagagcggcgagcgtattatgttttaggtcgttttcggggtagtagtagcgggcgttcggggtaaggcgcgggtcgagggcgtcgaggggtcgggcggttcgtgcgggacgatgaagcggtagaacgtgcgtacgttggcgtttatcgtgtgtatttttatttatttgttggtgggcgtcgcggttttcgacgcgttggagtcggagttcgagttgatcgagcggtagcggttggagttgcggagtaggagttgcgggcgcgttataattttagttagggcggttacgaggagttggagcgcgtcgtgttgcgttttaagtcgtataaggtcggcgtgtagtggcgtttcgtcggttttttttatttcgttattatcgttattattattatcggtaacggttcgtcgggcggggggcgggaatttagggttgggcgcggggtttcgggagtcgttcggggtcggttggggttgggggcgggggttttttcgagaggggttgggcgtcgaattttgcgttcgtagaaattcgagtttagtttggcgtgtgtgtttcgcggggacggaattcggggaggcgtcgatttttggtttcggatttgatttttcggtcgggttagttttaatttggttttgttatgttgtataggtttttagggatttt

SEQ ID NO: 16134 - DNA, 916 bp, Artificial Sequence
  chemically treated genomic DNA (Homo sapiens) CpG-island No: 16134
aaaatccctaaaaacctatacaacataacaaaaccaaattaaaactaacccgaccgaaaaatcaaatccgaaaccaaaaatcgacgcctccccgaattccgtccccgcgaaacacacacgccaaactaaactcgaatttctacgaacgcaaaattcgacgcccaacccctctcgaaaaaacccccgcccccaaccccaaccgaccccgaacgactcccgaaaccccgcgcccaaccctaaattcccgccccccgcccgacgaaccgttaccgataataataataacgataataacgaaataaaaaaaaccgacgaaacgccactacacgccgaccttatacgacttaaaacgcaacacgacgcgctccaactcctcgtaaccgccctaactaaaattataacgcgcccgcaactcctactccgcaactccaaccgctaccgctcgatcaactcgaactccgactccaacgcgtcgaaaaccgcgacgcccaccaacaaataaataaaaatacacacgataaacgccaacgtacgcacgttctaccgcttcatcgtcccgcacgaaccgcccgacccctcgacgccctcgacccgcgccttaccccgaacgcccgctactactaccccgaaaacgacctaaaacataatacgctcgccgctctccgcgccgaacacccgctcaaacgcccgaaaccgccgccgccgccgccgccgcgaaactatcccttcaacaccacccaccgccctccttcgaccgaccccgcgcccgccccccgccccccgcccgcaaaccgcctcctcccgccaaccctcccgcccaaccaaataaaaactaaaaaaacgcgccgaaaaaaaaaaaaaaaaactaacgaaaaaaacgaaaaaaacgaccgcgaaaaaacccgaacaaaacaaa

SEQ ID NO: 16135 - DNA, 916 bp, Artificial Sequence
  chemically treated genomic DNA (Homo sapiens) CpG-island No: 16135
ggagtttttgggggtttatgtaatatggtagggttaagttagggttggttcggtcggagagttaggttcggagttaggaatcgacgttttttcgagtttcgttttcgcggagtatatacgttaggttgaattcgggtttttgcgagcgtagggttcggcgtttagtttttttcgggggagttttcgtttttagttttagtcggtttcggacgattttcggagtttcgcgtttagttttgggttttcgtttttcgttcggcgagtcgttatcgatggtggtgatgacggtgatggcgaagtagaaggagtcggcgaagcgttattgtacgtcggttttgtgcggtttgaggcgtagtacgacgcgttttagtttttcgtagtcgttttggttgaggttgtagcgcgttcgtagtttttgtttcgtagttttagtcgttgtcgttcgattagttcgggtttcgattttagcgcgtcgaagatcgcggcgtttattagtaggtaggtgaaggtgtatacgatgagcgttagcgtgcgtacgttttgtcgttttatcgtttcgtacgagtcgttcggtttttcggcgttttcggttcgcgttttgtttcggacgttcgttgttgttgtttcggaggcggtttggggtatggtgcgttcgtcgtttttcgcgtcgggtattcgtttaagcgttcggggtcgtcgtcgtcgtcgtcgtcgcggagttgtttttttagtattatttatcgttttttttcggtcggtttcgcgttcgtttttcgtttttcgttcgtaggtcgttttttttcgttagttttttcgtttagttaaataaggattggggagacgcgtcgaggagggaggaggggggttggcggaggggacgggaggggcggtcgcgagagagttcgggtaggataga

SEQ ID NO: 16136 - DNA, 916 bp, Artificial Sequence
  chemically treated genomic DNA (Homo sapiens) CpG-island No: 16136
tctatcctacccgaactctctcgcgaccgcccctcccgtcccctccgccaacccccctcctccctcctcgacgcgtctccccaatccttatttaactaaacgaaaaaactaacgaaaaaaaacgacctacgaacgaaaaacgaaaaacgaacgcgaaaccgaccgaaaaaaaacgataaataatactaaaaaaacaactccgcgacgacgacgacgacgacgaccccgaacgcttaaacgaatacccgacgcgaaaaacgacgaacgcaccataccccaaaccgcctccgaaacaacaacaacgaacgtccgaaacaaaacgcgaaccgaaaacgccgaaaaaccgaacgactcgtacgaaacgataaaacgacaaaacgtacgcacgctaacgctcatcgtatacaccttcacctacctactaataaacgccgcgatcttcgacgcgctaaaatcgaaacccgaactaatcgaacgacaacgactaaaactacgaaacaaaaactacgaacgcgctacaacctcaaccaaaacgactacgaaaaactaaaacgcgtcgtactacgcctcaaaccgcacaaaaccgacgtacaataacgcttcgccgactccttctacttcgccatcaccgtcatcaccaccatcgataacgactcgccgaacgaaaaacgaaaacccaaaactaaacgcgaaactccgaaaatcgtccgaaaccgactaaaactaaaaacgaaaactcccccgaaaaaaactaaacgccgaaccctacgctcgcaaaaacccgaattcaacctaacgtatatactccgcgaaaacgaaactcgaaaaaacgtcgattcctaactccgaacctaactctccgaccgaaccaaccctaacttaaccctaccatattacataaacccccaaaaactcc

SEQ ID NO: 16137 - DNA, 887 bp, Artificial Sequence
  chemically treated genomic DNA (Homo sapiens) CpG-island No: 16137
tgttttacgcgttgttgggtatatcgtttacgttcgttatgttttagagtttgggcgagcgtattaatattttggtgaggtatttgttgtatcgcgttaagaaggggttgggtatgcggcgcgtcgacgtgtttatggttaatatggtgtttatcggttttttttcgtgtatatatacgttgtggtatcgcgtcgtcgttttttttaattacgagtattggatttttttttaggtttattattattgtttattatttttattattatcggtttcggcgattacgtggcgttgtagaaggattaggttcgtagacgtagtcgtagtacgtggtttttagtttcgtttatattttacgggtttacggttatcggcgttttttttaatttcgtggtgtgcgttttatgattatgaacgtcgaggacgagaagcgcgacgtcgagtatcgcgcgttttacgcgtaacgggtaggcgggcggcggcggagggggtggtagcgcgtatattacggatatcgttttatttacggcggtagcgggcggcggcggtttcgtaacgtttacgcggaggtgttgtatttttagtttatgtgttcgtgtttgtggtataagagtcgcgagaagttgtagtattttatttttatgattatttcgcgggatttttttacgttcgatacgtgcgtggagtagagttattcgtcgtcgggagggggcggtcgttatagcgatacgttttcgcgacgttgtttgtgtagcggggcgttacgtttcgttattagttcggtgtttacgggtttgtatagtttgtttatttttcgcggttttatgaagcgtaggagtttcgtgtgattgtttcgaggggtttggagtatttgggggcgcgggcgggg

SEQ ID NO: 16138 - DNA, 887 bp, Artificial Sequence
  chemically treated genomic DNA (Homo sapiens) CpG-island No: 16138
ccccgcccgcgcccccaaatactccaaacccctcgaaacaatcacacgaaactcctacgcttcataaaaccgcgaaaaataaacaaactatacaaacccgtaaacaccgaactaataacgaaacgtaacgccccgctacacaaacaacgtcgcgaaaacgtatcgctataacgaccgccccctcccgacgacgaataactctactccacgcacgtatcgaacgtaaaaaaatcccgcgaaataatcataaaaataaaatactacaacttctcgcgactcttataccacaaacacgaacacataaactaaaaatacaacacctccgcgtaaacgttacgaaaccgccgccgcccgctaccgccgtaaataaaacgatatccgtaatatacgcgctaccaccccctccgccgccgcccgcctacccgttacgcgtaaaacgcgcgatactcgacgtcgcgcttctcgtcctcgacgttcataatcataaaacgcacaccacgaaattaaaaaaaacgccgataaccgtaaacccgtaaaatataaacgaaactaaaaaccacgtactacgactacgtctacgaacctaatccttctacaacgccacgtaatcgccgaaaccgataataataaaaataataaacaataataataaacctaaaaaaaaatccaatactcgtaattaaaaaaaacgacgacgcgataccacaacgtatatatacacgaaaaaaaaccgataaacaccatattaaccataaacacgtcgacgcgccgcatacccaaccccttcttaacgcgatacaacaaatacctcaccaaaatattaatacgctcgcccaaactctaaaacataacgaacgtaaacgatatacccaacaacgcgtaaaaca

SEQ ID NO: 16139 - DNA, 887 bp, Artificial Sequence
  chemically treated genomic DNA (Homo sapiens) CpG-island No: 16139
tttcgttcgcgtttttaggtgttttaggtttttcggggtagttatacggagtttttgcgttttatgaggtcgcggaaggtggataggttgtgtagattcgtggatatcgagttgatggcggagcgtggcgtttcgttgtataggtagcgtcgcgagggcgtgtcgttgtagcggtcgttttttttcggcgacgagtggttttgttttacgtacgtgtcggacgtggagaggtttcgcgggatgattatggggatggagtattgtagtttttcgcggtttttgtattataggtacgagtatatggattggaagtgtagtattttcgcgtagacgttgcggaatcgtcgtcgttcgttgtcgtcgtggatgaggcggtgttcgtagtgtgcgcgttgttatttttttcgtcgtcgttcgtttgttcgttgcgcgtgaagcgcgcggtgttcggcgtcgcgtttttcgttttcggcgtttatggttatgaagcgtatattacgaggttgaggaaggcgtcgatgatcgtgagttcgtaagatgtagacgaagttgaaggttacgtattgcggttgcgtttgcgggtttggtttttttgtagcgttacgtagtcgtcgaagtcgatggtggtgagggtgatgagtagtagtagtaggtttggaagaaagtttagtgttcgtagttggagaaggcggcggcgcgatgttatagcgtgtgtatgtacgagaagaagtcgatgagtattatgttggttatggatacgtcggcgcgtcgtatgtttagtttttttttggcgcggtgtagtaggtattttattaaggtgttgatgcgttcgtttaggttttggaatatgacgagcgtgagcggtatgtttagtagcgcgtagaata

SEQ ID NO: 16140 - DNA, 887 bp, Artificial Sequence
  chemically treated genomic DNA (Homo sapiens) CpG-island No: 16140
tattctacgcgctactaaacataccgctcacgctcgtcatattccaaaacctaaacgaacgcatcaacaccttaataaaatacctactacaccgcgccaaaaaaaaactaaacatacgacgcgccgacgtatccataaccaacataatactcatcgacttcttctcgtacatacacacgctataacatcgcgccgccgccttctccaactacgaacactaaactttcttccaaacctactactactactcatcaccctcaccaccatcgacttcgacgactacgtaacgctacaaaaaaaccaaacccgcaaacgcaaccgcaatacgtaaccttcaacttcgtctacatcttacgaactcacgatcatcgacgccttcctcaacctcgtaatatacgcttcataaccataaacgccgaaaacgaaaaacgcgacgccgaacaccgcgcgcttcacgcgcaacgaacaaacgaacgacgacgaaaaaaataacaacgcgcacactacgaacaccgcctcatccacgacgacaacgaacgacgacgattccgcaacgtctacgcgaaaatactacacttccaatccatatactcgtacctataatacaaaaaccgcgaaaaactacaatactccatccccataatcatcccgcgaaacctctccacgtccgacacgtacgtaaaacaaaaccactcgtcgccgaaaaaaaacgaccgctacaacgacacgccctcgcgacgctacctatacaacgaaacgccacgctccgccatcaactcgatatccacgaatctacacaacctatccaccttccgcgacctcataaaacgcaaaaactccgtataactaccccgaaaaacctaaaacacctaaaaacgcgaacgaaa

SEQ ID NO: 16141 - DNA, 553 bp, Artificial Sequence
  chemically treated genomic DNA (Homo sapiens) CpG-island No: 16141
cgttttaggacgattcggtagagcgcgggtatcgtggtttaggcgcgtttttcgggggcggggcgagtaggaggggttacgtgacgttcggttcggaatgttcgcgtaggagatttcgggtgacggggttcggcgtcgttaattggagcgaattttagcgttcgtcgatatggtttggattaagtattagttgtttttggtcgggtttatgtttgttatcggttttattaatacgttttcggtaaagtgagtttggcgtgtcgggcgtgcgggttttggcgatttcggcgttcgttttacgttttttttttttttggttttgtttttttggttttttttgtttttttatttgtttcggttagttcgcgcgcgttatgattatttaagggatgcgaggttcggggaaatgcggaggttgcgttcgggcggggggattcgagtttcggttttgatttgttgtatagttttcgtttttgtttttacgttttttaataggagggttggtcgatttttttttacggtttttttagtgttggcgtttaagtttgagtat

SEQ ID NO: 16142 - DNA, 553 bp, Artificial Sequence
  chemically treated genomic DNA (Homo sapiens) CpG-island No: 16142
atactcaaacttaaacgccaacactaaaaaaaccgtaaaaaaaaatcgaccaaccctcctattaaaaaacgtaaaaacaaaaacgaaaactatacaacaaatcaaaaccgaaactcgaatccccccgcccgaacgcaacctccgcatttccccgaacctcgcatcccttaaataatcataacgcgcgcgaactaaccgaaacaaataaaaaaacaaaaaaaaccaaaaaaacaaaaccaaaaaaaaaaaaaacgtaaaacgaacgccgaaatcgccaaaacccgcacgcccgacacgccaaactcactttaccgaaaacgtattaataaaaccgataacaaacataaacccgaccaaaaacaactaatacttaatccaaaccatatcgacgaacgctaaaattcgctccaattaacgacgccgaaccccgtcacccgaaatctcctacgcgaacattccgaaccgaacgtcacgtaacccctcctactcgccccgcccccgaaaaacgcgcctaaaccacgatacccgcgctctaccgaatcgtcctaaaacg

SEQ ID NO: 16143 - DNA, 553 bp, Artificial Sequence
  chemically treated genomic DNA (Homo sapiens) CpG-island No: 16143
gtgtttaggtttggacgttagtattggaagggtcgtggaaaggaatcggttaatttttttgttaaaagacgtggaaataggagcggaggttgtatagtaaattaaagtcggggttcggattttttcgttcgggcgtagttttcgtattttttcgggtttcgtattttttgggtggttataacgcgcgcgaattgatcggagtaagtgggaaagtaggggaagttaggagggtagggttaagaagggggaaggcgtagaacgagcgtcggggtcgttagggttcgtacgttcggtacgttagatttattttgtcgagagcgtgttgatggagtcggtaataagtatgagttcggttaggaatagttggtatttggtttaggttatgtcggcggacgttggggttcgttttagttagcggcgtcgggtttcgttattcggggttttttgcgcgagtatttcgggtcgggcgttacgtgattttttttgttcgtttcgttttcggggagcgcgtttgagttacggtgttcgcgttttgtcgagtcgttttggagcg

SEQ ID NO: 16144 - DNA, 553 bp, Artificial Sequence
  chemically treated genomic DNA (Homo sapiens) CpG-island No: 16144
cgctccaaaacgactcgacaaaacgcgaacaccgtaactcaaacgcgctccccgaaaacgaaacgaacaaaaaaaatcacgtaacgcccgacccgaaatactcgcgcaaaaaaccccgaataacgaaacccgacgccgctaactaaaacgaaccccaacgtccgccgacataacctaaaccaaataccaactattcctaaccgaactcatacttattaccgactccatcaacacgctctcgacaaaataaatctaacgtaccgaacgtacgaaccctaacgaccccgacgctcgttctacgccttcccccttcttaaccctaccctcctaacttcccctactttcccacttactccgatcaattcgcgcgcgttataaccacccaaaaaatacgaaacccgaaaaaatacgaaaactacgcccgaacgaaaaaatccgaaccccgactttaatttactatacaacctccgctcctatttccacgtcttttaacaaaaaaattaaccgattcctttccacgacccttccaatactaacgtccaaacctaaacac

SEQ ID NO: 16145 - DNA, 865 bp, Artificial Sequence
  chemically treated genomic DNA (Homo sapiens) CpG-island No: 16145
tatcgtcggattttgttcgaattagtagcgatatttttttgagtttttttacgtaagtggaggagacgtgttcggtgtttcggtcgttttattgtcggttttcgtttagggtatagatttttattcgtcgtcgcgtattcgatatggtggttgttgtttttatcgttttagtcgtcgttttttcgtttatttcgttcgcgttttttatttttaggagacggtaaaggtagtagtggcggtggcggcggcggcggtttcggagaggttcgaatttattatggttttaaaggtttagtcgcgagaaggggtgataagagttattgaggttttttcgttcggagtttcgttattttttattttattcgcgtatatatttattttttcgtttttttgttttttagggttcgtttgttttttcgtcgtcgcggtaattattatagattcgttattttgtaattcgattttttttgttttttttttttttttttagtaggttcgtacgggttgttttagtaggggttacggcggtcgataagttttatgagtagtattttcgtttttgtacgcgttttttaggtcggaatgttcggcgttttcgcgaggaggggtattcgattggggcgggagtatttcggcgagatttttttttttttcggttcgatttttttttttttcggtttcgttttttggcgcggggtcgtaattgggcgggaggttttcgcgattttttcgtttacgtttgcgtcgcgagaggtcgttaggtggaaggggatttcggtttcgtacgtcgttatgttgttggatggtattagtatgtgacgtttttaggaatttagttttgaggaaaaaataaagtaaatcgggg

SEQ ID NO: 16146 - DNA, 865 bp, Artificial Sequence
  chemically treated genomic DNA (Homo sapiens) CpG-island No: 16146
ccccgatttactttattttttcctcaaaactaaattcctaaaaacgtcacatactaataccatccaacaacataacgacgtacgaaaccgaaatccccttccacctaacgacctctcgcgacgcaaacgtaaacgaaaaaatcgcgaaaacctcccgcccaattacgaccccgcgccaaaaaacgaaaccgaaaaaaaaaaaaatcgaaccgaaaaaaaaaaaaatctcgccgaaatactcccgccccaatcgaatacccctcctcgcgaaaacgccgaacattccgacctaaaaaacgcgtacaaaaacgaaaatactactcataaaacttatcgaccgccgtaacccctactaaaacaacccgtacgaacctactaaaaaaaaaaaaaaaaaacaaaaaaaatcgaattacaaaataacgaatctataataattaccgcgacgacgaaaaaacaaacgaaccctaaaaaacaaaaaaacgaaaaaataaatatatacgcgaataaaataaaaaataacgaaactccgaacgaaaaaacctcaataactcttatcaccccttctcgcgactaaacctttaaaaccataataaattcgaacctctccgaaaccgccgccgccgccaccgccactactacctttaccgtctcctaaaaataaaaaacgcgaacgaaataaacgaaaaaacgacgactaaaacgataaaaacaacaaccaccatatcgaatacgcgacgacgaataaaaatctataccctaaacgaaaaccgacaataaaacgaccgaaacaccgaacacgtctcctccacttacgtaaaaaaactcaaaaaaatatcgctactaattcgaacaaaatccgacgata

SEQ ID NO: 16147 - DNA, 865 bp, Artificial Sequence
  chemically treated genomic DNA (Homo sapiens) CpG-island No: 16147
tttcggtttgttttgttttttttttagagttaagtttttaggaacgttatatattggtgttatttaataatatgacgacgtgcggaatcgaagtttttttttatttagcggtttttcgcggcgtaggcgtggacggggagatcgcgagaatttttcgtttaattgcgatttcgcgttaagaggcggggtcgaaagaggaggaagtcgggtcgaaagaggaggaagtttcgtcgaagtattttcgttttagtcgggtattttttttcgcgagagcgtcgagtatttcggtttgggaagcgcgtgtagaagcggaggtgttgtttatgggatttgtcggtcgtcgtagtttttgttaggatagttcgtgcgagtttgttggaggaggaagagaaaggtagagagagtcgggttataagatggcggatttgtagtagttatcgcggcggcgggagagtaagcgagttttggggggtaaagagacgggagagtgggtgtatgcgcgggtgaagtgagaggtaacggggtttcgggcggagaggttttagtggtttttgttattttttttcgcggttgaatttttggagttatggtgaattcgggttttttcgaagtcgtcgtcgtcgttatcgttattattgtttttatcgttttttaagagtgaggagcgcggacgaggtaagcgaggaggcggcggttagagcggtggagatagtagttattatgtcggatacgcggcggcgagtgaaggtttatattttgaacgaagatcggtaatgggacgatcgaggtatcgggtacgttttttttatttacgtggaggagtttaaggggatgtcgttgttggttcgggtagagttcgacggta

SEQ ID NO: 16148 - DNA, 865 bp, Artificial Sequence
  chemically treated genomic DNA (Homo sapiens) CpG-island No: 16148
taccgtcgaactctacccgaaccaacaacgacatccccttaaactcctccacgtaaataaaaaaaacgtacccgatacctcgatcgtcccattaccgatcttcgttcaaaatataaaccttcactcgccgccgcgtatccgacataataactactatctccaccgctctaaccgccgcctcctcgcttacctcgtccgcgctcctcactcttaaaaaacgataaaaacaataataacgataacgacgacgacgacttcgaaaaaacccgaattcaccataactccaaaaattcaaccgcgaaaaaaaataacaaaaaccactaaaacctctccgcccgaaaccccgttacctctcacttcacccgcgcatacacccactctcccgtctctttaccccccaaaactcgcttactctcccgccgccgcgataactactacaaatccgccatcttataacccgactctctctacctttctcttcctcctccaacaaactcgcacgaactatcctaacaaaaactacgacgaccgacaaatcccataaacaacacctccgcttctacacgcgcttcccaaaccgaaatactcgacgctctcgcgaaaaaaaatacccgactaaaacgaaaatacttcgacgaaacttcctcctctttcgacccgacttcctcctctttcgaccccgcctcttaacgcgaaatcgcaattaaacgaaaaattctcgcgatctccccgtccacgcctacgccgcgaaaaaccgctaaataaaaaaaaacttcgattccgcacgtcgtcatattattaaataacaccaatatataacgttcctaaaaacttaactctaaaaaaaaaacaaaacaaaccgaaa

SEQ ID NO: 16149 - DNA, 852 bp, Artificial Sequence
  chemically treated genomic DNA (Homo sapiens) CpG-island No: 16149
gacgttcgtttttttggaaggtgggattcgggtggtaggtttttgggcggcgatttcggtcgggtttatagcgtcgcgttcgtttcgtttatcggttttatttagcgttttttttagatcgacgatcgtttgggaagtttcgagtttttagttcgttgtatagttcggtttcgttttatagttttttattgttatcggtcggggcgatatcgggcgagttggcgagattcggttttaggatcgaatcgcgtcgatatttgacggcgtttttcgtttttttttgtcgtcgttttcgttttcgttcggtcgtatttcggcgttcgtcgtcgtcgtcgttatcgtcgtcgatttgggaggtttgtttttcgtcgtttatcgtagtttcggcgttcggtcggtcgtcgtttttaagatggtcgcggcgcgtacggtttttgcggcggggtagaggcggaggcggagtcgagttattttcgtatttcggggtttcggtgtttcgcgttaggttgtagtttattgttcgtcgcggttatgcggggtttcgtgtacggatgagagaagtcgttgtcgcgttggttttttttttcgtttttgtcgttacgtttgtcgtcgttatggaggagtcgtcgttatcgtcgtcgtcgttattatcgttatcggaattcgagatcgagttagaattcgagtgttgtttggcggcgaggtgagtgtggcggtcgtagtcggtcgttcgtagaaagcggggcgggttttggttcgaattcggtcgggttcgagggtttttgtttttcgttaggttgggagggaagtatttagtttttgtaggttggggcgggaggggcgcggtgtatt

SEQ ID NO: 16150 - DNA, 852 bp, Artificial Sequence
  chemically treated genomic DNA (Homo sapiens) CpG-island No: 16150
aatacaccgcgcccctcccgccccaacctacaaaaactaaatacttccctcccaacctaacgaaaaacaaaaaccctcgaacccgaccgaattcgaaccaaaacccgccccgctttctacgaacgaccgactacgaccgccacactcacctcgccgccaaacaacactcgaattctaactcgatctcgaattccgataacgataataacgacgacgacgataacgacgactcctccataacgacgacaaacgtaacgacaaaaacgaaaaaaaaaaccaacgcgacaacgacttctctcatccgtacacgaaaccccgcataaccgcgacgaacaataaactacaacctaacgcgaaacaccgaaaccccgaaatacgaaaataactcgactccgcctccgcctctaccccgccgcaaaaaccgtacgcgccgcgaccatcttaaaaacgacgaccgaccgaacgccgaaactacgataaacgacgaaaaacaaacctcccaaatcgacgacgataacgacgacgacgacgaacgccgaaatacgaccgaacgaaaacgaaaacgacgacaaaaaaaaacgaaaaacgccgtcaaatatcgacgcgattcgatcctaaaaccgaatctcgccaactcgcccgatatcgccccgaccgataacaataaaaaactataaaacgaaaccgaactatacaacgaactaaaaactcgaaacttcccaaacgatcgtcgatctaaaaaaaacgctaaataaaaccgataaacgaaacgaacgcgacgctataaacccgaccgaaatcgccgcccaaaaacctaccacccgaatcccaccttccaaaaaaacgaacgtc

SEQ ID NO: 16151 - DNA, 852 bp, Artificial Sequence
  chemically treated genomic DNA (Homo sapiens) CpG-island No: 16151
gatgtatcgcgtttttttcgttttagtttgtagagattggatgttttttttttaatttggcgggaagtagaggttttcgggttcgatcgagttcgggttaggattcgtttcgttttttgcgagcgatcgattgcggtcgttatatttatttcgtcgttaagtagtattcgggttttgattcggtttcgggtttcggtggcggtggtggcggcggcggcggtggcggcggtttttttatggcggcggtaggcgtgacggtaaaggcgggaggagggattagcgcggtagcggttttttttattcgtgtacggagtttcgtatggtcgcggcgggtagtaagttgtagtttggcgcggggtatcggagtttcgaagtgcgggagtgattcgatttcgttttcgtttttatttcgtcgtaggagtcgtgcgcgtcgcggttattttggaaacggcgatcggtcgagcgtcggggttacggtgggcggcgagggataagttttttagatcggcggcggtggcggcggcggcggcgggcgtcggaatgcgatcggacgggggcggagacggcggtagggaggggcggggagcgtcgttaagtgtcggcgcgattcggttttggagtcgggtttcgttagttcgttcggtgtcgtttcggtcggtggtagtgggggattgtggagcggagtcgggttgtgtagcgggttgggagttcgaggttttttaggcggtcgtcggtttgggagggacgttgggtagggtcgatgagcggggcgggcgcgacgttatgagttcggtcggagtcgtcgtttagggatttgttattcggattttattttttaggaggacggacgtt

SEQ ID NO: 16152 - DNA, 852 bp, Artificial Sequence
  chemically treated genomic DNA (Homo sapiens) CpG-island No: 16152
aacgtccgtcctcctaaaaaataaaatccgaataacaaatccctaaacgacgactccgaccgaactcataacgtcgcgcccgccccgctcatcgaccctacccaacgtccctcccaaaccgacgaccgcctaaaaaacctcgaactcccaacccgctacacaacccgactccgctccacaatcccccactaccaccgaccgaaacgacaccgaacgaactaacgaaacccgactccaaaaccgaatcgcgccgacacttaacgacgctccccgcccctccctaccgccgtctccgcccccgtccgatcgcattccgacgcccgccgccgccgccgccaccgccgccgatctaaaaaacttatccctcgccgcccaccgtaaccccgacgctcgaccgatcgccgtttccaaaataaccgcgacgcgcacgactcctacgacgaaataaaaacgaaaacgaaatcgaatcactcccgcacttcgaaactccgataccccgcgccaaactacaacttactacccgccgcgaccatacgaaactccgtacacgaataaaaaaaaccgctaccgcgctaatccctcctcccgcctttaccgtcacgcctaccgccgccataaaaaaaccgccgccaccgccgccgccgccaccaccgccaccgaaacccgaaaccgaatcaaaacccgaatactacttaacgacgaaataaatataacgaccgcaatcgatcgctcgcaaaaaacgaaacgaatcctaacccgaactcgatcgaacccgaaaacctctacttcccgccaaattaaaaaaaaaacatccaatctctacaaactaaaacgaaaaaaacgcgatacatc

SEQ ID NO: 16153 - DNA, 675 bp, Artificial Sequence
  chemically treated genomic DNA (Homo sapiens) CpG-island No: 16153
  misc_feature (126)..(126): n is either a, c, g or t
ttcgggttgttgacgtggtaaacgtgtagacggtaattagtaattttcgttagatatagtacgcggcgaattgtttttatttcggtaaatatcggacgcgattatatagttatgagcggttatcgntttttacgtttcgttttttcgtttagttcgttataaattagcgcgttttcgtagtgtattagtatcggttgatttagttcgtttagtttttgcgtatttttgaagaattgttagtcgtttatattacggaagtcgttgtcgatatcgcgatcgttataggtcgtaacgaagtatttgaagtcgataacgtttattttatttagtttatgtagacggtcgatgttgtaagatattaggttatcgagttgtgtcgtattaatagttagtttgtttttagcggtatcgaattttagtttaattgaagcgcggttaatcgttgtaggtagttggttgagcggtatttcgattatggtggtgatattattttttgtcgttgcgcgagtatcggttttataatttttttagtggttacgattcggtttagaaatatgggtgtgcgtattaattatgttcggcgaaattattagattagacgtatttataattttttttgtatcgtttagattttgatcgatagtagtaattttttcgtttttaacggcgatattt

SEQ ID NO: 16154 - DNA, 675 bp, Artificial Sequence
  chemically treated genomic DNA (Homo sapiens) CpG-island No: 16154
  misc_feature (550)..(550): n is either a, c, g or t
aaatatcgccgttaaaaacgaaaaaattactactatcgatcaaaatctaaacgatacaaaaaaaattataaatacgtctaatctaataatttcgccgaacataattaatacgcacacccatatttctaaaccgaatcgtaaccactaaaaaaattataaaaccgatactcgcgcaacgacaaaaaataatatcaccaccataatcgaaataccgctcaaccaactacctacaacgattaaccgcgcttcaattaaactaaaattcgataccgctaaaaacaaactaactattaatacgacacaactcgataacctaatatcttacaacatcgaccgtctacataaactaaataaaataaacgttatcgacttcaaatacttcgttacgacctataacgatcgcgatatcgacaacgacttccgtaatataaacgactaacaattcttcaaaaatacgcaaaaactaaacgaactaaatcaaccgatactaatacactacgaaaacgcgctaatttataacgaactaaacgaaaaaacgaaacgtaaaaancgataaccgctcataactatataatcgcgtccgatatttaccgaaataaaaacaattcgccgcgtactatatctaacgaaaattactaattaccgtctacacgtttaccacgtcaacaacccgaa

SEQ ID NO: 16155 - DNA, 675 bp, Artificial Sequence
  chemically treated genomic DNA (Homo sapiens) CpG-island No: 16155
  misc_feature (550)..(550): n is either a, c, g or t
agatatcgtcgttaaaggcggaaaaattgttgttatcggttaggatttgggcgatgtaaaagaagttatggatgcgtttggtttggtggtttcgtcgggtatggttgatgcgtatatttatatttttgaatcgggtcgtagttattgggaaggttatgaaatcggtattcgcgtagcggtaaaaggtggtattattattatgatcgaaatgtcgtttaattagttgtttgtaacggttgatcgcgttttaattgaattgaagttcgatgtcgttaaaggtaagttgattattgatgcggtataattcggtggtttggtgttttataatatcgatcgtttgtatgagttggatgaagtgggcgttgtcggttttaaatgtttcgttgcgatttgtggcgatcgcggtatcgataacgattttcgtgatgtaaacgattggtagttttttaaaggtgcgtagaagttgggcgaattgggttagtcggtgttggtgtattgcgaaaacgcgttgatttgtgacgaattgggcgaagaagcgaagcgtgaaggncggtaatcgtttatgattatgtggtcgcgttcggtatttatcgaagtggaagtaattcgtcgcgtattgtatttggcgaaagttgttggttgtcgtttgtacgtttgttacgttagtagttcgga

SEQ ID NO: 16156 - DNA, 675 bp, Artificial Sequence
  chemically treated genomic DNA (Homo sapiens) CpG-island No: 16156
  misc_feature (126)..(126): n is either a, c, g or t
tccgaactactaacgtaacaaacgtacaaacgacaaccaacaactttcgccaaatacaatacgcgacgaattacttccacttcgataaataccgaacgcgaccacataatcataaacgattaccgnccttcacgcttcgcttcttcgcccaattcgtcacaaatcaacgcgttttcgcaatacaccaacaccgactaacccaattcgcccaacttctacgcacctttaaaaaactaccaatcgtttacatcacgaaaatcgttatcgataccgcgatcgccacaaatcgcaacgaaacatttaaaaccgacaacgcccacttcatccaactcatacaaacgatcgatattataaaacaccaaaccaccgaattataccgcatcaataatcaacttacctttaacgacatcgaacttcaattcaattaaaacgcgatcaaccgttacaaacaactaattaaacgacatttcgatcataataataataccaccttttaccgctacgcgaataccgatttcataaccttcccaataactacgacccgattcaaaaatataaatatacgcatcaaccatacccgacgaaaccaccaaaccaaacgcatccataacttcttttacatcgcccaaatcctaaccgataacaacaatttttccgcctttaacgacgatatct

SEQ ID NO: 16157 - DNA, 645 bp, Artificial Sequence
  chemically treated genomic DNA (Homo sapiens) CpG-island No: 16157
cggttatcgtttggcggtttgtttaatgttaattggttaatttttgttaagttattcggtgatcgtatcgcgtaaaggcgtgattgaattgatgcgtatgttcgacggcggcgataattcgttgtatatatagattggtagtaataatattcgcgtttacgttggcgattttatttttatttttaaattggtggatggtcgtttttcggattatcgtcgcgttttgtcgaagaattcggataaatatttggaagttggttgcgatttgtttaagtaggcgtttgttcgcgcggcgattttttttaacgagaaatttcgcggcgtacgtttttatgttagcgaaaattagttgaaaattatcgttaataattcggaataggaagaagcggaagagattttcgacgttatttatagcggtgcggagatggaaatcggttttaacgttagttatggtgttggatgttttgaacgcgttgaaatgcgaaaacgttcgtatgatgttgatcgattcggtttttagcgtgtagattgaagatgcggttagttagagcgcggtttattgttgttatgttaatgagattgtaatgtttttatcgtttgttgatcgcgattttcgtaatattgaaatcgcggatttcgttttat

SEQ ID NO: 16158 - DNA, 645 bp, Artificial Sequence
  chemically treated genomic DNA (Homo sapiens) CpG-island No: 16158
ataaaacgaaatccgcgatttcaatattacgaaaatcgcgatcaacaaacgataaaaacattacaatctcattaacataacaacaataaaccgcgctctaactaaccgcatcttcaatctacacgctaaaaaccgaatcgatcaacatcatacgaacgttttcgcatttcaacgcgttcaaaacatccaacaccataactaacgttaaaaccgatttccatctccgcaccgctataaataacgtcgaaaatctcttccgcttcttcctattccgaattattaacgataattttcaactaattttcgctaacataaaaacgtacgccgcgaaatttctcgttaaaaaaaatcgccgcgcgaacaaacgcctacttaaacaaatcgcaaccaacttccaaatatttatccgaattcttcgacaaaacgcgacgataatccgaaaaacgaccatccaccaatttaaaaataaaaataaaatcgccaacgtaaacgcgaatattattactaccaatctatatatacaacgaattatcgccgccgtcgaacatacgcatcaattcaatcacgcctttacgcgatacgatcaccgaataacttaacaaaaattaaccaattaacattaaacaaaccgccaaacgataaccg

SEQ ID NO: 16159 - DNA, 645 bp, Artificial Sequence
  chemically treated genomic DNA (Homo sapiens) CpG-island No: 16159
ataaggcgagattcgcggttttaatgttgcggaaatcgcgattaataagcggtgaggatattatagttttattggtatgataataataagtcgcgttttggttggtcgtatttttaatttgtacgttggaaatcgaatcggttagtattatgcggacgttttcgtattttagcgcgtttagaatatttagtattataattgacgttgaagtcgatttttattttcgtatcgttataggtaacgtcgaggatttttttcgtttttttttgtttcgggttgttggcggtgatttttagttggttttcgttgatataaagacgtacgtcgcggaatttttcgttagagagaatcgtcgcgcgagtaaacgtttgtttgagtagatcgtagttagtttttagatgtttgttcgggtttttcggtagaacgcggcgataattcgggaagcgattatttattagtttggaggtgaagataaagtcgttaacgtgggcgcgaatgttgttgttgttaatttgtatgtgtagcggattgtcgtcgtcgtcgagtatacgtattagtttaattacgtttttacgcggtacgattatcgaatggtttggtaaagattgattaattggtattgaatagatcgttagacggtggtcg

SEQ ID NO: 16160 - DNA, 645 bp, Artificial Sequence
  chemically treated genomic DNA (Homo sapiens) CpG-island No: 16160
cgaccaccgtctaacgatctattcaataccaattaatcaatctttaccaaaccattcgataatcgtaccgcgtaaaaacgtaattaaactaatacgtatactcgacgacgacgacaatccgctacacatacaaattaacaacaacaacattcgcgcccacgttaacgactttatcttcacctccaaactaataaataatcgcttcccgaattatcgccgcgttctaccgaaaaacccgaacaaacatctaaaaactaactacgatctactcaaacaaacgtttactcgcgcgacgattctctctaacgaaaaattccgcgacgtacgtctttatatcaacgaaaaccaactaaaaatcaccgccaacaacccgaaacaaaaaaaaacgaaaaaaatcctcgacgttacctataacgatacgaaaataaaaatcgacttcaacgtcaattataatactaaatattctaaacgcgctaaaatacgaaaacgtccgcataatactaaccgattcgatttccaacgtacaaattaaaaatacgaccaaccaaaacgcgacttattattatcataccaataaaactataatatcctcaccgcttattaatcgcgatttccgcaacattaaaaccgcgaatctcgccttat

SEQ ID NO: 16161 - DNA, 1109 bp, Artificial Sequence
  chemically treated genomic DNA (Homo sapiens) CpG-island No: 16161
  misc_feature (948)..(948): n is either a, c, g or t
  misc_feature (1010)..(1010): n is either a, c, g or t
  misc_feature (1016)..(1016): n is either a, c, g or t
  misc_feature (1095)..(1095): n is either a, c, g or t
gcggtttcgtcgttttttcgattcgttattttcgtttgtttttcgcgcgcgtttttattatttttttgttatcgttttttttatttgcgttcgttttatttcgttcgttcggtttttttttttcgtatttttttacgcgtaggtaatttcgcgtagttttcgtcggtttttttttcgtcgcgcgttttattatttttatattgcgtcgttttatgttatcgtgtcgatttgtttttttagcgtcgcggcgttcgttttttcgttttcgttgttcgtattttagtcgtttcgtttcgacgttacgtatcggtcgttaattcgtttcgcgcgatatttttacgtttttttgttacgcgtttagcgttacgacgttatcgcgttgtagtttcgttcgtagtcgcgttttttttcgtatgtgtttttacgtatttttttacgtttttatcgtattatcgtcgttttatcgtcgttcgtatcgttcgtatttcgttcgtttttttttttacggttcgtacgttataggtttgattcgcggttagttttttttatcgtatcgtttagcgttcgtttttatatgtcgtttcgtaatacgttttgtcgttacgtattatagttttgttattatatttttattagtcggtattttttacgttcgtattttttacgatttcgtcggattttcgcgttattcgtttttgtcgtgtattacggatttcgtattatgtatcgatgcgtttcgagtcgttttagtagtagtattttgtacgcggttgttgcgtacgattcgttatacgtattttacgtttacgttttgatacgatttagattcgttattcgtgttgtttgtcgttacgcgttacgattttttgcgtttgtcgtattcgttaatatgtagttatagcgcgcgatattatatcgaacgcgtgttgttttgtagtattgtatttnatagattatgttatcgttatcggttgtagttattcgttatatttcgtgacgtattagttcgnatattnttattgttagttatatcgtcgttgttttgatttgagtatagtatgtgattatatagacgttgtgatatcgtttagttgntaggttatgtatgt

SEQ ID NO: 16162 - DNA, 1109 bp, Artificial Sequence
  chemically treated genomic DNA (Homo sapiens) CpG-island No: 16162
  misc_feature (15)..(15): n is either a, c, g or t
  misc_feature (94)..(94): n is either a, c, g or t
  misc_feature (100)..(100): n is either a, c, g or t
  misc_feature (162)..(162): n is either a, c, g or t
acatacataacctancaactaaacgatatcacaacgtctatataatcacatactatactcaaatcaaaacaacgacgatataactaacaataanaatatncgaactaatacgtcacgaaatataacgaataactacaaccgataacgataacataatctatnaaatacaatactacaaaacaacacgcgttcgatataatatcgcgcgctataactacatattaacgaatacgacaaacgcaaaaaatcgtaacgcgtaacgacaaacaacacgaataacgaatctaaatcgtatcaaaacgtaaacgtaaaatacgtataacgaatcgtacgcaacaaccgcgtacaaaatactactactaaaacgactcgaaacgcatcgatacataatacgaaatccgtaatacacgacaaaaacgaataacgcgaaaatccgacgaaatcgtaaaaaatacgaacgtaaaaaataccgactaataaaaatataataacaaaactataatacgtaacgacaaaacgtattacgaaacgacatataaaaacgaacgctaaacgatacgataaaaaaaactaaccgcgaatcaaacctataacgtacgaaccgtaaaaaaaaaaacgaacgaaatacgaacgatacgaacgacgataaaacgacgataatacgataaaaacgtaaaaaaatacgtaaaaacacatacgaaaaaaaacgcgactacgaacgaaactacaacgcgataacgtcgtaacgctaaacgcgtaacaaaaaaacgtaaaaatatcgcgcgaaacgaattaacgaccgatacgtaacgtcgaaacgaaacgactaaaatacgaacaacgaaaacgaaaaaacgaacgccgcgacgctaaaaaaacaaatcgacacgataacataaaacgacgcaatataaaaataataaaacgcgcgacgaaaaaaaaaccgacgaaaactacgcgaaattacctacgcgtaaaaaaatacgaaaaaaaaaaaccgaacgaacgaaataaaacgaacgcaaataaaaaaaacgataacaaaaaaataataaaaacgcgcgcgaaaaacaaacgaaaataacgaatcgaaaaaacgacgaaaccgc

SEQ ID NO: 16163 - DNA, 1109 bp, Artificial Sequence
  chemically treated genomic DNA (Homo sapiens) CpG-island No: 16163
  misc_feature (15)..(15): n is either a, c, g or t
  misc_feature (94)..(94): n is either a, c, g or t
  misc_feature (100)..(100): n is either a, c, g or t
  misc_feature (162)..(162): n is either a, c, g or t
gtatatatgatttantagttgagcgatgttatagcgtttgtgtagttatatgttatgtttagattagagtagcggcgatgtggttagtagtgangatgtncgagttgatacgttacgggatgtgacgggtagttatagtcgatggcgatgatatgatttatngagtgtagtgttgtagagtagtacgcgttcggtatgatgtcgcgcgttgtgattgtatgttggcgagtgcgataggcgtagagagtcgtagcgcgtggcgataggtagtacgagtgacgagtttgagtcgtgttagagcgtagacgtggagtgcgtatagcgagtcgtacgtagtagtcgcgtgtagagtattgttgttggagcggttcggagcgtatcggtatatggtgcgaggttcgtgatgtacggtagagacgagtagcgcgagagttcgacgggatcgtgaggagtgcggacgtggagagtgtcggttgatgaggatgtgatgatagagttgtggtgcgtggcgatagagcgtgttacggggcgatatgtgggggcgagcgttgagcggtacggtgggagagattggtcgcggattagatttgtagcgtgcgggtcgtaagagagggggcgggcgaggtgcggacggtgcgaacgacggtgggacggcggtggtgcggtggaggcgtggggggatacgtgagggtatatgcggggagagacgcgattgcgagcggaattgtagcgcggtggcgtcgtagcgttgggcgcgtggtaggggggcgtgggggtgtcgcgcggagcggattgacgatcggtgcgtgacgtcggggcgggacggttggggtgcgagtaacggaggcggagaggcgggcgtcgcggcgttaggagggtaggtcgatacggtggtatgggacggcgtagtgtgggagtgatggggcgcgcggcggggggagagtcggcgaggattgcgcggggttatttgcgcgtgggggaatgcgggagggaggggtcgggcgggcgaggtggggcgggcgtaggtggggggggcggtggtagggaggtagtagggacgcgcgcggggggtaggcgggggtggcgagtcggagggacggcgagatcgt

SEQ ID NO: 16164 - DNA, 1109 bp, Artificial Sequence
  chemically treated genomic DNA (Homo sapiens) CpG-island No: 16164
  misc_feature (948)..(948): n is either a, c, g or t
  misc_feature (1010)..(1010): n is either a, c, g or t
  misc_feature (1016)..(1016): n is either a, c, g or t
  misc_feature (1095)..(1095): n is either a, c, g or t
acgatctcgccgtccctccgactcgccacccccgcctaccccccgcgcgcgtccctactacctccctaccaccgccccccccacctacgcccgccccacctcgcccgcccgacccctccctcccgcattcccccacgcgcaaataaccccgcgcaatcctcgccgactctccccccgccgcgcgccccatcactcccacactacgccgtcccataccaccgtatcgacctaccctcctaacgccgcgacgcccgcctctccgcctccgttactcgcaccccaaccgtcccgccccgacgtcacgcaccgatcgtcaatccgctccgcgcgacacccccacgcccccctaccacgcgcccaacgctacgacgccaccgcgctacaattccgctcgcaatcgcgtctctccccgcatataccctcacgtatccccccacgcctccaccgcaccaccgccgtcccaccgtcgttcgcaccgtccgcacctcgcccgccccctctcttacgacccgcacgctacaaatctaatccgcgaccaatctctcccaccgtaccgctcaacgctcgcccccacatatcgccccgtaacacgctctatcgccacgcaccacaactctatcatcacatcctcatcaaccgacactctccacgtccgcactcctcacgatcccgtcgaactctcgcgctactcgtctctaccgtacatcacgaacctcgcaccatataccgatacgctccgaaccgctccaacaacaatactctacacgcgactactacgtacgactcgctatacgcactccacgtctacgctctaacacgactcaaactcgtcactcgtactacctatcgccacgcgctacgactctctacgcctatcgcactcgccaacatacaatcacaacgcgcgacatcataccgaacgcgtactactctacaacactacactcnataaatcatatcatcgccatcgactataactacccgtcacatcccgtaacgtatcaactcgnacatcntcactactaaccacatcgccgctactctaatctaaacataacatataactacacaaacgctataacatcgctcaactantaaatcatatatac

SEQ ID NO: 16165 - DNA, 1333 bp, Artificial Sequence
  chemically treated genomic DNA (Homo sapiens) CpG-island No: 16165
  misc_feature (832)..(832): n is either a, c, g or t
gttttacgcgtttcgggtcgatatcgttagtgacgtatttacgttttttgtatatcgattcgacgttttttattattgtgcgcggttattttacgtgtttttttgttacgaagtagtcgtaagtagcgacgttagattgttttgcgacgggtatacgtatggtacggtttataatagattgtattttttacggcgcgcgcgaatttatcgttattacgttgcggttatacgttttttagcggtcgtatttgttagcgttagatttttttcgtcgttttggagttacgtgcgttttgtagttatttatttcgcgttcgtttttatatttggacgttgttatgggcgatagtttggtttttgttagtagttatttcgatatcgattcgtttacgttattcggtatagcgtattttattcgggacgtttatttcgtaacgattttagtttcgatgcgtttatgttacgttttgttcgtcgttttatttgtatacgtttattcgtcgtcgattttagtttgattattggatttagagtattgcgtgttttaattaacgcgatttattatattttttcggtgatggttatacgcgtcggagacgatatcgttttgatacgtttatttatagttatattacgcggtcgagtcgatggttagtgtattacggacgtttacgttggacgttgtttcgacgttcgtatttcgagtttttgcgtagttttttacgattcgttattcgattatagttttgttttagacgttattttaattattagttacgtgttttcgtcgtagcgtaattagtcgtatgcgttattagttttgtatacgtantatacgaagattatacgttagatttgagattttataagttcgtggtgcgttcgcgcgttacgtatagtatacgagtttttacgacgtgtacgacgtagacgtatagataagattgtgttcgttatagatatagttattgagcgtagcgtatttaacgttattgatacgcgcggtttgtacgttacgagacgtgtagttcgttaattcgtcgacgtcgttttttcgatatgttttttacgatttatttagaagtttcgaggcgtagtttttttttttgtgtttattttattttatttttgatttagatatatatttgttatacgtacgtttttttattcgcgttatttttatttttatcgtttaaaatttttatttacgaatttttaatatagagttttatgacgattattatatatttgttaatatatatacgtttagtatatttataatttatttttcgaatatattattttatatagaggaatttttttattaaatatt

SEQ ID NO: 16166 - DNA, 1333 bp, Artificial Sequence
  chemically treated genomic DNA (Homo sapiens) CpG-island No: 16166
  misc_feature (502)..(502): n is either a, c, g or t
aatatttaataaaaaaattcctctatataaaataatatattcgaaaaataaattataaatatactaaacgtatatatattaacaaatatataataatcgtcataaaactctatattaaaaattcgtaaataaaaattttaaacgataaaaataaaaataacgcgaataaaaaaacgtacgtataacaaatatatatctaaatcaaaaataaaataaaataaacacaaaaaaaaaaactacgcctcgaaacttctaaataaatcgtaaaaaacatatcgaaaaaacgacgtcgacgaattaacgaactacacgtctcgtaacgtacaaaccgcgcgtatcaataacgttaaatacgctacgctcaataactatatctataacgaacacaatcttatctatacgtctacgtcgtacacgtcgtaaaaactcgtatactatacgtaacgcgcgaacgcaccacgaacttataaaatctcaaatctaacgtataatcttcgtatantacgtatacaaaactaataacgcatacgactaattacgctacgacgaaaacacgtaactaataattaaaataacgtctaaaacaaaactataatcgaataacgaatcgtaaaaaactacgcaaaaactcgaaatacgaacgtcgaaacaacgtccaacgtaaacgtccgtaatacactaaccatcgactcgaccgcgtaatataactataaataaacgtatcaaaacgatatcgtctccgacgcgtataaccatcaccgaaaaaatataataaatcgcgttaattaaaacacgcaatactctaaatccaataatcaaactaaaatcgacgacgaataaacgtatacaaataaaacgacgaacaaaacgtaacataaacgcatcgaaactaaaatcgttacgaaataaacgtcccgaataaaatacgctataccgaataacgtaaacgaatcgatatcgaaataactactaacaaaaaccaaactatcgcccataacaacgtccaaatataaaaacgaacgcgaaataaataactacaaaacgcacgtaactccaaaacgacgaaaaaaatctaacgctaacaaatacgaccgctaaaaaacgtataaccgcaacgtaataacgataaattcgcgcgcgccgtaaaaaatacaatctattataaaccgtaccatacgtatacccgtcgcaaaacaatctaacgtcgctacttacgactacttcgtaacaaaaaaacacgtaaaataaccgcgcacaataataaaaaacgtcgaatcgatatacaaaaaacgtaaatacgtcactaacgatatcgacccgaaacgcgtaaaac

SEQ ID NO: 16167 - DNA, 1333 bp, Artificial Sequence
  chemically treated genomic DNA (Homo sapiens) CpG-island No: 16167
  misc_feature (502)..(502): n is either a, c, g or t
ggtgtttggtgggggaatttttttgtgtgaggtgatgtgttcgagaggtgggttgtgggtgtattgggcgtgtgtgtgttggtaggtgtgtggtggtcgttatggagttttatgttgggggttcgtaggtgggggttttgggcgatggaagtggaggtggcgcgggtaggagagcgtacgtgtggtagatgtatgtttgagttagagatagagtgaggtgagtatagagagagaggttgcgtttcgaggtttttagatgagtcgtggagagtatatcggagagacgacgtcgacgagttagcgagttatacgtttcgtggcgtgtagatcgcgcgtgttagtgacgttggatgcgttgcgtttagtgattgtgtttgtggcggatatagttttgtttatgcgtttacgtcgtgtacgtcgtgagaattcgtgtgttgtgcgtgacgcgcgagcgtattacgagtttgtagagttttagatttgacgtgtggttttcgtgtgntgcgtgtgtaggattggtggcgtatgcggttagttgcgttacgacgagagtacgtgattgatagttaaggtagcgtttaaggtaggattgtagtcgggtggcggatcgtgagagattacgtagagattcggggtacgagcgtcgagatagcgtttaacgtgagcgttcgtggtgtattagttatcggttcgatcgcgtagtgtggttatggatgaacgtgttagagcgatgtcgttttcgacgcgtgtgattattatcgagggagtgtgataggtcgcgttggttgggatacgtagtgttttgagtttagtgattaggttgaggtcgacggcgagtaggcgtgtgtaggtggaacggcggataaggcgtgatatggacgtatcgaggttgggatcgttgcgaggtggacgtttcggataagatgcgttgtatcgggtggcgtgggcgagtcgatgtcggagtggttgttagtagagattaggttgtcgtttatgatagcgtttagatgtaggggcggacgcggagtgggtggttatagggcgtacgtaattttaggacggcggaaggagtttgacgttgatagatgcggtcgttaggagacgtgtggtcgtagcgtggtggcggtaggttcgcgcgcgtcgtaggagatgtagtttgttgtgggtcgtgttatgcgtgtattcgtcgtagagtagtttggcgtcgttatttgcgattgtttcgtggtaggggaatacgtgagatggtcgcgtataatagtgagggacgtcgaatcgatgtgtagaggacgtaggtgcgttattggcgatgtcggttcggagcgcgtggggt

SEQ ID NO: 16168 - DNA, 1333 bp, Artificial Sequence
  chemically treated genomic DNA (Homo sapiens) CpG-island No: 16168
  misc_feature (832)..(832): n is either a, c, g or t
accccacgcgctccgaaccgacatcgccaataacgcacctacgtcctctacacatcgattcgacgtccctcactattatacgcgaccatctcacgtattcccctaccacgaaacaatcgcaaataacgacgccaaactactctacgacgaatacacgcataacacgacccacaacaaactacatctcctacgacgcgcgcgaacctaccgccaccacgctacgaccacacgtctcctaacgaccgcatctatcaacgtcaaactccttccgccgtcctaaaattacgtacgccctataaccacccactccgcgtccgcccctacatctaaacgctatcataaacgacaacctaatctctactaacaaccactccgacatcgactcgcccacgccacccgatacaacgcatcttatccgaaacgtccacctcgcaacgatcccaacctcgatacgtccatatcacgccttatccgccgttccacctacacacgcctactcgccgtcgacctcaacctaatcactaaactcaaaacactacgtatcccaaccaacgcgacctatcacactccctcgataataatcacacgcgtcgaaaacgacatcgctctaacacgttcatccataaccacactacgcgatcgaaccgataactaatacaccacgaacgctcacgttaaacgctatctcgacgctcgtaccccgaatctctacgtaatctctcacgatccgccacccgactacaatcctaccttaaacgctaccttaactatcaatcacgtactctcgtcgtaacgcaactaaccgcatacgccaccaatcctacacacgcancacacgaaaaccacacgtcaaatctaaaactctacaaactcgtaatacgctcgcgcgtcacgcacaacacacgaattctcacgacgtacacgacgtaaacgcataaacaaaactatatccgccacaaacacaatcactaaacgcaacgcatccaacgtcactaacacgcgcgatctacacgccacgaaacgtataactcgctaactcgtcgacgtcgtctctccgatatactctccacgactcatctaaaaacctcgaaacgcaacctctctctctatactcacctcactctatctctaactcaaacatacatctaccacacgtacgctctcctacccgcgccacctccacttccatcgcccaaaacccccacctacgaacccccaacataaaactccataacgaccaccacacacctaccaacacacacacgcccaatacacccacaacccacctctcgaacacatcacctcacacaaaaaaattcccccaccaaacacc

SEQ ID NO: 16169 - DNA, 1447 bp, Artificial Sequence
  chemically treated genomic DNA (Homo sapiens) CpG-island No: 16169
acgagatcgcgatttttataatagatatttcgtcgtttaattttaattttatatagagtttatatatttgttattcgattcgttgtttaaatcgattagggatacgacgttgtacggttattgggacgtttcgattaattttttaggtgttttagttataagattatatatattaatatttatttcgaatcgtatcgagttatttgatacgtttcgcgatcgattaattggcggttgttataattttagacgcggcgttatttcgtttaagaatagatatgcgtttatagttatattgtgtaatattattcgtttcgaatttatatatatcggtattacgttatattattaggtagacgtgcgtatagttacgtagtcgattatttcgttaatattgtttatagttatttcgtgagagagtatcgagtacgagtattgtacgcgaattcgttgtattttgagtgtagttatagcgcgttgatttttatagtacgcgttacgtgtacgtagatttaattagttgagcgcgattattcgaatcgcgcgacgtatatcgtatagattacgattgtacgttggtatttatacgagtattaatagtcgattttcgttaacgcgtcgtcgtacgttgtgtcgtgacgtggtatatttgtagtagcgatgttgcgaatttaacgattcgtgttagttagatgagtttacgataattacgttttataagcgcgatatcgttatagagatttagattagtagatttgtggttcgcgtatgatttttatattgacgcgattatagtatatatatcgtgcgagaagttattatgcgattttatagtcggacgcgtgttgtagtcgtgtttatcgcgcgacgtgcgagatataaatatagttgagtgtaggttatagtcgttgagtatcgatagcgttgacgatacgtatttcgaacgtgatgcgatgtgtatagtatacgttagttaagcgtttatttcgtcgtaagttagttgtgttacgcgagtagattattatatttatatatttattattgcgatcgtcgtacgtcggattgatattttatagtagtttattagtgtcgttatattttagtagtttacgtagtatatgttttaacgttattatatttttcgtttttacgttgtgtttttgcgtttattttacgacggttttttagttacgatattatatttatagagatggtttttattacgatgggtttcgtttaagaaattacgtttttttgttgtttttattatattttttacgatttttaattattatttttttttttagttcgttttagatcgtttttttttttttcgcggggggggtttttcgaaaaaaaatttttttaaaaatatattgggggcggttttttaaaaaataatttttttttttttttttttatttttcgcgttatatcgttttatacg

SEQ ID NO: 16170 - DNA, 1447 bp, Artificial Sequence
  chemically treated genomic DNA (Homo sapiens) CpG-island No: 16170
cgtataaaacgatataacgcgaaaaataaaaaaaaaaaaaaaaaaattattttttaaaaaaccgcccccaatatatttttaaaaaaattttttttcgaaaaaccccccccgcgaaaaaaaaaaaaacgatctaaaacgaactaaaaaaaaaaataataattaaaaatcgtaaaaaatataataaaaacaacaaaaaaacgtaatttcttaaacgaaacccatcgtaataaaaaccatctctataaatataatatcgtaactaaaaaaccgtcgtaaaataaacgcaaaaacacaacgtaaaaacgaaaaatataataacgttaaaacatatactacgtaaactactaaaatataacgacactaataaactactataaaatatcaatccgacgtacgacgatcgcaataataaatatataaatataataatctactcgcgtaacacaactaacttacgacgaaataaacgcttaactaacgtatactatacacatcgcatcacgttcgaaatacgtatcgtcaacgctatcgatactcaacgactataacctacactcaactatatttatatctcgcacgtcgcgcgataaacacgactacaacacgcgtccgactataaaatcgcataataacttctcgcacgatatatatactataatcgcgtcaatataaaaatcatacgcgaaccacaaatctactaatctaaatctctataacgatatcgcgcttataaaacgtaattatcgtaaactcatctaactaacacgaatcgttaaattcgcaacatcgctactacaaatataccacgtcacgacacaacgtacgacgacgcgttaacgaaaatcgactattaatactcgtataaataccaacgtacaatcgtaatctatacgatatacgtcgcgcgattcgaataatcgcgctcaactaattaaatctacgtacacgtaacgcgtactataaaaatcaacgcgctataactacactcaaaatacaacgaattcgcgtacaatactcgtactcgatactctctcacgaaataactataaacaatattaacgaaataatcgactacgtaactatacgcacgtctacctaataatataacgtaataccgatatatataaattcgaaacgaataatattacacaatataactataaacgcatatctattcttaaacgaaataacgccgcgtctaaaattataacaaccgccaattaatcgatcgcgaaacgtatcaaataactcgatacgattcgaaataaatattaatatatataatcttataactaaaacacctaaaaaattaatcgaaacgtcccaataaccgtacaacgtcgtatccctaatcgatttaaacaacgaatcgaataacaaatatataaactctatataaaattaaaattaaacgacgaaatatctattataaaaatcgcgatctcgt

SEQ ID NO: 16171 - DNA, 1447 bp, Artificial Sequence
  chemically treated genomic DNA (Homo sapiens) CpG-island No: 16171
cgtgtgaggcggtgtggcgcggagggtggggaaaaaaagaggggggttgttttttaaaaaatcgtttttaatatatttttgggggggttttttttcggggggtttttttcgcgggaggggagggggcgatttggggcgggttgaaaaaaagggtagtggttggaggtcgtaaaaaatgtggtggggataataaagaggcgtggttttttggacggggtttatcgtagtgggagttatttttgtgggtgtgatatcgtgattaggggatcgtcgtgaggtgagcgtaagagtatagcgtaggagcgaggggtgtggtagcgttggagtatgtgttgcgtaggttgttagagtgtagcggtattggtgagttgttatgagatattagttcggcgtgcgacggtcgtagtagtggatgtgtgggtgtgatgatttgttcgcgtgatataattggtttgcggcgagatgagcgtttagttagcgtgtgttatgtatatcgtattacgttcggagtacgtgtcgttagcgttgtcgatgtttagcgattgtgatttgtatttagttgtgtttgtgtttcgtacgtcgcgcgatgagtacggttgtagtacgcgttcgattgtgaggtcgtatggtagtttttcgtacgatgtgtgtgttgtgatcgcgttagtgtgaagattatgcgcgagttataggtttgttgatttgagtttttgtggcgatgtcgcgtttgtgaggcgtgattgtcgtgggtttatttggttggtacggatcgttgaattcgtagtatcgttgttgtagatgtgttacgttacgatatagcgtacgacggcgcgttggcgagggtcggttgttgatgttcgtgtgagtattagcgtgtaatcgtgatttgtgcgatgtgcgtcgcgcgattcgagtggtcgcgtttagttggttgagtttacgtgtacgtagcgcgtgttgtggaagttaacgcgttgtagttgtatttagagtgtagcggattcgcgtgtagtgttcgtattcggtgtttttttacggaatggttgtgggtagtgttgacggggtggtcggttgcgtggttgtgcgtacgtttgtttgatggtgtggcgtggtgtcggtatgtgtgggttcggggcgagtggtgttgtatagtgtgattataggcgtatgtttgtttttagacggggtggcgtcgcgtttgggattgtggtagtcgttagttggtcggtcgcgggacgtgttaggtgattcgatgcggttcggggtgggtgttggtgtatgtggttttgtggttggggtatttggagggttgatcgggacgttttagtggtcgtgtagcgtcgtgtttttggtcggtttgggtagcgggtcgggtggtagatgtgtgggttttgtgtggagttggggttgggcggcgggatgtttgttgtggggatcgcggtttcgt

SEQ ID NO: 16172 - DNA, 1447 bp, Artificial Sequence
  chemically treated genomic DNA (Homo sapiens) CpG-island No: 16172
acgaaaccgcgatccccacaacaaacatcccgccgcccaaccccaactccacacaaaacccacacatctaccacccgacccgctacccaaaccgaccaaaaacacgacgctacacgaccactaaaacgtcccgatcaaccctccaaataccccaaccacaaaaccacatacaccaacacccaccccgaaccgcatcgaatcacctaacacgtcccgcgaccgaccaactaacgactaccacaatcccaaacgcgacgccaccccgtctaaaaacaaacatacgcctataatcacactatacaacaccactcgccccgaacccacacataccgacaccacgccacaccatcaaacaaacgtacgcacaaccacgcaaccgaccaccccgtcaacactacccacaaccattccgtaaaaaaacaccgaatacgaacactacacgcgaatccgctacactctaaatacaactacaacgcgttaacttccacaacacgcgctacgtacacgtaaactcaaccaactaaacgcgaccactcgaatcgcgcgacgcacatcgcacaaatcacgattacacgctaatactcacacgaacatcaacaaccgaccctcgccaacgcgccgtcgtacgctatatcgtaacgtaacacatctacaacaacgatactacgaattcaacgatccgtaccaaccaaataaacccacgacaatcacgcctcacaaacgcgacatcgccacaaaaactcaaatcaacaaacctataactcgcgcataatcttcacactaacgcgatcacaacacacacatcgtacgaaaaactaccatacgacctcacaatcgaacgcgtactacaaccgtactcatcgcgcgacgtacgaaacacaaacacaactaaatacaaatcacaatcgctaaacatcgacaacgctaacgacacgtactccgaacgtaatacgatatacataacacacgctaactaaacgctcatctcgccgcaaaccaattatatcacgcgaacaaatcatcacacccacacatccactactacgaccgtcgcacgccgaactaatatctcataacaactcaccaataccgctacactctaacaacctacgcaacacatactccaacgctaccacacccctcgctcctacgctatactcttacgctcacctcacgacgatcccctaatcacgatatcacacccacaaaaataactcccactacgataaaccccgtccaaaaaaccacgcctctttattatccccaccacattttttacgacctccaaccactaccctttttttcaacccgccccaaatcgccccctcccctcccgcgaaaaaaaccccccgaaaaaaaacccccccaaaaatatattaaaaacgattttttaaaaaacaacccccctctttttttccccaccctccgcgccacaccgcctcacacg

SEQ ID NO: 16173 - DNA, 509 bp, Artificial Sequence
  chemically treated genomic DNA (Homo sapiens) CpG-island No: 16173
gtcgtcgtcgtcgcgttttttatatttgtattgttagtagtagtaatagagttaggataagttcgtgttcgtttttcgcgtttttttcgtatttttattattattcgtatttcgcgtattagtagtcggttagcggcggtagtagtttatgttttcggtgtaatagttgcgtttttttcggtgtttcggcggcgggggcgggagataatttgtttttgttgtttcgtattttttcgttcggcggcgtttttcggattcgtattttttcgtcgttgtcgggttcgttttgttgttgttgttgttgttcgtcgcgtcggggtagttagtttaatgtgagcgagttgacgtcgtttagttatgttagtgcgtttcggtagtagtacgcgtagtagttcgcgtagtagtcggcgttcgttttttagtattattagtgttatagtttgtagttcgtcgttagttttacgggtagtttcggtagtttgggtttcgggttttcgttttcgtattat

SEQ ID NO: 16174 - DNA, 509 bp, Artificial Sequence
  chemically treated genomic DNA (Homo sapiens) CpG-island No: 16174
ataatacgaaaacgaaaacccgaaacccaaactaccgaaactacccgtaaaactaacgacgaactacaaactataacactaataatactaaaaaacgaacgccgactactacgcgaactactacgcgtactactaccgaaacgcactaacataactaaacgacgtcaactcgctcacattaaactaactaccccgacgcgacgaacaacaacaacaacaacaaaacgaacccgacaacgacgaaaaaatacgaatccgaaaaacgccgccgaacgaaaaaatacgaaacaacaaaaacaaattatctcccgcccccgccgccgaaacaccgaaaaaaacgcaactattacaccgaaaacataaactactaccgccgctaaccgactactaatacgcgaaatacgaataataataaaaatacgaaaaaaacgcgaaaaacgaacacgaacttatcctaactctattactactactaacaatacaaatataaaaaacgcgacgacgacgac

SEQ ID NO: 16175 - DNA, 509 bp, Artificial Sequence
  chemically treated genomic DNA (Homo sapiens) CpG-island No: 16175
gtggtgcgagagcgggggttcggagtttagattgtcgaggttgttcgtggggttggcggcgggttgtaggttgtggtattggtggtattgggaggcggacgtcgattgttgcgcggattgttgcgcgtattgttgtcggagcgtattggtatggttggacggcgttagttcgtttatattgagttggttgtttcggcgcgacgagtagtagtagtagtagtaggacgagttcgatagcggcgaggaggtgcgggttcggaaggcgtcgtcgggcgaggaggtgcggagtagtagggataggttatttttcgttttcgtcgtcggggtatcggaggaggcgtagttgttgtatcggaggtatgggttgttgtcgtcgttggtcggttgttggtgcgcgaggtgcgggtggtggtgagggtgcgggaggggcgcgaagggcgggtacgggtttgttttggttttgttgttgttgttggtaatgtaggtgtgaggagcgcggcggcggcggt

SEQ ID NO: 16176 - DNA, 509 bp, Artificial Sequence
  chemically treated genomic DNA (Homo sapiens) CpG-island No: 16176
accgccgccgccgcgctcctcacacctacattaccaacaacaacaacaaaaccaaaacaaacccgtacccgcccttcgcgcccctcccgcaccctcaccaccacccgcacctcgcgcaccaacaaccgaccaacgacgacaacaacccatacctccgatacaacaactacgcctcctccgataccccgacgacgaaaacgaaaaataacctatccctactactccgcacctcctcgcccgacgacgccttccgaacccgcacctcctcgccgctatcgaactcgtcctactactactactactactcgtcgcgccgaaacaaccaactcaatataaacgaactaacgccgtccaaccataccaatacgctccgacaacaatacgcgcaacaatccgcgcaacaatcgacgtccgcctcccaataccaccaataccacaacctacaacccgccgccaaccccacgaacaacctcgacaatctaaactccgaacccccgctctcgcaccac

SEQ ID NO: 16177 - DNA, 654 bp, Artificial Sequence
  chemically treated genomic DNA (Homo sapiens) CpG-island No: 16177
tattcgtattcggcgtattattagtattattagttttaggcgcgtcgcgagagtaatttttttatcgaaatagttatgagtagttgtaggtataacgggggcgttatgcggtcgtttagtaatttgagcgcgtttcgtcggaatttttacgagatggatttagaggcgtagtttttgtagtttttcgcgtttgtcggaggaggtggcggcgcgtttttttcgtttgtagtcgttgtcgtcgtcgtcgtcgttgtttcgtttttagttttcgagatcgtggtgtttaagttcgagtataataattttaataatttggcgttttatggaatcggcggcggaggtagtattggaggaggcggcggcggtggcgggagcgggtacggtagtagtagtggtattaagtttagtaaaaagaaaaattagaatatcggttataagttgggttatcggcgcgttttgttcgaaaagcgtaagcggtttagcgattacgcgtttattttcggtatgttcggtatcgtggttatggttatcgagatcgagttgtcgtggggcgtttacgataaggtataggtttgaattttagtttacgttatcggagtcgggtattgggtggttgggatgggtattggcggggattttttgcgtgcggatttt

SEQ ID NO: 16178 - DNA, 654 bp, Artificial Sequence
  chemically treated genomic DNA (Homo sapiens) CpG-island No: 16178
aaaatccgcacgcaaaaaatccccgccaatacccatcccaaccacccaatacccgactccgataacgtaaactaaaattcaaacctataccttatcgtaaacgccccacgacaactcgatctcgataaccataaccacgataccgaacataccgaaaataaacgcgtaatcgctaaaccgcttacgcttttcgaacaaaacgcgccgataacccaacttataaccgatattctaatttttctttttactaaacttaataccactactactaccgtacccgctcccgccaccgccgccgcctcctccaatactacctccgccgccgattccataaaacgccaaattattaaaattattatactcgaacttaaacaccacgatctcgaaaactaaaaacgaaacaacgacgacgacgacgacaacgactacaaacgaaaaaaacgcgccgccacctcctccgacaaacgcgaaaaactacaaaaactacgcctctaaatccatctcgtaaaaattccgacgaaacgcgctcaaattactaaacgaccgcataacgcccccgttatacctacaactactcataactatttcgataaaaaaattactctcgcgacgcgcctaaaactaataatactaataatacgccgaatacgaata

SEQ ID NO: 16179 - DNA, 654 bp, Artificial Sequence
  chemically treated genomic DNA (Homo sapiens) CpG-island No: 16179
gggattcgtacgtaaagggttttcgttagtgtttattttaattatttagtgttcgatttcggtagcgtgggttggggtttaagtttgtattttgtcgtaggcgttttacgatagttcggtttcgatgattatgattacgatgtcgaatatgtcgaagatgagcgcgtagtcgttgagtcgtttgcgtttttcgaatagggcgcgtcggtggtttagtttgtagtcgatgttttggtttttttttttgttggatttggtgttattgttgttgtcgtgttcgttttcgttatcgtcgtcgttttttttagtgttgttttcgtcgtcggttttatagagcgttaggttgttggagttgttgtgttcgggtttagatattacgatttcgggggttgaggacgaaatagcggcggcggcggcggtagcggttgtagacggggaggacgcgtcgttatttttttcgatagacgcggggggttgtaggggttgcgtttttgagtttatttcgtggaggtttcggcgggacgcgtttaagttgttgagcggtcgtatgacgttttcgttgtatttgtagttgtttatggttatttcggtgaaggggttgttttcgcggcgcgtttggggttggtggtgttggtggtgcgtcgggtgcgggtg

SEQ ID NO: 16180 - DNA, 654 bp, Artificial Sequence
  chemically treated genomic DNA (Homo sapiens) CpG-island No: 16180
cacccgcacccgacgcaccaccaacaccaccaaccccaaacgcgccgcgaaaacaaccccttcaccgaaataaccataaacaactacaaatacaacgaaaacgtcatacgaccgctcaacaacttaaacgcgtcccgccgaaacctccacgaaataaactcaaaaacgcaacccctacaaccccccgcgtctatcgaaaaaaataacgacgcgtcctccccgtctacaaccgctaccgccgccgccgccgctatttcgtcctcaacccccgaaatcgtaatatctaaacccgaacacaacaactccaacaacctaacgctctataaaaccgacgacgaaaacaacactaaaaaaaacgacgacgataacgaaaacgaacacgacaacaacaataacaccaaatccaacaaaaaaaaaaaccaaaacatcgactacaaactaaaccaccgacgcgccctattcgaaaaacgcaaacgactcaacgactacgcgctcatcttcgacatattcgacatcgtaatcataatcatcgaaaccgaactatcgtaaaacgcctacgacaaaatacaaacttaaaccccaacccacgctaccgaaatcgaacactaaataattaaaataaacactaacgaaaaccctttacgtacgaatccc

SEQ ID NO: 16181 - DNA, 576 bp, Artificial Sequence
  chemically treated genomic DNA (Homo sapiens) CpG-island No: 16181
tttgacgttatcgaatttgcggcgtttgtaatcggtaaagtatacgttattaaattttattataacgtgggcggtttgtcgaaagagatgaagatgggtttggttgaatcgttgaaagagttgtttaaagacgaagtgcgtaagattggtttggagttgggtttgtcgtacgatatgttgtatcgttattcgttttcgggattaggttttggcgttcgtgttttgggtgaagtgaagaaagagtattgtgatttgttgcgtcgtgttgacgttatttttattgaagaattgcgtaaagcggatttgtacgataaagttagttaggcgtttattgtgtttttgtcggtacgtttcgttggcgtaatgggcgatggtcgtaagtatgattgggttgtttttttgcgtgttgtcgaaattatcgattttatgatcgtatattgggcgtatttgtcgtacgattttttcggtcgcgtttttaatcgtattattaatgaagtgaacggtatttttcgcgtggtgtatgatattagcggtaagtcgttagttattattgagtgggaatgatttgattttgta

SEQ ID NO: 16182 - DNA, 576 bp, Artificial Sequence
  chemically treated genomic DNA (Homo sapiens) CpG-island No: 16182
tacaaaatcaaatcattcccactcaataataactaacgacttaccgctaatatcatacaccacgcgaaaaataccgttcacttcattaataatacgattaaaaacgcgaccgaaaaaatcgtacgacaaatacgcccaatatacgatcataaaatcgataatttcgacaacacgcaaaaaaacaacccaatcatacttacgaccatcgcccattacgccaacgaaacgtaccgacaaaaacacaataaacgcctaactaactttatcgtacaaatccgctttacgcaattcttcaataaaaataacgtcaacacgacgcaacaaatcacaatactctttcttcacttcacccaaaacacgaacgccaaaacctaatcccgaaaacgaataacgatacaacatatcgtacgacaaacccaactccaaaccaatcttacgcacttcgtctttaaacaactctttcaacgattcaaccaaacccatcttcatctctttcgacaaaccgcccacgttataataaaatttaataacgtatactttaccgattacaaacgccgcaaattcgataacgtcaaa

SEQ ID NO: 16183 - DNA, 576 bp, Artificial Sequence
  chemically treated genomic DNA (Homo sapiens) CpG-island No: 16183
tgtagggttaaattatttttatttaatggtagttggcggtttgtcgttgatgttatatattacgcgggaaatatcgtttattttattgataatgcggttggaaacgcgatcgaggaaatcgtacggtagatgcgtttagtgtgcggttataaagtcgatggtttcgatagtacgtagagagataatttagttatatttacgattatcgtttattacgttaacggaacgtatcggtaggaatatagtgaacgtttggttgattttgtcgtataggttcgttttacgtagttttttaatgaagatggcgttagtacggcgtagtaggttatagtattttttttttattttatttagaatacgaacgttaaggtttggtttcgggaacgggtgacggtatagtatgtcgtacggtaggtttagttttagattaattttacgtatttcgtttttgaatagtttttttagcggtttaattaggtttatttttatttttttcggtaggtcgtttacgttgtggtgagatttgatgacgtgtgttttatcggttgtagacgtcgtagattcgataacgttagg

SEQ ID NO: 16184 - DNA, 576 bp, Artificial Sequence
  chemically treated genomic DNA (Homo sapiens) CpG-island No: 16184
cctaacgttatcgaatctacgacgtctacaaccgataaaacacacgtcatcaaatctcaccacaacgtaaacgacctaccgaaaaaaataaaaataaacctaattaaaccgctaaaaaaactattcaaaaacgaaatacgtaaaattaatctaaaactaaacctaccgtacgacatactataccgtcacccgttcccgaaaccaaaccttaacgttcgtattctaaataaaataaaaaaaaaatactataacctactacgccgtactaacgccatcttcattaaaaaactacgtaaaacgaacctatacgacaaaatcaaccaaacgttcactatattcctaccgatacgttccgttaacgtaataaacgataatcgtaaatataactaaattatctctctacgtactatcgaaaccatcgactttataaccgcacactaaacgcatctaccgtacgatttcctcgatcgcgtttccaaccgcattatcaataaaataaacgatatttcccgcgtaatatataacatcaacgacaaaccgccaactaccattaaataaaaataatttaaccctaca

SEQ ID NO: 16185 - DNA, 1437 bp, Artificial Sequence
  chemically treated genomic DNA (Homo sapiens) CpG-island No: 16185
attgtttacgcgtattgcggaaaatgcgtatttatgggttattttcgttttagtttttcggatgttaggagttgttgatagtacggaaaatacgtttcgggtgcggtattataatggtgattcgattatttttagtcgtgattgtcgtaatatcgttcggtgaatcgttcgggttagtcgggtaggttttagtgattttgtcgaagttatcgatatagcgtagtgttattagttttttgttttttagtgtcgttagatgcgtcgtattacgtatttttacgcgttttttattatgagagatagtaatcggtatttgcgagtttaatattttttgtaatagtagagacgggttttgggttattttaattaggttgaaacgcgttttaaagcgatcggaggtattgcgtataaaacgtggttataatttattatttgggattagtttacgtagattagatattatttggtaatcgttatatatttttagcgttagcgtttgcggacggtggaagaaggttgtaaatttatcgcgtatacggttattgaataggattgatttcgtttaatttttatcggtatttagtatattatcgtaggagaaattatcgtacgcgattagggcgtggaaattttttaggttcgtgcgttcggttagtaggttatttatatgtacgtcgatagtattaaagtttgtacggtggaaagttgtcgttattttaatatgcgagtttacgttttgtttacgtagtacggtaattttcggacgtgcgttagtggtaatatacggtgttgttatattttcgttgatatcgaacgatagttttatatttaggttcggatcggcgtcgttagatttcgtttgatgtttttgatcggtatatttcgggttgttacgtaggcgttgtatttgttaggtagtttttgtttattagatacgtaacgtggtgcggttttcgttgaatatagtttgttcgttggcggtaattataaaacggttatcggaaatcgtttgttttatataatggatataattagtaagtttatgttgtgttagtacggattcgatcgttttacggttagcggtacgaatttgaattatcgtatttagtttttcgttaaataacgtcgttaggcgatcgttatttagagtggcgatattcgcgttaatgttataatgattagtaaaggttattttcgttagcgttattagtaggtcgttattagagcggtcgtgatacgttagtagtttacgttgtgtaattagcgtttgaatcgcgttatagaagttttttagttgcgcgatatcgcgtatatttgtcggtttgtcgttaagttgacgataaatttgcgttagcgtcgttgcgtttagcgcgttattgtttttgtttaaattaattagtagtagtgcgtattttcggtagaaagttgcggcgtgat

SEQ ID NO: 16186 - DNA, 1437 bp, Artificial Sequence
  chemically treated genomic DNA (Homo sapiens) CpG-island No: 16186
atcacgccgcaactttctaccgaaaatacgcactactactaattaatttaaacaaaaacaataacgcgctaaacgcaacgacgctaacgcaaatttatcgtcaacttaacgacaaaccgacaaatatacgcgatatcgcgcaactaaaaaacttctataacgcgattcaaacgctaattacacaacgtaaactactaacgtatcacgaccgctctaataacgacctactaataacgctaacgaaaataacctttactaatcattataacattaacgcgaatatcgccactctaaataacgatcgcctaacgacgttatttaacgaaaaactaaatacgataattcaaattcgtaccgctaaccgtaaaacgatcgaatccgtactaacacaacataaacttactaattatatccattatataaaacaaacgatttccgataaccgttttataattaccgccaacgaacaaactatattcaacgaaaaccgcaccacgttacgtatctaataaacaaaaactacctaacaaatacaacgcctacgtaacaacccgaaatataccgatcaaaaacatcaaacgaaatctaacgacgccgatccgaacctaaatataaaactatcgttcgatatcaacgaaaatataacaacaccgtatattaccactaacgcacgtccgaaaattaccgtactacgtaaacaaaacgtaaactcgcatattaaaataacgacaactttccaccgtacaaactttaatactatcgacgtacatataaataacctactaaccgaacgcacgaacctaaaaaatttccacgccctaatcgcgtacgataatttctcctacgataatatactaaataccgataaaaattaaacgaaatcaatcctattcaataaccgtatacgcgataaatttacaaccttcttccaccgtccgcaaacgctaacgctaaaaatatataacgattaccaaataatatctaatctacgtaaactaatcccaaataataaattataaccacgttttatacgcaatacctccgatcgctttaaaacgcgtttcaacctaattaaaataacccaaaacccgtctctactattacaaaaaatattaaactcgcaaataccgattactatctctcataataaaaaacgcgtaaaaatacgtaatacgacgcatctaacgacactaaaaaacaaaaaactaataacactacgctatatcgataacttcgacaaaatcactaaaacctacccgactaacccgaacgattcaccgaacgatattacgacaatcacgactaaaaataatcgaatcaccattataataccgcacccgaaacgtattttccgtactatcaacaactcctaacatccgaaaaactaaaacgaaaataacccataaatacgcattttccgcaatacgcgtaaacaat

SEQ ID NO: 16187 - DNA, 1437 bp, Artificial Sequence
  chemically treated genomic DNA (Homo sapiens) CpG-island No: 16187
attacgtcgtagttttttatcgaagatacgtattgttgttgattgatttgggtaaaggtaataacgcgttgggcgtaacggcgttggcgtaggtttatcgttagtttggcgataaatcggtagatgtacgcgatgtcgcgtaattgaaaggtttttatgacgcgatttaggcgttggttgtatagcgtaagttgttggcgtattacgatcgttttgatggcggtttgttggtaacgttggcggaaatggtttttgttggttattgtggtattgacgcggatatcgttattttgggtgacgatcgtttggcggcgttgtttaacgaagaattgggtgcggtgatttaggttcgtgtcgttgatcgtgaagcggtcgagttcgtattggtatagtatgggtttgttgattgtgtttattatgtagggtaggcggttttcggtgatcgttttgtgattatcgttaacgggtagattgtatttagcgaaagtcgtattacgttgcgtgtttggtgggtagaaattatttggtagatgtagcgtttgcgtgataattcggagtgtgtcgattaggagtattaggcgaaatttaacgacgtcgattcgggtttgaatgtaaaattgtcgttcgatattaacgaagatgtggtagtatcgtatattgttattggcgtacgttcgaaagttgtcgtattgcgtgagtagggcgtgaattcgtatgttgaaatggcggtagttttttatcgtgtaggttttgatgttatcgacgtgtatatgagtgatttgttgatcggacgtacgggtttggaagatttttacgttttggtcgcgtgcggtggttttttttacggtgatgtgttgggtgtcggtgaaggttgggcgaagttaattttgtttaatgatcgtgtacgcgatgagtttgtaatttttttttatcgttcgtaaacgttggcgttgggggtatgtaacggttgttagatgatgtttaatttgcgtgaattgattttaggtagtgagttgtggttacgttttgtgcgtaatattttcgatcgttttgaagcgcgttttagtttggttgaagtaatttaaagttcgtttttgttgttgtaggggatgttgggttcgtaaatgtcgattgttgttttttatggtgaagggcgcgtggaagtgcgtgatgcggcgtatttggcggtattggaaagtaaagggttggtggtattgcgttatgtcgataatttcggtaaagttattgaaatttattcggttaattcgaacggtttatcgaacggtattacggtagttacgattgaaagtggtcgagttattattatgatgtcgtattcggaacgtgtttttcgtattgttagtaatttttggtattcggaaaattggggcgaggatggtttatggatgcgtatttttcgtaatgcgcgtaagtagt

SEQ ID NO: 16188 - DNA, 1437 bp, Artificial Sequence
  chemically treated genomic DNA (Homo sapiens) CpG-island No: 16188
actacttacgcgcattacgaaaaatacgcatccataaaccatcctcgccccaattttccgaataccaaaaattactaacaatacgaaaaacacgttccgaatacgacatcataataataactcgaccactttcaatcgtaactaccgtaataccgttcgataaaccgttcgaattaaccgaataaatttcaataactttaccgaaattatcgacataacgcaataccaccaaccctttactttccaataccgccaaatacgccgcatcacgcacttccacgcgcccttcaccataaaaaacaacaatcgacatttacgaacccaacatcccctacaacaacaaaaacgaactttaaattacttcaaccaaactaaaacgcgcttcaaaacgatcgaaaatattacgcacaaaacgtaaccacaactcactacctaaaatcaattcacgcaaattaaacatcatctaacaaccgttacatacccccaacgccaacgtttacgaacgataaaaaaaaattacaaactcatcgcgtacacgatcattaaacaaaattaacttcgcccaaccttcaccgacacccaacacatcaccgtaaaaaaaaccaccgcacgcgaccaaaacgtaaaaatcttccaaacccgtacgtccgatcaacaaatcactcatatacacgtcgataacatcaaaacctacacgataaaaaactaccgccatttcaacatacgaattcacgccctactcacgcaatacgacaactttcgaacgtacgccaataacaatatacgatactaccacatcttcgttaatatcgaacgacaattttacattcaaacccgaatcgacgtcgttaaatttcgcctaatactcctaatcgacacactccgaattatcacgcaaacgctacatctaccaaataatttctacccaccaaacacgcaacgtaatacgactttcgctaaatacaatctacccgttaacgataatcacaaaacgatcaccgaaaaccgcctaccctacataataaacacaatcaacaaacccatactataccaatacgaactcgaccgcttcacgatcaacgacacgaacctaaatcaccgcacccaattcttcgttaaacaacgccgccaaacgatcgtcacccaaaataacgatatccgcgtcaataccacaataaccaacaaaaaccatttccgccaacgttaccaacaaaccgccatcaaaacgatcgtaatacgccaacaacttacgctatacaaccaacgcctaaatcgcgtcataaaaacctttcaattacgcgacatcgcgtacatctaccgatttatcgccaaactaacgataaacctacgccaacgccgttacgcccaacgcgttattacctttacccaaatcaatcaacaacaatacgtatcttcgataaaaaactacgacgtaat

SEQ ID NO: 16189 - DNA, 884 bp, Artificial Sequence
  chemically treated genomic DNA (Homo sapiens) CpG-island No: 16189
atcgtgcggaatatgtagcgtcgcgttcggttgatgcgttatcgcgtggtataatttaagattcgtattggaaaacgttattttcgttatatatgaagttagtaatatgttttcgcgcgcggtaaggtcgtgatcgtagtttatcgttttcggtagcgatttgttaattatcgtaatggtattaatcgttagattgtcggtaaacggtgtagcgtttagggcgttgtatgttttaatggtatgggttaacgtattaatgtcggttatcgtcgtgatatgcgacggtatattttcggttaatgcggcgtcgaggatcgttatattcggtattagcgaggtatgggttaatatttgtttgcgttcgtttatcgcgtcgataattatcgttatattggtggttttagagtcggtttcggcggtagttggaatggtaattagcggtaagcgcggttgtagaacgttggtttttgatatttttgttagcgtgttattcgggttcgttattagtaacgttacggttttcgtcgtatttagtatcgagtcgtcgttaaacgcgattattttattatagtttgatttacgtaattgcgttacggttgtatatacgtcggtaatgtacggttcgtttatcggatatggttagagcgttatggcgatatttttaacggttaggttacgcgttagttcggcggttatttttgtttgatgtaaaaagttgtttgttattacgaatagatgttttagtttacgcgtttgcgtttgttgttcgtaattgtttatcgagttcggatcgtaaagcgttatcggtggaacgttaaatgtttttattcgttgtagatttagggtatcgaacgtttgaaagagcgcggtttgtaatttatttt

SEQ ID NO: 16190 - DNA, 884 bp, Artificial Sequence
  chemically treated genomic DNA (Homo sapiens) CpG-island No: 16190
aaaataaattacaaaccgcgctctttcaaacgttcgataccctaaatctacaacgaataaaaacatttaacgttccaccgataacgctttacgatccgaactcgataaacaattacgaacaacaaacgcaaacgcgtaaactaaaacatctattcgtaataacaaacaactttttacatcaaacaaaaataaccgccgaactaacgcgtaacctaaccgttaaaaatatcgccataacgctctaaccatatccgataaacgaaccgtacattaccgacgtatatacaaccgtaacgcaattacgtaaatcaaactataataaaataatcgcgtttaacgacgactcgatactaaatacgacgaaaaccgtaacgttactaataacgaacccgaataacacgctaacaaaaatatcaaaaaccaacgttctacaaccgcgcttaccgctaattaccattccaactaccgccgaaaccgactctaaaaccaccaatataacgataattatcgacgcgataaacgaacgcaaacaaatattaacccatacctcgctaataccgaatataacgatcctcgacgccgcattaaccgaaaatataccgtcgcatatcacgacgataaccgacattaatacgttaacccataccattaaaacatacaacgccctaaacgctacaccgtttaccgacaatctaacgattaataccattacgataattaacaaatcgctaccgaaaacgataaactacgatcacgaccttaccgcgcgcgaaaacatattactaacttcatatataacgaaaataacgttttccaatacgaatcttaaattataccacgcgataacgcatcaaccgaacgcgacgctacatattccgcacgat

SEQ ID NO: 16191 - DNA, 884 bp, Artificial Sequence
  chemically treated genomic DNA (Homo sapiens) CpG-island No: 16191
aaaatgaattgtagatcgcgtttttttaggcgttcgatattttgaatttgtaacgggtaaaaatatttagcgttttatcggtgacgttttgcggttcgggttcggtgagtagttgcggatagtaagcgtaaacgcgtgggttgaaatatttgttcgtgatggtagatagttttttgtattaggtagggatgatcgtcgggttgacgcgtagtttgatcgttaaaggtatcgttatgacgttttggttatgttcggtgggcgaatcgtgtattatcgacgtgtgtgtagtcgtggcgtagttgcgtgagttaggttgtgatggggtgatcgcgtttggcggcggttcggtgttggatgcggcgaaagtcgtgacgttgttggtgacgaattcggatagtacgttggtagagatgttagaaattagcgttttgtaatcgcgtttgtcgttgattgttattttaattatcgtcggaatcggttttgaaattattaatgtaacggtgattatcgacgcggtgagcgggcgtaagtaggtgttagtttatgtttcgttgatgtcggatgtggcgattttcgacgtcgtattgatcgaaggtgtgtcgtcgtatgttacggcgatgatcggtattgatgcgttaatttatgttattgaagtatatagcgttttgaacgttatatcgtttatcgatagtttggcgattggtgttattgcgatgattggtaaatcgttgtcgaaagcggtgggttacggttacgattttgtcgcgcgcgagagtatgttgttggttttatgtatggcgggaatggcgttttttagtgcgggttttgggttgtgttacgcgatggcgtattagtcgggcgcggcgttgtatatttcgtacggt

SEQ ID NO: 16192 - DNA, 884 bp, Artificial Sequence
  chemically treated genomic DNA (Homo sapiens) CpG-island No: 16192
accgtacgaaatatacaacgccgcgcccgactaatacgccatcgcgtaacacaacccaaaacccgcactaaaaaacgccattcccgccatacataaaaccaacaacatactctcgcgcgcgacaaaatcgtaaccgtaacccaccgctttcgacaacgatttaccaatcatcgcaataacaccaatcgccaaactatcgataaacgatataacgttcaaaacgctatatacttcaataacataaattaacgcatcaataccgatcatcgccgtaacatacgacgacacaccttcgatcaatacgacgtcgaaaatcgccacatccgacatcaacgaaacataaactaacacctacttacgcccgctcaccgcgtcgataatcaccgttacattaataatttcaaaaccgattccgacgataattaaaataacaatcaacgacaaacgcgattacaaaacgctaatttctaacatctctaccaacgtactatccgaattcgtcaccaacaacgtcacgactttcgccgcatccaacaccgaaccgccgccaaacgcgatcaccccatcacaacctaactcacgcaactacgccacgactacacacacgtcgataatacacgattcgcccaccgaacataaccaaaacgtcataacgatacctttaacgatcaaactacgcgtcaacccgacgatcatccctacctaatacaaaaaactatctaccatcacgaacaaatatttcaacccacgcgtttacgcttactatccgcaactactcaccgaacccgaaccgcaaaacgtcaccgataaaacgctaaatatttttacccgttacaaattcaaaatatcgaacgcctaaaaaaacgcgatctacaattcatttt

SEQ ID NO: 16193 - DNA, 578 bp, Artificial Sequence
  chemically treated genomic DNA (Homo sapiens) CpG-island No: 16193
agaggtgtttgcgtcgtcgttagttgatgtggtaacgatgcgcgaaatggtagaacgggtcggattttaggttatcgtgggaggttaaaatggtatatttggtggtagtaatcgtttgcgtaagcggcgtggcgtatatttatatggcggcggaacggttggaaaagttgtgtttgttagagaagtggggagttagtattgaaatttaggcgcgttgggaacggagaatcgtttagcggatgaggatattcgtcgggcggatgttgttttgttgattacggatatcgagtttgtcggtgtcgagcgatttgaatattgtcgttatgtgtaatgtagtatttacgtatttttgcgtgagtcgtagcgggtaatgagcgcggtgcgtaaagtgttttttgcgtcgtagtaaatttattttattttggagtagtcggtttttttgttagttggttgtggtattgtcggcgatatttcgacggcgagcgttcggtgtttttacgaaatagacggtagaagtagttgttgtcgataaagtcgtaggcgtgcgttattttttttatttttaggttatagttttt

SEQ ID NO: 16194 - DNA, 578 bp, Artificial Sequence
  chemically treated genomic DNA (Homo sapiens) CpG-island No: 16194
aaaaactataacctaaaaataaaaaaaataacgcacgcctacgactttatcgacaacaactacttctaccgtctatttcgtaaaaacaccgaacgctcgccgtcgaaatatcgccgacaataccacaaccaactaacaaaaaaaccgactactccaaaataaaataaatttactacgacgcaaaaaacactttacgcaccgcgctcattacccgctacgactcacgcaaaaatacgtaaatactacattacacataacgacaatattcaaatcgctcgacaccgacaaactcgatatccgtaatcaacaaaacaacatccgcccgacgaatatcctcatccgctaaacgattctccgttcccaacgcgcctaaatttcaatactaactccccacttctctaacaaacacaacttttccaaccgttccgccgccatataaatatacgccacgccgcttacgcaaacgattactaccaccaaatataccattttaacctcccacgataacctaaaatccgacccgttctaccatttcgcgcatcgttaccacatcaactaacgacgacgcaaacacctct

SEQ ID NO: 16195 - DNA, 578 bp, Artificial Sequence
  chemically treated genomic DNA (Homo sapiens) CpG-island No: 16195
aaaggttatgatttgaaggtaaaagaagtggcgtacgtttgcggttttgtcgatagtaattatttttgtcgtttgtttcgtaaaaatatcgaacgttcgtcgtcggaatatcgtcggtagtattatagttaattgatagaaaaatcgattattttagaataagatgggtttgttgcggcgtagaaagtattttgcgtatcgcgtttattattcgttgcggtttacgtaggaatgcgtagatgttgtattgtatatagcggtaatgtttaaatcgttcggtatcggtaagttcgatattcgtaattaatagagtaatattcgttcggcggatatttttattcgttaaacgatttttcgtttttagcgcgtttgagttttaatgttgattttttatttttttaataggtataatttttttagtcgtttcgtcgttatataagtatgcgttacgtcgtttacgtaggcggttattgttattaggtatgttattttaattttttacggtaatttgaagttcggttcgttttgttatttcgcgtatcgttgttatattagttgacgacggcgtaggtattttt

SEQ ID NO: 16196 - DNA, 578 bp, Artificial Sequence
  chemically treated genomic DNA (Homo sapiens) CpG-island No: 16196
aaaaatacctacgccgtcgtcaactaatataacaacgatacgcgaaataacaaaacgaaccgaacttcaaattaccgtaaaaaattaaaataacatacctaataacaataaccgcctacgtaaacgacgtaacgcatacttatataacgacgaaacgactaaaaaaattatacctattaaaaaaataaaaaatcaacattaaaactcaaacgcgctaaaaacgaaaaatcgtttaacgaataaaaatatccgccgaacgaatattactctattaattacgaatatcgaacttaccgataccgaacgatttaaacattaccgctatatacaatacaacatctacgcattcctacgtaaaccgcaacgaataataaacgcgatacgcaaaatactttctacgccgcaacaaacccatcttattctaaaataatcgatttttctatcaattaactataatactaccgacgatattccgacgacgaacgttcgatatttttacgaaacaaacgacaaaaataattactatcgacaaaaccgcaaacgtacgccacttcttttaccttcaaatcataaccttt

SEQ ID NO: 16197 - DNA, 501 bp, Artificial Sequence
  chemically treated genomic DNA (Homo sapiens) CpG-island No: 16197
tcggaacgggtttttatagtgttaagacgttcgttatggagttttattttaatatcgaaacggttatgaatacggttggtaaatttacgcgttttggtagttaatggttgttcggtgtcgtttatatttagcggtaaatcgacgatgatttcgttcggttgttatttttttagtaaacgttcgataatgttttagttcggcgtatcgttttgtgttttaattgtaggtaaagggcgagcggtgtcggtaatgcgttggtcgaacgttacgttaatgtttttggtgtcgaagtcgaaggcgagtaagggttttaattcgattaggcgtgttttgttatattaggtatggtgagaaataattttataatttaagttagtatagtcgattcgcgttacggtcggtaatcggcgtttcgtatagattatttagatttgtcggggtcgttagttaggcgtatcgagaatttttgttttaagtgattttatttaggaggttaaatta

SEQ ID NO: 16198 - DNA, 501 bp, Artificial Sequence
  chemically treated genomic DNA (Homo sapiens) CpG-island No: 16198
taatttaacctcctaaataaaatcacttaaaacaaaaattctcgatacgcctaactaacgaccccgacaaatctaaataatctatacgaaacgccgattaccgaccgtaacgcgaatcgactatactaacttaaattataaaattatttctcaccatacctaatataacaaaacacgcctaatcgaattaaaacccttactcgccttcgacttcgacaccaaaaacattaacgtaacgttcgaccaacgcattaccgacaccgctcgccctttacctacaattaaaacacaaaacgatacgccgaactaaaacattatcgaacgtttactaaaaaaataacaaccgaacgaaatcatcgtcgatttaccgctaaatataaacgacaccgaacaaccattaactaccaaaacgcgtaaatttaccaaccgtattcataaccgtttcgatattaaaataaaactccataacgaacgtcttaacactataaaaacccgttccga

SEQ ID NO: 16199 - DNA, 501 bp, Artificial Sequence
  chemically treated genomic DNA (Homo sapiens) CpG-island No: 16199
tggtttagttttttggataaagttatttggaataggaattttcgatacgtttggttaacggtttcggtagatttggatagtttgtgcgaaacgtcgattgtcgatcgtggcgcgagtcggttatattgatttgggttgtggaattattttttattatgtttggtgtggtaggatacgtttgatcgagttggaatttttattcgttttcgatttcggtattaaaagtattggcgtagcgttcggttaacgtattatcggtatcgttcgttttttgtttgtaattaaagtataggacggtacgtcggattggaatattatcgagcgtttattgaaagagtggtagtcggacgaaattatcgtcggtttgtcgttgaatatggacggtatcgagtaattattgattgttagagcgcgtaaatttgttaatcgtatttatggtcgtttcggtgttgaagtaaagttttatgacgagcgttttagtattgtggaagttcgtttcgg

SEQ ID NO: 16200 - DNA, 501 bp, Artificial Sequence
  chemically treated genomic DNA (Homo sapiens) CpG-island No: 16200
ccgaaacgaacttccacaatactaaaacgctcgtcataaaactttacttcaacaccgaaacgaccataaatacgattaacaaatttacgcgctctaacaatcaataattactcgataccgtccatattcaacgacaaaccgacgataatttcgtccgactaccactctttcaataaacgctcgataatattccaatccgacgtaccgtcctatactttaattacaaacaaaaaacgaacgataccgataatacgttaaccgaacgctacgccaatacttttaataccgaaatcgaaaacgaataaaaattccaactcgatcaaacgtatcctaccacaccaaacataataaaaaataattccacaacccaaatcaatataaccgactcgcgccacgatcgacaatcgacgtttcgcacaaactatccaaatctaccgaaaccgttaaccaaacgtatcgaaaattcctattccaaataactttatccaaaaaactaaacca

SEQ ID NO: 16201 - DNA, 550 bp, Artificial Sequence
  chemically treated genomic DNA (Homo sapiens) CpG-island No: 16201
ttcgcgtcgatagatatagcgttgtatgtagtttattggatacgttaggtggtatatttatattttgatagtttggtaattacgatttggtcgatagttgggaatacggtcggtagtaatagttcgtattttttggtcgatacggagttttaaattatagaggtttttaggttttgagtgacgttcggtgattaacgcggttaatagttacgggttattaggtggtattaacgtatagatagtaagtatttcgagcgggttaggtgtatgattcgagtaaatatatacggatgtcgtgcgagaatatcgatttcgtgcgaataattattcgtcgaattagtgatttattagtgttcgttagtgcgatatttggcgtatttaaagttagtcggattcggttacggcgtttttatagtattttagaaattacggtaaaattacgaaagttcggcggataatttaaatggtaagttatttggtcgcgtagcgttattgagcgttgatttattatattaagtaaattcgtttttagataatgttggttatgatt

SEQ ID NO: 16202 - DNA, 550 bp, Artificial Sequence
  chemically treated genomic DNA (Homo sapiens) CpG-island No: 16202
aatcataaccaacattatctaaaaacgaatttacttaatataataaatcaacgctcaataacgctacgcgaccaaataacttaccatttaaattatccgccgaactttcgtaattttaccgtaatttctaaaatactataaaaacgccgtaaccgaatccgactaactttaaatacgccaaatatcgcactaacgaacactaataaatcactaattcgacgaataattattcgcacgaaatcgatattctcgcacgacatccgtatatatttactcgaatcatacacctaacccgctcgaaatacttactatctatacgttaataccacctaataacccgtaactattaaccgcgttaatcaccgaacgtcactcaaaacctaaaaacctctataatttaaaactccgtatcgaccaaaaaatacgaactattactaccgaccgtattcccaactatcgaccaaatcgtaattaccaaactatcaaaatataaatataccacctaacgtatccaataaactacatacaacgctatatctatcgacgcgaa

SEQ ID NO: 16203 - DNA, 550 bp, Artificial Sequence
  chemically treated genomic DNA (Homo sapiens) CpG-island No: 16203
gattatggttagtattgtttggggacgaatttatttggtatagtggattaacgtttaatggcgttgcgcgattagatgatttgttatttgggttgttcgtcgggttttcgtgattttgtcgtgatttttgggatattgtgggaacgtcgtggtcggattcggttggttttggatgcgttaagtgtcgtattggcgggtattggtggattattgattcgacggatgattgttcgtacggggtcgatgttttcgtacggtattcgtgtatgtttattcgggttatgtatttggttcgttcggggtatttgttgtttgtacgttggtgttatttgatggttcgtgattgttgatcgcgttggttatcgggcgttatttagggtttggggatttttgtagtttgaaatttcgtatcgattagggagtgcgggttgttattatcggtcgtgtttttagttgtcggttaagtcgtggttgttaggttgttagaatgtggatatgttatttggcgtgtttaataggttgtatgtaacgttgtgtttgtcggcgcgga

SEQ ID NO: 16204 - DNA, 550 bp, Artificial Sequence
  chemically treated genomic DNA (Homo sapiens) CpG-island No: 16204
tccgcgccgacaaacacaacgttacatacaacctattaaacacgccaaataacatatccacattctaacaacctaacaaccacgacttaaccgacaactaaaaacacgaccgataataacaacccgcactccctaatcgatacgaaatttcaaactacaaaaatccccaaaccctaaataacgcccgataaccaacgcgatcaacaatcacgaaccatcaaataacaccaacgtacaaacaacaaataccccgaacgaaccaaatacataacccgaataaacatacacgaataccgtacgaaaacatcgaccccgtacgaacaatcatccgtcgaatcaataatccaccaatacccgccaatacgacacttaacgcatccaaaaccaaccgaatccgaccacgacgttcccacaatatcccaaaaatcacgacaaaatcacgaaaacccgacgaacaacccaaataacaaatcatctaatcgcgcaacgccattaaacgttaatccactataccaaataaattcgtccccaaacaatactaaccataatc

SEQ ID NO: 16205 - DNA, 511 bp, Artificial Sequence
  chemically treated genomic DNA (Homo sapiens) CpG-island No: 16205
tgtcggcgtgttgttcgttgttagttaagttagacgggtgttaaagagagtttgggcgattattgttgtttttcgattgaacgcgttattatgcgagataaacgttgcgttagatgaacggggtgaaatgagtcgtatttcgaggtcgttgaatttgtagttttagtttggttttaaaatcggaaatcggtaattgggcgttttgttcgtgcgagaagttgtgatgtcgtagaagcgtttgtttgcgtagtattttttattataatcgttcgatatgcgtttaagaatacgacgatttaacggtttttgtttgttagggttaacggatgatgaggcgcgatcgtaaagatttgttttagatcgtttaatcgtgaaaaattaaatttattggaagatggtggtttatgtatcgcgttaataataatattcgttcgtttttgagttagggtattttatgaattatcgagtacgttattgataaattttaggcgcgttacgttatgatgttgat

SEQ ID NO: 16206 - DNA, 511 bp, Artificial Sequence
  chemically treated genomic DNA (Homo sapiens) CpG-island No: 16206
atcaacatcataacgtaacgcgcctaaaatttatcaataacgtactcgataattcataaaataccctaactcaaaaacgaacgaatattattattaacgcgatacataaaccaccatcttccaataaatttaatttttcacgattaaacgatctaaaacaaatctttacgatcgcgcctcatcatccgttaaccctaacaaacaaaaaccgttaaatcgtcgtattcttaaacgcatatcgaacgattataataaaaaatactacgcaaacaaacgcttctacgacatcacaacttctcgcacgaacaaaacgcccaattaccgatttccgattttaaaaccaaactaaaactacaaattcaacgacctcgaaatacgactcatttcaccccgttcatctaacgcaacgtttatctcgcataataacgcgttcaatcgaaaaacaacaataatcgcccaaactctctttaacacccgtctaacttaactaacaacgaacaacacgccgaca

SEQ ID NO: 16207 - DNA, 511 bp, Artificial Sequence
  chemically treated genomic DNA (Homo sapiens) CpG-island No: 16207
attaatattatagcgtgacgcgtttgaagtttattaatggcgtattcggtggtttatgggatgttttgatttaggggcgagcggatattattgttggcgcgatgtatgagttattattttttagtgagtttggttttttacggttgggcgatttggaataagtttttgcggtcgcgttttattattcgttagttttggtaagtaagagtcgttaaatcgtcgtatttttaagcgtatatcgggcgattgtggtgggggatattgcgtaggtaggcgtttttacggtattataatttttcgtacgaataagacgtttaattatcggttttcgattttaaaattaaattggagttgtaaatttagcggtttcgggatgcggtttattttatttcgtttatttggcgtaacgtttatttcgtatagtggcgcgtttaatcgagaagtaatagtggtcgtttaaattttttttgatattcgtttggtttggttggtaacgaatagtacgtcggta

SEQ ID NO: 16208 - DNA, 511 bp, Artificial Sequence
  chemically treated genomic DNA (Homo sapiens) CpG-island No: 16208
taccgacgtactattcgttaccaaccaaaccaaacgaatatcaaaaaaaatttaaacgaccactattacttctcgattaaacgcgccactatacgaaataaacgttacgccaaataaacgaaataaaataaaccgcatcccgaaaccgctaaatttacaactccaatttaattttaaaatcgaaaaccgataattaaacgtcttattcgtacgaaaaattataataccgtaaaaacgcctacctacgcaatatcccccaccacaatcgcccgatatacgcttaaaaatacgacgatttaacgactcttacttaccaaaactaacgaataataaaacgcgaccgcaaaaacttattccaaatcgcccaaccgtaaaaaaccaaactcactaaaaaataataactcatacatcgcgccaacaataatatccgctcgcccctaaatcaaaacatcccataaaccaccgaatacgccattaataaacttcaaacgcgtcacgctataatattaat

SEQ ID NO: 16209 - DNA, 768 bp, Artificial Sequence
  chemically treated genomic DNA (Homo sapiens) CpG-island No: 16209
cgttggaatagagtgcgtaagcgggcgtattatcgttcgtgatagtggtgatggtaaagtatagacgttgggcgcggtagagtatagttcgttgtatatttcggtagattcgttgtaaagtatgagtcgtgaagagaagttggatattttgcgtcgcgtcgattaggttgttcgcgaagcggataagcgcgtataggaagtgattgttagttttagtggtgtttatgaattaattttggttgcggttatcgacggtacgttagcggcggatgttcgttcgttggtgcgttttttcgtgagcgttttcgtcgaagaagatggtaaacgcgaacgcggtgttagtggcggcggcggtcgtttaggttatgaatttttttttgtcgatttcgacggcgaagttcgtgcggatgtatgggtaaaagaagtagtgcgtatggcgttggttaatttttttgtcgttgttgtattagcgggtattatgtcggtagtatttggcgtaggttggtcgggcgtgttgttgtatgaagcgcgtggttacggtttggacggggattttaatcgtcggggtattttagtattaagtggataggttcgggatatgtggtttagatttggtatcgggtgattattgtcgatgtcgacgttagattggaggtatgagattacgtattaggtcgtaacggttgatgaaggaattaaggtacgcggaatattaacgttgacggaatttaggaagatggaaattattagttgcgaatataattcgaa

SEQ ID NO: 16210 - DNA, 768 bp, Artificial Sequence
  chemically treated genomic DNA (Homo sapiens) CpG-island No: 16210
ttcgaattatattcgcaactaataatttccatcttcctaaattccgtcaacgttaatattccgcgtaccttaattccttcatcaaccgttacgacctaatacgtaatctcatacctccaatctaacgtcgacatcgacaataatcacccgataccaaatctaaaccacatatcccgaacctatccacttaatactaaaataccccgacgattaaaatccccgtccaaaccgtaaccacgcgcttcatacaacaacacgcccgaccaacctacgccaaatactaccgacataatacccgctaatacaacaacgacaaaaaaattaaccaacgccatacgcactacttcttttacccatacatccgcacgaacttcgccgtcgaaatcgacaaaaaaaaattcataacctaaacgaccgccgccgccactaacaccgcgttcgcgtttaccatcttcttcgacgaaaacgctcacgaaaaaacgcaccaacgaacgaacatccgccgctaacgtaccgtcgataaccgcaaccaaaattaattcataaacaccactaaaactaacaatcacttcctatacgcgcttatccgcttcgcgaacaacctaatcgacgcgacgcaaaatatccaacttctcttcacgactcatactttacaacgaatctaccgaaatatacaacgaactatactctaccgcgcccaacgtctatactttaccatcaccactatcacgaacgataatacgcccgcttacgcactctattccaacg

SEQ ID NO: 16211 - DNA, 768 bp, Artificial Sequence
  chemically treated genomic DNA (Homo sapiens) CpG-island No: 16211
ttcgaattgtgttcgtagttggtgatttttatttttttggatttcgttagcgttgatgtttcgcgtgttttgatttttttattaatcgttacggtttggtacgtggttttatgtttttaatttggcgtcgatatcggtaataattattcggtattaggtttgagttatatgtttcggatttgtttatttaatattgaagtgtttcggcggttgaagttttcgtttagatcgtgattacgcgttttatgtaatagtacgttcggttaatttgcgttaagtattatcggtatggtgttcgttggtgtagtaacggtagaaagattgattagcgttatacgtattgttttttttgtttatgtattcgtacggatttcgtcgtcgagatcggtaaggaagaatttataatttaaacgatcgtcgtcgttattggtatcgcgttcgcgtttgttatttttttcgacgagaacgtttacggaaagacgtattagcggacggatattcgtcgttagcgtgtcgtcggtggtcgtaattaaaattaatttatagatattattgaggttggtagttattttttgtacgcgtttgttcgtttcgcgggtaatttgatcgacgcgacgtaggatatttagtttttttttacggtttatgttttgtagcggatttatcgaggtatataacgggttatgttttatcgcgtttagcgtttgtattttattattattattattacggacgatggtgcgttcgtttgcgtattttgttttagcg

SEQ ID NO: 16212 - DNA, 768 bp, Artificial Sequence
  chemically treated genomic DNA (Homo sapiens) CpG-island No: 16212
cgctaaaacaaaatacgcaaacgaacgcaccatcgtccgtaataataataataataaaatacaaacgctaaacgcgataaaacataacccgttatatacctcgataaatccgctacaaaacataaaccgtaaaaaaaaactaaatatcctacgtcgcgtcgatcaaattacccgcgaaacgaacaaacgcgtacaaaaaataactaccaacctcaataatatctataaattaattttaattacgaccaccgacgacacgctaacgacgaatatccgtccgctaatacgtctttccgtaaacgttctcgtcgaaaaaaataacaaacgcgaacgcgataccaataacgacgacgatcgtttaaattataaattcttccttaccgatctcgacgacgaaatccgtacgaatacataaacaaaaaaaacaatacgtataacgctaatcaatctttctaccgttactacaccaacgaacaccataccgataatacttaacgcaaattaaccgaacgtactattacataaaacgcgtaatcacgatctaaacgaaaacttcaaccgccgaaacacttcaatattaaataaacaaatccgaaacatataactcaaacctaataccgaataattattaccgatatcgacgccaaattaaaaacataaaaccacgtaccaaaccgtaacgattaataaaaaaatcaaaacacgcgaaacatcaacgctaacgaaatccaaaaaaataaaaatcaccaactacgaacacaattcgaa

SEQ ID NO: 16213 - DNA, 1028 bp, Artificial Sequence
  chemically treated genomic DNA (Homo sapiens) CpG-island No: 16213
cgggttagtgtcgaagtcgaagttttttgcgtcgagaatcgtcgttttgatgatatcgatattcgtttttaggtcgatatcgatttgtaaacggattttgtgacgtaagtcgttagtaattagcgtttgttgggttttaataagttttagattttacggatagattgcgtattttatcgatgaaagcggatttgcgtcggtgtcgtcgttatagtttgcgatggtgattaagttcgtataagtttttggttatgttagtcgcgatggtgtttattttcggttcggaaattagttttacggagattatcgttttcgggttaatttgtttgaggtcgaaaatgagttgcgttaagttttcgatagagtagatatcgtggtgcggcggcggggagattagcgttatttcgggtatcgaatagcgtagtttggcgatgtaaggcgtgattttattattcggtaattgatcgttttcgtttggtttcgcgttttgggcgattttaatttgaatgacgtcggtattgattagatacgtcggagtaattttaaagcgatcggaagttatttgtttgatgcgcgatattttgttggtgtcgtagcgcgtcgggttttcgtcgtttttatcggagttcgaattatcgtcgatgttgtttatcgttttcgttagcgtttcgtgggttttcgggtttaacgcgtcgatagatatcgcggcggtattaaagcgtttaaatagttcgtttgtcggtttaatattagtaatgttgatcgcgtttttattcggcgtaattgttagtagatcgcgtagcgtggttgtcggacgtttattaattagtttcgcgtatttttgatagtcgttgtattcgtcgttttgtatcgtttgttgtagcgtgcgtattacgttcgggttgtaggcgtggtatacgtcgtcgtggacgtatttagtagaacgttttggttgatggggttacgcgttagttagttcggttcgatagattagaaaattcgttggaattttaaagtttgtttttaat

SEQ ID NO: 16214 - DNA, 1028 bp, Artificial Sequence
  chemically treated genomic DNA (Homo sapiens) CpG-island No: 16214
attaaaaacaaactttaaaattccaacgaattttctaatctatcgaaccgaactaactaacgcgtaaccccatcaaccaaaacgttctactaaatacgtccacgacgacgtataccacgcctacaacccgaacgtaatacgcacgctacaacaaacgatacaaaacgacgaatacaacgactatcaaaaatacgcgaaactaattaataaacgtccgacaaccacgctacgcgatctactaacaattacgccgaataaaaacgcgatcaacattactaatattaaaccgacaaacgaactatttaaacgctttaataccgccgcgatatctatcgacgcgttaaacccgaaaacccacgaaacgctaacgaaaacgataaacaacatcgacgataattcgaactccgataaaaacgacgaaaacccgacgcgctacgacaccaacaaaatatcgcgcatcaaacaaataacttccgatcgctttaaaattactccgacgtatctaatcaataccgacgtcattcaaattaaaatcgcccaaaacgcgaaaccaaacgaaaacgatcaattaccgaataataaaatcacgccttacatcgccaaactacgctattcgatacccgaaataacgctaatctccccgccgccgcaccacgatatctactctatcgaaaacttaacgcaactcattttcgacctcaaacaaattaacccgaaaacgataatctccgtaaaactaatttccgaaccgaaaataaacaccatcgcgactaacataaccaaaaacttatacgaacttaatcaccatcgcaaactataacgacgacaccgacgcaaatccgctttcatcgataaaatacgcaatctatccgtaaaatctaaaacttattaaaacccaacaaacgctaattactaacgacttacgtcacaaaatccgtttacaaatcgatatcgacctaaaaacgaatatcgatatcatcaaaacgacgattctcgacgcaaaaaacttcgacttcgacactaacccg

SEQ ID NO: 16215 - DNA, 1028 bp, Artificial Sequence
  chemically treated genomic DNA (Homo sapiens) CpG-island No: 16215
attggggataagttttgagattttagcggattttttaatttgtcgaatcgggttggttggcgcgtaattttattagttagggcgttttgttgaatacgtttacggcggcgtatattacgtttataattcggacgtggtgcgtacgttgtaataagcggtataaagcggcgagtatagcgattattaggaatacgcgaagttggttaatgagcgttcggtaattacgttgcgcgatttgttggtaattacgtcgggtgaaaacgcggttaatattgttgatgttgaatcggtaagcgaattgtttaaacgttttgatatcgtcgcgatgtttatcggcgcgttaagttcggaagtttacgaggcgttggcggaagcgatgaatagtatcggcggtaattcgaatttcggtgaaggcggcgaagattcggcgcgttacggtattaataaagtgtcgcgtattaagtaggtggttttcggtcgttttggggttatttcggcgtatttggttaatgtcgacgttatttagattaaagtcgtttagggcgcgaagttaggcgaaggcggttagttgtcgggtgataaagttacgttttatatcgttaaattgcgttattcggtgttcggagtgacgttgattttttcgtcgtcgtattacgatatttattttatcgaggatttagcgtagtttattttcgattttaagtaggttaattcgaaagcgatgattttcgtgaagttggttttcgaatcgggagtaggtattatcgcgattggtatggttaaaggtttatgcggatttgattattatcgtaggttatgacggcggtatcggcgtaagttcgtttttatcggtgaaatacgtagtttgttcgtgggatttggggtttgttgaaatttagtaggcgttggttgttaacggtttgcgttataagattcgtttgtaggtcgatgtcggtttgaaaacgggtgtcgatattattaaggcggcgattttcggcgtagaaagtttcggtttcggtattggttcg

SEQ ID NO: 16216 - DNA, 1028 bp, Artificial Sequence
  chemically treated genomic DNA (Homo sapiens) CpG-island No: 16216
cgaaccaataccgaaaccgaaactttctacgccgaaaatcgccgccttaataatatcgacacccgttttcaaaccgacatcgacctacaaacgaatcttataacgcaaaccgttaacaaccaacgcctactaaatttcaacaaaccccaaatcccacgaacaaactacgtatttcaccgataaaaacgaacttacgccgataccgccgtcataacctacgataataatcaaatccgcataaacctttaaccataccaatcgcgataatacctactcccgattcgaaaaccaacttcacgaaaatcatcgctttcgaattaacctacttaaaatcgaaaataaactacgctaaatcctcgataaaataaatatcgtaatacgacgacgaaaaaatcaacgtcactccgaacaccgaataacgcaatttaacgatataaaacgtaactttatcacccgacaactaaccgccttcgcctaacttcgcgccctaaacgactttaatctaaataacgtcgacattaaccaaatacgccgaaataaccccaaaacgaccgaaaaccacctacttaatacgcgacactttattaataccgtaacgcgccgaatcttcgccgccttcaccgaaattcgaattaccgccgatactattcatcgcttccgccaacgcctcgtaaacttccgaacttaacgcgccgataaacatcgcgacgatatcaaaacgtttaaacaattcgcttaccgattcaacatcaacaatattaaccgcgttttcacccgacgtaattaccaacaaatcgcgcaacgtaattaccgaacgctcattaaccaacttcgcgtattcctaataatcgctatactcgccgctttataccgcttattacaacgtacgcaccacgtccgaattataaacgtaatatacgccgccgtaaacgtattcaacaaaacgccctaactaataaaattacgcgccaaccaacccgattcgacaaattaaaaaatccgctaaaatctcaaaacttatccccaat

SEQ ID NO: 16217 - DNA, 610 bp, Artificial Sequence
  chemically treated genomic DNA (Homo sapiens) CpG-island No: 16217
ttatatcggtatatagatggtggttattttcgcgttcgttacgttcgaaaacgtttttggtttagtgtacgatttggtggaaattcgcgatcgcgttttgggtattattattggtatcgtggtgttcgcggtgatttatatttttgtttggtttgaaagtgaagcgcgtatattgtcgtaaaaattggttggtacgttgggtatgttaagtaaagtaatgcggattttacgttagtaggaagttacggttttgcgtatttatttgtaaattcgtatcggtttgtatgcggcgtttaatgtttgtgaagagatgtgttaacgcgtggcgttggagcgttaattggatagcgaagaacgcgtattattgattgaacgttcgtaaacggttattcgttagggtcgcgattttttttacgtttgggatgttatttggaattcggcgtaggcgttggataacgtattatagtcggatagagtaggttagtttgtcgacgttttggagaaatacgttgtcggtttggtaatcgtatttagtcgttttttttaaataacgtttgaagagatattcgttttttaggttattttggttattttattaaataggagtata

SEQ ID NO: 16218 - DNA, 610 bp, Artificial Sequence
  chemically treated genomic DNA (Homo sapiens) CpG-island No: 16218
tatactcctatttaataaaataaccaaaataacctaaaaaacgaatatctcttcaaacgttatttaaaaaaaacgactaaatacgattaccaaaccgacaacgtatttctccaaaacgtcgacaaactaacctactctatccgactataatacgttatccaacgcctacgccgaattccaaataacatcccaaacgtaaaaaaaatcgcgaccctaacgaataaccgtttacgaacgttcaatcaataatacgcgttcttcgctatccaattaacgctccaacgccacgcgttaacacatctcttcacaaacattaaacgccgcatacaaaccgatacgaatttacaaataaatacgcaaaaccgtaacttcctactaacgtaaaatccgcattactttacttaacatacccaacgtaccaaccaatttttacgacaatatacgcgcttcactttcaaaccaaacaaaaatataaatcaccgcgaacaccacgataccaataataatacccaaaacgcgatcgcgaatttccaccaaatcgtacactaaaccaaaaacgttttcgaacgtaacgaacgcgaaaataaccaccatctatataccgatataa

SEQ ID NO: 16219 - DNA, 610 bp, Artificial Sequence
  chemically treated genomic DNA (Homo sapiens) CpG-island No: 16219
tgtgtttttgtttaataaggtggttaggatggtttgagaggcgggtgtttttttaagcgttatttgaggagaacggttgagtgcggttgttagatcggtagcgtatttttttagggcgtcggtaaattgatttgttttgttcggttgtagtgcgttatttagcgtttgcgtcgagttttaggtggtattttaggcgtgaagaagatcgcggttttgacgaataatcgtttgcgaacgtttaattagtaatgcgcgtttttcgttgtttagttgacgttttagcgttacgcgttggtatatttttttataggtattaaacgtcgtatgtagatcgatacgaatttgtagataagtgcgtagagtcgtgattttttgttggcgtgggattcgtattattttatttaatatatttagcgtgttagttagtttttgcggtagtgtgcgcgttttatttttaggttagataaaggtgtaaattatcgcggatattacggtattaatgatgatatttagggcgcgatcgcgaatttttattaggtcgtatattgggttaaaaacgttttcgagcgtggcgagcgcgaaggtgattattatttgtgtgtcgatataa

SEQ ID NO: 16220 - DNA, 610 bp, Artificial Sequence
  chemically treated genomic DNA (Homo sapiens) CpG-island No: 16220
ttatatcgacacacaaataataatcaccttcgcgctcgccacgctcgaaaacgtttttaacccaatatacgacctaataaaaattcgcgatcgcgccctaaatatcatcattaataccgtaatatccgcgataatttacacctttatctaacctaaaaataaaacgcgcacactaccgcaaaaactaactaacacgctaaatatattaaataaaataatacgaatcccacgccaacaaaaaatcacgactctacgcacttatctacaaattcgtatcgatctacatacgacgtttaatacctataaaaaaatataccaacgcgtaacgctaaaacgtcaactaaacaacgaaaaacgcgcattactaattaaacgttcgcaaacgattattcgtcaaaaccgcgatcttcttcacgcctaaaataccacctaaaactcgacgcaaacgctaaataacgcactacaaccgaacaaaacaaatcaatttaccgacgccctaaaaaaatacgctaccgatctaacaaccgcactcaaccgttctcctcaaataacgcttaaaaaaacacccgcctctcaaaccatcctaaccaccttattaaacaaaaacaca

SEQ ID NO: 16221 - DNA, 1113 bp, Artificial Sequence
  chemically treated genomic DNA (Homo sapiens) CpG-island No: 16221
tttaggaacgttgaggacgagtaaatagtaatgcggtgtagtaaagaatatggaacgttttatattgcgtaataattgtcgtcggtagatgtagaaacgtagttaggcgtgcgttgttagtaggttacgcgttcggtagttttagttgggttgtatatttttggcggtttcgtttcgttttttttaacggtattaatgttggcgatttcggcgagtattgcgggttgtaaaaaagtggtgttgtgtttatcgtcgtcgattgtcgatgagattttttatgcggcgtagttgtgcggtgtgtaggacgtgtttaacgtcggcggcgtataggttattgtcgtattggcgtttggtacggaatttgtgttaaaagtggataaaattttcgggtcgggtaacgtttttgttatcgaagcgaaacgttaggtgagttagcgtttggacggtgcggcgatcgatatgttcgtaggttcgtcggaagtgttggtgattgttgatagcggcgttacgtcggatttcgtggtttttgatttgtttttttaggttgaatacggttcggatttataggtgattttattgacgttcgttgttgatatggcgcgtcgcgttgtcgaggtcgtcgaacgttaattggtagaattgtcgcgtgtcgaaatcgttcgttaggtattgaacgttagtcgtttgatcgtgattaaagatttagcgtagtgcgtggagatttttaattagtacggttcggagtatttgattatttagattcgtaacgttcgtgaattggtcgatagtattattagcgtcggttcggtattttttggtgattggttatcggaatcggtaggtgattacgttttcggtattaattacgttttatcgatttacggttatatcgttatttgttttagtttcgggttggtagatttttagaagcgtatgatcgtataggaattgtcgaaagaggggtttttcgcgttggttttaattatagaaatattggtcgtcgtcgagcgtttgatcgtttataaaaatgtcgttattttgcgtgttaacgtttttaaggagtaagtatgagtatcgtgattattatcgatttagcgcgtgaaaacgttcgta

SEQ ID NO: 16222 - DNA, 1113 bp, Artificial Sequence
  chemically treated genomic DNA (Homo sapiens) CpG-island No: 16222
tacgaacgttttcacgcgctaaatcgataataatcacgatactcatacttactccttaaaaacgttaacacgcaaaataacgacatttttataaacgatcaaacgctcgacgacgaccaatatttctataattaaaaccaacgcgaaaaacccctctttcgacaattcctatacgatcatacgcttctaaaaatctaccaacccgaaactaaaacaaataacgatataaccgtaaatcgataaaacgtaattaataccgaaaacgtaatcacctaccgattccgataaccaatcaccaaaaaataccgaaccgacgctaataatactatcgaccaattcacgaacgttacgaatctaaataatcaaatactccgaaccgtactaattaaaaatctccacgcactacgctaaatctttaatcacgatcaaacgactaacgttcaatacctaacgaacgatttcgacacgcgacaattctaccaattaacgttcgacgacctcgacaacgcgacgcgccatatcaacaacgaacgtcaataaaatcacctataaatccgaaccgtattcaacctaaaaaaacaaatcaaaaaccacgaaatccgacgtaacgccgctatcaacaatcaccaacacttccgacgaacctacgaacatatcgatcgccgcaccgtccaaacgctaactcacctaacgtttcgcttcgataacaaaaacgttacccgacccgaaaattttatccacttttaacacaaattccgtaccaaacgccaatacgacaataacctatacgccgccgacgttaaacacgtcctacacaccgcacaactacgccgcataaaaaatctcatcgacaatcgacgacgataaacacaacaccacttttttacaacccgcaatactcgccgaaatcgccaacattaataccgttaaaaaaaacgaaacgaaaccgccaaaaatatacaacccaactaaaactaccgaacgcgtaacctactaacaacgcacgcctaactacgtttctacatctaccgacgacaattattacgcaatataaaacgttccatattctttactacaccgcattactatttactcgtcctcaacgttcctaaa

SEQ ID NO: 16223 - DNA, 1113 bp, Artificial Sequence
  chemically treated genomic DNA (Homo sapiens) CpG-island No: 16223
tgcggacgtttttacgcgttaaatcggtaatagttacggtgtttatgtttgttttttaagggcgttaatacgtaaagtaacggtatttttgtgggcggttaggcgttcggcggcggttagtgtttttatggttgaagttagcgcggagaatttttttttcgatagtttttgtacggttatgcgtttttggaaatttgttagttcgaggttggaataggtggcggtgtaatcgtaagtcggtagaacgtggttggtgtcggaggcgtaattatttgtcgatttcggtgattagttattaagaaatatcgaatcggcgttggtgatgttatcgattagtttacgggcgttgcgggtttgaatgattaggtgtttcgggtcgtattggttggagatttttacgtattgcgttaaatttttagttacgattaggcggttggcgtttagtgtttggcgggcggtttcggtacgcggtagttttgttagttggcgttcgacggtttcggtaacgcgacgcgttatattagtagcgggcgttagtaaaattatttgtgagttcgggtcgtgtttagtttgagagagtaaattagaagttacgaaattcggcgtagcgtcgttgttagtaattattagtattttcgacgggtttgcgggtatatcgatcgtcgtatcgtttagacgttggtttatttgacgtttcgtttcggtgataaaggcgttattcggttcgaagattttgtttatttttggtatagatttcgtattaaacgttagtgcggtaatggtttgtgcgtcgtcgacgttaaatacgttttgtatatcgtatagttgcgtcgtataaaggattttatcggtaatcggcggcggtgagtatagtattatttttttatagttcgtaatattcgtcggagtcgttagtattaatatcgttgagaagagcggggcggagtcgttaggaatatataatttaattgaagttatcggacgcgtgatttgttggtaacgtacgtttggttgcgtttttatatttatcggcggtagttattgcgtagtgtggaacgttttatattttttattgtatcgtattgttgtttattcgtttttagcgtttttggg

SEQ ID NO: 16224 - DNA, 1113 bp, Artificial Sequence
  chemically treated genomic DNA (Homo sapiens) CpG-island No: 16224
cccaaaaacgctaaaaacgaataaacaacaatacgatacaataaaaaatataaaacgttccacactacgcaataactaccgccgataaatataaaaacgcaaccaaacgtacgttaccaacaaatcacgcgtccgataacttcaattaaattatatattcctaacgactccgccccgctcttctcaacgatattaatactaacgactccgacgaatattacgaactataaaaaaataatactatactcaccgccgccgattaccgataaaatcctttatacgacgcaactatacgatatacaaaacgtatttaacgtcgacgacgcacaaaccattaccgcactaacgtttaatacgaaatctataccaaaaataaacaaaatcttcgaaccgaataacgcctttatcaccgaaacgaaacgtcaaataaaccaacgtctaaacgatacgacgatcgatatacccgcaaacccgtcgaaaatactaataattactaacaacgacgctacgccgaatttcgtaacttctaatttactctctcaaactaaacacgacccgaactcacaaataattttactaacgcccgctactaatataacgcgtcgcgttaccgaaaccgtcgaacgccaactaacaaaactaccgcgtaccgaaaccgcccgccaaacactaaacgccaaccgcctaatcgtaactaaaaatttaacgcaatacgtaaaaatctccaaccaatacgacccgaaacacctaatcattcaaacccgcaacgcccgtaaactaatcgataacatcaccaacgccgattcgatatttcttaataactaatcaccgaaatcgacaaataattacgcctccgacaccaaccacgttctaccgacttacgattacaccgccacctattccaacctcgaactaacaaatttccaaaaacgcataaccgtacaaaaactatcgaaaaaaaaattctccgcgctaacttcaaccataaaaacactaaccgccgccgaacgcctaaccgcccacaaaaataccgttactttacgtattaacgcccttaaaaaacaaacataaacaccgtaactattaccgatttaacgcgtaaaaacgtccgca

SEQ ID NO: 16225 - DNA, 959 bp, Artificial Sequence
  chemically treated genomic DNA (Homo sapiens) CpG-island No: 16225
gattggaaggttgggtcgttagtcgcgcgcgttagggcgttagcgcgttaatggcgttgaaattagaaatcgttacgcgtttgcgtaagggtgagcgggaagaggtggcgattaatagtttgcgttttggcgatgtgattgaagtcgtcgtaggtgggcgtttgtttgtcgacggtaaattgtttttatcgtttgttagttttgatgaaagcgttttgatcggcgaatttatttcggtggagcgcgtaacgggcgataaagtttttgttggtgttattagcgtagatcgtttggtgacgttggaagtgttgttagaatcgggagttagcgttattgatcggattttgaaattgatcgaagaagtcgaagagcgtcgcgtttttattgagcggtttatcgatcgttttagtcgtatttatacgttcgcgattatggtcgtcgttttgttggtgacgttggtgttatcgttgttgtttgtcgttagttggtaggagtggatttataaagggttgacgttgttgttgattggttgttcgtgtgcgttagttattttaacgtttgcggcgattattttcgggttggcggcggtagcgcgtcgtggggcgttgattaaaggcggagcggcgttggaatagttgggtcgtgttatttaggtggcgtttgataaaatcggtacgttgatcgtcggtaaatcgcgcgttatcgcgatttattcggtaacgggtattagtgaatttgaattgttgatattggcggcggcggtcgagtaaggcgcgacgtatttattggcgtaagttatcgtacgcgaagtataggttgttgaattcgttatttttatcgtcgaattatagcgggcgttggtcgggtttggtattgaagcgtaggttaacggtgagcgcgtattgatttgcgttgtcgggaaatatttcgttgatgtatttattggtttaattaacgaa

SEQ ID NO: 16226 - DNA, 959 bp, Artificial Sequence
  chemically treated genomic DNA (Homo sapiens) CpG-island No: 16226
ttcgttaattaaaccaataaatacatcaacgaaatatttcccgacaacgcaaatcaatacgcgctcaccgttaacctacgcttcaataccaaacccgaccaacgcccgctataattcgacgataaaaataacgaattcaacaacctatacttcgcgtacgataacttacgccaataaatacgtcgcgccttactcgaccgccgccgccaatatcaacaattcaaattcactaatacccgttaccgaataaatcgcgataacgcgcgatttaccgacgatcaacgtaccgattttatcaaacgccacctaaataacacgacccaactattccaacgccgctccgcctttaatcaacgccccacgacgcgctaccgccgccaacccgaaaataatcgccgcaaacgttaaaataactaacgcacacgaacaaccaatcaacaacaacgtcaaccctttataaatccactcctaccaactaacgacaaacaacaacgataacaccaacgtcaccaacaaaacgacgaccataatcgcgaacgtataaatacgactaaaacgatcgataaaccgctcaataaaaacgcgacgctcttcgacttcttcgatcaatttcaaaatccgatcaataacgctaactcccgattctaacaacacttccaacgtcaccaaacgatctacgctaataacaccaacaaaaactttatcgcccgttacgcgctccaccgaaataaattcgccgatcaaaacgctttcatcaaaactaacaaacgataaaaacaatttaccgtcgacaaacaaacgcccacctacgacgacttcaatcacatcgccaaaacgcaaactattaatcgccacctcttcccgctcacccttacgcaaacgcgtaacgatttctaatttcaacgccattaacgcgctaacgccctaacgcgcgcgactaacgacccaaccttccaatc

SEQ ID NO: 16227 - DNA, 959 bp, Artificial Sequence
  chemically treated genomic DNA (Homo sapiens) CpG-island No: 16227
ttcgttaattaaattagtaaatgtattagcgggatgtttttcggtagcgtaaattaatacgcgtttatcgttaatttgcgttttaatgttagattcgattagcgttcgttgtgattcggcggtgggaatggcgagtttagtaatttgtgtttcgcgtacgatggtttgcgttagtggatgcgtcgcgttttgttcgatcgtcgtcgttagtgttagtagtttagatttattaatattcgttgtcggatgaatcgcggtaacgcgcggtttatcgacggttagcgtatcggttttattaaacgttatttgagtaatacgatttagttgttttagcgtcgtttcgtttttaattaacgttttacgacgcgttgtcgtcgttagttcggaggtaatcgtcgtaggcgttgagataattaacgtatacgggtagttaattagtagtagcgttagttttttataaatttatttttgttagttggcggtaaatagtagcggtggtattagcgttattagtagagcgacggttataatcgcgggcgtatagatacggttgaaacggtcgataaatcgtttaatgggagcgcgacgtttttcggttttttcgattagttttagaattcggttaatggcgttggttttcggttttgatagtatttttaacgttattagacggtttacgttggtggtattagtagggattttatcgttcgttgcgcgttttatcggaatggattcgtcggttagggcgtttttattaaaattggtaaacggtgagagtagtttatcgtcggtaggtaaacgtttatttgcggcgattttaattatatcgttagggcgtaggttgttaatcgttattttttttcgtttatttttacgtaggcgcgtggcggtttttggttttagcgttattaacgcgttaacgttttgacgcgcgcggttggcggtttagttttttagtt

SEQ ID NO: 16228 - DNA, 959 bp, Artificial Sequence
  chemically treated genomic DNA (Homo sapiens) CpG-island No: 16228
aactaaaaaactaaaccgccaaccgcgcgcgtcaaaacgttaacgcgttaataacgctaaaaccaaaaaccgccacgcgcctacgtaaaaataaacgaaaaaaaataacgattaacaacctacgccctaacgatataattaaaatcgccgcaaataaacgtttacctaccgacgataaactactctcaccgtttaccaattttaataaaaacgccctaaccgacgaatccattccgataaaacgcgcaacgaacgataaaatccctactaataccaccaacgtaaaccgtctaataacgttaaaaatactatcaaaaccgaaaaccaacgccattaaccgaattctaaaactaatcgaaaaaaccgaaaaacgtcgcgctcccattaaacgatttatcgaccgtttcaaccgtatctatacgcccgcgattataaccgtcgctctactaataacgctaataccaccgctactatttaccgccaactaacaaaaataaatttataaaaaactaacgctactactaattaactacccgtatacgttaattatctcaacgcctacgacgattacctccgaactaacgacgacaacgcgtcgtaaaacgttaattaaaaacgaaacgacgctaaaacaactaaatcgtattactcaaataacgtttaataaaaccgatacgctaaccgtcgataaaccgcgcgttaccgcgattcatccgacaacgaatattaataaatctaaactactaacactaacgacgacgatcgaacaaaacgcgacgcatccactaacgcaaaccatcgtacgcgaaacacaaattactaaactcgccattcccaccgccgaatcacaacgaacgctaatcgaatctaacattaaaacgcaaattaacgataaacgcgtattaatttacgctaccgaaaaacatcccgctaatacatttactaatttaattaacgaa

SEQ ID NO: 16229 - DNA, 524 bp, Artificial Sequence
  chemically treated genomic DNA (Homo sapiens) CpG-island No: 16229
ggttcgtttataaagcggtggtcgcgaattacgcgatcggattgaatgtttagaatggttgtcggaatgattttgtcgtttagtagtagggttacggtgtgtatcggacgtacgaagtgtacgtcgtttgcgttttaacgtattagtttcgggatcggtagtttcgttagagaagtcgtaattatattcggtagtagtgtttcggtgttttcgttttttatatgggcgcgatatagtagttattcgtttttatcggtagttagacgtttagtttggttaacggtaatatcgtaattacgcgtttaattttttgacgttttgttcggtttgtttttagcgtcgaacgtttgggtaatcgtcgggtcgcgtttttcgattttacgattcggttgcgttttcggtaggttagttattttagcgttaggacgagcggagtagtaattattgacggggcgtgtgcgaggttacgtttttagttttaagaagtcgtttaaggtttttagttgtcgggatgggggggttta

SEQ ID NO: 16230 - DNA, 524 bp, Artificial Sequence
  chemically treated genomic DNA (Homo sapiens) CpG-island No: 16230
taaacccccccatcccgacaactaaaaaccttaaacgacttcttaaaactaaaaacgtaacctcgcacacgccccgtcaataattactactccgctcgtcctaacgctaaaataactaacctaccgaaaacgcaaccgaatcgtaaaatcgaaaaacgcgacccgacgattacccaaacgttcgacgctaaaaacaaaccgaacaaaacgtcaaaaaattaaacgcgtaattacgatattaccgttaaccaaactaaacgtctaactaccgataaaaacgaataactactatatcgcgcccatataaaaaacgaaaacaccgaaacactactaccgaatataattacgacttctctaacgaaactaccgatcccgaaactaatacgttaaaacgcaaacgacgtacacttcgtacgtccgatacacaccgtaaccctactactaaacgacaaaatcattccgacaaccattctaaacattcaatccgatcgcgtaattcgcgaccaccgctttataaacgaacc

SEQ ID NO: 16231 - DNA, 524 bp, Artificial Sequence
  chemically treated genomic DNA (Homo sapiens) CpG-island No: 16231
tgagtttttttatttcggtagttgggggttttgggcgattttttgggattggagacgtggtttcgtatacgtttcgttaatggttgttgtttcgttcgttttggcgttgaagtagttagtttgtcggaagcgtaatcggatcgtgaaatcgaaaaacgcggttcggcgattgtttaggcgttcgacgttgaaggtaaatcgagtaaagcgttagaaggttgggcgcgtggttgcggtattatcgttgattaggttgagcgtttgattatcgataaaggcgaatggttgttgtatcgcgtttatgtgaagggcgaaagtatcgaagtattgttgtcgaatatggttgcgatttttttggcgaaattgtcgatttcgaaattgatgcgttggggcgtaagcgacgtgtatttcgtgcgttcggtgtatatcgtgattttgttgttgggcgataaagttatttcggtaattattttgggtatttagttcgatcgcgtgattcgcggttatcgttttatgggcgagtt

SEQ ID NO: 16232 - DNA, 524 bp, Artificial Sequence
  chemically treated genomic DNA (Homo sapiens) CpG-island No: 16232
aactcgcccataaaacgataaccgcgaatcacgcgatcgaactaaatacccaaaataattaccgaaataactttatcgcccaacaacaaaatcacgatatacaccgaacgcacgaaatacacgtcgcttacgccccaacgcatcaatttcgaaatcgacaatttcgccaaaaaaatcgcaaccatattcgacaacaatacttcgatactttcgcccttcacataaacgcgatacaacaaccattcgcctttatcgataatcaaacgctcaacctaatcaacgataataccgcaaccacgcgcccaaccttctaacgctttactcgatttaccttcaacgtcgaacgcctaaacaatcgccgaaccgcgtttttcgatttcacgatccgattacgcttccgacaaactaactacttcaacgccaaaacgaacgaaacaacaaccattaacgaaacgtatacgaaaccacgtctccaatcccaaaaaatcgcccaaaacccccaactaccgaaataaaaaaactca

SEQ ID NO: 16233 - DNA, 938 bp, Artificial Sequence
  chemically treated genomic DNA (Homo sapiens) CpG-island No: 16233
tattcgcgtattcgttttgatttgtttaattatgaatttcgcggttgttcgcgtggcgtaagttatttttggtatttttatagcgttaatcgtttgaaatattcgtttattcgtaaacgattgattgaattgtggcgcgaagtttttaagtaatatagcgattcggtattggcgtgggtatcgattatgaacgattcgtaaaagtgtttgagttataaataagtgcgtgggcgcggcgggtttattcgttttaattggtaggaattaaattagttgattgtcgtcgttaacgtttggattattagaatttacggttcggatcgcgttgtcggtttttcgtcgatttcggcgatgtcgatggttttttacgtcgtcggaacgcgttatttgtcgttgtttggcggtatttgtataagtttttacgattggtattgcgattgttttttgcgtttcgatgatttggggcgagtaaattgacgtatcggaatttgttgattggtataattttagttatattatcgtttgggggttaaacgtgtcgtagacgcgtatttcggatgtttatttttttattgaagtgcgttataaagggattaaaattgttgtcgttatattagattacgttgaaatcgttaaattgtgcgatttgtggttggtatcgaaatagggtatcgatgcggtaatggcgttggcgatgggttacgtaatgttgcgtgaattttatttcgataatttaagttagtattttatcgattatgtgcgtcgttatatcgatatgtcgatgttggtgatgttggaagaacgcgacggttattacgttgtaggtcgtatgttgcgcgttgttgatttggttgatgcgttgggttaggaaaataattcggaatggaaaattgtcgtttttaatattaatggcgaaatggttgcgtcgaacggtttta

SEQ ID NO: 16234 - DNA, 938 bp, Artificial Sequence
  chemically treated genomic DNA (Homo sapiens) CpG-island No: 16234
taaaaccgttcgacgcaaccatttcgccattaatattaaaaacgacaattttccattccgaattattttcctaacccaacgcatcaaccaaatcaacaacgcgcaacatacgacctacaacgtaataaccgtcgcgttcttccaacatcaccaacatcgacatatcgatataacgacgcacataatcgataaaatactaacttaaattatcgaaataaaattcacgcaacattacgtaacccatcgccaacgccattaccgcatcgataccctatttcgataccaaccacaaatcgcacaatttaacgatttcaacgtaatctaatataacgacaacaattttaatccctttataacgcacttcaataaaaaaataaacatccgaaatacgcgtctacgacacgtttaacccccaaacgataatataactaaaattataccaatcaacaaattccgatacgtcaatttactcgccccaaatcatcgaaacgcaaaaaacaatcgcaataccaatcgtaaaaacttatacaaataccgccaaacaacgacaaataacgcgttccgacgacgtaaaaaaccatcgacatcgccgaaatcgacgaaaaaccgacaacgcgatccgaaccgtaaattctaataatccaaacgttaacgacgacaatcaactaatttaattcctaccaattaaaacgaataaacccgccgcgcccacgcacttatttataactcaaacacttttacgaatcgttcataatcgatacccacgccaataccgaatcgctatattacttaaaaacttcgcgccacaattcaatcaatcgtttacgaataaacgaatatttcaaacgattaacgctataaaaataccaaaaataacttacgccacgcgaacaaccgcgaaattcataattaaacaaatcaaaacgaatacgcgaata

SEQ ID NO: 16235 - DNA, 938 bp, Artificial Sequence
  chemically treated genomic DNA (Homo sapiens) CpG-island No: 16235
tagaatcgttcggcgtaattatttcgttattggtattaaaggcgatagttttttatttcggattgtttttttggtttagcgtattaattagattagtagcgcgtagtatacgatttgtagcgtagtaatcgtcgcgtttttttagtattattagtatcggtatgtcggtgtagcgacgtatatagtcggtgaaatattggtttgggttgtcgaggtggaatttacgtagtattacgtggtttatcgttagcgttattgtcgtatcggtgttttgtttcggtgttagttatagatcgtatagtttggcgattttagcgtagtttggtgtgacggtaatagttttggtttttttgtaacgtattttagtaaagaagtgagtattcggggtacgcgtttgcggtacgtttgatttttaggcgatgatgtagttggagttgtattagttagtagatttcggtacgttagtttgttcgttttaggttatcggaacgtaggaggtagtcgtagtattagtcgtagaaatttatataggtgtcgttaagtagcgatagataacgcgtttcggcggcgtaagaaattatcgatatcgtcgggatcggcgagaaatcggtaacgcgattcgggtcgtaggttttgatggtttagacgttagcggcggtaattagttggtttagtttttgttagttggagcggataaattcgtcgcgtttacgtatttgtttgtagtttaggtatttttgcggatcgtttataatcgatgtttacgttagtatcggatcgttgtgttgtttgagggtttcgcgttatagtttaattagtcgtttacgaatgagcgggtattttaggcggttagcgttgtaaagatattaggagtaatttgcgttacgcgggtagtcgcgaggtttatgattgggtaggttagggcgagtgcgcgggta

SEQ ID NO: 16236 - DNA, 938 bp, Artificial Sequence
  chemically treated genomic DNA (Homo sapiens) CpG-island No: 16236
tacccgcgcactcgccctaacctacccaatcataaacctcgcgactacccgcgtaacgcaaattactcctaatatctttacaacgctaaccgcctaaaatacccgctcattcgtaaacgactaattaaactataacgcgaaaccctcaaacaacacaacgatccgatactaacgtaaacatcgattataaacgatccgcaaaaatacctaaactacaaacaaatacgtaaacgcgacgaatttatccgctccaactaacaaaaactaaaccaactaattaccgccgctaacgtctaaaccatcaaaacctacgacccgaatcgcgttaccgatttctcgccgatcccgacgatatcgataatttcttacgccgccgaaacgcgttatctatcgctacttaacgacacctatataaatttctacgactaatactacgactacctcctacgttccgataacctaaaacgaacaaactaacgtaccgaaatctactaactaatacaactccaactacatcatcgcctaaaaatcaaacgtaccgcaaacgcgtaccccgaatactcacttctttactaaaatacgttacaaaaaaaccaaaactattaccgtcacaccaaactacgctaaaatcgccaaactatacgatctataactaacaccgaaacaaaacaccgatacgacaataacgctaacgataaaccacgtaatactacgtaaattccacctcgacaacccaaaccaatatttcaccgactatatacgtcgctacaccgacataccgatactaataatactaaaaaaacgcgacgattactacgctacaaatcgtatactacgcgctactaatctaattaatacgctaaaccaaaaaaacaatccgaaataaaaaactatcgcctttaataccaataacgaaataattacgccgaacgattcta

SEQ ID NO: 16237 - DNA, 739 bp, Artificial Sequence
  chemically treated genomic DNA (Homo sapiens) CpG-island No: 16237
cgattatgttggcgggcgggatcggtaatattcgcgtcgattacgtataaaaaggcgagattaacgtcggtgcgaagttggtcgttttcggcggttcggtaatgaatatcggttttggcggtggtgtagcgttttttatggcgtttggttagtttgatgtcgatttcgattttgttttcgtatagcgcgataattcggagatggagcgtcgttgttaggaagtgatcgatcgttgttggtagtttggtgatgttaatttaattttgtttatttacgacgttggcgttggcggtttttttaacgttatgtcggaattggtgagcgacggcgggcgcggcggtaaatttgaattgcgcgagattttaagcgacgaatcgggtatgagttcgttggaaatttggtgtaacgaattttaggaacgttacgtgttggcggttgttgtcgattattatcgttgtatgacgaaattgtgtacgcgtgagcgcgtatttttacgcggggattggtgaagttatcgataattgtattttttttgtcgatcgttatttgataatacgtcgtcggttgtcgtggatttcgttggtaaacgcgaaatattcggagataattcgaataaggaagtttgtcggaaggtatatggatcgtattatcgatgcgcggttaaaatttttttttattattcgatatttatatggcggtgcgaatagtaaatatattagaatatcgggattttcggtat

SEQ ID NO: 16238 - DNA, 739 bp, Artificial Sequence
  chemically treated genomic DNA (Homo sapiens) CpG-island No: 16238
ataccgaaaatcccgatattctaatatatttactattcgcaccgccatataaatatcgaataataaaaaaaaattttaaccgcgcatcgataatacgatccatataccttccgacaaacttccttattcgaattatctccgaatatttcgcgtttaccaacgaaatccacgacaaccgacgacgtattatcaaataacgatcgacaaaaaaaatacaattatcgataacttcaccaatccccgcgtaaaaatacgcgctcacgcgtacacaatttcgtcatacaacgataataatcgacaacaaccgccaacacgtaacgttcctaaaattcgttacaccaaatttccaacgaactcatacccgattcgtcgcttaaaatctcgcgcaattcaaatttaccgccgcgcccgccgtcgctcaccaattccgacataacgttaaaaaaaccgccaacgccaacgtcgtaaataaacaaaattaaattaacatcaccaaactaccaacaacgatcgatcacttcctaacaacgacgctccatctccgaattatcgcgctatacgaaaacaaaatcgaaatcgacatcaaactaaccaaacgccataaaaaacgctacaccaccgccaaaaccgatattcattaccgaaccgccgaaaacgaccaacttcgcaccgacgttaatctcgcctttttatacgtaatcgacgcgaatattaccgatcccgcccgccaacataatcg

SEQ ID NO: 16239 - DNA, 739 bp, Artificial Sequence
  chemically treated genomic DNA (Homo sapiens) CpG-island No: 16239
gtgtcgagggtttcggtgttttaatgtgtttgttattcgtatcgttatgtgggtatcgagtggtaaggagaggttttgatcgcgtatcgatggtacggtttatgtatttttcgataggtttttttgttcgggttgttttcgggtatttcgcgtttattagcggagtttacggtagtcgacggcgtattattagatgacgatcggtagagaagatgtagttgtcggtggttttattaattttcgcgtaggggtgcgcgtttacgcgtatatagtttcgttatatagcggtaatgatcggtagtaatcgttagtacgtagcgtttttgggattcgttatattagatttttagcgggtttatgttcggttcgtcgtttagaatttcgcgtagtttaaatttatcgtcgcgttcgtcgtcgtttattagtttcggtatggcgttagaaagatcgttagcgttaacgtcgtggataaataggattgggttggtattattaagttgttagtaacggtcgattattttttggtagcgacgttttattttcgggttgtcgcgttgtacggaagtaaagtcgaggtcggtattagattgattagacgttatagaagacgttgtattatcgttaagatcgatgtttattgtcgggtcgtcgagaacgattagtttcgtatcgacgttgatttcgtttttttgtacgtgatcggcgcgaatgttgtcgatttcgttcgttagtatgatcg

SEQ ID NO: 16240 - DNA, 739 bp, Artificial Sequence
  chemically treated genomic DNA (Homo sapiens) CpG-island No: 16240
cgatcatactaacgaacgaaatcgacaacattcgcgccgatcacgtacaaaaaaacgaaatcaacgtcgatacgaaactaatcgttctcgacgacccgacaataaacatcgatcttaacgataatacaacgtcttctataacgtctaatcaatctaataccgacctcgactttacttccgtacaacgcgacaacccgaaaataaaacgtcgctaccaaaaaataatcgaccgttactaacaacttaataataccaacccaatcctatttatccacgacgttaacgctaacgatctttctaacgccataccgaaactaataaacgacgacgaacgcgacgataaatttaaactacgcgaaattctaaacgacgaaccgaacataaacccgctaaaaatctaatataacgaatcccaaaaacgctacgtactaacgattactaccgatcattaccgctatataacgaaactatatacgcgtaaacgcgcacccctacgcgaaaattaataaaaccaccgacaactacatcttctctaccgatcgtcatctaataatacgccgtcgactaccgtaaactccgctaataaacgcgaaatacccgaaaacaacccgaacaaaaaaacctatcgaaaaatacataaaccgtaccatcgatacgcgatcaaaacctctccttaccactcgatacccacataacgatacgaataacaaacacattaaaacaccgaaaccctcgacac

SEQ ID NO: 16241 - DNA, 1169 bp, Artificial Sequence
  chemically treated genomic DNA (Homo sapiens) CpG-island No: 16241
gtcgtcgtttatttcgaacgggtatagttttagtacgcgcgcggcgttttttagttttatcgtttttataggtacgcggtaagcgtagcgttatcggcgggtttttttaacgttaggtaggtttttcgcgcgtgggtgtgtatggtgtgtagtggattaaaggcgttgcgcgggttttgtatgatggtggtaattttgatgtcgcgtagggcgtaaggcgaaatcggtttgttatcggttaaaatttttttcgtcgtttggcgaacgttagcgggtaaaatgtttagcgttgcggcgtaggttaatgatttttcgttgtcgttatcgtcgattaacgttagtacgcgttcgcgttgtagggttaacgatatatcgtgtattagcggttgcgcggtttgtagcgcgatattacgtagtttaatttgttgcggtattagtgtgcgtgtttcgttattagatgagggtttagatgatcgcgtagtgcgttatttattaggttaaaggttattacgttgataaatagcgttagtttcggttagaatatttgtagcggttgggtttagatatattggcgcgcgtcgttaattattacgttttattcggcggtcggcgcggttatatcgaggttaaggaaagatattttcgcgacgtgtagtattatatggtcgatatttagcgttgttagtattagtagcgaagggattatcgcgtttgttagatgatcgataaatattcgtatatggttcgtatcggaaagtcgtgacgttagtataaattcgcgttggcgtagtgaaattattaggttgcgtattatgcgtgtatattacgtttagtgcgatagggcgatggcgataattacgttggttagttcggtgtcgagtacgttaattataaagaacgatagaatcgaggtcgggaaggttataaatatatcggcgacgcgtatggtggtttgattaacgcgttcgttaattaattcggcgttgtcgttaataattagttttaatgttagtattagtagtaggtaggttattatcgaatcgagcgatacgcgggtcgttgttattacgtcgcgacgatataattatttcggttcggaaatttttattattagggtttggatttatcggaggattgggtttttttaagggattttaacgtttggtttt

SEQ ID NO: 16242 - DNA, 1169 bp, Artificial Sequence
  chemically treated genomic DNA (Homo sapiens) CpG-island No: 16242
aaaaccaaacgttaaaatcccttaaaaaaacccaatcctccgataaatccaaaccctaataataaaaatttccgaaccgaaataattatatcgtcgcgacgtaataacaacgacccgcgtatcgctcgattcgataataacctacctactactaatactaacattaaaactaattattaacgacaacgccgaattaattaacgaacgcgttaatcaaaccaccatacgcgtcgccgatatatttataaccttcccgacctcgattctatcgttctttataattaacgtactcgacaccgaactaaccaacgtaattatcgccatcgccctatcgcactaaacgtaatatacacgcataatacgcaacctaataatttcactacgccaacgcgaatttatactaacgtcacgactttccgatacgaaccatatacgaatatttatcgatcatctaacaaacgcgataatcccttcgctactaatactaacaacgctaaatatcgaccatataatactacacgtcgcgaaaatatctttccttaacctcgatataaccgcgccgaccgccgaataaaacgtaataattaacgacgcgcgccaatatatctaaacccaaccgctacaaatattctaaccgaaactaacgctatttatcaacgtaataacctttaacctaataaataacgcactacgcgatcatctaaaccctcatctaataacgaaacacgcacactaataccgcaacaaattaaactacgtaatatcgcgctacaaaccgcgcaaccgctaatacacgatatatcgttaaccctacaacgcgaacgcgtactaacgttaatcgacgataacgacaacgaaaaatcattaacctacgccgcaacgctaaacattttacccgctaacgttcgccaaacgacgaaaaaaattttaaccgataacaaaccgatttcgccttacgccctacgcgacatcaaaattaccaccatcatacaaaacccgcgcaacgcctttaatccactacacaccatacacacccacgcgcgaaaaacctacctaacgttaaaaaaacccgccgataacgctacgcttaccgcgtacctataaaaacgataaaactaaaaaacgccgcgcgcgtactaaaactatacccgttcgaaataaacgacgac

SEQ ID NO: 16243 - DNA, 1169 bp, Artificial Sequence
  chemically treated genomic DNA (Homo sapiens) CpG-island No: 16243
aaggttaagcgttggggttttttgggggggtttaatttttcggtaggtttaggttttggtaatgggggttttcgggtcgaagtagttgtgtcgtcgcggcgtgatggtagcgattcgcgtgtcgttcggttcggtaatggtttgtttgttgttggtgttgatattagggttggttattggcggtagcgtcgggttgattggcgggcgcgttgattaggttattatgcgcgtcgtcgatatgtttatgattttttcgatttcgattttgtcgttttttatggttggcgtgttcggtatcgggttgattaacgtaattatcgttatcgttttgtcgtattgggcgtggtatgtacgtatggtgcgtagtttggtgattttattacgttaacgcgagtttgtgttggcgttacggtttttcggtgcgggttatgtgcgggtgtttgtcgattatttggtaggcgcggtgattttttcgttgttggtgttggtaacgttggatatcggttatatgatgttgtacgtcgcggggatgtttttttttggtttcggtgtgatcgcgtcgatcgtcgaatggggcgtgatgattaacgacgcgcgttagtatatttggatttagtcgttgtaaatgttttggtcggggttggcgttgtttattagcgtgatggtttttaatttggtgggtgacgtattgcgcgattatttggatttttatttggtgacggagtacgtatattaatgtcgtaatagattgaattacgtaatatcgcgttataggtcgcgtagtcgttggtatacggtgtatcgttaattttgtaacgcgggcgcgtgttggcgttagtcggcggtagcggtagcgggaaattattaatttgcgtcgtaacgttgggtattttgttcgttggcgttcgttagacggcgggggaaattttagtcgatggtaaatcggtttcgttttgcgttttgcgcggtattaaaattgttattattatgtagaattcgcgtagcgtttttaatttattgtatattatgtatatttacgcgcgggaaatttgtttggcgttagggaaattcgtcgatgacgttacgtttatcgcgtgtttatagaagcggtggggttggaaaacgtcgcgcgcgtgttgaagttgtattcgttcgagatgagcggcggt

SEQ ID NO: 16244 - DNA, 1169 bp, Artificial Sequence
  chemically treated genomic DNA (Homo sapiens) CpG-island No: 16244
accgccgctcatctcgaacgaatacaacttcaacacgcgcgcgacgttttccaaccccaccgcttctataaacacgcgataaacgtaacgtcatcgacgaatttccctaacgccaaacaaatttcccgcgcgtaaatatacataatatacaataaattaaaaacgctacgcgaattctacataataataacaattttaataccgcgcaaaacgcaaaacgaaaccgatttaccatcgactaaaatttcccccgccgtctaacgaacgccaacgaacaaaatacccaacgttacgacgcaaattaataatttcccgctaccgctaccgccgactaacgccaacacgcgcccgcgttacaaaattaacgatacaccgtataccaacgactacgcgacctataacgcgatattacgtaattcaatctattacgacattaatatacgtactccgtcaccaaataaaaatccaaataatcgcgcaatacgtcacccaccaaattaaaaaccatcacgctaataaacaacgccaaccccgaccaaaacatttacaacgactaaatccaaatatactaacgcgcgtcgttaatcatcacgccccattcgacgatcgacgcgatcacaccgaaaccaaaaaaaaacatccccgcgacgtacaacatcatataaccgatatccaacgttaccaacaccaacaacgaaaaaatcaccgcgcctaccaaataatcgacaaacacccgcacataacccgcaccgaaaaaccgtaacgccaacacaaactcgcgttaacgtaataaaatcaccaaactacgcaccatacgtacataccacgcccaatacgacaaaacgataacgataattacgttaatcaacccgataccgaacacgccaaccataaaaaacgacaaaatcgaaatcgaaaaaatcataaacatatcgacgacgcgcataataacctaatcaacgcgcccgccaatcaacccgacgctaccgccaataaccaaccctaatatcaacaccaacaacaaacaaaccattaccgaaccgaacgacacgcgaatcgctaccatcacgccgcgacgacacaactacttcgacccgaaaacccccattaccaaaacctaaacctaccgaaaaattaaacccccccaaaaaaccccaacgcttaacctt

SEQ ID NO: 16245 - DNA, 1033 bp, Artificial Sequence
  chemically treated genomic DNA (Homo sapiens) CpG-island No: 16245
ggcgttgacgtaatgcgcggttcgcgcggtttgaaagcggttggttcgtatgtggttattaaagcgatggtattcggcgtttttgtttgtttcgttatttcgtttaaaatttatggcgttaattattttattagtttcgcgtgtgcgattttcgtatattgtatcggtaacgtagtagagtagatttaattgggtaaataggatatcgtgtttgttggcggcggcgaagagttgtgttgggaaatggtttgcgaattcgacgtaatgggtgcgttgtttattaaatataacgatatttcggaaaaagtttttcgtatttacgacgtttatcgtgacggtttcgttatcgttggcggcggcggtatggtagtggttgaagagttggaatacgcgttggcgcgtggtgtttatatttatgttgaaatcgttggttacggcgtaatttttgatggtgtagatatggttgtttcgtttggcgaaggcgtagtacgttgtatgaagatggcgatgtatggcgttgatattttaatcgattatttgaatttttacggtatttcgatttcggttggcgacgtgaaagagttggtagttattcgtgaagtgttcggcgataagagttcggcgatttttgtaattaaagttatgatcggttattttttgggcgttgttggcgtataggaagttatttattttttgttgatgttggaatacggttttatcgtttcgagtattaatattgaagagttggacgagtaggttgcgggtttgaatatcgtgatcgaaacgatcgatcgcgaattgattatcgttatgtttaatagtttcggtttcggcggtattaacgttacgttggtaatgcgtaagttgaaagattaattcgtagtaggtcggagtagacgcgttagcgtcgtattcgacgttacgcgttaatgcggttttcggtattaacgtaaaagggaatttgatggtttttttttttatattattgataatcgtcgttagttttaggtaaatttttcgttttgtcgatttt

SEQ ID NO: 16246 - DNA, 1033 bp, Artificial Sequence
  chemically treated genomic DNA (Homo sapiens) CpG-island No: 16246
aaaatcgacaaaacgaaaaatttacctaaaactaacgacgattatcaataatataaaaaaaaaaaccatcaaattcccttttacgttaataccgaaaaccgcattaacgcgtaacgtcgaatacgacgctaacgcgtctactccgacctactacgaattaatctttcaacttacgcattaccaacgtaacgttaataccgccgaaaccgaaactattaaacataacgataatcaattcgcgatcgatcgtttcgatcacgatattcaaacccgcaacctactcgtccaactcttcaatattaatactcgaaacgataaaaccgtattccaacatcaacaaaaaataaataacttcctatacgccaacaacgcccaaaaaataaccgatcataactttaattacaaaaatcgccgaactcttatcgccgaacacttcacgaataactaccaactctttcacgtcgccaaccgaaatcgaaataccgtaaaaattcaaataatcgattaaaatatcaacgccatacatcgccatcttcatacaacgtactacgccttcgccaaacgaaacaaccatatctacaccatcaaaaattacgccgtaaccaacgatttcaacataaatataaacaccacgcgccaacgcgtattccaactcttcaaccactaccataccgccgccgccaacgataacgaaaccgtcacgataaacgtcgtaaatacgaaaaactttttccgaaatatcgttatatttaataaacaacgcacccattacgtcgaattcgcaaaccatttcccaacacaactcttcgccgccgccaacaaacacgatatcctatttacccaattaaatctactctactacgttaccgatacaatatacgaaaatcgcacacgcgaaactaataaaataattaacgccataaattttaaacgaaataacgaaacaaacaaaaacgccgaataccatcgctttaataaccacatacgaaccaaccgctttcaaaccgcgcgaaccgcgcattacgtcaacgcc

SEQ ID NO: 16247 - DNA, 1033 bp, Artificial Sequence
  chemically treated genomic DNA (Homo sapiens) CpG-island No: 16247
gaaatcgataaagcgggaagtttgtttggaattggcggcgattgttaatgatgtgaaaaagggaattattaggtttttttttgcgttagtgtcggaggtcgtattggcgcgtaacgtcggatgcgacgttggcgcgtttatttcgatttattgcgaattaattttttagtttgcgtattattagcgtggcgttggtgtcgtcgaagtcgaagttgttagatataacggtggttagttcgcgatcggtcgtttcggttacgatgtttagattcgtagtttgttcgtttagttttttaatgttgatgttcggggcgataaagtcgtgttttagtattagtagagagtagatagttttttgtacgttagtagcgtttagagagtgatcggttatggttttggttgtagaaatcgtcgggtttttatcgtcgaatattttacggatagttgttagtttttttacgtcgttaatcggagtcgaagtatcgtgggagtttaggtaatcgattggggtattaacgttatgtatcgttatttttatgtagcgtattgcgttttcgttagacggagtaattatgtttgtattattagaggttgcgtcgtagttaacgattttagtatagatgtgagtattacgcgttagcgcgtgttttagttttttaattattattatatcgtcgtcgttagcgataacgaaatcgttacggtgagcgtcgtaagtacgggaggtttttttcggggtgtcgttgtatttagtagatagcgtatttattgcgtcgaattcgtaagttattttttagtatagtttttcgtcgtcgttagtaaatacgatgttttgtttgtttagttggatttgttttattgcgttatcgatatagtgtgcggaagtcgtatacgcggagttgatggagtagttaacgttatgaattttaaacggggtggcgaggtaggtagaaacgtcggatgttatcgttttggtgattatatacgggttaatcgtttttaggtcgcgcgggtcgcgtattgcgttagcgtt

SEQ ID NO: 16248 - DNA, 1033 bp, Artificial Sequence
  chemically treated genomic DNA (Homo sapiens) CpG-island No: 16248
aacgctaacgcaatacgcgacccgcgcgacctaaaaacgattaacccgtatataatcaccaaaacgataacatccgacgtttctacctacctcgccaccccgtttaaaattcataacgttaactactccatcaactccgcgtatacgacttccgcacactatatcgataacgcaataaaacaaatccaactaaacaaacaaaacatcgtatttactaacgacgacgaaaaactatactaaaaaataacttacgaattcgacgcaataaatacgctatctactaaatacaacgacaccccgaaaaaaacctcccgtacttacgacgctcaccgtaacgatttcgttatcgctaacgacgacgatataataataattaaaaaactaaaacacgcgctaacgcgtaatactcacatctatactaaaatcgttaactacgacgcaacctctaataatacaaacataattactccgtctaacgaaaacgcaatacgctacataaaaataacgatacataacgttaataccccaatcgattacctaaactcccacgatacttcgactccgattaacgacgtaaaaaaactaacaactatccgtaaaatattcgacgataaaaacccgacgatttctacaaccaaaaccataaccgatcactctctaaacgctactaacgtacaaaaaactatctactctctactaatactaaaacacgactttatcgccccgaacatcaacattaaaaaactaaacgaacaaactacgaatctaaacatcgtaaccgaaacgaccgatcgcgaactaaccaccgttatatctaacaacttcgacttcgacgacaccaacgccacgctaataatacgcaaactaaaaaattaattcgcaataaatcgaaataaacgcgccaacgtcgcatccgacgttacgcgccaatacgacctccgacactaacgcaaaaaaaaacctaataattccctttttcacatcattaacaatcgccgccaattccaaacaaacttcccgctttatcgatttc

SEQ ID NO: 16249 - DNA, 530 bp, Artificial Sequence
  chemically treated genomic DNA (Homo sapiens) CpG-island No: 16249
gtcgagttcgtagtaggtttattaggaatcgaggatgattttcgtcgttaatgtattttagttaggtaacgtttagcgttagtaaattcgggcgtaggtattattaaattcgtcgcgtagtagattcgttagcgttacgttcgtcgttattattaaatcgttatagttaaggtaaagtagcggtggatgaaagataagatcgggatgttgtagtatcggattgagatcgcggttttcgattgttggtggaaatattcgtacgaagggatcggattatagtattataaatagtagtagtgcggcgagtatgagagataaaacggttaacgttagcggaaatagcggatcggtttgttgtcgataatgttaggtaaatagcgcgttttaggcggaaagtagtagtatttaaagtagtagggaatttttatgggcgtttatacggtggtagtttgagttttacgatagacggttatagttatgtagcgcgatttaaatgatcgagaatcgtgatagaaatatacgtagtagta

SEQ ID NO: 16250 - DNA, 530 bp, Artificial Sequence
  chemically treated genomic DNA (Homo sapiens) CpG-island No: 16250
tactactacgtatatttctatcacgattctcgatcatttaaatcgcgctacataactataaccgtctatcgtaaaactcaaactaccaccgtataaacgcccataaaaattccctactactttaaatactactactttccgcctaaaacgcgctatttacctaacattatcgacaacaaaccgatccgctatttccgctaacgttaaccgttttatctctcatactcgccgcactactactatttataatactataatccgatcccttcgtacgaatatttccaccaacaatcgaaaaccgcgatctcaatccgatactacaacatcccgatcttatctttcatccaccgctactttaccttaactataacgatttaataataacgacgaacgtaacgctaacgaatctactacgcgacgaatttaataatacctacgcccgaatttactaacgctaaacgttacctaactaaaatacattaacgacgaaaatcatcctcgattcctaataaacctactacgaactcgac

SEQ ID NO: 16251 - DNA, 530 bp, Artificial Sequence
  chemically treated genomic DNA (Homo sapiens) CpG-island No: 16251
tgttattacgtatgtttttattacgattttcggttatttaggtcgcgttatatagttatagtcgtttgtcgtggaatttaagttgttatcgtgtgggcgtttatgaaggttttttgttgttttgggtattgttgtttttcgtttggagcgcgttgtttgtttggtattatcggtagtaaatcgattcgttattttcgttgacgttagtcgttttattttttatgttcgtcgtattgttattgtttgtggtgttgtggttcgattttttcgtgcggatatttttattagtaatcgaaggtcgcgattttaattcgatgttgtaatatttcggttttattttttatttatcgttgttttattttggttatggcggtttgatggtagcggcgagcgtggcgttggcgagtttattgcgcggcgagtttgatggtgtttgcgttcgaatttgttggcgttgggcgttatttggttggagtgtattaacggcggggattattttcggtttttggtgggtttattgcgaattcggt

SEQ ID NO: 16252 - DNA, 530 bp, Artificial Sequence
  chemically treated genomic DNA (Homo sapiens) CpG-island No: 16252
accgaattcgcaataaacccaccaaaaaccgaaaataatccccgccgttaatacactccaaccaaataacgcccaacgccaacaaattcgaacgcaaacaccatcaaactcgccgcgcaataaactcgccaacgccacgctcgccgctaccatcaaaccgccataaccaaaataaaacaacgataaataaaaaataaaaccgaaatattacaacatcgaattaaaatcgcgaccttcgattactaataaaaatatccgcacgaaaaaatcgaaccacaacaccacaaacaataacaatacgacgaacataaaaaataaaacgactaacgtcaacgaaaataacgaatcgatttactaccgataataccaaacaaacaacgcgctccaaacgaaaaacaacaatacccaaaacaacaaaaaaccttcataaacgcccacacgataacaacttaaattccacgacaaacgactataactatataacgcgacctaaataaccgaaaatcgtaataaaaacatacgtaataaca

SEQ ID NO: 16253 - DNA, 554 bp, Artificial Sequence
  chemically treated genomic DNA (Homo sapiens) CpG-island No: 16253
atgggcggagttttaggcgttggatggcgatataatcgatatggtttttattatcgtttttatcggcgttggcggcggtgtagtgagcggttgtaaattgtttatcggttttggcggtttggcggggtatatcgggtatacgtttgtcgatttatacggtttagtttgcggttgtggacgtataggttgcgtggaagcgattgtttttggtcgcggtattgtagcggtagcgtagggggagttggttggcgcggatgcgaaaattatttttacgcgcgtcgggtagggtgacgagtaggcgtagtagttgatttatcgtttcgtacgtacgtttgtaaggttgatcgttgatattaaagttataattgattgttagtgcgtggtggtcggtggtagcgttggtttggtagaagggtatttggcgttggtggaaacgtatttggcgtaggagttagcggtattttatgttgatttattggcggcgtattatcgttatgatgtaggtttatttggggttgcgttgttggtttagggagaaaaattatgatgatggg

SEQ ID NO: 16254 - DNA, 554 bp, Artificial Sequence
  chemically treated genomic DNA (Homo sapiens) CpG-island No: 16254
cccatcatcataatttttctccctaaaccaacaacgcaaccccaaataaacctacatcataacgataatacgccgccaataaatcaacataaaataccgctaactcctacgccaaatacgtttccaccaacgccaaatacccttctaccaaaccaacgctaccaccgaccaccacgcactaacaatcaattataactttaatatcaacgatcaaccttacaaacgtacgtacgaaacgataaatcaactactacgcctactcgtcaccctacccgacgcgcgtaaaaataattttcgcatccgcgccaaccaactccccctacgctaccgctacaataccgcgaccaaaaacaatcgcttccacgcaacctatacgtccacaaccgcaaactaaaccgtataaatcgacaaacgtatacccgatataccccgccaaaccgccaaaaccgataaacaatttacaaccgctcactacaccgccgccaacgccgataaaaacgataataaaaaccatatcgattatatcgccatccaacgcctaaaactccgcccat

SEQ ID NO: 16255 - DNA, 554 bp, Artificial Sequence
  chemically treated genomic DNA (Homo sapiens) CpG-island No: 16255
tttattattataatttttttttttgggttaatagcgtagttttaagtaaatttgtattatggcggtaatgcgtcgttagtaaattaatatgaaatgtcgttggtttttgcgttagatacgtttttattagcgttagatatttttttgttagattaacgttgttatcgattattacgtattggtaattagttgtggttttaatattagcgattagttttgtaagcgtacgtgcggagcggtgaattagttgttgcgtttgttcgttattttgttcggcgcgcgtgaaaatagttttcgtattcgcgttagttaattttttttgcgttgtcgttgtaatgtcgcgattagaagtaatcgtttttacgtaatttgtgcgtttatagtcgtagattgggtcgtgtggatcggtaagcgtatgttcgatatgtttcgttagatcgttagggtcggtaagtagtttgtagtcgtttattatatcgtcgttaacgtcggtggaaacggtgataaagattatatcggttatatcgttatttagcgtttgaaatttcgtttat

SEQ ID NO: 16256 - DNA, 554 bp, Artificial Sequence
  chemically treated genomic DNA (Homo sapiens) CpG-island No: 16256
ataaacgaaatttcaaacgctaaataacgatataaccgatataatctttatcaccgtttccaccgacgttaacgacgatataataaacgactacaaactacttaccgaccctaacgatctaacgaaacatatcgaacatacgcttaccgatccacacgacccaatctacgactataaacgcacaaattacgtaaaaacgattacttctaatcgcgacattacaacgacaacgcaaaaaaaattaactaacgcgaatacgaaaactattttcacgcgcgccgaacaaaataacgaacaaacgcaacaactaattcaccgctccgcacgtacgcttacaaaactaatcgctaatattaaaaccacaactaattaccaatacgtaataatcgataacaacgttaatctaacaaaaaaatatctaacgctaataaaaacgtatctaacgcaaaaaccaacgacatttcatattaatttactaacgacgcattaccgccataatacaaatttacttaaaactacgctattaacccaaaaaaaaaaattataataataaa

SEQ ID NO: 16257 - DNA, 844 bp, Artificial Sequence
  chemically treated genomic DNA (Homo sapiens) CpG-island No: 16257
cgacgttatcggtgttgttaaaagaaggttagtacgacgtagcgtaaaaattgttcgttatttttttcgttaatgaaatgtttgaggagcgttatgttgttagcgtggcgattcgtaataaggttgaagttttgcgtttggtacgattgttgtattagtaagaatcggtaaattttattcgtttggattaattaatttggtaattgatgtagaacgagtagttacgcgaagttgtcgatttattgttgtaacgttattttttttagggcgatgcgcgtgttagttagattttaatggcgcgattggcgtttttgttggaaagttatttttatttggtaacgtcggcgaaggtggcgattttatcgaaatttttatcgttggcggagtaacgttagtggtaaagttagttgtcgggtattgtagataattgttcggtaatagttcgtttgttggggcgatatgtcgtttttttacgatgtcgtcgtttggaatcgtttggtaaagtgttatcgggatacgttattcggtgtggcgttgtatgtatggttttaggtcgaataacgataatcgagcgtttggtaatatcgtgcggtagtttattaggcgtattaggttgaggattacgttatcgtattggcggtttggtagaaaattagtttttacgatatgagtaatgaggatttgtttgttgttgttaatatcgtttaggcggtaggaaatggtgcggttcgcgatcgttggttataataggtagaaaaacgtggattgggaagtaatgttttttattggtggttgtatgcgtaacgttatatttttggttagtcggaattcgtattgaacgatt

SEQ ID NO: 16258 - DNA, 844 bp, Artificial Sequence
  chemically treated genomic DNA (Homo sapiens) CpG-island No: 16258
aatcgttcaatacgaattccgactaaccaaaaatataacgttacgcatacaaccaccaataaaaaacattacttcccaatccacgtttttctacctattataaccaacgatcgcgaaccgcaccatttcctaccgcctaaacgatattaacaacaacaaacaaatcctcattactcatatcgtaaaaactaattttctaccaaaccgccaatacgataacgtaatcctcaacctaatacgcctaataaactaccgcacgatattaccaaacgctcgattatcgttattcgacctaaaaccatacatacaacgccacaccgaataacgtatcccgataacactttaccaaacgattccaaacgacgacatcgtaaaaaaacgacatatcgccccaacaaacgaactattaccgaacaattatctacaatacccgacaactaactttaccactaacgttactccgccaacgataaaaatttcgataaaatcgccaccttcgccgacgttaccaaataaaaataactttccaacaaaaacgccaatcgcgccattaaaatctaactaacacgcgcatcgccctaaaaaaaataacgttacaacaataaatcgacaacttcgcgtaactactcgttctacatcaattaccaaattaattaatccaaacgaataaaatttaccgattcttactaatacaacaatcgtaccaaacgcaaaacttcaaccttattacgaatcgccacgctaacaacataacgctcctcaaacatttcattaacgaaaaaaataacgaacaatttttacgctacgtcgtactaaccttcttttaacaacaccgataacgtcg

SEQ ID NO: 16259 - DNA, 844 bp, Artificial Sequence
  chemically treated genomic DNA (Homo sapiens) CpG-island No: 16259
gatcgtttagtgcgagtttcggttgattaggaatgtaacgttgcgtatgtagttattagtagagggtattgttttttagtttacgtttttttgtttgttgtagttagcgatcgcgagtcgtattattttttgtcgtttgggcggtattggtagtagtaagtagatttttattgtttatgtcgtgaagattgattttttgttaggtcgttagtgcggtggcgtagtttttaatttgatacgtttgataggttatcgtacgatgttgttaggcgttcggttgtcgttgttcggtttgaagttatgtatataacgttatatcgggtagcgtgtttcgataatattttgttagacggttttaggcggcggtatcgtaggaaggcgatatatcgttttagtaagcgaattattgtcgggtaattatttgtaatattcggtaattgattttgttattgacgttgtttcgttagcggtaagggtttcgataaaatcgttattttcgtcggcgttgttaggtaaggatgattttttagtagagacgttagtcgcgttattaaagtttggttgatacgcgtatcgttttggaaaggatagcgttgtagtaataaatcggtagtttcgcgtgattgttcgttttgtattagttgttaggttagttgatttaggcgggtaagatttgtcggtttttgttgatatagtaatcgtgttagacgtagagttttagttttgttacgggtcgttacgttgatagtataacgttttttaagtattttattggcggggagggtggcgagtagtttttgcgttgcgtcgtattgatttttttttaatagtatcggtagcgtcg

SEQ ID NO: 16260 - DNA, 844 bp, Artificial Sequence
  chemically treated genomic DNA (Homo sapiens) CpG-island No: 16260
cgacgctaccgatactattaaaaaaaaatcaatacgacgcaacgcaaaaactactcgccaccctccccgccaataaaatacttaaaaaacgttatactatcaacgtaacgacccgtaacaaaactaaaactctacgtctaacacgattactatatcaacaaaaaccgacaaatcttacccgcctaaatcaactaacctaacaactaatacaaaacgaacaatcacgcgaaactaccgatttattactacaacgctatcctttccaaaacgatacgcgtatcaaccaaactttaataacgcgactaacgtctctactaaaaaatcatccttacctaacaacgccgacgaaaataacgattttatcgaaacccttaccgctaacgaaacaacgtcaataacaaaatcaattaccgaatattacaaataattacccgacaataattcgcttactaaaacgatatatcgccttcctacgataccgccgcctaaaaccgtctaacaaaatattatcgaaacacgctacccgatataacgttatatacataacttcaaaccgaacaacgacaaccgaacgcctaacaacatcgtacgataacctatcaaacgtatcaaattaaaaactacgccaccgcactaacgacctaacaaaaaatcaatcttcacgacataaacaataaaaatctacttactactaccaataccgcccaaacgacaaaaaataatacgactcgcgatcgctaactacaacaaacaaaaaaacgtaaactaaaaaacaataccctctactaataactacatacgcaacgttacattcctaatcaaccgaaactcgcactaaacgatc

SEQ ID NO: 16261 - DNA, 533 bp, Artificial Sequence
  chemically treated genomic DNA (Homo sapiens) CpG-island No: 16261
tcgcgggttagttcggcggcggtttttttttcggaaggtacgaagaagattggattataattaaagttattagtgttcgttggtttacgagtaattacgttcggttagttatcgtggtatattagcggagtgggatttttcgcgtgacgtagatatattagtacgtagtggaaacgcgtttgacgttggtcgttcggtacgttttttattgtttttagtagtttttgtagatttttttgatcggtcgcgtttttatcggaataacgcgcggagtaaatgttcggcgcgtcgttaagtatatttatcgttagattagagtcgtcggtaattgtcggtaaagcggttatttttgtcgtatggcgcgtttttagaatcgcgttttcgataaaggttaggtcggtttttttagcggaattaacgtcgaggtttgtttgggttacgatattaagatcgaagtcgttaagtagcgacgttagtttacgtattttatcgatattgtcggttgcgaggataattttttgtataggatattt

SEQ ID NO: 16262 - DNA, 533 bp, Artificial Sequence
  chemically treated genomic DNA (Homo sapiens) CpG-island No: 16262
aaatatcctatacaaaaaattatcctcgcaaccgacaatatcgataaaatacgtaaactaacgtcgctacttaacgacttcgatcttaatatcgtaacccaaacaaacctcgacgttaattccgctaaaaaaaccgacctaacctttatcgaaaacgcgattctaaaaacgcgccatacgacaaaaataaccgctttaccgacaattaccgacgactctaatctaacgataaatatacttaacgacgcgccgaacatttactccgcgcgttattccgataaaaacgcgaccgatcaaaaaaatctacaaaaactactaaaaacaataaaaaacgtaccgaacgaccaacgtcaaacgcgtttccactacgtactaatatatctacgtcacgcgaaaaatcccactccgctaatataccacgataactaaccgaacgtaattactcgtaaaccaacgaacactaataactttaattataatccaatcttcttcgtaccttccgaaaaaaaaaccgccgccgaactaacccgcga

SEQ ID NO: 16263 - DNA, 533 bp, Artificial Sequence
  chemically treated genomic DNA (Homo sapiens) CpG-island No: 16263
aggtattttatgtaaaaagttgttttcgtaatcggtaatgtcggtaaagtgcgtgagttggcgtcgttgtttagcgatttcggttttgatatcgtggtttaaatagatttcggcgttgatttcgttgaagaaatcggtttgatttttatcgaaaacgcgattttgaaagcgcgttatgcggtaaaagtgatcgttttatcggtaattgtcgacgattttggtttggcggtagatgtgtttggcggcgcgtcgggtatttatttcgcgcgttatttcggtgaagacgcgatcgattaaaagaatttgtaaaaattgttggaaataatgaaagacgtatcggacgattaacgttaggcgcgtttttattgcgtgttggtatatttgcgttacgcggaagattttatttcgttggtatgttacggtagttggtcgggcgtgattattcgtgaattagcgggtattggtggttttggttatgatttaatttttttcgtatttttcgaagggaaaatcgtcgtcgaattgattcgcga

SEQ ID NO: 16264 - DNA, 533 bp, Artificial Sequence
  chemically treated genomic DNA (Homo sapiens) CpG-island No: 16264
tcgcgaatcaattcgacgacgattttcccttcgaaaaatacgaaaaaaattaaatcataaccaaaaccaccaatacccgctaattcacgaataatcacgcccgaccaactaccgtaacataccaacgaaataaaatcttccgcgtaacgcaaatataccaacacgcaataaaaacgcgcctaacgttaatcgtccgatacgtctttcattatttccaacaatttttacaaattcttttaatcgatcgcgtcttcaccgaaataacgcgcgaaataaatacccgacgcgccgccaaacacatctaccgccaaaccaaaatcgtcgacaattaccgataaaacgatcacttttaccgcataacgcgctttcaaaatcgcgttttcgataaaaatcaaaccgatttcttcaacgaaatcaacgccgaaatctatttaaaccacgatatcaaaaccgaaatcgctaaacaacgacgccaactcacgcactttaccgacattaccgattacgaaaacaactttttacataaaatacct

SEQ ID NO: 16265 - DNA, 698 bp, Artificial Sequence
  chemically treated genomic DNA (Homo sapiens) CpG-island No: 16265
attattcggcgggtaatttggagaatgcggttacgttttaaatgaatagcgaaggggggaaatcggggaatgtattgatcgttaacggtaattatatcggaaataatggtttgatgacgtttaacgcgacgttgggcggcgataattcgtttatcgataagatgaacgtgaaaggcgatatttaagggaatattcgcgttcgggttgataatattggcggcgtcggtgtataaacggttaacggtattgaatttattgaggttggcggtaattttgtaggtaatttcgcgttgattatcggaattgtcgaagttggggtttacgtttatacgttggttaaagggaaggggaatgacgagaaaaattggtatttgattagtaaatgggacggcgtaacgttagcggatatattcgattttattaataatttttttgttgtggattcggaaggtttattagtttatcgttcggaggtcggaagttatattagtaatattgtcgtagttaattcgttgtttagttatcgtttatacgatcgtttgggtgagtcgtagtatatagatttattgtatttttaggggtcggtaagtagtatgtggatgcgttatgtcggagggtacgaacgtttaagggtcggtgacggttagttaaatatttaggttaatcgttatgtattgtagttaggcggcgatttggcg

SEQ ID NO: 16266 - DNA, 698 bp, Artificial Sequence
  chemically treated genomic DNA (Homo sapiens) CpG-island No: 16266
cgccaaatcgccgcctaactacaatacataacgattaacctaaatatttaactaaccgtcaccgacccttaaacgttcgtaccctccgacataacgcatccacatactacttaccgacccctaaaaatacaataaatctatatactacgactcacccaaacgatcgtataaacgataactaaacaacgaattaactacgacaatattactaatataacttccgacctccgaacgataaactaataaaccttccgaatccacaacaaaaaaattattaataaaatcgaatatatccgctaacgttacgccgtcccatttactaatcaaataccaatttttctcgtcattccccttccctttaaccaacgtataaacgtaaaccccaacttcgacaattccgataatcaacgcgaaattacctacaaaattaccgccaacctcaataaattcaataccgttaaccgtttatacaccgacgccgccaatattatcaacccgaacgcgaatattcccttaaatatcgcctttcacgttcatcttatcgataaacgaattatcgccgcccaacgtcgcgttaaacgtcatcaaaccattatttccgatataattaccgttaacgatcaatacattccccgatttccccccttcgctattcatttaaaacgtaaccgcattctccaaattacccgccgaataat

SEQ ID NO: 16267 - DNA, 698 bp, Artificial Sequence
  chemically treated genomic DNA (Homo sapiens) CpG-island No: 16267
cgttaaatcgtcgtttagttgtaatatatagcggttagtttgagtatttagttgatcgttatcggtttttgaacgttcgtgtttttcgatatgacgtatttatatattgtttgtcgatttttgagaatgtagtgaatttgtatattgcggtttatttagacggtcgtgtaaacgatggttaaatagcgagttggttgcggtaatgttgttgatatagttttcggttttcgggcgataaattgatgggtttttcggatttataatagggggattattgatgggatcgggtgtattcgttggcgttacgtcgttttatttattggttagatattagtttttttcgttattttttttttttttagttagcgtgtagacgtaagttttagtttcgatagtttcggtggttagcgcgaagttatttgtagaattatcgttaattttaatgagtttaatatcgttgatcgtttgtgtatcgacgtcgttaatgttattaattcgaacgcgagtgtttttttgggtatcgttttttacgtttattttatcggtgggcgaattatcgtcgtttagcgtcgcgttgaacgttattaggttattgttttcggtatagttgtcgttaacggttagtatatttttcggtttttttttttcgttatttatttgaggcgtggtcgtattttttaggttgttcgtcggatagt

SEQ ID NO: 16268 - DNA, 698 bp, Artificial Sequence
  chemically treated genomic DNA (Homo sapiens) CpG-island No: 16268
actatccgacgaacaacctaaaaaatacgaccacgcctcaaataaataacgaaaaaaaaaaaccgaaaaatatactaaccgttaacgacaactataccgaaaacaataacctaataacgttcaacgcgacgctaaacgacgataattcgcccaccgataaaataaacgtaaaaaacgatacccaaaaaaacactcgcgttcgaattaataacattaacgacgtcgatacacaaacgatcaacgatattaaactcattaaaattaacgataattctacaaataacttcgcgctaaccaccgaaactatcgaaactaaaacttacgtctacacgctaactaaaaaaaaaaaaaataacgaaaaaaactaatatctaaccaataaataaaacgacgtaacgccaacgaatacacccgatcccatcaataatccccctattataaatccgaaaaacccatcaatttatcgcccgaaaaccgaaaactatatcaacaacattaccgcaaccaactcgctatttaaccatcgtttacacgaccgtctaaataaaccgcaatatacaaattcactacattctcaaaaatcgacaaacaatatataaatacgtcatatcgaaaaacacgaacgttcaaaaaccgataacgatcaactaaatactcaaactaaccgctatatattacaactaaacgacgatttaacg

SEQ ID NO: 16269 - DNA, 794 bp, Artificial Sequence
  chemically treated genomic DNA (Homo sapiens) CpG-island No: 16269
atttcgttggcgtagtagttttggtaaacggtcgttagagattcgcgtattagcgaggcgtttcggtatattgcgttagaaatgtcggaaaaaatttcggtaatttaagataaaagtgtggttcgtttggcgcggtataatttatttttataagtttcgtcgttttatttatttaattggttatcgtatttaaatttttttttaggataagtttttcgttaaatttttagtttcgggaagttaattaatagcgtttcgtatttttgttgtagtatatttgcgcggtataggtagttttgttagtcgttcggacgagggtttttagcggcgcgggtttgaggttgtcggtaaatatttgggcgcggtgatatgttttttttaacgtcgaaatgtagttttacgtcgttttaggtaagcgtttatttagtagatgcgagaatgtcgagtttgatcgaagttttatttttagttattttggcgggtaaaggtttcggcgaagtttggtaagtttggcgttttgttcggggagatgattttcgtttttacgcgttcgttataatgggcgaaaaaggtttcggttatggtttcgtaaatttgtttatgggtgattttcggtaatagttcggtgaggttggttacgcgggaacgtatcgacgtaatgtttttcgtcgttagtttttttttattcggattgagatagtttgttaggcggttgaggtcggtattgtagtagtaaggtgtcgtggtggaagtcgcgatttttggtttcgcgataggtcgagtttgagattttg

SEQ ID NO: 16270 - DNA, 794 bp, Artificial Sequence
  chemically treated genomic DNA (Homo sapiens) CpG-island No: 16270
caaaatctcaaactcgacctatcgcgaaaccaaaaatcgcgacttccaccacgacaccttactactacaataccgacctcaaccgcctaacaaactatctcaatccgaataaaaaaaaactaacgacgaaaaacattacgtcgatacgttcccgcgtaaccaacctcaccgaactattaccgaaaatcacccataaacaaatttacgaaaccataaccgaaacctttttcgcccattataacgaacgcgtaaaaacgaaaatcatctccccgaacaaaacgccaaacttaccaaacttcgccgaaacctttacccgccaaaataactaaaaataaaacttcgatcaaactcgacattctcgcatctactaaataaacgcttacctaaaacgacgtaaaactacatttcgacgttaaaaaaaacatatcaccgcgcccaaatatttaccgacaacctcaaacccgcgccgctaaaaaccctcgtccgaacgactaacaaaactacctataccgcgcaaatatactacaacaaaaatacgaaacgctattaattaacttcccgaaactaaaaatttaacgaaaaacttatcctaaaaaaaaatttaaatacgataaccaattaaataaataaaacgacgaaacttataaaaataaattataccgcgccaaacgaaccacacttttatcttaaattaccgaaattttttccgacatttctaacgcaatataccgaaacgcctcgctaatacgcgaatctctaacgaccgtttaccaaaactactacgccaacgaaat

SEQ ID NO: 16271 - DNA, 794 bp, Artificial Sequence
  chemically treated genomic DNA (Homo sapiens) CpG-island No: 16271
taaagttttaggttcggtttatcgcgaaattaaagatcgcggtttttattacggtattttgttattataatgtcgattttagtcgtttggtaaattattttaattcggataaaaagaaattggcggcgaaaggtattacgtcggtacgttttcgcgtgattaattttatcgagttgttgtcggggattatttatgagtaggtttgcgaggttataatcgaggtttttttcgtttattatggcgagcgcgtggaagcggaaattattttttcgaataaaacgttagatttgttaaatttcgtcgaaatttttgttcgttagagtagttgggaatggaatttcggttaggttcggtattttcgtatttgttggatgaacgtttatttggggcggcgtggaattgtatttcgacgttgaaaaaggtatattatcgcgtttaggtgtttatcgatagttttaaattcgcgtcgttggaagttttcgttcggacgattggtaaggttgtttgtatcgcgtagatatgttgtaataggagtgcgaagcgttgttggttgatttttcggaattaggagtttaacgaagggtttattttggggaagggtttaggtacggtggttaattgggtaagtgggacggcggggtttgtaagagtaagttatatcgcgttaagcgggttatatttttgttttgaattgtcggaatttttttcggtatttttggcgtaatgtgtcgaaacgtttcgttgatacgcggatttttggcgatcgtttgttagaattgttgcgttagcgggat

SEQ ID NO: 16272 - DNA, 794 bp, Artificial Sequence
  chemically treated genomic DNA (Homo sapiens) CpG-island No: 16272
atcccgctaacgcaacaattctaacaaacgatcgccaaaaatccgcgtatcaacgaaacgtttcgacacattacgccaaaaataccgaaaaaaattccgacaattcaaaacaaaaatataacccgcttaacgcgatataacttactcttacaaaccccgccgtcccacttacccaattaaccaccgtacctaaacccttccccaaaataaacccttcgttaaactcctaattccgaaaaatcaaccaacaacgcttcgcactcctattacaacatatctacgcgatacaaacaaccttaccaatcgtccgaacgaaaacttccaacgacgcgaatttaaaactatcgataaacacctaaacgcgataatatacctttttcaacgtcgaaatacaattccacgccgccccaaataaacgttcatccaacaaatacgaaaataccgaacctaaccgaaattccattcccaactactctaacgaacaaaaatttcgacgaaatttaacaaatctaacgttttattcgaaaaaataatttccgcttccacgcgctcgccataataaacgaaaaaaacctcgattataacctcgcaaacctactcataaataatccccgacaacaactcgataaaattaatcacgcgaaaacgtaccgacgtaatacctttcgccgccaatttctttttatccgaattaaaataatttaccaaacgactaaaatcgacattataataacaaaataccgtaataaaaaccgcgatctttaatttcgcgataaaccgaacctaaaacttta

SEQ ID NO: 16273 - DNA, 927 bp, Artificial Sequence
  chemically treated genomic DNA (Homo sapiens) CpG-island No: 16273
cgtattcggtaattaatgtttgatgcgacgttgtcgcgttttattaggtttataattattgtcgatttgtaggtttgataaggtatttgtgtcgtattcggtaattaatgtttgatgcgacgttgtcgcgttttattaggtttataattgttgtcgatttgtaggtcggataaggtatttgtgtcgtattcggtaattaatgtttgatgcgacgttgtcgcgttttattaggtttataattattgtcgatttgtaggtcggataaggtatttgtgtcgtattcggtaattaatgtttgatgcgacgttgtcgcgttttattaggtttataattgttgtcgattcgtaggtcggataaggcgttcgcgtcgtattcggtagtgtttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggttttagtaacgtacgtagtagggttttttttatattgcgtgtattaatgatttacgcgggtaggcggtgatagaggttcgaagaagttaggtcgattgtatcggttaaacgattggacgttaatttcgggtatgtttggtttatatttacgtttattatttgtttataacgacgcgaagtttttttggggttatttgtggggatttgaatttatcggggagtcgtcgtcgtttggcggtggttttatcgggcgcggtttcgttacgtcggtatagggtttattcgtttcgggcggtttttttgtgtttttttgttttgtttttcgtttttttcgtttagttacgacgcg

SEQ ID NO: 16274 - DNA, 927 bp, Artificial Sequence
  chemically treated genomic DNA (Homo sapiens) CpG-island No: 16274
cgcgtcgtaactaaacgaaaaaaacgaaaaacaaaacaaaaaaacacaaaaaaaccgcccgaaacgaataaaccctataccgacgtaacgaaaccgcgcccgataaaaccaccgccaaacgacgacgactccccgataaattcaaatccccacaaataaccccaaaaaaacttcgcgtcgttataaacaaataataaacgtaaatataaaccaaacatacccgaaattaacgtccaatcgtttaaccgatacaatcgacctaacttcttcgaacctctatcaccgcctacccgcgtaaatcattaatacacgcaatataaaaaaaaccctactacgtacgttactaaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataaacactaccgaatacgacgcgaacgccttatccgacctacgaatcgacaacaattataaacctaataaaacgcgacaacgtcgcatcaaacattaattaccgaatacgacacaaataccttatccgacctacaaatcgacaataattataaacctaataaaacgcgacaacgtcgcatcaaacattaattaccgaatacgacacaaataccttatccgacctacaaatcgacaacaattataaacctaataaaacgcgacaacgtcgcatcaaacattaattaccgaatacgacacaaataccttatcaaacctacaaatcgacaataattataaacctaataaaacgcgacaacgtcgcatcaaacattaattaccgaatacg

SEQ ID NO: 16275 - DNA, 927 bp, Artificial Sequence
  chemically treated genomic DNA (Homo sapiens) CpG-island No: 16275
cgcgtcgtggttgggcggggagaacggagaataagatagaagggtatagagggatcgttcgggacgggtgaattttatgtcgacgtggcggaatcgcgttcgatagggttatcgttaggcggcggcggtttttcggtaggtttaaatttttataggtagttttagggggatttcgcgtcgttgtggatagataataggcgtggatgtgagttaggtatgttcggagttggcgtttaatcgtttgatcggtgtaatcggtttgattttttcgagtttttattatcgtttgttcgcgtgggttattggtatacgtaatatgaaaaaagttttgttgcgtgcgttgttggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattaggtttataggtcggtaatagttgtaggtttgataagacgcgatagcgtcgtattaggtattgattgtcggatgcg

SEQ ID NO: 16276 - DNA, 927 bp, Artificial Sequence
  chemically treated genomic DNA (Homo sapiens) CpG-island No: 16276
cgcatccgacaatcaatacctaatacgacgctatcgcgtcttatcaaacctacaactattaccgacctataaacctaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattccaacaacgcacgcaacaaaacttttttcatattacgtataccaataacccacgcgaacaaacgataataaaaactcgaaaaaatcaaaccgattacaccgatcaaacgattaaacgccaactccgaacatacctaactcacatccacgcctattatctatccacaacgacgcgaaatccccctaaaactacctataaaaatttaaacctaccgaaaaaccgccgccgcctaacgataaccctatcgaacgcgattccgccacgtcgacataaaattcacccgtcccgaacgatccctctatacccttctatcttattctccgttctccccgcccaaccacgacgcg

SEQ ID NO: 16277 - DNA, 569 bp, Artificial Sequence
  chemically treated genomic DNA (Homo sapiens) CpG-island No: 16277
cgttatatagacgtttaggttagtgattagcggttatgtttagatagcggatttcgggaattattgtattgcgtttagttagatagcggcggttgagtcgataatagcgtcgattatatacgacggaatggcggtgatggggttttttagcgtaaacggaatcgtatttttattgatttttataaacgttaggaatatggcggttttattttgcggataaagttgagcgttgaataggcgtttgtcggttaaacgacggtcgataatggtcgttagttttagattaatcggcggaataacgatagcgatagaacgagcggtgatcggtaatacgtggttagtggtaaagttgaaggtaataaaatttgcggttttgttgatcgggttattaaggtcgattgttgtcgtcgcggcgatttttattgcgtatattagcgcgttttttttatttgcggtagttagtatagtacggatatcgtcgttgatttagttattaaagggggtgatgacgtagtatatcgttagtatgataaaaatggcggaaagaatcgggagtaaaaatgtggttt

SEQ ID NO: 16278 - DNA, 569 bp, Artificial Sequence
  chemically treated genomic DNA (Homo sapiens) CpG-island No: 16278
aaaccacatttttactcccgattctttccgccatttttatcatactaacgatatactacgtcatcaccccctttaataactaaatcaacgacgatatccgtactatactaactaccgcaaataaaaaaaacgcgctaatatacgcaataaaaatcgccgcgacgacaacaatcgaccttaataacccgatcaacaaaaccgcaaattttattaccttcaactttaccactaaccacgtattaccgatcaccgctcgttctatcgctatcgttattccgccgattaatctaaaactaacgaccattatcgaccgtcgtttaaccgacaaacgcctattcaacgctcaactttatccgcaaaataaaaccgccatattcctaacgtttataaaaatcaataaaaatacgattccgtttacgctaaaaaaccccatcaccgccattccgtcgtatataatcgacgctattatcgactcaaccgccgctatctaactaaacgcaatacaataattcccgaaatccgctatctaaacataaccgctaatcactaacctaaacgtctatataacg

SEQ ID NO: 16279 - DNA, 569 bp, Artificial Sequence
  chemically treated genomic DNA (Homo sapiens) CpG-island No: 16279
aaattatatttttgttttcgatttttttcgttatttttgttatgttggcgatgtattacgttattattttttttggtggttggattaacggcggtattcgtattgtgttgattgtcgtaggtgagaagggcgcgttgatgtacgtaatggggatcgtcgcggcgatagtaatcgattttggtggttcgattaataaagtcgtaggttttgttgtttttagttttattattgattacgtattatcggttatcgttcgttttatcgttatcgttatttcgtcgattggtttggggttggcgattattatcgatcgtcgtttaatcggtaaacgtttgtttaacgtttaattttattcgtagggtaagatcgttatgtttttggcgtttatggggattagtgagggtgcgatttcgtttgcgttggaaagttttattatcgttatttcgtcgtatatggtcggcgttattgtcggtttaatcgtcgttgtttggttgggcgtagtgtaatggttttcggagttcgttatttgggtatggtcgttggttattaatttgggcgtttatatggcg

SEQ ID NO: 16280 - DNA, 569 bp, Artificial Sequence
  chemically treated genomic DNA (Homo sapiens) CpG-island No: 16280
cgccatataaacgcccaaattaataaccaacgaccatacccaaataacgaactccgaaaaccattacactacgcccaaccaaacaacgacgattaaaccgacaataacgccgaccatatacgacgaaataacgataataaaactttccaacgcaaacgaaatcgcaccctcactaatccccataaacgccaaaaacataacgatcttaccctacgaataaaattaaacgttaaacaaacgtttaccgattaaacgacgatcgataataatcgccaaccccaaaccaatcgacgaaataacgataacgataaaacgaacgataaccgataatacgtaatcaataataaaactaaaaacaacaaaacctacgactttattaatcgaaccaccaaaatcgattactatcgccgcgacgatccccattacgtacatcaacgcgcccttctcacctacgacaatcaacacaatacgaataccgccgttaatccaaccaccaaaaaaaataataacgtaatacatcgccaacataacaaaaataacgaaaaaaatcgaaaacaaaaatataattt

SEQ ID NO: 16281 - DNA, 730 bp, Artificial Sequence
  chemically treated genomic DNA (Homo sapiens) CpG-island No: 16281
gaacggaggtcgggcgtcgggtcggtcggcggcggcggtagcgtatttttggggtgcgggttcgggtttcgtagtagttcgcggcggtagtagtagttcgggcggcgaatcgagaggataatgttcgtagtttgcgcgaggcgacggttggagtttttagttgcggtagttcgggagggtagggaggcggtggcggcgggttgcggaggtggttgttaattgcgcgtcgggtcgggacgcgcgtggtatgagttttcgcggaacgtgcgtttatcgtcgcggtttatcgcgtttttttttatagtttttattgggcgagggttttttattcgtcgcgcgtagttcggttcgttttttttcggcgagtatgtttagtgcgtttcggtcgcgttttgtttaagcggtcgtttttggtttttcgcggggtcgggagggggcggggtagtgggcggggtttcggatttgagttcgatttggggagtggcgcgagttaggaattggttggaagatggggtgtgtgtgcgtatatgggagcgaggaaagcgttgtaggaagtatgtaggtcgttttattttatagttgtgggagtggtggataagggcggcggttttgcgagaagtacgtgggcgcggcgggtcgttttagggatggagtaggttgtggttttgttaattttcgttattaaaggtttaaggacgttatttatttagtttcgggcgggcgtgggttt

SEQ ID NO: 16282 - DNA, 730 bp, Artificial Sequence
  chemically treated genomic DNA (Homo sapiens) CpG-island No: 16282
aaacccacgcccgcccgaaactaaataaataacgtccttaaacctttaataacgaaaattaacaaaaccacaacctactccatccctaaaacgacccgccgcgcccacgtacttctcgcaaaaccgccgcccttatccaccactcccacaactataaaataaaacgacctacatacttcctacaacgctttcctcgctcccatatacgcacacacaccccatcttccaaccaattcctaactcgcgccactccccaaatcgaactcaaatccgaaaccccgcccactaccccgccccctcccgaccccgcgaaaaaccaaaaacgaccgcttaaacaaaacgcgaccgaaacgcactaaacatactcgccgaaaaaaaacgaaccgaactacgcgcgacgaataaaaaaccctcgcccaataaaaactataaaaaaaaacgcgataaaccgcgacgataaacgcacgttccgcgaaaactcataccacgcgcgtcccgacccgacgcgcaattaacaaccacctccgcaacccgccgccaccgcctccctaccctcccgaactaccgcaactaaaaactccaaccgtcgcctcgcgcaaactacgaacattatcctctcgattcgccgcccgaactactactaccgccgcgaactactacgaaacccgaacccgcaccccaaaaatacgctaccgccgccgccgaccgacccgacgcccgacctccgttc

SEQ ID NO: 16283 - DNA, 730 bp, Artificial Sequence
  chemically treated genomic DNA (Homo sapiens) CpG-island No: 16283
agatttacgttcgttcggggttgagtgaatggcgtttttgggtttttgataacgggagttggtaagattatagtttattttatttttgaggcggttcgtcgcgtttacgtgtttttcgtagagtcgtcgtttttgtttattatttttatagttgtaaaataaagcggtttgtatgttttttatagcgtttttttcgtttttatatacgtatatatattttattttttagttagtttttaattcgcgttattttttaaatcggatttaaattcggagtttcgtttattgtttcgttttttttcggtttcgcggaaaattaggagcggtcgtttgggtaaggcgcggtcggaacgtattgggtatgttcgtcggggaggggcgggtcgggttgcgcgcggcgagtaggaagttttcgtttagtagaggttgtgggagagagcgcgatgggtcgcggcggtgggcgtacgtttcgcggggatttatgttacgcgcgtttcggttcgacgcgtaattagtagttattttcgtagttcgtcgttatcgtttttttgttttttcgggttgtcgtagttaggagttttagtcgtcgtttcgcgtaggttgcgggtattgttttttcggttcgtcgttcgggttgttgttgtcgtcgcggattgttgcggggttcggattcgtattttagggatacgttgtcgtcgtcgtcggtcggttcggcgttcggttttcgttt

SEQ ID NO: 16284 - DNA, 730 bp, Artificial Sequence
  chemically treated genomic DNA (Homo sapiens) CpG-island No: 16284
aaacgaaaaccgaacgccgaaccgaccgacgacgacgacaacgtatccctaaaatacgaatccgaaccccgcaacaatccgcgacgacaacaacaacccgaacgacgaaccgaaaaaacaatacccgcaacctacgcgaaacgacgactaaaactcctaactacgacaacccgaaaaaacaaaaaaacgataacgacgaactacgaaaataactactaattacgcgtcgaaccgaaacgcgcgtaacataaatccccgcgaaacgtacgcccaccgccgcgacccatcgcgctctctcccacaacctctactaaacgaaaacttcctactcgccgcgcgcaacccgacccgcccctccccgacgaacatacccaatacgttccgaccgcgccttacccaaacgaccgctcctaattttccgcgaaaccgaaaaaaaacgaaacaataaacgaaactccgaatttaaatccgatttaaaaaataacgcgaattaaaaactaactaaaaaataaaatatatatacgtatataaaaacgaaaaaaacgctataaaaaacatacaaaccgctttattttacaactataaaaataataaacaaaaacgacgactctacgaaaaacacgtaaacgcgacgaaccgcctcaaaaataaaataaactataatcttaccaactcccgttatcaaaaacccaaaaacgccattcactcaaccccgaacgaacgtaaatct

SEQ ID NO: 16285 - DNA, 626 bp, Artificial Sequence
  chemically treated genomic DNA (Homo sapiens) CpG-island No: 16285
tttggtcggtaagttagtgaagtttttacgttagatttatattagtgcgttttagatttatggacgttatgcgttcgttggcgttaggtgttatcgtgtaagttggtttgggtttgaatattcgatgggttatttattcgatgtgtatattatggaatcgttttatattttatgggcgacgggtttgttatttttgatgatttcgacggtcgtcggatattgtcgtaaatcgaattcgatcgagatcgcggttattaggtggttaatttcgattgttagattgaatatatgttggtcggtttgggtttggtatgtggtttttgtgtcgggttattaatcgcgattaatatacgtcgtcgttaaatgttatatttgtatattaattcgttttttggtcgttatgtggttcgtggattagtttgtgagattcggttatattatgtgttatggaaatttgtgtcgtcgatataaggttttcgcgttgatagtgcgtatagattcggtaatgtatatcgtggattgcggtttttagggtgtgtcgattacgtcgtggcgaaataatttttttggaggttgatagggaaggttttaaaattaattataatatatgattgtgttcggaatta

SEQ ID NO: 16286 - DNA, 626 bp, Artificial Sequence
  chemically treated genomic DNA (Homo sapiens) CpG-island No: 16286
taattccgaacacaatcatatattataattaattttaaaaccttccctatcaacctccaaaaaaattatttcgccacgacgtaatcgacacaccctaaaaaccgcaatccacgatatacattaccgaatctatacgcactatcaacgcgaaaaccttatatcgacgacacaaatttccataacacataatataaccgaatctcacaaactaatccacgaaccacataacgaccaaaaaacgaattaatatacaaatataacatttaacgacgacgtatattaatcgcgattaataacccgacacaaaaaccacataccaaacccaaaccgaccaacatatattcaatctaacaatcgaaattaaccacctaataaccgcgatctcgatcgaattcgatttacgacaatatccgacgaccgtcgaaatcatcaaaaataacaaacccgtcgcccataaaatataaaacgattccataatatacacatcgaataaataacccatcgaatattcaaacccaaaccaacttacacgataacacctaacgccaacgaacgcataacgtccataaatctaaaacgcactaatataaatctaacgtaaaaacttcactaacttaccgaccaaa

SEQ ID NO: 16287 - DNA, 626 bp, Artificial Sequence
  chemically treated genomic DNA (Homo sapiens) CpG-island No: 16287
tagtttcggatataattatgtgttgtgattgattttagggttttttttattaatttttaggaaggttgtttcgttacggcgtaatcggtatattttggaggtcgtaatttacggtgtgtattgtcgagtttgtgcgtattgttaacgcgggggttttgtgtcgacgatatagatttttatggtatatgatgtggtcggattttataaattggtttacgaattatataacggttagggggcggattagtatgtaagtgtgatatttagcgacggcgtgtgttaatcgcgattaatgattcgatataggagttatatgttaagtttaagtcggttagtatgtgtttaatttagtagtcggaattaattatttagtaatcgcgatttcggtcgagttcggtttgcgataatattcggcgatcgtcgggattattaggaatgatagattcgtcgtttatggagtgtgaggcggttttatgatgtgtatatcggatagatagtttatcgggtatttaaatttaggttaatttgtacgatggtatttggcgttagcggacgtatggcgtttatgggtttagaacgtattaatatgaatttgacgtaggagttttattgatttgtcgattaag

SEQ ID NO: 16288 - DNA, 626 bp, Artificial Sequence
  chemically treated genomic DNA (Homo sapiens) CpG-island No: 16288
cttaatcgacaaatcaataaaactcctacgtcaaattcatattaatacgttctaaacccataaacgccatacgtccgctaacgccaaataccatcgtacaaattaacctaaatttaaatacccgataaactatctatccgatatacacatcataaaaccgcctcacactccataaacgacgaatctatcattcctaataatcccgacgatcgccgaatattatcgcaaaccgaactcgaccgaaatcgcgattactaaataattaattccgactactaaattaaacacatactaaccgacttaaacttaacatataactcctatatcgaatcattaatcgcgattaacacacgccgtcgctaaatatcacacttacatactaatccgccccctaaccgttatataattcgtaaaccaatttataaaatccgaccacatcatataccataaaaatctatatcgtcgacacaaaacccccgcgttaacaatacgcacaaactcgacaatacacaccgtaaattacgacctccaaaatataccgattacgccgtaacgaaacaaccttcctaaaaattaataaaaaaaaccctaaaatcaatcacaacacataattatatccgaaacta

SEQ ID NO: 16289 - DNA, 530 bp, Artificial Sequence
  chemically treated genomic DNA (Homo sapiens) CpG-island No: 16289
tcggcgcgtattacgacggttagggcgttaattttatattttttttcgtttatgtcgagcgggtagaattgtgtgtttttgacgttaatggttaggaatatcgttatgatttgttagggtatagtggcgatatttggtacggttatttgtcggatgcgcgttcgggtttgcgttatggttatcgcgtttatggtttttggtaattcgtcgaggggtatcgttttaattcggcgaagttgttgattgatttttgcgcgcggtaaattgacggggagtttaaagataattcgttgttgtacgtcggttataatgaatttgattatcgcgataacgtcgttattgcgtcgaaatgcgtagtggtggttgattattatgattgggaagatgatgtttcgtcgcgtacgtcgtggggtagtattattatttatgaagtttatgttaaaggattaacgtatttgtattcggagatttcggtcgagattcgtggtatttataaagttttcgggtattcggtgatgattaattatttg

SEQ ID NO: 16290 - DNA, 530 bp, Artificial Sequence
  chemically treated genomic DNA (Homo sapiens) CpG-island No: 16290
caaataattaatcatcaccgaatacccgaaaactttataaataccacgaatctcgaccgaaatctccgaatacaaatacgttaatcctttaacataaacttcataaataataatactaccccacgacgtacgcgacgaaacatcatcttcccaatcataataatcaaccaccactacgcatttcgacgcaataacgacgttatcgcgataatcaaattcattataaccgacgtacaacaacgaattatctttaaactccccgtcaatttaccgcgcgcaaaaatcaatcaacaacttcgccgaattaaaacgatacccctcgacgaattaccaaaaaccataaacgcgataaccataacgcaaacccgaacgcgcatccgacaaataaccgtaccaaatatcgccactataccctaacaaatcataacgatattcctaaccattaacgtcaaaaacacacaattctacccgctcgacataaacgaaaaaaaatataaaattaacgccctaaccgtcgtaatacgcgccga

SEQ ID NO: 16291 - DNA, 530 bp, Artificial Sequence
  chemically treated genomic DNA (Homo sapiens) CpG-island No: 16291
taaatagttgattattatcggatgttcgagggttttataagtgttacggatttcgatcgggattttcgggtgtaagtacgttaattttttgatatgggttttataaatgatggtgttgttttacggcgtgcgcggcggggtattatttttttagttatagtgattaattattattacgtatttcggcgtaatggcggcgttgtcgcgatagttaggtttattatgatcggcgtgtagtagcgggttatttttaaatttttcgttaatttgtcgcgcgtaaggattaattaataatttcgtcgggttaaagcgatgtttttcggcgggttgttaggggttatgaacgcgataattataacgtaaattcgggcgcgtattcggtagataatcgtgttaaatgtcgttattgtgttttggtaagttatagcgatgtttttggttattggcgttaaagatatatagttttattcgttcggtatgagcggagaaaagtgtgaagttgacgttttgatcgtcgtaatgcgcgtcga

SEQ ID NO: 16292 - DNA, 530 bp, Artificial Sequence
  chemically treated genomic DNA (Homo sapiens) CpG-island No: 16292
tcgacgcgcattacgacgatcaaaacgtcaacttcacacttttctccgctcataccgaacgaataaaactatatatctttaacgccaataaccaaaaacatcgctataacttaccaaaacacaataacgacatttaacacgattatctaccgaatacgcgcccgaatttacgttataattatcgcgttcataacccctaacaacccgccgaaaaacatcgctttaacccgacgaaattattaattaatccttacgcgcgacaaattaacgaaaaatttaaaaataacccgctactacacgccgatcataataaacctaactatcgcgacaacgccgccattacgccgaaatacgtaataataattaatcactataactaaaaaaataataccccgccgcgcacgccgtaaaacaacaccatcatttataaaacccatatcaaaaaattaacgtacttacacccgaaaatcccgatcgaaatccgtaacacttataaaaccctcgaacatccgataataatcaactattta

SEQ ID NO: 16293 - DNA, 657 bp, Artificial Sequence
  chemically treated genomic DNA (Homo sapiens) CpG-island No: 16293
tgttttgacgggtgcggggtttatagttaatgttttgacgggtcggagtttatataaatgttttgacggggcggcgtttatattaatgttttgacgggtcggggtttatattaatgttttgacggggcggggtttatattaatgttttgacggggcggggtttatagtaattttttgacggggcggagtttatattaatgttttgacgggacggagtttatattaatgttttgacggggcggggtttatattaatgttttgacggggcggagtttatattaatgttttgacggggcggggtttatagtaattttttgacggggcggggtttatattaatgttttgacggggcggggtttatattaatgttttgacggggcggggtttatagtaattttttgacggggcggagtttatattaatgttttgacggggcggggtttatattaatgttttgacggggcggggtttatagtaattttttgacggggcggagtttatattaatgttttgacggggcggagtttatattaatgttttgacggggcggagtttatattaatgttttgacggggcggggtttatagtaattttttgacggggcggagtttatattaatgttttgacggggcggggtttatattaatgttttgacgg

SEQ ID NO: 16294 - DNA, 657 bp, Artificial Sequence
  chemically treated genomic DNA (Homo sapiens) CpG-island No: 16294
ccgtcaaaacattaatataaaccccgccccgtcaaaacattaatataaactccgccccgtcaaaaaattactataaaccccgccccgtcaaaacattaatataaactccgccccgtcaaaacattaatataaactccgccccgtcaaaacattaatataaactccgccccgtcaaaaaattactataaaccccgccccgtcaaaacattaatataaaccccgccccgtcaaaacattaatataaactccgccccgtcaaaaaattactataaaccccgccccgtcaaaacattaatataaaccccgccccgtcaaaacattaatataaaccccgccccgtcaaaaaattactataaaccccgccccgtcaaaacattaatataaactccgccccgtcaaaacattaatataaaccccgccccgtcaaaacattaatataaactccgtcccgtcaaaacattaatataaactccgccccgtcaaaaaattactataaaccccgccccgtcaaaacattaatataaaccccgccccgtcaaaacattaatataaaccccgacccgtcaaaacattaatataaacgccgccccgtcaaaacatttatataaactccgacccgtcaaaacattaactataaaccccgcacccgtcaaaaca

SEQ ID NO: 16295 - DNA, 657 bp, Artificial Sequence
  chemically treated genomic DNA (Homo sapiens) CpG-island No: 16295
tcgttagagtattagtgtgagtttcgtttcgttagagtattagtgtgagtttcgtttcgttagaagattattgtgagtttcgtttcgttagagtattagtgtgagtttcgtttcgttagagtattagtgtgagtttcgtttcgttagagtattagtgtgagtttcgtttcgttagaggattattgtgagtttcgtttcgttagagtattagtgtgagtttcgtttcgttagagtattagtgtgagtttcgtttcgttagaggattattgtgagtttcgtttcgttagagtattagtgtgagtttcgtttcgttagagtattagtgtgagtttcgtttcgttagaggattattgtgagtttcgtttcgttagagtattagtgtgagtttcgtttcgttagagtattagtgtgagtttcgtttcgttagagtattagtgtgagtttcgtttcgttagagtattagtgtgagtttcgtttcgttagaggattattgtgagtttcgtttcgttagagtattagtgtgagtttcgtttcgttagagtattagtgtgagtttcggttcgttagagtattagtgtgagcgtcgtttcgttagagtatttgtgtgagtttcggttcgttagagtattaattgtgagtttcgtattcgttagagta

SEQ ID NO: 16296 - DNA, 657 bp, Artificial Sequence
  chemically treated genomic DNA (Homo sapiens) CpG-island No: 16296
tactctaacgaatacgaaactcacaattaatactctaacgaaccgaaactcacacaaatactctaacgaaacgacgctcacactaatactctaacgaaccgaaactcacactaatactctaacgaaacgaaactcacactaatactctaacgaaacgaaactcacaataatcctctaacgaaacgaaactcacactaatactctaacgaaacgaaactcacactaatactctaacgaaacgaaactcacactaatactctaacgaaacgaaactcacactaatactctaacgaaacgaaactcacaataatcctctaacgaaacgaaactcacactaatactctaacgaaacgaaactcacactaatactctaacgaaacgaaactcacaataatcctctaacgaaacgaaactcacactaatactctaacgaaacgaaactcacactaatactctaacgaaacgaaactcacaataatcctctaacgaaacgaaactcacactaatactctaacgaaacgaaactcacactaatactctaacgaaacgaaactcacactaatactctaacgaaacgaaactcacaataatcttctaacgaaacgaaactcacactaatactctaacgaaacgaaactcacactaatactctaacga

SEQ ID NO: 16297 - DNA, 613 bp, Artificial Sequence
  chemically treated genomic DNA (Homo sapiens) CpG-island No: 16297
  misc_feature (552)..(552): n is either a, c, g or t
gtattatcgtgtgagtttcgttttttcgttagagtattatcgtgtgagtttcgttttttgttatagtattatcgtgtgagtttcgtttttcgttagagtattatcgtgtgagtttcgtttttcgttcgagtattatcgtgtgagtttcgtttttcgttagagtattatcgtgtgagtttcgtttttcgttatagtattatcgtgtgagtttcgttttttgttagagtattattgtgagttttttttttttttagagttttgtcgtgagtttcgtttttcgttagagtattatcgtgtgagtttcggtttttcgttcgagtattatcgtgtgagtttcgtttttcgttcgagtattatcgtgtgagtttcggttttcgttagagtattatcgtgtgagtttcgtttttcgttagagtattatcgtgtgagtttcgtttttcgttagagtattatcgtgtgagtttcgtttttcgttagagtattatcgtgtgagttttagtttttcgatagagtattatcgtgtgagttttaggtttttcggtttataggttnattatcgtgtgagtttcgtttttcgatagagtattatcgtagtgagtttttgttttttggt

SEQ ID NO: 16298 - DNA, 613 bp, Artificial Sequence
  chemically treated genomic DNA (Homo sapiens) CpG-island No: 16298
  misc_feature (62)..(62): n is either a, c, g or t
accaaaaaacaaaaactcactacgataatactctatcgaaaaacgaaactcacacgataatnaacctataaaccgaaaaacctaaaactcacacgataatactctatcgaaaaactaaaactcacacgataatactctaacgaaaaacgaaactcacacgataatactctaacgaaaaacgaaactcacacgataatactctaacgaaaaacgaaactcacacgataatactctaacgaaaaccgaaactcacacgataatactcgaacgaaaaacgaaactcacacgataatactcgaacgaaaaaccgaaactcacacgataatactctaacgaaaaacgaaactcacgacaaaactctaaaaaaaaaaaaaactcacaataatactctaacaaaaaacgaaactcacacgataatactataacgaaaaacgaaactcacacgataatactctaacgaaaaacgaaactcacacgataatactcgaacgaaaaacgaaactcacacgataatactctaacgaaaaacgaaactcacacgataatactataacaaaaaacgaaactcacacgataatactctaacgaaaaaacgaaactcacacgataatac

SEQ ID NO: 16299 - DNA, 613 bp, Artificial Sequence
  chemically treated genomic DNA (Homo sapiens) CpG-island No: 16299
  misc_feature (62)..(62): n is either a, c, g or t
gttaggaggtaggagtttattacggtaatgttttgtcgggaggcggagtttatacggtaatnagtttgtggatcgggaggtttggagtttatacggtaatgttttgtcgggaggttggagtttatacggtaatgttttggcgggaggcggagtttatacggtaatgttttgacgggaggcggagtttatacggtaatgttttgacgggaggcggagtttatacggtaatgttttgacgggagtcggagtttatacggtaatgttcggacgggagacggagtttatacggtaatgttcggacgggagatcggagtttatacggtaatgttttggcggaggacggagtttacggtaaggttttgagaggagaaggagtttatagtaatgttttggtagggggcggagtttatacggtaatgttgtgacgggaggcggagtttatacggtaatgttttgacggggggcggagtttatacggtaatgttcggacgggagacggagtttatacggtaatgttttggcgggagacggagtttatacggtaatgttgtgataggaggcggagtttatacggtaatgttttggcgggagagcggagtttatacggtaatgt

SEQ ID NO: 16300 - DNA, 613 bp, Artificial Sequence
  chemically treated genomic DNA (Homo sapiens) CpG-island No: 16300
  misc_feature (552)..(552): n is either a, c, g or t
acattaccgtataaactccgctctcccgccaaaacattaccgtataaactccgcctcctatcacaacattaccgtataaactccgtctcccgccaaaacattaccgtataaactccgtctcccgtccgaacattaccgtataaactccgccccccgtcaaaacattaccgtataaactccgcctcccgtcacaacattaccgtataaactccgccccctaccaaaacattactataaactccttctcctctcaaaaccttaccgtaaactccgtcctccgccaaaacattaccgtataaactccgatctcccgtccgaacattaccgtataaactccgtctcccgtccgaacattaccgtataaactccgactcccgtcaaaacattaccgtataaactccgcctcccgtcaaaacattaccgtataaactccgcctcccgtcaaaacattaccgtataaactccgcctcccgccaaaacattaccgtataaactccaacctcccgacaaaacattaccgtataaactccaaacctcccgatccacaaactnattaccgtataaactccgcctcccgacaaaacattaccgtaataaactcctacctcctaac

SEQ ID NO: 16301 - DNA, 619 bp, Artificial Sequence
  chemically treated genomic DNA (Homo sapiens) CpG-island No: 16301
tttcgtttttcgttagagtattatcgtgtgagtttcgtttttcgttagagtattatcgtgtgagtttcgtttttcgttagagtattatcgtgtgagtttcgtttttcgttatagtattatcgtgtgagtttcgtttttcgttatagtattatcgtgtgagtttcgtttttcgttatagtattatcgtgtgagtttcgtttttcgttatagtattatcgtgtgagtttcgtttttcgttatagtattatcgtgtgagtttcgtttttcgttatagtattatcgtgtgagtttcgtttttcgttatagtattatcgtgtgagtttcgtttttcggtagagtattatcgtgtgagtttcgtttttcgttagagtattatcgtgtgagtttcgtttttcgttagagtattatcgtgtgagtttcgtttttcgatagagtattatcgtgtgagtttcgtttttcgttatagtattatcgtgtgagtttcgtttttcgatagagtattatcgtgtgagtttcgtttttcgttagagtattatcgtgtgagtttcgtttttcggtagagtattatcgtgtgagtttcgttttttgtttaagtattattgtgtgagattcgtttttt

SEQ ID NO: 16302 - DNA, 619 bp, Artificial Sequence
  chemically treated genomic DNA (Homo sapiens) CpG-island No: 16302
aaaaaacgaatctcacacaataatacttaaacaaaaaacgaaactcacacgataatactctaccgaaaaacgaaactcacacgataatactctaacgaaaaacgaaactcacacgataatactctatcgaaaaacgaaactcacacgataatactataacgaaaaacgaaactcacacgataatactctatcgaaaaacgaaactcacacgataatactctaacgaaaaacgaaactcacacgataatactctaacgaaaaacgaaactcacacgataatactctaccgaaaaacgaaactcacacgataatactataacgaaaaacgaaactcacacgataatactataacgaaaaacgaaactcacacgataatactataacgaaaaacgaaactcacacgataatactataacgaaaaacgaaactcacacgataatactataacgaaaaacgaaactcacacgataatactataacgaaaaacgaaactcacacgataatactataacgaaaaacgaaactcacacgataatactctaacgaaaaacgaaactcacacgataatactctaacgaaaaacgaaactcacacgataatactctaacgaaaaacgaaa

SEQ ID NO: 16303 - DNA, 619 bp, Artificial Sequence
  chemically treated genomic DNA (Homo sapiens) CpG-island No: 16303
agggggcggattttatatagtaatgtttggataggaggcggagtttatacggtaatgttttgtcgggaggcggagtttatacggtaatgttttgacgggaggcggagtttatacggtaatgttttgtcgggaggcggagtttatacggtaatgttgtgacgggaggcggagtttatacggtaatgttttgtcgggaggcggagtttatacggtaatgttttggcgggaggcggagtttatacggtaatgttttgacgggaggcggagtttatacggtaatgttttgtcgggaggcggagtttatacggtaatgttgtgacgggaggcggagtttatacggtaatgttgtgacgggaggcggagtttatacggtaatgttgtgacgggaggcggagtttatacggtaatgttgtgacgggaggcggagtttatacggtaatgttgtgacgggaggcggagtttatacggtaatgttgtgacgggaggcggagtttatacggtaatgttgtgacgggaggcggagtttatacggtaatgttttgacgggaggcggagtttatacggtaatgttttgacgggaggcggagtttatacggtaatgttttgacgggaggcggag

SEQ ID NO: 16304 - DNA, 619 bp, Artificial Sequence
  chemically treated genomic DNA (Homo sapiens) CpG-island No: 16304
ctccgcctcccgtcaaaacattaccgtataaactccgcctcccgtcaaaacattaccgtataaactccgcctcccgtcaaaacattaccgtataaactccgcctcccgtcacaacattaccgtataaactccgcctcccgtcacaacattaccgtataaactccgcctcccgtcacaacattaccgtataaactccgcctcccgtcacaacattaccgtataaactccgcctcccgtcacaacattaccgtataaactccgcctcccgtcacaacattaccgtataaactccgcctcccgtcacaacattaccgtataaactccgcctcccgacaaaacattaccgtataaactccgcctcccgtcaaaacattaccgtataaactccgcctcccgccaaaacattaccgtataaactccgcctcccgacaaaacattaccgtataaactccgcctcccgtcacaacattaccgtataaactccgcctcccgacaaaacattaccgtataaactccgcctcccgtcaaaacattaccgtataaactccgcctcccgacaaaacattaccgtataaactccgcctcctatccaaacattactatataaaatccgccccct

SEQ ID NO: 16305 - DNA, 666 bp, Artificial Sequence
  chemically treated genomic DNA (Homo sapiens) CpG-island No: 16305
cgtattttgtattttgggaagggttcgacgtataggatagggatcgggtaggaggtaggggcggttttaggagatcgggtagcggacgggggagatcgcgggggattcgttaggggacgggggcggtcgcgtcggttggggtaggggtcgggggcggcggtaggggacgggagggggtcgcgggggattcgataggggacggaggaggtcgtagtagaatcggtagggaacggggttggtcgggggagtcgggataggggtcggggtcgtcgcggcggaggcgggaggtgttcgggcggtgttaggtcgtatttttggaaaacgttttataggaagttttggttcggtagcgtcgcgtttgtagtaggtttagggtcggttttagggtcggggcggtaagagtaggcggttatgggttaaggtacgcggttgggttgaggcgtttgtagcgacgagagattttttaggtcgatttcgttttcgtttttgtcgggggtagggtttggtattattattattttcgggggcgtaggaaatgcgtggttttcgggatggttacggggtttcgcgtagttaattttttcgtagttgagttgttaggtaacgttttggcgtttgcggggagggcggggtttgggcgtttggaggaagttagagttttggcgt

SEQ ID NO: 16306 - DNA, 666 bp, Artificial Sequence
  chemically treated genomic DNA (Homo sapiens) CpG-island No: 16306
acgccaaaactctaacttcctccaaacgcccaaaccccgccctccccgcaaacgccaaaacgttacctaacaactcaactacgaaaaaattaactacgcgaaaccccgtaaccatcccgaaaaccacgcatttcctacgcccccgaaaataataataataccaaaccctacccccgacaaaaacgaaaacgaaatcgacctaaaaaatctctcgtcgctacaaacgcctcaacccaaccgcgtaccttaacccataaccgcctactcttaccgccccgaccctaaaaccgaccctaaacctactacaaacgcgacgctaccgaaccaaaacttcctataaaacgttttccaaaaatacgacctaacaccgcccgaacacctcccgcctccgccgcgacgaccccgacccctatcccgactcccccgaccaaccccgttccctaccgattctactacgacctcctccgtcccctatcgaatcccccgcgaccccctcccgtcccctaccgccgcccccgacccctaccccaaccgacgcgaccgcccccgtcccctaacgaatcccccgcgatctcccccgtccgctacccgatctcctaaaaccgcccctacctcctacccgatccctatcctatacgtcgaacccttcccaaaatacaaaatacg

SEQ ID NO: 16307 - DNA, 666 bp, Artificial Sequence
  chemically treated genomic DNA (Homo sapiens) CpG-island No: 16307
gcgttaaagttttggttttttttaggcgtttagatttcgtttttttcgtaggcgttagggcgttgtttggtaatttagttgcgaggggattggttgcgcgggatttcgtgattatttcggagattacgtattttttgcgttttcggaagtggtgataatgttaggttttgttttcggtagaggcggaagcggagtcggtttgagaggtttttcgtcgttgtaggcgttttagtttagtcgcgtgttttggtttatggtcgtttatttttatcgtttcggttttggggtcggttttgggtttgttgtaggcgcggcgttgtcggattagagttttttgtggaacgttttttagaggtgcggtttggtatcgttcgggtatttttcgttttcgtcgcggcggtttcgatttttgtttcgattttttcgattaatttcgttttttgtcggttttattgcggtttttttcgttttttgtcgggtttttcgcggttttttttcgttttttgtcgtcgttttcgatttttgttttagtcgacgcggtcgttttcgttttttggcgggtttttcgcggtttttttcgttcgttgttcggttttttggggtcgtttttgttttttgttcggtttttgttttgtgcgtcgggttttttttaagatgtagagtgcg

SEQ ID NO: 16308 - DNA, 666 bp, Artificial Sequence
  chemically treated genomic DNA (Homo sapiens) CpG-island No: 16308
cgcactctacatcttaaaaaaaacccgacgcacaaaacaaaaaccgaacaaaaaacaaaaacgaccccaaaaaaccgaacaacgaacgaaaaaaaccgcgaaaaacccgccaaaaaacgaaaacgaccgcgtcgactaaaacaaaaatcgaaaacgacgacaaaaaacgaaaaaaaaccgcgaaaaacccgacaaaaaacgaaaaaaaccgcaataaaaccgacaaaaaacgaaattaatcgaaaaaatcgaaacaaaaatcgaaaccgccgcgacgaaaacgaaaaatacccgaacgataccaaaccgcacctctaaaaaacgttccacaaaaaactctaatccgacaacgccgcgcctacaacaaacccaaaaccgaccccaaaaccgaaacgataaaaataaacgaccataaaccaaaacacgcgactaaactaaaacgcctacaacgacgaaaaacctctcaaaccgactccgcttccgcctctaccgaaaacaaaacctaacattatcaccacttccgaaaacgcaaaaaatacgtaatctccgaaataatcacgaaatcccgcgcaaccaatcccctcgcaactaaattaccaaacaacgccctaacgcctacgaaaaaaacgaaatctaaacgcctaaaaaaaaccaaaactttaacgc

SEQ ID NO: 16309 - DNA, 684 bp, Artificial Sequence
  chemically treated genomic DNA (Homo sapiens) CpG-island No: 16309
ttgatttgttttttttgttatattttttttcgtttttgatagtatcgcgggcgtttgtagtttttagtgtttcgtgttgttttcgtttttttgatttgttttttttgttatattttttttcgtttttgatagtatcgcgggcgtttgtagtttttagtgtttcgtgttgttttcgtttttttgatttgttttttttgttatattttttttcgtttttgatagtatcgcgggcgtttgtagtttttagtgtttcgtgttgttttcgtttttttgatttgttttttttgttatattttttttcgtttttgatagtatcgcgggcgtttgtagtttttagtgtttcgtgttgttttcgtttttttgatttgttttttttgttatattttttttcgtttttgatagtatcgcgggcgtttgtagtttttagtgtttcgtgttgttttcgtttttttgatttgttttttttgttatatttttttttatttttgatagtatcgcgggcgtttgtagtttttagtgtttcgtgttgttttcgtttttttgatttgttttttttgttatatttttttttatttttgatattatcgtaggcgtttgtagtttttagtgtttcgtgttgttttcgtttttttgatttgttttttttgttatatttttttttatttttgatagtatcgtgggtgt

SEQ ID NO: 16310 - DNA, 684 bp, Artificial Sequence
  chemically treated genomic DNA (Homo sapiens) CpG-island No: 16310
acacccacgatactatcaaaaataaaaaaaaatataacaaaaaaaacaaatcaaaaaaacgaaaacaacacgaaacactaaaaactacaaacgcctacgataatatcaaaaataaaaaaaaatataacaaaaaaaacaaatcaaaaaaacgaaaacaacacgaaacactaaaaactacaaacgcccgcgatactatcaaaaataaaaaaaaatataacaaaaaaaacaaatcaaaaaaacgaaaacaacacgaaacactaaaaactacaaacgcccgcgatactatcaaaaacgaaaaaaaatataacaaaaaaaacaaatcaaaaaaacgaaaacaacacgaaacactaaaaactacaaacgcccgcgatactatcaaaaacgaaaaaaaatataacaaaaaaaacaaatcaaaaaaacgaaaacaacacgaaacactaaaaactacaaacgcccgcgatactatcaaaaacgaaaaaaaatataacaaaaaaaacaaatcaaaaaaacgaaaacaacacgaaacactaaaaactacaaacgcccgcgatactatcaaaaacgaaaaaaaatataacaaaaaaaacaaatcaaaaaaacgaaaacaacacgaaacactaaaaactacaaacgcccgcgatactatcaaaaacgaaaaaaaatataacaaaaaaaacaaatcaa

SEQ ID NO: 16311 - DNA, 684 bp, Artificial Sequence
  chemically treated genomic DNA (Homo sapiens) CpG-island No: 16311
atatttacgatattgttagagatggagaaaggtatgataggaagagtagattaagaagacgggaatagtacgaggtattgggagttgtaaacgtttgcgataatgttagagatggagaaaggtatgataggaagagtagattaagaagacgggaatagtacgaggtattgggagttgtaaacgttcgcgatattgttagagatggagaaaggtatgataggaagagtagattaagaagacgggaatagtacgaggtattgggagttgtaaacgttcgcgatattgttagagacggagaaaggtatgataggaagagtagattaagaagacgggaatagtacgaggtattgggagttgtaaacgttcgcgatattgttagagacggagaaaggtatgataggaagagtagattaagaagacgggaatagtacgaggtattgggagttgtaaacgttcgcgatattgttagagacggagaaaggtatgataggaagagtagattaagaagacgggaatagtacgaggtattgggagttgtaaacgttcgcgatattgttagagacggagaaaggtatgataggaagagtagattaagaagacgggaatagtacgaggtattgggagttgtaaacgttcgcgatattgttagagacggagaaaggtatgataggaagagtagattaa

SEQ ID NO: 16312 - DNA, 684 bp, Artificial Sequence
  chemically treated genomic DNA (Homo sapiens) CpG-island No: 16312
ttaatctactcttcctatcatacctttctccgtctctaacaatatcgcgaacgtttacaactcccaatacctcgtactattcccgtcttcttaatctactcttcctatcatacctttctccgtctctaacaatatcgcgaacgtttacaactcccaatacctcgtactattcccgtcttcttaatctactcttcctatcatacctttctccgtctctaacaatatcgcgaacgtttacaactcccaatacctcgtactattcccgtcttcttaatctactcttcctatcatacctttctccgtctctaacaatatcgcgaacgtttacaactcccaatacctcgtactattcccgtcttcttaatctactcttcctatcatacctttctccgtctctaacaatatcgcgaacgtttacaactcccaatacctcgtactattcccgtcttcttaatctactcttcctatcatacctttctccatctctaacaatatcgcgaacgtttacaactcccaatacctcgtactattcccgtcttcttaatctactcttcctatcatacctttctccatctctaacattatcgcaaacgtttacaactcccaatacctcgtactattcccgtcttcttaatctactcttcctatcatacctttctccatctctaacaatatcgtaaatat

SEQ ID NO: 16313 - DNA, 639 bp, Artificial Sequence
  chemically treated genomic DNA (Homo sapiens) CpG-island No: 16313
  misc_feature (200)..(200): n is either a, c, g or t
  misc_feature (210)..(210): n is either a, c, g or t
  misc_feature (214)..(214): n is either a, c, g or t
  misc_feature (216)..(217): n is either a, c, g or t
  misc_feature (486)..(486): n is either a, c, g or t
cgatttcgcggcgcgttcggttcgtttcggattcgggggcgttttttcgttcgtttcgcgttcgttcggttcgggagatttagttggtagttaggcgtcgagcgtttaagcggataggtttcggattttcgatatgtttgttgtgtcgcgcgtagtttcgttagtttttgcgtagattgcgtttgcgtattatatcgggngttcgagttntggntnngggggaggggggatatcgcgtttgcgtattacgtcggagtcgagcggggttgtagtgggggatatcgcgtttgcgtattatgttacgttcggagcgggtattgagtgggggcgtcgcgtttgcgtaaagcggattcgcggacggtggcgttaagggaacgttgaggtttcgcgtttttcgatcgaggtagagcgggttttgtttcggggaggtggtgggtattaatatttttaaagtttcgtgggtggtttttcgggatcgtttagatncgaagggtttgaacgtttagatcgtagggaatggggtcggaggggggcgttcgttcgcggaggtgggcgggagcggttcggggttttcgattttttgtttatatatattttttgattaattaaattattttgtaattgtgtgtgtttgtggag

SEQ ID NO: 16314 - DNA, 639 bp, Artificial Sequence
  chemically treated genomic DNA (Homo sapiens) CpG-island No: 16314
  misc_feature (154)..(154): n is either a, c, g or t
  misc_feature (423)..(424): n is either a, c, g or t
  misc_feature (426)..(426): n is either a, c, g or t
  misc_feature (430)..(430): n is either a, c, g or t
  misc_feature (440)..(440): n is either a, c, g or t
ctccacaaacacacacaattacaaaataatttaattaatcaaaaaatatatataaacaaaaaatcgaaaaccccgaaccgctcccgcccacctccgcgaacgaacgcccccctccgaccccattccctacgatctaaacgttcaaacccttcgnatctaaacgatcccgaaaaaccacccacgaaactttaaaaatattaatacccaccacctccccgaaacaaaacccgctctacctcgatcgaaaaacgcgaaacctcaacgttcccttaacgccaccgtccgcgaatccgctttacgcaaacgcgacgcccccactcaatacccgctccgaacgtaacataatacgcaaacgcgatatcccccactacaaccccgctcgactccgacgtaatacgcaaacgcgatatcccccctcccccnnanccanaactcgaacncccgatataatacgcaaacgcaatctacgcaaaaactaacgaaactacgcgcgacacaacaaacatatcgaaaatccgaaacctatccgcttaaacgctcgacgcctaactaccaactaaatctcccgaaccgaacgaacgcgaaacgaacgaaaaaacgcccccgaatccgaaacgaaccgaacgcgccgcgaaatcg

SEQ ID NO: 16315 - DNA, 639 bp, Artificial Sequence
  chemically treated genomic DNA (Homo sapiens) CpG-island No: 16315
  misc_feature (154)..(154): n is either a, c, g or t
  misc_feature (423)..(424): n is either a, c, g or t
  misc_feature (426)..(426): n is either a, c, g or t
  misc_feature (430)..(430): n is either a, c, g or t
  misc_feature (440)..(440): n is either a, c, g or t
ttttataaatatatataattataaaatagtttagttaattaagggatgtatataaataagaggtcggaggtttcgggtcgttttcgtttattttcgcggacgagcgttttttttcgattttattttttgcggtttgggcgtttaggtttttcgngtttgggcgatttcggagaattatttacggggttttaaaaatgttggtgtttattattttttcggaatagggttcgttttatttcggtcggggagcgcgggattttagcgtttttttaacgttatcgttcgcgggttcgttttgcgtaggcgcggcgtttttatttagtattcgtttcgggcgtggtatggtgcgtaggcgcgatgttttttattgtagtttcgttcgatttcggcgtggtgcgtaggcgcggtatttttttttttttnngnttanggttcggatnttcggtgtggtgcgtaggcgtagtttgcgtagggattggcgggattgcgcgcggtatagtagatatgtcgggggttcggggtttgttcgtttgagcgttcggcgtttggttgttagttgagtttttcggatcgggcgggcgcggggcgggcgaggaggcgttttcgggttcgaggcgggtcgggcgcgtcgcgggatcg

SEQ ID NO: 16316 - DNA, 639 bp, Artificial Sequence
  chemically treated genomic DNA (Homo sapiens) CpG-island No: 16316
  misc_feature (200)..(200): n is either a, c, g or t
  misc_feature (210)..(210): n is either a, c, g or t
  misc_feature (214)..(214): n is either a, c, g or t
  misc_feature (216)..(217): n is either a, c, g or t
  misc_feature (486)..(486): n is either a, c, g or t
cgatcccgcgacgcgcccgacccgcctcgaacccgaaaacgcctcctcgcccgccccgcgcccgcccgatccgaaaaactcaactaacaaccaaacgccgaacgctcaaacgaacaaaccccgaacccccgacatatctactataccgcgcgcaatcccgccaatccctacgcaaactacgcctacgcaccacaccgaanatccgaaccntaancnnaaaaaaaaaaaaataccgcgcctacgcaccacgccgaaatcgaacgaaactacaataaaaaacatcgcgcctacgcaccataccacgcccgaaacgaatactaaataaaaacgccgcgcctacgcaaaacgaacccgcgaacgataacgttaaaaaaacgctaaaatcccgcgctccccgaccgaaataaaacgaaccctattccgaaaaaataataaacaccaacatttttaaaaccccgtaaataattctccgaaatcgcccaaacncgaaaaacctaaacgcccaaaccgcaaaaaataaaatcgaaaaaaaacgctcgtccgcgaaaataaacgaaaacgacccgaaacctccgacctcttatttatatacatcccttaattaactaaactattttataattatatatatttataaaa

SEQ ID NO: 16317 - DNA, 582 bp, Artificial Sequence
  chemically treated genomic DNA (Homo sapiens) CpG-island No: 16317
atatcgggagtttttttttcgtagagtatacggtggagttcgtatttcgtagagtaatatcgtggatttcgtttttcggagagtattatcggtgagttagtttttcggtagagtattatcgtgtgagtttcgtttttcgttagagtattatcgtgtgaggtttacgtttttcggtagagtattatcgtgtgagtttcgtttttcgttagagtaattatacgtttcgcgtgcgggcgttttcggtgagtattcgtaagttcgggcgcgttcgaagatattcgggtgagtttcgtttttcgttagagtattatcgtgtgagtttcgtttttcgttatagtattatcgtgtgagtttcgtttttttatagagtattatcgtgtgagtttcgtttttcgttatagtattatcgtgtgagtttcgtttttcggtagagtattatcgtgtgagtttcgtttttcggtagagtattatcgtgtgagtttcgtatatttcgttagagtattatcgtgtgagtttcgtttttcgatagagtattatcgtgtgagtttatagtttttcgttagagtattatcgtgtgagttt

SEQ ID NO: 16318 - DNA, 582 bp, Artificial Sequence
  chemically treated genomic DNA (Homo sapiens) CpG-island No: 16318
aaactcacacgataatactctaacgaaaaactataaactcacacgataatactctatcgaaaaacgaaactcacacgataatactctaacgaaatatacgaaactcacacgataatactctaccgaaaaacgaaactcacacgataatactctaccgaaaaacgaaactcacacgataatactataacgaaaaacgaaactcacacgataatactctataaaaaaacgaaactcacacgataatactataacgaaaaacgaaactcacacgataatactctaacgaaaaacgaaactcacccgaatatcttcgaacgcgcccgaacttacgaatactcaccgaaaacgcccgcacgcgaaacgtataattactctaacgaaaaacgaaactcacacgataatactctaccgaaaaacgtaaacctcacacgataatactctaacgaaaaacgaaactcacacgataatactctaccgaaaaactaactcaccgataatactctccgaaaaacgaaatccacgatattactctacgaaatacgaactccaccgtatactctacgaaaaaaaaactcccgatat

SEQ ID NO: 16319 - DNA, 582 bp, Artificial Sequence
  chemically treated genomic DNA (Homo sapiens) CpG-island No: 16319
gagtttatacggtaatgttttgacggggggttgtgagtttatacggtaatgttttgtcggggggcggagtttatacggtaatgttttggcggggtgtgcggagtttatacggtaatgttttgtcgggaggcggagtttatacggtaatgttttgtcgggaggcggagtttatacggtaatgttgtgacgggaggcggagtttatacggtaatgttttgtggggaggcggagtttatacggtaatgttgtgacgggaggcggagtttatacggtaatgttttggcgggaggcggagtttattcggatgttttcgggcgcgttcgaatttacgggtgtttatcgagagcgttcgtacgcggaacgtgtaattgttttggcgggaggcggagtttatacggtaatgttttgtcgggaggcgtgagttttatacggtaatgttttgacgggaggcggagtttatacggtagtgttttgtcgggaggttagtttatcggtaatgtttttcgggaggcggagtttacggtattgttttgcgggatgcgggttttatcgtatgttttgcgggaggggagttttcggtat

SEQ ID NO: 16320 - DNA, 582 bp, Artificial Sequence
  chemically treated genomic DNA (Homo sapiens) CpG-island No: 16320
ataccgaaaactcccctcccgcaaaacatacgataaaacccgcatcccgcaaaacaataccgtaaactccgcctcccgaaaaacattaccgataaactaacctcccgacaaaacactaccgtataaactccgcctcccgtcaaaacattaccgtataaaactcacgcctcccgacaaaacattaccgtataaactccgcctcccgccaaaacaattacacgttccgcgtacgaacgctctcgataaacacccgtaaattcgaacgcgcccgaaaacatccgaataaactccgcctcccgccaaaacattaccgtataaactccgcctcccgtcacaacattaccgtataaactccgcctccccacaaaacattaccgtataaactccgcctcccgtcacaacattaccgtataaactccgcctcccgacaaaacattaccgtataaactccgcctcccgacaaaacattaccgtataaactccgcacaccccgccaaaacattaccgtataaactccgccccccgacaaaacattaccgtataaactcacaaccccccgtcaaaacattaccgtataaactc

SEQ ID NO: 16321 - DNA, 552 bp, Artificial Sequence
  chemically treated genomic DNA (Homo sapiens) CpG-island No: 16321
ttcgtttttcgttatagtattatcgtgtgagtttcgtttttcgttatagtattatcgtgtgagtttcgtttttcgttatagtattatcgtgtgatgtttcgtttttcgtttgaatattatcgttgtgatgtttcgtttttcgttcgagtattatcgtgtgagtttcggttttcgttaggagtattatcgtgtgagtttcgatttttttgtttagagttatgtatcgtcgtgagtttcgtttttcgttttagatatttatcgttgatgtaggtttcgttttttttgttatagtatttatcgtgtgtagttttagttttcgcgtttattaggcgattttattcggtgatgtaagtcgttcgtgatattttacgttttagatgttttatcgtgtgagtttcgtttttcgatatagtattatcgttgtgtatggttttttcggttttttcgtcgtatttaagaaggtcgatttaatatagttggttgtatgcgtgttcggtttttatcggggagattattatcgtgtgagtttcgtttttcgttagagtattatcg

SEQ ID NO: 16322 - DNA, 552 bp, Artificial Sequence
  chemically treated genomic DNA (Homo sapiens) CpG-island No: 16322
cgataatactctaacgaaaaacgaaactcacacgataataatctccccgataaaaaccgaacacgcatacaaccaactatattaaatcgaccttcttaaatacgacgaaaaaaccgaaaaaaccatacacaacgataatactatatcgaaaaacgaaactcacacgataaaacatctaaaacgtaaaatatcacgaacgacttacatcaccgaataaaatcgcctaataaacgcgaaaactaaaactacacacgataaatactataacaaaaaaaacgaaacctacatcaacgataaatatctaaaacgaaaaacgaaactcacgacgatacataactctaaacaaaaaaatcgaaactcacacgataatactcctaacgaaaaccgaaactcacacgataatactcgaacgaaaaacgaaacatcacaacgataatattcaaacgaaaaacgaaacatcacacgataatactataacgaaaaacgaaactcacacgataatactataacgaaaaacgaaactcacacgataatactataacgaaaaacgaa

SEQ ID NO: 16323 - DNA, 552 bp, Artificial Sequence
  chemically treated genomic DNA (Homo sapiens) CpG-island No: 16323
cggtaatgttttgacgggaggcggagtttatacggtaatgattttttcggtgaggatcgggtacgtatgtaattagttgtgttaaatcgatttttttggatgcggcgaagggatcggggaggttatgtataacggtaatgttatgtcgggagacggagtttatacggtaaagtatttggaacgtggaatgttacggacgatttgtattatcgagtgaaatcgtttagtggacgcggaggttggagttgtatacggtgaatgttgtgatagggaggacggagtttatattaacggtgaatgtttgagacgggagacggagtttacgacggtatatgattttggatagggagatcggagtttatacggtaatgtttttgacgggagtcggagtttatacggtaatgttcggacgggaggcggagtattataacggtaatgtttagacgggaggcggagtattatacggtaatgttgtgacgggaggcggagtttatacggtaatgttgtgacgggaggcggagtttatacggtaatgttgtgacgggaggcgga

SEQ ID NO: 16324 - DNA, 552 bp, Artificial Sequence
  chemically treated genomic DNA (Homo sapiens) CpG-island No: 16324
tccgcctcccgtcacaacattaccgtataaactccgcctcccgtcacaacattaccgtataaactccgcctcccgtcacaacattaccgtataatactccgcctcccgtctaaacattaccgttataatactccgcctcccgtccgaacattaccgtataaactccgactcccgtcaaaaacattaccgtataaactccgatctccctatccaaaatcatataccgtcgtaaactccgtctcccgtctcaaacattcaccgttaatataaactccgtcctccctatcacaacattcaccgtatacaactccaacctccgcgtccactaaacgatttcactcgataatacaaatcgtccgtaacattccacgttccaaatactttaccgtataaactccgtctcccgacataacattaccgttatacataacctccccgatcccttcgccgcatccaaaaaaatcgatttaacacaactaattacatacgtacccgatcctcaccgaaaaaatcattaccgtataaactccgcctcccgtcaaaacattaccg

SEQ ID NO: 16325 - DNA, 582 bp, Artificial Sequence
  chemically treated genomic DNA (Homo sapiens) CpG-island No: 16325
cggtgtcgttcgtcgtgcgtcgtcgtcgtttgattcgcgtgttttcggattaatagtaggagagcggatattatatacgatcgtatggattaggcggcgtaggacgttcgacgacgcgttaagtatatttgcggatagaggcgcgcgggatttcgggaatagtgatttgtttgttcgttcgtacgaggttagatagcggaatagatttatttagcgtagagttgacgttatgtgatattaagtatcgagggtacgtaattggatagagcgatagcgggggataatcgcgatttgagatattcgcgttcggaattcgagacgcggttgtaagaagaggattaaaatatttgtagtatagagtaaatacggaaacgggaatgaatgtaggtgtatagtaaggtaaacggatttcgaacgggtagataagatatcgaaagttcggagttcgatgagtatcgattcgatcgggagtgtcgtgtagataaatatagggaggaatagagatattatcgtgagaatcgttaaagatgtaggattttttaggtaacgattataaaataggtacgattgggtgagtataaa

SEQ ID NO: 16326 - DNA, 582 bp, Artificial Sequence
  chemically treated genomic DNA (Homo sapiens) CpG-island No: 16326
tttatactcacccaatcgtacctattttataatcgttacctaaaaaatcctacatctttaacgattctcacgataatatctctattcctccctatatttatctacacgacactcccgatcgaatcgatactcatcgaactccgaactttcgatatcttatctacccgttcgaaatccgtttaccttactatacacctacattcattcccgtttccgtatttactctatactacaaatattttaatcctcttcttacaaccgcgtctcgaattccgaacgcgaatatctcaaatcgcgattatcccccgctatcgctctatccaattacgtaccctcgatacttaatatcacataacgtcaactctacgctaaataaatctattccgctatctaacctcgtacgaacgaacaaacaaatcactattcccgaaatcccgcgcgcctctatccgcaaatatacttaacgcgtcgtcgaacgtcctacgccgcctaatccatacgatcgtatataatatccgctctcctactattaatccgaaaacacgcgaatcaaacgacgacgacgcacgacgaacgacaccg

SEQ ID NO: 16327 - DNA, 582 bp, Artificial Sequence
  chemically treated genomic DNA (Homo sapiens) CpG-island No: 16327
tttgtgtttatttagtcgtatttattttgtggtcgttatttggagggttttatatttttggcggtttttacggtggtgtttttgtttttttttgtatttatttatacgatattttcggtcgggtcggtatttatcgggtttcggattttcggtgttttgtttattcgttcggggttcgtttgttttgttgtgtatttgtatttattttcgttttcgtgtttgttttgtgttgtaggtgttttggttttttttttgtagtcgcgtttcgggtttcggacgcgggtgttttaggtcgcggttatttttcgttgtcgttttgtttagttgcgtattttcggtgtttgatgttatatggcgttagttttgcgttaagtggatttgtttcgttatttggtttcgtacgggcggataggtagattattgttttcgggatttcgcgcgtttttgttcgtaggtatgtttgacgcgtcgtcgggcgttttgcgtcgtttggtttatacggtcgtgtgtagtattcgtttttttgttgttagttcggagatacgcgggttaagcggcgacggcgtacgacggacgatatcg

SEQ ID NO: 16328 - DNA, 582 bp, Artificial Sequence
  chemically treated genomic DNA (Homo sapiens) CpG-island No: 16328
cgatatcgtccgtcgtacgccgtcgccgcttaacccgcgtatctccgaactaacaacaaaaaaacgaatactacacacgaccgtataaaccaaacgacgcaaaacgcccgacgacgcgtcaaacatacctacgaacaaaaacgcgcgaaatcccgaaaacaataatctacctatccgcccgtacgaaaccaaataacgaaacaaatccacttaacgcaaaactaacgccatataacatcaaacaccgaaaatacgcaactaaacaaaacgacaacgaaaaataaccgcgacctaaaacacccgcgtccgaaacccgaaacgcgactacaaaaaaaaaaccaaaacacctacaacacaaaacaaacacgaaaacgaaaataaatacaaatacacaacaaaacaaacgaaccccgaacgaataaacaaaacaccgaaaatccgaaacccgataaataccgacccgaccgaaaatatcgtataaataaatacaaaaaaaaacaaaaacaccaccgtaaaaaccgccaaaaatataaaaccctccaaataacgaccacaaaataaatacgactaaataaacacaaa

SEQ ID NO: 16329 - DNA, 519 bp, Artificial Sequence
  chemically treated genomic DNA (Homo sapiens) CpG-island No: 16329
gtattcgtttattatttgcgttcgaggatgcgttcggggtgtcgtattcgattattatttgcgtaggaggatgcgttcgtcgagtcgtattcgtttattaattgcgtaggaggatgcgttcgtcgagtcgtattcgtttattatttgcgtaggaggatgcgttcgtcgagtcgtattcgttgattatttgcgtaggaggatgcgttcgttcggagtgcgttaatcgcgtttcgatcgatttgcgatacgtaagatgtcgttgcgtcgagtcgtattcgtttattatttgcgtaggaggatgcgttcgtcgagtcgtattcgtttattatttgcgtaggaggatgcgttcgtcgagtcgtattcgtttattatttgtatacgaagatgcgttcgtcgagtggtatcggtgtattttttgcggcgcgtgagtaatgatatttgttaagattgaatagtattttataggtgggtcgtgaaggtagggcgtgcgagggttagcgtaggggttattatttgatg

SEQ ID NO: 16330 - DNA, 519 bp, Artificial Sequence
  chemically treated genomic DNA (Homo sapiens) CpG-island No: 16330
catcaaataataacccctacgctaaccctcgcacgccctaccttcacgacccacctataaaatactattcaatcttaacaaatatcattactcacgcgccgcaaaaaatacaccgataccactcgacgaacgcatcttcgtatacaaataataaacgaatacgactcgacgaacgcatcctcctacgcaaataataaacgaatacgactcgacgaacgcatcctcctacgcaaataataaacgaatacgactcgacgcaacgacatcttacgtatcgcaaatcgatcgaaacgcgattaacgcactccgaacgaacgcatcctcctacgcaaataatcaacgaatacgactcgacgaacgcatcctcctacgcaaataataaacgaatacgactcgacgaacgcatcctcctacgcaattaataaacgaatacgactcgacgaacgcatcctcctacgcaaataataatcgaatacgacaccccgaacgcatcctcgaacgcaaataataaacgaatac

SEQ ID NO: 16331 - DNA, 519 bp, Artificial Sequence
  chemically treated genomic DNA (Homo sapiens) CpG-island No: 16331
tattagatggtgatttttacgttgattttcgtacgttttgtttttacggtttatttgtaaggtattgtttagttttggtaagtgttattatttacgcgtcgtaaagggtgtatcggtgttattcgacgaacgtattttcgtatgtaaatggtgaacgggtgcgattcgacgaacgtatttttttacgtaaatggtgaacgggtgcgattcgacgaacgtatttttttacgtaaatggtgaacgggtgcgattcgacgtaacggtattttgcgtatcgtaaatcggtcgaaacgcggttagcgtatttcgagcgaacgtatttttttacgtaaatggttaacgggtgcgattcgacgaacgtatttttttacgtaaatggtgaacgggtgcgattcggcgaacgtatttttttacgtaattggtgaacgggtgcgattcgacgaacgtatttttttacgtaaatggtgatcgggtgcgatatttcgaacgtattttcgaacgtaaatggtgaacgggtgt

SEQ ID NO: 16332 - DNA, 519 bp, Artificial Sequence
  chemically treated genomic DNA (Homo sapiens) CpG-island No: 16332
acacccgttcaccatttacgttcgaaaatacgttcgaaatatcgcacccgatcaccatttacgtaaaaaaatacgttcgtcgaatcgcacccgttcaccaattacgtaaaaaaatacgttcgccgaatcgcacccgttcaccatttacgtaaaaaaatacgttcgtcgaatcgcacccgttaaccatttacgtaaaaaaatacgttcgctcgaaatacgctaaccgcgtttcgaccgatttacgatacgcaaaataccgttacgtcgaatcgcacccgttcaccatttacgtaaaaaaatacgttcgtcgaatcgcacccgttcaccatttacgtaaaaaaatacgttcgtcgaatcgcacccgttcaccatttacatacgaaaatacgttcgtcgaataacaccgatacaccctttacgacgcgtaaataataacacttaccaaaactaaacaataccttacaaataaaccgtaaaaacaaaacgtacgaaaatcaacgtaaaaatcaccatctaata

SEQ ID NO: 16333 - DNA, 619 bp, Artificial Sequence
  chemically treated genomic DNA (Homo sapiens) CpG-island No: 16333
gttcgcggtaattcgacgttttcggaatttttttatatttgtcgtgatgttaatttcgcgatataattttcggtacggatattttcggttttcggagtaggttgcgtcggagaaatttcgatacgtggtagatttttaaaacgagattcgtacgggcgggttttttatcgtatgtgcggtgatatttacgtcgcgtggcgtcgtcgtgcgcgtggtttttcgatttttatgtgcgttttgtattcgggcgtttattgtgttcgtttttttttatttttcgtatcggggtaagggttttgtaaggcgtgtggttaaatacgcgtttacgggtcgtgtatggtgttttttcggtgcggtttatcgtttgtacggtttttatgttgtgtttttgttattaattcgtgggtaatcggaatgcgtgtcgtattcggttatgggagggtgttcgttcggtagatcgatatagtattgggacgagtagtgtaaggtaacgaggaggtttagagcgtaatatttagagggtgcgttcgggtagtagagttatggttgttttatcgggttttaagggtatacggaacggtggttgtgtttttttaatgtttttttttgatttatagta

SEQ ID NO: 16334 - DNA, 619 bp, Artificial Sequence
  chemically treated genomic DNA (Homo sapiens) CpG-island No: 16334
tactataaatcaaaaaaaaacattaaaaaaacacaaccaccgttccgtatacccttaaaacccgataaaacaaccataactctactacccgaacgcaccctctaaatattacgctctaaacctcctcgttaccttacactactcgtcccaatactatatcgatctaccgaacgaacaccctcccataaccgaatacgacacgcattccgattacccacgaattaataacaaaaacacaacataaaaaccgtacaaacgataaaccgcaccgaaaaaacaccatacacgacccgtaaacgcgtatttaaccacacgccttacaaaacccttaccccgatacgaaaaataaaaaaaaacgaacacaataaacgcccgaatacaaaacgcacataaaaatcgaaaaaccacgcgcacgacgacgccacgcgacgtaaatatcaccgcacatacgataaaaaacccgcccgtacgaatctcgttttaaaaatctaccacgtatcgaaatttctccgacgcaacctactccgaaaaccgaaaatatccgtaccgaaaattatatcgcgaaattaacatcacgacaaatataaaaaaattccgaaaacgtcgaattaccgcgaac

SEQ ID NO: 16335 - DNA, 619 bp, Artificial Sequence
  chemically treated genomic DNA (Homo sapiens) CpG-island No: 16335
tgttgtaagttaagaaaaaatattgagaaaatataattatcgtttcgtatatttttgggattcgataaggtaattatggttttattgttcgggcgtattttttaggtgttgcgttttaaattttttcgttgttttatattgttcgttttagtgttatatcggtttatcgggcggatatttttttatggtcgaatacggtacgtatttcgattatttacgggttgatgataaagatataatatggggatcgtatagacggtaaatcgtatcgggaagatattatatacggttcgtgagcgcgtatttgattatacgttttataaagtttttgtttcgatacggggaatgaaagggaacggatatagtaaacgttcgggtataggacgtatatgggggtcgggaaattacgcgtacgacgacgttacgcgacgtggatgttatcgtatatgcggtggaaaattcgttcgtgcggatttcgttttaagagtttattacgtgtcggggttttttcggcgtaatttatttcggaaatcggagatgttcgtgtcggagattatatcgcggaattggtattacggtaaatgtggggaggtttcggagacgtcgaattatcgcgggt

SEQ ID NO: 16336 - DNA, 619 bp, Artificial Sequence
  chemically treated genomic DNA (Homo sapiens) CpG-island No: 16336
acccgcgataattcgacgtctccgaaacctccccacatttaccgtaataccaattccgcgatataatctccgacacgaacatctccgatttccgaaataaattacgccgaaaaaaccccgacacgtaataaactcttaaaacgaaatccgcacgaacgaattttccaccgcatatacgataacatccacgtcgcgtaacgtcgtcgtacgcgtaatttcccgacccccatatacgtcctatacccgaacgtttactatatccgttccctttcattccccgtatcgaaacaaaaactttataaaacgtataatcaaatacgcgctcacgaaccgtatataatatcttcccgatacgatttaccgtctatacgatccccatattatatctttatcatcaacccgtaaataatcgaaatacgtaccgtattcgaccataaaaaaatatccgcccgataaaccgatataacactaaaacgaacaatataaaacaacgaaaaaatttaaaacgcaacacctaaaaaatacgcccgaacaataaaaccataattaccttatcgaatcccaaaaatatacgaaacgataattatattttctcaatattttttcttaacttacaaca

SEQ ID NO: 16337 - DNA, 520 bp, Artificial Sequence
  chemically treated genomic DNA (Homo sapiens) CpG-island No: 16337
  misc_feature (492)..(492): n is either a, c, g or t
  misc_feature (509)..(509): n is either a, c, g or t
gaggcgagcgagttaggcgcgagttttttgggattgtagcggcggttttaggtcgcgttttgcgttaatttttcgtacgtgttcgtagttttttggttatttagcgtcgtagggaaggcgttgggtttttttttttatttgtatcgggacgttaagggtttggcgcgtcgcgatttagggggcgggggcgggtttcgcgtatgcgcgttgcgtttggcgggcgtgagggcgggtcgttgcggcggcggcggcggcggttatcgaatcgcggttatagagtttgtaatagtaatagagttatggtttaagttggttagcggggcgggtaggtagtagacgcggtaggcgcgcgtttttcggtaggggagttcgagattttagaattttaagaaagagaggggcgagaggtggtcgaggcgggcgggttggggtattgcgtttttttaacggcgcggattttttttgaaaattaatattaaaaaaaaaaaagtngaggatttagaggtttngttggggggta

SEQ ID NO: 16338 - DNA, 520 bp, Artificial Sequence
  chemically treated genomic DNA (Homo sapiens) CpG-island No: 16338
  misc_feature (12)..(12): n is either a, c, g or t
  misc_feature (29)..(29): n is either a, c, g or t
taccccccaacnaaacctctaaatcctcnacttttttttttttaatattaattttcaaaaaaaatccgcgccgttaaaaaaacgcaataccccaacccgcccgcctcgaccacctctcgcccctctctttcttaaaattctaaaatctcgaactcccctaccgaaaaacgcgcgcctaccgcgtctactacctacccgccccgctaaccaacttaaaccataactctattactattacaaactctataaccgcgattcgataaccgccgccgccgccgccgcaacgacccgccctcacgcccgccaaacgcaacgcgcatacgcgaaacccgcccccgccccctaaatcgcgacgcgccaaacccttaacgtcccgatacaaataaaaaaaaaaacccaacgccttccctacgacgctaaataaccaaaaaactacgaacacgtacgaaaaattaacgcaaaacgcgacctaaaaccgccgctacaatcccaaaaaactcgcgcctaactcgctcgcctc

SEQ ID NO: 16339 - DNA, 520 bp, Artificial Sequence
  chemically treated genomic DNA (Homo sapiens) CpG-island No: 16339
  misc_feature (12)..(12): n is either a, c, g or t
  misc_feature (29)..(29): n is either a, c, g or t
tattttttagtnaagtttttgggtttttngtttttttttttttaatattaatttttaaagaggattcgcgtcgttgggagagcgtagtgttttagttcgttcgtttcggttatttttcgttttttttttttttaaaattttgaggtttcgggtttttttgtcggggggcgcgcgtttgtcgcgtttgttgtttgttcgtttcgttggttagtttgagttatggttttgttattgttatagattttgtggtcgcggttcggtagtcgtcgtcgtcgtcgtcgtagcggttcgtttttacgttcgttaggcgtagcgcgtatgcgcgaggttcgttttcgttttttaggtcgcggcgcgttaggtttttggcgtttcggtataaatgaaggagggggtttagcgttttttttgcggcgttggatggttagggagttgcgggtacgtgcgaaagattggcgtagagcgcgatttggggtcgtcgttgtaattttaggagattcgcgtttggttcgttcgtttt

SEQ ID NO: 16340 - DNA, 520 bp, Artificial Sequence
  chemically treated genomic DNA (Homo sapiens) CpG-island No: 16340
  misc_feature (492)..(492): n is either a, c, g or t
  misc_feature (509)..(509): n is either a, c, g or t
aaaacgaacgaaccaaacgcgaatctcctaaaattacaacgacgaccccaaatcgcgctctacgccaatctttcgcacgtacccgcaactccctaaccatccaacgccgcaaaaaaaacgctaaaccccctccttcatttataccgaaacgccaaaaacctaacgcgccgcgacctaaaaaacgaaaacgaacctcgcgcatacgcgctacgcctaacgaacgtaaaaacgaaccgctacgacgacgacgacgacgactaccgaaccgcgaccacaaaatctataacaataacaaaaccataactcaaactaaccaacgaaacgaacaaacaacaaacgcgacaaacgcgcgccccccgacaaaaaaacccgaaacctcaaaattttaaaaaaaaaaaaaacgaaaaataaccgaaacgaacgaactaaaacactacgctctcccaacgacgcgaatcctctttaaaaattaatattaaaaaaaaaaaaacnaaaaacccaaaaacttnactaaaaaata

SEQ ID NO: 16341 - DNA, 1639 bp, Artificial Sequence
  chemically treated genomic DNA (Homo sapiens) CpG-island No: 16341
cgtttcgttcgtgcgggatattagtttttaggatgcgttaatcgtagatcgtttaagcgtaagaggtggcgagaggttattacggttgtttaatagttgcgtttttaggttgtttggtgtgacgtagtagttttcgttcggattttgaggtttggcgtttcgattgagtcgaggtttgtgttattcgatattttttgcgattcggttttttaggtttatttagcgcggtttttttcggtttttcgagttttatcgtagtttttttttattttcgttttttttcggttttttgttagtgttcgtcgcgatgtttttgcgtaattattttaagtgatattagcgtttatattcgtacggagcgagtttgaagtttttatttttcggaatttaacgtcgggtcgttaagggcgggtatttaagcgaggattagcggattaaggtcgcgattagagtttagcggttttcgcgtagttagagttcgatagtttttgcgtattcgtcgtgcgtatttttattcgtgcgcgtgcgcgtattcgttttttcgtttcgttttagtattaatcgttttttttttacgtttacgattttttaacgtagtttttttcgtttttcgcgcgcgagtagaaaggtttcggcgtgcgcgcgttcgttcgtttcgcgttttgtcgggaaggggagtgagtagaggcgtttacgtcgcgcgggaggcggaggcgacggcgatttcggtggcggcggcggttacgacggagacggttgcgttcgtttgttttttcggcgttatggcggttgtcgggggtagataagcggagggagcgggagcgcgcgcgcgacggcggcggcggcggcggcgacgattggttatttatagtttttgttgttttcgtttttggtgttttaataatgaattgttagttttatttcgtaggggatcgcgcgttggtgttgcggatcggggtttttttttttttttcgcgtttgtttttttttttttttttcgtacggatttttgtttatttcgagacgtcggagttttaggattgggcggcggagatttcgggtttgggtgcgggggaggtcgtttattcgagtcggtttttttcgtttcgttaagttcgtcggtaagaaagggggcggcgggcgggttaggatgtggcggagaggataggaatcggtcgggcggagggcgggcgcggcgcggtgtttaggcggcggtttagcggtcgggtgaaggtcgggtggttttgtgagtgtcggtggcggtgtacgggtttggcgcgtagggggcgtgtgagcggcgagtataggtcggggtcgtagaacgtatttttgcgtcggttcggcggttttgtttcggttttttcggtttggtgtcgatcgggtcgcgagaggagattcgcgaatggttagtatttagtcggtgcgtgggttttgtcgcgattcgggtttttagtacgtggggagcggcgggagggggagggggcggcggttcgggcgagtttgggagggcgcggggcgggtttgcgggaagtttgaggcgggaagagggatttttggatcgggatggaggttttgggagaggggggtaggttcgcgagggaggttgattggagcgcgttggatggatgagtgaggatgg

SEQ ID NO: 16342 - DNA, 1639 bp, Artificial Sequence
  chemically treated genomic DNA (Homo sapiens) CpG-island No: 16342
ccatcctcactcatccatccaacgcgctccaatcaacctccctcgcgaacctacccccctctcccaaaacctccatcccgatccaaaaatccctcttcccgcctcaaacttcccgcaaacccgccccgcgccctcccaaactcgcccgaaccgccgccccctccccctcccgccgctccccacgtactaaaaacccgaatcgcgacaaaacccacgcaccgactaaatactaaccattcgcgaatctcctctcgcgacccgatcgacaccaaaccgaaaaaaccgaaacaaaaccgccgaaccgacgcaaaaatacgttctacgaccccgacctatactcgccgctcacacgccccctacgcgccaaacccgtacaccgccaccgacactcacaaaaccacccgaccttcacccgaccgctaaaccgccgcctaaacaccgcgccgcgcccgccctccgcccgaccgattcctatcctctccgccacatcctaacccgcccgccgccccctttcttaccgacgaacttaacgaaacgaaaaaaaccgactcgaataaacgacctcccccgcacccaaacccgaaatctccgccgcccaatcctaaaactccgacgtctcgaaataaacaaaaatccgtacgaaaaaaaaaaaaaaaaacaaacgcgaaaaaaaaaaaaaaaccccgatccgcaacaccaacgcgcgatcccctacgaaataaaactaacaattcattattaaaacaccaaaaacgaaaacaacaaaaactataaataaccaatcgtcgccgccgccgccgccgccgtcgcgcgcgcgctcccgctccctccgcttatctacccccgacaaccgccataacgccgaaaaaacaaacgaacgcaaccgtctccgtcgtaaccgccgccgccaccgaaatcgccgtcgcctccgcctcccgcgcgacgtaaacgcctctactcactccccttcccgacaaaacgcgaaacgaacgaacgcgcgcacgccgaaacctttctactcgcgcgcgaaaaacgaaaaaaactacgttaaaaaatcgtaaacgtaaaaaaaaaacgattaatactaaaacgaaacgaaaaaacgaatacgcgcacgcgcacgaataaaaatacgcacgacgaatacgcaaaaactatcgaactctaactacgcgaaaaccgctaaactctaatcgcgaccttaatccgctaatcctcgcttaaatacccgcccttaacgacccgacgttaaattccgaaaaataaaaacttcaaactcgctccgtacgaatataaacgctaatatcacttaaaataattacgcaaaaacatcgcgacgaacactaacaaaaaaccgaaaaaaaacgaaaataaaaaaaaactacgataaaactcgaaaaaccgaaaaaaaccgcgctaaataaacctaaaaaaccgaatcgcaaaaaatatcgaataacacaaacctcgactcaatcgaaacgccaaacctcaaaatccgaacgaaaactactacgtcacaccaaacaacctaaaaacgcaactattaaacaaccgtaataacctctcgccacctcttacgcttaaacgatctacgattaacgcatcctaaaaactaatatcccgcacgaacgaaacg

SEQ ID NO: 16343 - DNA, 1639 bp, Artificial Sequence
  chemically treated genomic DNA (Homo sapiens) CpG-island No: 16343
ttatttttatttatttatttagcgcgttttaattagtttttttcgcggatttgttttttttttttagggtttttatttcggtttaggagttttttttttcgttttaaatttttcgtagattcgtttcgcgtttttttaggttcgttcgagtcgtcgttttttttttttttcgtcgttttttacgtgttgggagttcgggtcgcggtaggatttacgtatcggttaagtgttagttattcgcgggttttttttcgcggttcggtcggtattaagtcgaagaggtcggggtagggtcgtcgggtcggcgtaaggatgcgttttgcggtttcggtttgtattcgtcgtttatacgttttttgcgcgttaggttcgtatatcgttatcggtatttatagagttattcggtttttattcggtcgttgggtcgtcgtttgggtatcgcgtcgcgttcgtttttcgttcggtcggtttttgtttttttcgttatattttgattcgttcgtcgtttttttttttatcggcgggtttggcggggcggagggagtcgattcgggtggacggtttttttcgtatttaggttcgggattttcgtcgtttagttttagggtttcggcgtttcggggtaagtaagagttcgtgcgggggagggggaaggggatagacgcggaggggaaggggaagtttcggttcgtagtattaacgcgcgattttttgcggagtggagttaataatttattattgaagtattaagggcgagggtagtaagagttataagtaattagtcgtcgtcgtcgtcgtcgtcgtcgtcgcgcgcgcgttttcgtttttttcgtttatttgttttcggtagtcgttatgacgtcgagaaagtaagcgagcgtaatcgttttcgtcgtagtcgtcgtcgttatcgaggtcgtcgtcgttttcgtttttcgcgcgacgtaagcgtttttgtttattttttttttcgatagagcgcgaggcgggcgggcgcgcgtacgtcgaagtttttttgttcgcgcgcgggaggcgggagggattacgttgaagggtcgtgggcgtaggaaaaaagcgattggtgttggggcggggcgggggggcgagtgcgcgtacgcgtacgaatgggagtgcgtacggcggatgcgtagaggttgtcggattttgattgcgcggagatcgttggattttggtcgcggttttagttcgttgattttcgtttgggtgttcgtttttagcggttcggcgttgaatttcgggaagtgggagttttaggttcgtttcgtgcgggtatgggcgttaatgttatttgggatggttgcgtaaggatatcgcggcggatattgataaggaatcggggaggaacgggggtggggagagattgcgatgggattcgggaagtcgggaagggtcgcgttgaataagtttaaggggtcgggtcgtaaggagtgtcgggtagtataggtttcggtttagtcggagcgttaggttttagggttcgggcgggggttgttgcgttatattaggtagtttgggaacgtaattgttgggtaatcgtggtggtttttcgttattttttacgtttgggcgatttgcgattgacgtattttgggagttgatgtttcgtacgggcggggcg

SEQ ID NO: 16344 - DNA, 1639 bp, Artificial Sequence
  chemically treated genomic DNA (Homo sapiens) CpG-island No: 16344
cgccccgcccgtacgaaacatcaactcccaaaatacgtcaatcgcaaatcgcccaaacgtaaaaaataacgaaaaaccaccacgattacccaacaattacgttcccaaactacctaatataacgcaacaacccccgcccgaaccctaaaacctaacgctccgactaaaccgaaacctatactacccgacactccttacgacccgaccccttaaacttattcaacgcgacccttcccgacttcccgaatcccatcgcaatctctccccacccccgttcctccccgattccttatcaatatccgccgcgatatccttacgcaaccatcccaaataacattaacgcccatacccgcacgaaacgaacctaaaactcccacttcccgaaattcaacgccgaaccgctaaaaacgaacacccaaacgaaaatcaacgaactaaaaccgcgaccaaaatccaacgatctccgcgcaatcaaaatccgacaacctctacgcatccgccgtacgcactcccattcgtacgcgtacgcgcactcgcccccccgccccgccccaacaccaatcgcttttttcctacgcccacgacccttcaacgtaatccctcccgcctcccgcgcgcgaacaaaaaaacttcgacgtacgcgcgcccgcccgcctcgcgctctatcgaaaaaaaaaataaacaaaaacgcttacgtcgcgcgaaaaacgaaaacgacgacgacctcgataacgacgacgactacgacgaaaacgattacgctcgcttactttctcgacgtcataacgactaccgaaaacaaataaacgaaaaaaacgaaaacgcgcgcgcgacgacgacgacgacgacgacgacgactaattacttataactcttactaccctcgcccttaatacttcaataataaattattaactccactccgcaaaaaatcgcgcgttaatactacgaaccgaaacttccccttcccctccgcgtctatccccttccccctcccccgcacgaactcttacttaccccgaaacgccgaaaccctaaaactaaacgacgaaaatcccgaacctaaatacgaaaaaaaccgtccacccgaatcgactccctccgccccgccaaacccgccgataaaaaaaaaaacgacgaacgaatcaaaatataacgaaaaaaacaaaaaccgaccgaacgaaaaacgaacgcgacgcgatacccaaacgacgacccaacgaccgaataaaaaccgaataactctataaataccgataacgatatacgaacctaacgcgcaaaaaacgtataaacgacgaatacaaaccgaaaccgcaaaacgcatccttacgccgacccgacgaccctaccccgacctcttcgacttaataccgaccgaaccgcgaaaaaaaacccgcgaataactaacacttaaccgatacgtaaatcctaccgcgacccgaactcccaacacgtaaaaaacgacgaaaaaaaaaaaaaacgacgactcgaacgaacctaaaaaaacgcgaaacgaatctacgaaaaatttaaaacgaaaaaaaaaactcctaaaccgaaataaaaaccctaaaaaaaaaaaacaaatccgcgaaaaaaactaattaaaacgcgctaaataaataaataaaaataa

SEQ ID NO: 16345 - DNA, 603 bp, Artificial Sequence
  chemically treated genomic DNA (Homo sapiens) CpG-island No: 16345
gggcggcgggcgagggcggtaggagagggcgacgggtagtttcgcgtcgagaaagtttcgagtatttgagggttttgtttgttggttttttttgcggcggttggattgaggagcggatggttgaggagttagagaggcggcggttacggtagttgtattcggttcggtttcgggcgtttttttcgttttttcgtttttgtagacggtttataaaaaaattttgttttgtattcggaattttcgtttttatacggattcgagcgtgataaggttttgtcgtttcgtttattaggttcggtacgtttttttattggttaggatttttttacgatagtttcggcgtttcgtttagttacgtttattattggatggagtttcggaggggcgggaagggggcggggtcgcggttttaatagataggggcggggtttttttttttcggagtcgggcgtgggtcggggggtcgtggtcgggtgtagcggcgggcgaattgggggcgcgggtcgcgtgtagcgggagggggaggggttggtcgggttttttcgggtgtggcggagttttggtttgcggattatcgtaatttttagtatatttgcgggggtt

SEQ ID NO: 16346 - DNA, 603 bp, Artificial Sequence
  chemically treated genomic DNA (Homo sapiens) CpG-island No: 16346
aacccccgcaaatatactaaaaattacgataatccgcaaaccaaaactccgccacacccgaaaaaacccgaccaacccctccccctcccgctacacgcgacccgcgcccccaattcgcccgccgctacacccgaccacgaccccccgacccacgcccgactccgaaaaaaaaaaaccccgcccctatctattaaaaccgcgaccccgcccccttcccgcccctccgaaactccatccaataataaacgtaactaaacgaaacgccgaaactatcgtaaaaaaatcctaaccaataaaaaaacgtaccgaacctaataaacgaaacgacaaaaccttatcacgctcgaatccgtataaaaacgaaaattccgaatacaaaacaaaatttttttataaaccgtctacaaaaacgaaaaaacgaaaaaaacgcccgaaaccgaaccgaatacaactaccgtaaccgccgcctctctaactcctcaaccatccgctcctcaatccaaccgccgcaaaaaaaaccaacaaacaaaaccctcaaatactcgaaactttctcgacgcgaaactacccgtcgccctctcctaccgccctcgcccgccgccc

SEQ ID NO: 16347 - DNA, 603 bp, Artificial Sequence
  chemically treated genomic DNA (Homo sapiens) CpG-island No: 16347
ggttttcgtaggtgtgttgggagttgcgatggttcgtaggttaggatttcgttatattcgaggggattcggttagtttttttttttttcgttgtacgcggttcgcgtttttaattcgttcgtcgttgtattcggttacggtttttcggtttacgttcggtttcgggaggaaaaggtttcgtttttatttgttggagtcgcgatttcgtttttttttcgttttttcgaggttttatttaatagtgagcgtggttgggcgggacgtcgaggttgtcgtgagggggttttgattaatggggaagcgtgtcgggtttggtgggcggggcggtaaggttttgttacgttcgggttcgtgtgaaaacgggggtttcgagtgtaaagtaaagtttttttgtaaatcgtttgtaaaggcgggggggcgaagaaggcgttcgagatcgggtcgagtgtagttgtcgtggtcgtcgtttttttagttttttagttattcgttttttagtttagtcgtcgtagaggagattagtaagtagagtttttagatgttcggagttttttcggcgcgaagttgttcgtcgtttttttttgtcgttttcgttcgtcgttt

SEQ ID NO: 16348 - DNA, 603 bp, Artificial Sequence
  chemically treated genomic DNA (Homo sapiens) CpG-island No: 16348
aaacgacgaacgaaaacgacaaaaaaaaacgacgaacaacttcgcgccgaaaaaactccgaacatctaaaaactctacttactaatctcctctacgacgactaaactaaaaaacgaataactaaaaaactaaaaaaacgacgaccacgacaactacactcgacccgatctcgaacgccttcttcgcccccccgcctttacaaacgatttacaaaaaaactttactttacactcgaaacccccgttttcacacgaacccgaacgtaacaaaaccttaccgccccgcccaccaaacccgacacgcttccccattaatcaaaaccccctcacgacaacctcgacgtcccgcccaaccacgctcactattaaataaaacctcgaaaaaacgaaaaaaaaacgaaatcgcgactccaacaaataaaaacgaaaccttttcctcccgaaaccgaacgtaaaccgaaaaaccgtaaccgaatacaacgacgaacgaattaaaaacgcgaaccgcgtacaacgaaaaaaaaaaaaactaaccgaatcccctcgaatataacgaaatcctaacctacgaaccatcgcaactcccaacacacctacgaaaacc

SEQ ID NO: 16349 - DNA, 615 bp, Artificial Sequence
  chemically treated genomic DNA (Homo sapiens) CpG-island No: 16349
agcgtatagggcgggacgggagtaggtatgaagagatggagatatgggcgacgattcgcggaattaacggtgtgtaagtttaggtgatatacgttcggttacggtagagaggtggatgggcgaacgatacgcgagatgatgttcgcgggattgaatagtaatattaggcgtcgtatgtgggatcgacgtgatgcggtataggtcgcgagcggtggcgagtagttgtgaataggaggatgggtacgtgggattaaggacgggagagaagagattggttatgaaagacgtgggggtatcggagtttgcgggcgggtggggagtgattggttgtgcggttttgcggcggcgacgcgggggatagaagaacgtgaaaataaagagaatcgcggacgtcgacgggcgtggtagtgaagaacgtgcgcgaggtggtaaaatcgggatatgggggttttgcgagagagtgggagatacgataaagagatagatgttagatggtggggaggattggaagggatgttcgttgcgcgagcgtcgggcgggtgtgtcgtgcgcgtgttttatatattatatatatatattatatatgttatatatatatattatatttattagttt

SEQ ID NO: 16350 - DNA, 615 bp, Artificial Sequence
  chemically treated genomic DNA (Homo sapiens) CpG-island No: 16350
aaactaataaatataatatatatatataacatatataatatatatatataatatataaaacacgcgcacgacacacccgcccgacgctcgcgcaacgaacatcccttccaatcctccccaccatctaacatctatctctttatcgtatctcccactctctcgcaaaacccccatatcccgattttaccacctcgcgcacgttcttcactaccacgcccgtcgacgtccgcgattctctttattttcacgttcttctatcccccgcgtcgccgccgcaaaaccgcacaaccaatcactccccacccgcccgcaaactccgatacccccacgtctttcataaccaatctcttctctcccgtccttaatcccacgtacccatcctcctattcacaactactcgccaccgctcgcgacctataccgcatcacgtcgatcccacatacgacgcctaatattactattcaatcccgcgaacatcatctcgcgtatcgttcgcccatccacctctctaccgtaaccgaacgtatatcacctaaacttacacaccgttaattccgcgaatcgtcgcccatatctccatctcttcatacctactcccgtcccgccctatacgct

SEQ ID NO: 16351 - DNA, 615 bp, Artificial Sequence
  chemically treated genomic DNA (Homo sapiens) CpG-island No: 16351
aaattggtaggtgtggtatgtgtgtgtggtatgtgtggtatgtgtgtgtggtgtgtgaagtacgcgtacggtatattcgttcggcgttcgcgtagcgagtattttttttagttttttttattatttgatatttatttttttatcgtgttttttattttttcgtaaggtttttatatttcggttttattatttcgcgtacgttttttattattacgttcgtcggcgttcgcggttttttttatttttacgtttttttatttttcgcgtcgtcgtcgtagggtcgtataattaattattttttattcgttcgtaaatttcgatatttttacgttttttatagttaattttttttttttcgtttttgattttacgtatttatttttttgtttatagttattcgttatcgttcgcgatttatatcgtattacgtcggttttatatacggcgtttagtgttattgtttaatttcgcggatattatttcgcgtatcgttcgtttatttatttttttatcgtgatcgagcgtgtgttatttaagtttatatatcgttagtttcgcgggtcgtcgtttatgtttttatttttttatatttgttttcgtttcgttttatacgtt

SEQ ID NO: 16352 - DNA, 615 bp, Artificial Sequence
  chemically treated genomic DNA (Homo sapiens) CpG-island No: 16352
aacgtataaaacgaaacgaaaacaaatataaaaaaataaaaacataaacgacgacccgcgaaactaacgatatataaacttaaataacacacgctcgatcacgataaaaaaataaataaacgaacgatacgcgaaataatatccgcgaaattaaacaataacactaaacgccgtatataaaaccgacgtaatacgatataaatcgcgaacgataacgaataactataaacaaaaaaataaatacgtaaaatcaaaaacgaaaaaaaaaaaattaactataaaaaacgtaaaaatatcgaaatttacgaacgaataaaaaataattaattatacgaccctacgacgacgacgcgaaaaataaaaaaacgtaaaaataaaaaaaaccgcgaacgccgacgaacgtaataataaaaaacgtacgcgaaataataaaaccgaaatataaaaaccttacgaaaaaataaaaaacacgataaaaaaataaatatcaaataataaaaaaaactaaaaaaaatactcgctacgcgaacgccgaacgaatataccgtacgcgtacttcacacaccacacacacataccacacataccacacacacataccacacctaccaattt

SEQ ID NO: 16353 - DNA, 613 bp, Artificial Sequence
  chemically treated genomic DNA (Homo sapiens) CpG-island No: 16353
ggggcgtgcggtacgggaggcgtgggcggcggcgcgcggatgcgcgttttggtgcggagcgcgcgttgcgggggagggcggcggggagcgtcggtatgacggtcgggggttgcgttcgcgtcggatagtggttggggtcgtgcgggcgcgtgtagcgggtggcgtgacgcggtgcgcgcggggggtgcgcgggtcggggcgtgcggttatcgtcgtttagtgtcgtgagggcgttcgggaagtcgatcggtattggggtcgtgtggtgttttggtgttcgcgtcgagaatcgtgtagtggatgcgcggcgggaggttgaggtcgcgcggtttagttacgggtgggcggaggtcgaatcgtgcgagaggcgttttacgcgggtggataggcgcgtaaggagggcgcggcgcgcgggttagcgaattatatcgcgatacgggcggggtcgcgcgcggggaaggcgttggtattgatgacgggcggcggtagggaagcgggtggtaggtcgggggtggagggcgagtgatagggggcgagtagtgtgcggttttcggatggcgatatacgtattgttgggtaattgagtgacgatgagggttaggtcggcgagtat

SEQ ID NO: 16354 - DNA, 613 bp, Artificial Sequence
  chemically treated genomic DNA (Homo sapiens) CpG-island No: 16354
atactcgccgacctaaccctcatcgtcactcaattacccaacaatacgtatatcgccatccgaaaaccgcacactactcgccccctatcactcgccctccacccccgacctaccacccgcttccctaccgccgcccgtcatcaataccaacgccttccccgcgcgcgaccccgcccgtatcgcgatataattcgctaacccgcgcgccgcgccctccttacgcgcctatccacccgcgtaaaacgcctctcgcacgattcgacctccgcccacccgtaactaaaccgcgcgacctcaacctcccgccgcgcatccactacacgattctcgacgcgaacaccaaaacaccacacgaccccaataccgatcgacttcccgaacgccctcacgacactaaacgacgataaccgcacgccccgacccgcgcaccccccgcgcgcaccgcgtcacgccacccgctacacgcgcccgcacgaccccaaccactatccgacgcgaacgcaacccccgaccgtcataccgacgctccccgccgccctcccccgcaacgcgcgctccgcaccaaaacgcgcatccgcgcgccgccgcccacgcctcccgtaccgcacgcccc

SEQ ID NO: 16355 - DNA, 613 bp, Artificial Sequence
  chemically treated genomic DNA (Homo sapiens) CpG-island No: 16355
atattcgtcggtttggtttttatcgttatttagttgtttagtaatacgtatatcgttattcggaaatcgtatattattcgttttttgttattcgttttttattttcggtttgttattcgtttttttatcgtcgttcgttattagtgttagcgtttttttcgcgcgcgatttcgttcgtgtcgcgatatagttcgttgattcgcgcgtcgcgttttttttacgcgtttatttattcgcgtggggcgtttttcgtacgattcggttttcgtttattcgtaattgagtcgcgcggttttaatttttcgtcgcgtatttattatacgattttcggcgcgaatattagggtattatacgattttaatgtcgatcggtttttcggacgtttttacggtattaagcggcggtggtcgtacgtttcggttcgcgtatttttcgcgcgtatcgcgttacgttattcgttgtacgcgttcgtacggttttaattattattcgacgcgaacgtagttttcgatcgttatgtcgacgtttttcgtcgttttttttcgtagcgcgcgtttcgtattaaagcgcgtattcgcgcgtcgtcgtttacgtttttcgtgtcgtacgtttt

SEQ ID NO: 16356 - DNA, 613 bp, Artificial Sequence
  chemically treated genomic DNA (Homo sapiens) CpG-island No: 16356
aaaacgtacgacacgaaaaacgtaaacgacgacgcgcgaatacgcgctttaatacgaaacgcgcgctacgaaaaaaaacgacgaaaaacgtcgacataacgatcgaaaactacgttcgcgtcgaataataattaaaaccgtacgaacgcgtacaacgaataacgtaacgcgatacgcgcgaaaaatacgcgaaccgaaacgtacgaccaccgccgcttaataccgtaaaaacgtccgaaaaaccgatcgacattaaaatcgtataataccctaatattcgcgccgaaaatcgtataataaatacgcgacgaaaaattaaaaccgcgcgactcaattacgaataaacgaaaaccgaatcgtacgaaaaacgccccacgcgaataaataaacgcgtaaaaaaaacgcgacgcgcgaatcaacgaactatatcgcgacacgaacgaaatcgcgcgcgaaaaaaacgctaacactaataacgaacgacgataaaaaaacgaataacaaaccgaaaataaaaaacgaataacaaaaaacgaataatatacgatttccgaataacgatatacgtattactaaacaactaaataacgataaaaaccaaaccgacgaatat

SEQ ID NO: 16357 - DNA, 756 bp, Artificial Sequence
  chemically treated genomic DNA (Homo sapiens) CpG-island No: 16357
ggtcgtttgttagggtcgggaaaggattttttatcgttattttcggggttcggtttttttttattaacgtttgttagttcgcgtggatttcgagttcggtttcggaaattagtttgattatttcgtttattttttaagttttttcgggcggcggtcggttagtttttatggtgcggtgagttaggttcggtcgtcgtttcggtcgttttgcgatgaatggttttgtttagaaggtcggcgtttaagcgacgttttcgttcgcgcgttcggggtttttaggtcgtttttcgtttcgtgtttttatattgcgaaacggacggtcggatgtttcgttttagggtcggggtcgtttgttttttgtcgatttggcgtagagtcgttttttgtattcggtttcgtgtcgttttggggttgtttatagtcgggttgtgttatcgagttgagttcggaatcgaatggcgggtcgcggaaaaggcggttaggttcgtaggggcgattgttcgaggttttagaatagcgttcggggagttttaggtcggtttcgaggggatcgcgggcgggataggaggggaatagttggtatcggcgttcggttttagttgttcgattgcggtgggcgggtaggtacgttttttcgtagttattcgcgtacgggtttttaaggcgttaagggtaatttatttggtcgttgtaagaaagcgattgcgtttttacgtttagttagtcgttttgtttatgagaattatttggagggta

SEQ ID NO: 16358 - DNA, 756 bp, Artificial Sequence
  chemically treated genomic DNA (Homo sapiens) CpG-island No: 16358
taccctccaaataattctcataaacaaaacgactaactaaacgtaaaaacgcaatcgctttcttacaacgaccaaataaattacccttaacgccttaaaaacccgtacgcgaataactacgaaaaaacgtacctacccgcccaccgcaatcgaacaactaaaaccgaacgccgataccaactattcccctcctatcccgcccgcgatcccctcgaaaccgacctaaaactccccgaacgctattctaaaacctcgaacaatcgcccctacgaacctaaccgccttttccgcgacccgccattcgattccgaactcaactcgataacacaacccgactataaacaaccccaaaacgacacgaaaccgaatacaaaaaacgactctacgccaaatcgacaaaaaacaaacgaccccgaccctaaaacgaaacatccgaccgtccgtttcgcaatataaaaacacgaaacgaaaaacgacctaaaaaccccgaacgcgcgaacgaaaacgtcgcttaaacgccgaccttctaaacaaaaccattcatcgcaaaacgaccgaaacgacgaccgaacctaactcaccgcaccataaaaactaaccgaccgccgcccgaaaaaacttaaaaaataaacgaaataatcaaactaatttccgaaaccgaactcgaaatccacgcgaactaacaaacgttaataaaaaaaaaccgaaccccgaaaataacgataaaaaatcctttcccgaccctaacaaacgacc

SEQ ID NO: 16359 - DNA, 756 bp, Artificial Sequence
  chemically treated genomic DNA (Homo sapiens) CpG-island No: 16359
tgttttttaggtggtttttatggataaggcggttggttggacgtgggggcgtagtcgtttttttgtagcgattaggtgaattgtttttgacgttttggaaattcgtgcgcgggtggttgcgggggaacgtgtttattcgtttatcgtagtcgggtagttgaagtcgggcgtcgatgttagttgttttttttttgtttcgttcgcggttttttcgaggtcggtttggggtttttcgggcgttgttttgggatttcgagtagtcgtttttgcgggtttggtcgtttttttcgcggttcgttattcgatttcgggtttagttcggtggtatagttcggttgtaagtaattttagggcggtacggggtcgggtgtagaaggcggttttgcgttaggtcggtaggggataggcgatttcggttttggagcggagtattcgatcgttcgtttcgtaatgtggggatacggggcggggagcggtttggaggtttcgggcgcgcgggcgggagcgtcgtttggacgtcggttttttgggtagagttatttatcgtagggcggtcgaggcggcggtcgagtttggtttatcgtattatggaagttggtcggtcgtcgttcggggaggtttgggaaatgggcgaagtggttagattggttttcggagtcgggttcggaatttacgcggattggtagacgttggtgggggaggatcgaatttcgagggtggcggtggagggttttttttcgattttagtaggcgatt

SEQ ID NO: 16360 - DNA, 756 bp, Artificial Sequence
  chemically treated genomic DNA (Homo sapiens) CpG-island No: 16360
aatcgcctactaaaatcgaaaaaaaaccctccaccgccaccctcgaaattcgatcctcccccaccaacgtctaccaatccgcgtaaattccgaacccgactccgaaaaccaatctaaccacttcgcccatttcccaaacctccccgaacgacgaccgaccaacttccataatacgataaaccaaactcgaccgccgcctcgaccgccctacgataaataactctacccaaaaaaccgacgtccaaacgacgctcccgcccgcgcgcccgaaacctccaaaccgctccccgccccgtatccccacattacgaaacgaacgatcgaatactccgctccaaaaccgaaatcgcctatcccctaccgacctaacgcaaaaccgccttctacacccgaccccgtaccgccctaaaattacttacaaccgaactataccaccgaactaaacccgaaatcgaataacgaaccgcgaaaaaaacgaccaaacccgcaaaaacgactactcgaaatcccaaaacaacgcccgaaaaaccccaaaccgacctcgaaaaaaccgcgaacgaaacaaaaaaaaaacaactaacatcgacgcccgacttcaactacccgactacgataaacgaataaacacgttcccccgcaaccacccgcgcacgaatttccaaaacgtcaaaaacaattcacctaatcgctacaaaaaaacgactacgcccccacgtccaaccaaccgccttatccataaaaaccacctaaaaaaca

SEQ ID NO: 16361 - DNA, 1001 bp, Artificial Sequence
  chemically treated genomic DNA (Homo sapiens) CpG-island No: 16361
tcggcgtttagttgtcgtttcggtcgaagcgttttcgtcgtcgtcgtcgttcgtttcgtatagttcggtcggttcgtcgttgttcgcgttcgtttcggttttcggttcgcgttcgtttagataattgagttcgggtcgcggttgtataagaatttatgtaaatttcggacgttagcgggcggggtttcgtcgggtttagttcggcgttagggggcgggtcgcggcgcggattggcgtagtcgggtttatcggaggtttcgggtttgggcggcggggggaggaggaaagggcgcgggtgggggacgcggaggggagggcgtcggggaggtgtagggggagggatcggcgagtttgggagagggaggttgtagagagggagcgggatcgggaaggagaggtgtgttcgtcggggcggaggcgggcggagagtttgatagttcggaagggtttcggcggcgatttttcgtttatatttcggtgttcgggtttttttttcgcggtacgtttttagtgtttacggtttcgggatttttgttgggggttacggaagtattcgtcgtcgtttttagttgtatcgaattgcgttattagcgtttcgggacgcgcgggtttcgtcggtagggggcggaatggggtaggggtagttcgcgttttattgcgggtttcgtttcgtttttaggtttcgggtattttggagcgcgaggagggaaagggatagggcggagagaaggtcgaggattgggtgttaaggagagattgaagaacgtacgaggaaggggatcgaggagtagttaatttcggggttttggcgtttaagaatttcggtagaaagggttttaaattcgattttatttcgatttttaatggtttcgaatttatatttggtttttttattgacggggcgagatgttttgtttttagtagtttttagagttaagttaggcgagaggcgtaggaggtagagagagcgggcgcgggaggttagggttcgtttgggggtt

SEQ ID NO: 16362 - DNA, 1001 bp, Artificial Sequence
  chemically treated genomic DNA (Homo sapiens) CpG-island No: 16362
aacccccaaacgaaccctaacctcccgcgcccgctctctctacctcctacgcctctcgcctaacttaactctaaaaactactaaaaacaaaacatctcgccccgtcaataaaaaaaccaaatataaattcgaaaccattaaaaatcgaaataaaatcgaatttaaaaccctttctaccgaaattcttaaacgccaaaaccccgaaattaactactcctcgatccccttcctcgtacgttcttcaatctctccttaacacccaatcctcgaccttctctccgccctatccctttccctcctcgcgctccaaaatacccgaaacctaaaaacgaaacgaaacccgcaataaaacgcgaactacccctaccccattccgccccctaccgacgaaacccgcgcgtcccgaaacgctaataacgcaattcgatacaactaaaaacgacgacgaatacttccgtaacccccaacaaaaatcccgaaaccgtaaacactaaaaacgtaccgcgaaaaaaaaacccgaacaccgaaatataaacgaaaaatcgccgccgaaacccttccgaactatcaaactctccgcccgcctccgccccgacgaacacacctctccttcccgatcccgctccctctctacaacctccctctcccaaactcgccgatccctccccctacacctccccgacgccctcccctccgcgtcccccacccgcgccctttcctcctccccccgccgcccaaacccgaaacctccgataaacccgactacgccaatccgcgccgcgacccgccccctaacgccgaactaaacccgacgaaaccccgcccgctaacgtccgaaatttacataaattcttatacaaccgcgacccgaactcaattatctaaacgaacgcgaaccgaaaaccgaaacgaacgcgaacaacgacgaaccgaccgaactatacgaaacgaacgacgacgacgacgaaaacgcttcgaccgaaacgacaactaaacgccga

SEQ ID NO: 16363 - DNA, 1001 bp, Artificial Sequence
  chemically treated genomic DNA (Homo sapiens) CpG-island No: 16363
ggtttttaagcggattttggtttttcgcgttcgttttttttgttttttacgtttttcgtttagtttggttttggaggttgttagaaataggatatttcgtttcgttaataagaggattaagtgtaaattcggagttattgaggatcggggtgggatcggatttggagttttttttgtcgaggtttttgggcgttagggtttcgggattggttgtttttcggttttttttttcgtgcgttttttaatttttttttggtatttagttttcggtttttttttcgttttgttttttttttttttcgcgttttaaaatgttcggagtttggaggcgaggcggggttcgtagtggggcgcgagttgtttttgttttatttcgttttttgtcggcggggttcgcgcgtttcggggcgttggtgacgtaattcggtgtaattgggagcggcggcggatgttttcgtggtttttagtaggggtttcggggtcgtgaatattgagaacgtgtcgcgagggggaggttcgggtatcgggatgtgggcgaggggtcgtcgtcgagattttttcgggttgttaagtttttcgttcgttttcgtttcggcggatatatttttttttttcggtttcgttttttttttgtagttttttttttttaggttcgtcgatttttttttttgtattttttcggcgttttttttttcgcgttttttattcgcgtttttttttttttttttcgtcgtttaggttcggggttttcggtaggttcggttgcgttaattcgcgtcgcggttcgttttttgacgtcgagttgggttcggcgaggtttcgttcgttgacgttcgggatttgtatgagtttttgtgtagtcgcggttcgggtttagttgtttgagcgagcgcgagtcgggagtcggggcgggcgcgggtagcggcgggtcggtcgggttgtgcggggcgagcggcggcggcggcgggggcgtttcggtcggggcggtagttgggcgtcgg

SEQ ID NO: 16364 - DNA, 1001 bp, Artificial Sequence
  chemically treated genomic DNA (Homo sapiens) CpG-island No: 16364
ccgacgcccaactaccgccccgaccgaaacgcccccgccgccgccgccgctcgccccgcacaacccgaccgacccgccgctacccgcgcccgccccgactcccgactcgcgctcgctcaaacaactaaacccgaaccgcgactacacaaaaactcatacaaatcccgaacgtcaacgaacgaaacctcgccgaacccaactcgacgtcaaaaaacgaaccgcgacgcgaattaacgcaaccgaacctaccgaaaaccccgaacctaaacgacgaaaaaaaaaaaaaaaaacgcgaataaaaaacgcgaaaaaaaaaacgccgaaaaaatacaaaaaaaaaaatcgacgaacctaaaaaaaaaaaactacaaaaaaaaaacgaaaccgaaaaaaaaaaatatatccgccgaaacgaaaacgaacgaaaaacttaacaacccgaaaaaatctcgacgacgacccctcgcccacatcccgatacccgaacctccccctcgcgacacgttctcaatattcacgaccccgaaacccctactaaaaaccacgaaaacatccgccgccgctcccaattacaccgaattacgtcaccaacgccccgaaacgcgcgaaccccgccgacaaaaaacgaaataaaacaaaaacaactcgcgccccactacgaaccccgcctcgcctccaaactccgaacattttaaaacgcgaaaaaaaaaaaaaacaaaacgaaaaaaaaaccgaaaactaaataccaaaaaaaaattaaaaaacgcacgaaaaaaaaaaccgaaaaacaaccaatcccgaaaccctaacgcccaaaaacctcgacaaaaaaaactccaaatccgatcccaccccgatcctcaataactccgaatttacacttaatcctcttattaacgaaacgaaatatcctatttctaacaacctccaaaaccaaactaaacgaaaaacgtaaaaaacaaaaaaaacgaacgcgaaaaaccaaaatccgcttaaaaacc

SEQ ID NO: 16365 - DNA, 643 bp, Artificial Sequence
  chemically treated genomic DNA (Homo sapiens) CpG-island No: 16365
tggtcggcgaagttttcgacgttttcgagttttattttagcgggtcgcgcggtattgtagtcgggggtttttgcggattggttcgatagggtgcgcggacggggacgcgggtttcgagtatcgcgacgttagggttttttggtagggtttaagtatttttcggggttatatcgtcgttcgtagggtcgcgttttcgtattgcggtacgttggggtcgtaggcgtcgaagcgggacgcgttgttttttacgacgttcgttttttttaacgttagggtagttattttaggttcgttcggagaagtttattcggttttcggtttttatttagtcgcgaggtttcgtcggtttggagatttgcgttttcgggatttatattttaaatatgatttttggaacggtttttatcgttcgtcgtcgtcgtcgtcgcgtttataacggtttcggcgtattgtgtttttatttgggtttcgtttgtttaaggtcgtttcgcggttttttcgtgtttttgaggtttatttttttacgttagtttttgcgtttttttttcgggtgttttcgtcgcgtttttaaatttagcggggtttattcgtagggtagatttttttttttttttttttaattaagagttgttgtagtaaggta

SEQ ID NO: 16366 - DNA, 643 bp, Artificial Sequence
  chemically treated genomic DNA (Homo sapiens) CpG-island No: 16366
taccttactacaacaactcttaattaaaaaaaaaaaaaaaaaaatctaccctacgaataaaccccgctaaatttaaaaacgcgacgaaaacacccgaaaaaaaaacgcaaaaactaacgtaaaaaaataaacctcaaaaacacgaaaaaaccgcgaaacgaccttaaacaaacgaaacccaaataaaaacacaatacgccgaaaccgttataaacgcgacgacgacgacgacgaacgataaaaaccgttccaaaaatcatatttaaaatataaatcccgaaaacgcaaatctccaaaccgacgaaacctcgcgactaaataaaaaccgaaaaccgaataaacttctccgaacgaacctaaaataactaccctaacgttaaaaaaaacgaacgtcgtaaaaaacaacgcgtcccgcttcgacgcctacgaccccaacgtaccgcaatacgaaaacgcgaccctacgaacgacgatataaccccgaaaaatacttaaaccctaccaaaaaaccctaacgtcgcgatactcgaaacccgcgtccccgtccgcgcaccctatcgaaccaatccgcaaaaacccccgactacaataccgcgcgacccgctaaaataaaactcgaaaacgtcgaaaacttcgccgacca

SEQ ID NO: 16367 - DNA, 643 bp, Artificial Sequence
  chemically treated genomic DNA (Homo sapiens) CpG-island No: 16367
tgttttgttgtagtagtttttggttggaaaaaggaagaaagaaatttgttttgcgagtgggtttcgttgggtttgggggcgcgacggggatattcgagaggaaaacgtaggggttggcgtgaaggggtgaattttaggggtacgggagagtcgcggggcgattttgagtaaacgaaatttaaataaaaatatagtgcgtcgaggtcgttgtgagcgcggcggcggcggcggcgggcggtggaagtcgttttaaagattatatttgaaatatggatttcgggggcgtagatttttaggtcggcggggtttcgcgattgagtgggggtcgggggtcgggtgggttttttcgggcgggtttgaggtggttgttttgacgttgggagggacggacgtcgtagaaaatagcgcgtttcgtttcggcgtttgcgattttagcgtgtcgtaatgcggaggcgcggttttgcgggcggcggtgtggtttcgaggggtgtttgggttttgttaaaggattttggcgtcgcggtgttcggggttcgcgttttcgttcgcgtattttgtcgggttagttcgtaggaattttcggttgtagtgtcgcgcggttcgttagggtgggattcgggggcgtcggaggtttcgtcgatta

SEQ ID NO: 16368 - DNA, 643 bp, Artificial Sequence
  chemically treated genomic DNA (Homo sapiens) CpG-island No: 16368
taatcgacgaaacctccgacgcccccgaatcccaccctaacgaaccgcgcgacactacaaccgaaaattcctacgaactaacccgacaaaatacgcgaacgaaaacgcgaaccccgaacaccgcgacgccaaaatcctttaacaaaacccaaacacccctcgaaaccacaccgccgcccgcaaaaccgcgcctccgcattacgacacgctaaaatcgcaaacgccgaaacgaaacgcgctattttctacgacgtccgtccctcccaacgtcaaaacaaccacctcaaacccgcccgaaaaaacccacccgacccccgacccccactcaatcgcgaaaccccgccgacctaaaaatctacgcccccgaaatccatatttcaaatataatctttaaaacgacttccaccgcccgccgccgccgccgccgcgctcacaacgacctcgacgcactatatttttatttaaatttcgtttactcaaaatcgccccgcgactctcccgtacccctaaaattcaccccttcacgccaacccctacgttttcctctcgaatatccccgtcgcgcccccaaacccaacgaaacccactcgcaaaacaaatttctttcttcctttttccaaccaaaaactactacaacaaaaca

SEQ ID NO: 16369 - DNA, 536 bp, Artificial Sequence
  chemically treated genomic DNA (Homo sapiens) CpG-island No: 16369
ttcgaagtggtcgttagtcgaagcgtaattgtttttttttaattcgtttttttgcgtttttttttttcggttattttttttttagtttttagtttcgcggcgcgtcgagggttaagcgcgcgcgcgaggtgggggtatttggtttgggaggggggcgagaaaagggggcgtcgagcgtcgttggcggagaagttgggttcgttttagttttttttttttaatttcggagtcgaggggcggttcgatcggaagggttcggcgcgttttcgttttttcggttggtttgtagtttggtttggtcgcggttcggaatcgcgaggacgttgtttggaggtcgcgttttgcgtagttcgagagggggagggggcggaggtttcggagtcgcggtcgcgcgtcgttcgttagtcgatcgatttttaaaggcgggagcgcggtgaatttcgtcggatatttggggggtttcgatgtttttgtaggattgaggggcgaacggagaggggtttagggattttgtggtcgtgggatggcggtcggta

SEQ ID NO: 16370 - DNA, 536 bp, Artificial Sequence
  chemically treated genomic DNA (Homo sapiens) CpG-island No: 16370
taccgaccgccatcccacgaccacaaaatccctaaacccctctccgttcgcccctcaatcctacaaaaacatcgaaaccccccaaatatccgacgaaattcaccgcgctcccgcctttaaaaatcgatcgactaacgaacgacgcgcgaccgcgactccgaaacctccgccccctccccctctcgaactacgcaaaacgcgacctccaaacaacgtcctcgcgattccgaaccgcgaccaaaccaaactacaaaccaaccgaaaaaacgaaaacgcgccgaacccttccgatcgaaccgcccctcgactccgaaattaaaaaaaaaaaactaaaacgaacccaacttctccgccaacgacgctcgacgcccccttttctcgcccccctcccaaaccaaatacccccacctcgcgcgcgcgcttaaccctcgacgcgccgcgaaactaaaaactaaaaaaaaaataaccgaaaaaaaaaaacgcaaaaaaacgaattaaaaaaaaacaattacgcttcgactaacgaccacttcgaa

SEQ ID NO: 16371 - DNA, 536 bp, Artificial Sequence
  chemically treated genomic DNA (Homo sapiens) CpG-island No: 16371
tgtcggtcgttattttacggttataggatttttgagttttttttcgttcgttttttagttttgtagaggtatcgggattttttaggtgttcggcggggtttatcgcgttttcgtttttggggatcgatcggttggcgggcgacgcgcggtcgcggtttcggagttttcgttttttttttttttcgggttacgtaggacgcggtttttaagtagcgttttcgcggtttcgggtcgcggttaggttaggttgtaggttagtcggggaggcggagacgcgtcgggttttttcgatcgggtcgtttttcggtttcggggttggggagagggaattagagcgagtttagttttttcgttagcggcgttcggcgtttttttttttcgttttttttttaagttaaatatttttatttcgcgcgcgcgtttaattttcggcgcgtcgcgaggttgggagttgggaggggagtagtcgagggggaggggcgtaggggagcgagttggaggggggtagttgcgtttcggttgacgattatttcggg

SEQ ID NO: 16372 - DNA, 536 bp, Artificial Sequence
  chemically treated genomic DNA (Homo sapiens) CpG-island No: 16372
cccgaaataatcgtcaaccgaaacgcaactacccccctccaactcgctcccctacgcccctccccctcgactactcccctcccaactcccaacctcgcgacgcgccgaaaattaaacgcgcgcgcgaaataaaaatatttaacttaaaaaaaaaacgaaaaaaaaaaacgccgaacgccgctaacgaaaaaactaaactcgctctaattccctctccccaaccccgaaaccgaaaaacgacccgatcgaaaaaacccgacgcgtctccgcctccccgactaacctacaacctaacctaaccgcgacccgaaaccgcgaaaacgctacttaaaaaccgcgtcctacgtaacccgaaaaaaaaaaaaaacgaaaactccgaaaccgcgaccgcgcgtcgcccgccaaccgatcgatccccaaaaacgaaaacgcgataaaccccgccgaacacctaaaaaatcccgatacctctacaaaactaaaaaacgaacgaaaaaaaactcaaaaatcctataaccgtaaaataacgaccgaca

SEQ ID NO: 16373 - DNA, 733 bp, Artificial Sequence
  chemically treated genomic DNA (Homo sapiens) CpG-island No: 16373
cggcggcggcgagtggtatttttcgagcgttgtagttggtcgggtagttattgcgtcggttatatttggttcgggttgaacggtcgtcgcggtttttttttcgtcggttttcggggttcgcgcgtcgtagttcgttcggcggcgcgtttatcgatcgtcggggtcgcggtcgggcgagcggagaataaggtatagtttgtatttaggtttttgtttttatatggcgatgtgcgcgagcgttcgtcgagcggtcgtattatataagggtacgcggcgggcgtcgggttgagttggtgcgcgtttattggttcgcgcgtttttcggtaatcggtttttacgagtggaaattagttagtcgttttcgttcgtttttcgtttttttttttttttttttttcgggtattttcgtttttcgttttcgtatttttttcgttgtttaatttttttttttgtttgtattttttttttaattttttttttcgcggttttttttttttttttgtttcgttgttatttttttttcgtggtcgtttggtttgttttttttcgtttcgcgtacgtttttatttttattttacgtattttttttttaaattcggcgagtaacggcggaggagcgggaaggttcggatgcgggaggggagtttgtgtgcgtgtgtgtttgtgcgtgtgtgtgtgtgtgcgtgtgtgtgtgtgtgtgagagtgtgtcgttgacgtaaaaaacgatgaatt

SEQ ID NO: 16374 - DNA, 733 bp, Artificial Sequence
  chemically treated genomic DNA (Homo sapiens) CpG-island No: 16374
aattcatcgttttttacgtcaacgacacactctcacacacacacacacacgcacacacacacacacgcacaaacacacacgcacacaaactcccctcccgcatccgaaccttcccgctcctccgccgttactcgccgaatttaaaaaaaaaatacgtaaaataaaaataaaaacgtacgcgaaacgaaaaaaaacaaaccaaacgaccacgaaaaaaaaataacaacgaaacaaaaaaaaaaaaaaaaccgcgaaaaaaaaaattaaaaaaaaaatacaaacaaaaaaaaaaattaaacaacgaaaaaaatacgaaaacgaaaaacgaaaatacccgaaaaaaaaaaaaaaaaaaaaacgaaaaacgaacgaaaacgactaactaatttccactcgtaaaaaccgattaccgaaaaacgcgcgaaccaataaacgcgcaccaactcaacccgacgcccgccgcgtacccttatataatacgaccgctcgacgaacgctcgcgcacatcgccatataaaaacaaaaacctaaatacaaactataccttattctccgctcgcccgaccgcgaccccgacgatcgataaacgcgccgccgaacgaactacgacgcgcgaaccccgaaaaccgacgaaaaaaaaaccgcgacgaccgttcaacccgaaccaaatataaccgacgcaataactacccgaccaactacaacgctcgaaaaataccactcgccgccgccg

SEQ ID NO: 16375 - DNA, 733 bp, Artificial Sequence
  chemically treated genomic DNA (Homo sapiens) CpG-island No: 16375
aatttatcgttttttacgttagcgatatatttttatatatatatatatacgtatatatatatatacgtatagatatatacgtatataagtttttttttcgtattcgggttttttcgttttttcgtcgttgttcgtcgggtttggggagggggtgcgtggggtgggagtgggagcgtgcgcggagcgggagaggataggttaagcggttacgggagaagaatgataacgaggtaaagggaggaggaaggtcgcgggaagaaaaattggggagagggtgtaggtaaaaaggggggttaagtaacgaagggggtgcggaggcgaggagcggagatattcggggagaaagaaagggagggggcggggagcgggcgggggcggttggttggtttttattcgtgagagtcggttgtcgagagacgcgcgggttaatgagcgcgtattagtttagttcggcgttcgtcgcgtgtttttatatggtgcggtcgttcggcgggcgttcgcgtatatcgttatataagggtaggaatttaaatataggttatattttgtttttcgttcgttcggtcgcggtttcggcgatcgatgagcgcgtcgtcgagcgggttgcggcgcgcgggtttcgggagtcggcggggagggggtcgcggcggtcgtttagttcgggttagatgtggtcggcgtaatggttgttcggttagttgtagcgttcggaaggtgttattcgtcgtcgtcg

SEQ ID NO: 16376 - DNA, 733 bp, Artificial Sequence
  chemically treated genomic DNA (Homo sapiens) CpG-island No: 16376
cgacgacgacgaataacaccttccgaacgctacaactaaccgaacaaccattacgccgaccacatctaacccgaactaaacgaccgccgcgaccccctccccgccgactcccgaaacccgcgcgccgcaacccgctcgacgacgcgctcatcgatcgccgaaaccgcgaccgaacgaacgaaaaacaaaatataacctatatttaaattcctacccttatataacgatatacgcgaacgcccgccgaacgaccgcaccatataaaaacacgcgacgaacgccgaactaaactaatacgcgctcattaacccgcgcgtctctcgacaaccgactctcacgaataaaaaccaaccaaccgcccccgcccgctccccgccccctccctttctttctccccgaatatctccgctcctcgcctccgcacccccttcgttacttaacccccctttttacctacaccctctccccaatttttcttcccgcgaccttcctcctccctttacctcgttatcattcttctcccgtaaccgcttaacctatcctctcccgctccgcgcacgctcccactcccaccccacgcaccccctccccaaacccgacgaacaacgacgaaaaaacgaaaaaacccgaatacgaaaaaaaaacttatatacgtatatatctatacgtatatatatatatacgtatatatatatatataaaaatatatcgctaacgtaaaaaacgataaatt

SEQ ID NO: 16377 - DNA, 676 bp, Artificial Sequence
  chemically treated genomic DNA (Homo sapiens) CpG-island No: 16377
  misc_feature (283)..(283): n is either a, c, g or t
  misc_feature (340)..(340): n is either a, c, g or t
  misc_feature (344)..(344): n is either a, c, g or t
  misc_feature (346)..(346): n is either a, c, g or t
  misc_feature (391)..(392): n is either a, c, g or t
  misc_feature (399)..(401): n is either a, c, g or t
  misc_feature (404)..(404): n is either a, c, g or t
  misc_feature (409)..(411): n is either a, c, g or t
  misc_feature (429)..(429): n is either a, c, g or t
  misc_feature (432)..(436): n is either a, c, g or t
  misc_feature (449)..(450): n is either a, c, g or t
  misc_feature (457)..(457): n is either a, c, g or t
  misc_feature (480)..(480): n is either a, c, g or t
  misc_feature (482)..(483): n is either a, c, g or t
  misc_feature (486)..(487): n is either a, c, g or t
  misc_feature (489)..(489): n is either a, c, g or t
  misc_feature (502)..(502): n is either a, c, g or t
  misc_feature (530)..(532): n is either a, c, g or t
  misc_feature (535)..(535): n is either a, c, g or t
  misc_feature (587)..(587): n is either a, c, g or t
  misc_feature (592)..(592): n is either a, c, g or t
  misc_feature (618)..(618): n is either a, c, g or t
  misc_feature (642)..(642): n is either a, c, g or t
  misc_feature (652)..(652): n is either a, c, g or t
atcggagcgtcgcgatttcgcgagggtatcgggtatcggggtgggggtggggatagatcgagcgcgttttttttgcgtagttttcggtcgtttttatttcgtgttttttttgttcgtaggtaatcgtttttttttcgttcgtttcgcggtcgttttcgttcgttttttcgggagggtttttgcgttcggtcgagcgttttcgggcgggtatcgagagcggcgttgggggttgcggcgttcgttttcgtcggggtatcgtggcgattggcgtcgttttggtagntattttttgtagttgtcgcggtcggggttttgcgtagtgaggcggacggtgtatttnttananaaattcggcggtggcggcggtttcggttttttttttttttttcgnnttttcgnnnttntcgtnnnttatttttttcgttcggnttnnnnntcgtcgcgtgatnntcgattntttcgggcgtacgcgtcgtattntnnttnntncgggtttcgtttntattcgcgttcgtcgcgtcggcgtattnnnttntattttatcgttagtgacgcggggcgcgggttagcgcgagggcgcgggttanagttnacgttcgttacgtttcgttcgttatnatttgtttattgtttttttttttntatatatcgntttcgatcgcgacgcgttttacgt

SEQ ID NO: 16378 - DNA, 676 bp, Artificial Sequence
  chemically treated genomic DNA (Homo sapiens) CpG-island No: 16378
  misc_feature (25)..(25): n is either a, c, g or t
  misc_feature (35)..(35): n is either a, c, g or t
  misc_feature (59)..(59): n is either a, c, g or t
  misc_feature (85)..(85): n is either a, c, g or t
  misc_feature (90)..(90): n is either a, c, g or t
  misc_feature (142)..(142): n is either a, c, g or t
  misc_feature (145)..(147): n is either a, c, g or t
  misc_feature (175)..(175): n is either a, c, g or t
  misc_feature (188)..(188): n is either a, c, g or t
  misc_feature (190)..(191): n is either a, c, g or t
  misc_feature (194)..(195): n is either a, c, g or t
  misc_feature (197)..(197): n is either a, c, g or t
  misc_feature (220)..(220): n is either a, c, g or t
  misc_feature (227)..(228): n is either a, c, g or t
  misc_feature (241)..(245): n is either a, c, g or t
  misc_feature (248)..(248): n is either a, c, g or t
  misc_feature (266)..(268): n is either a, c, g or t
  misc_feature (273)..(273): n is either a, c, g or t
  misc_feature (276)..(278): n is either a, c, g or t
  misc_feature (285)..(286): n is either a, c, g or t
  misc_feature (331)..(331): n is either a, c, g or t
  misc_feature (333)..(333): n is either a, c, g or t
  misc_feature (337)..(337): n is either a, c, g or t
  misc_feature (394)..(394): n is either a, c, g or t
acgtaaaacgcgtcgcgatcgaaancgatatatanaaaaaaaaaaacaataaacaaatnataacgaacgaaacgtaacgaacgtnaactntaacccgcgccctcgcgctaacccgcgccccgcgtcactaacgataaaatanaannnaatacgccgacgcgacgaacgcgaatanaaacgaaacccgnannaannanaatacgacgcgtacgcccgaaanaatcgannatcacgcgacgannnnnaanccgaacgaaaaaaataannnacganaannncgaaaanncgaaaaaaaaaaaaaaaaccgaaaccgccgccaccgccgaatttntntaanaaatacaccgtccgcctcactacgcaaaaccccgaccgcgacaactacaaaaaatanctaccaaaacgacgccaatcgccacgataccccgacgaaaacgaacgccgcaacccccaacgccgctctcgatacccgcccgaaaacgctcgaccgaacgcaaaaaccctcccgaaaaaacgaacgaaaacgaccgcgaaacgaacgaaaaaaaaacgattacctacgaacaaaaaaaacacgaaataaaaacgaccgaaaactacgcaaaaaaaacgcgctcgatctatccccacccccaccccgatacccgataccctcgcgaaatcgcgacgctccgat

SEQ ID NO: 16379 - DNA, 676 bp, Artificial Sequence
  chemically treated genomic DNA (Homo sapiens) CpG-island No: 16379
  misc_feature (25)..(25): n is either a, c, g or t
  misc_feature (35)..(35): n is either a, c, g or t
  misc_feature (59)..(59): n is either a, c, g or t
  misc_feature (85)..(85): n is either a, c, g or t
  misc_feature (90)..(90): n is either a, c, g or t
  misc_feature (142)..(142): n is either a, c, g or t
  misc_feature (145)..(147): n is either a, c, g or t
  misc_feature (175)..(175): n is either a, c, g or t
  misc_feature (188)..(188): n is either a, c, g or t
  misc_feature (190)..(191): n is either a, c, g or t
  misc_feature (194)..(195): n is either a, c, g or t
  misc_feature (197)..(197): n is either a, c, g or t
  misc_feature (220)..(220): n is either a, c, g or t
  misc_feature (227)..(228): n is either a, c, g or t
  misc_feature (241)..(245): n is either a, c, g or t
  misc_feature (248)..(248): n is either a, c, g or t
  misc_feature (266)..(268): n is either a, c, g or t
  misc_feature (273)..(273): n is either a, c, g or t
  misc_feature (276)..(278): n is either a, c, g or t
  misc_feature (285)..(286): n is either a, c, g or t
  misc_feature (331)..(331): n is either a, c, g or t
  misc_feature (333)..(333): n is either a, c, g or t
  misc_feature (337)..(337): n is either a, c, g or t
  misc_feature (394)..(394): n is either a, c, g or t
gcgtaaagcgcgtcgcggtcggaancggtatatangaaaaggggggtaataaataggtnatggcgggcggaacgtggcgggcgtnaattntaattcgcgttttcgcgttggttcgcgtttcgcgttattggcggtaaggtgnagnnngatacgtcggcgcggcggacgcgggtanaggcggaattcgnannagnngnagtgcggcgcgtgcgttcggggnaatcggnnattacgcggcggnnnnnaantcgggcggggaaagtaannngcggnaannncgggggnncgggggaggagggaaaggtcgagatcgtcgttatcgtcgaatttntntggngggtgtatcgttcgttttattgcgtagagtttcggtcgcggtagttgtagaaaatgnttgttaaagcggcgttagtcgttacggtgtttcggcgggggcgggcgtcgtagtttttagcgtcgttttcggtgttcgttcggggacgttcggtcgggcgtagggattttttcgggggagcgggcgggggcggtcgcggggcgagcgggggaggggcggttatttgcgggtagagggggtacggggtgggggcggtcggggattgcgtaggaagggcgcgttcggtttgtttttatttttatttcggtgttcggtgttttcgcgaggtcgcggcgtttcggt

SEQ ID NO: 16380 - DNA, 676 bp, Artificial Sequence
  chemically treated genomic DNA (Homo sapiens) CpG-island No: 16380
  misc_feature (283)..(283): n is either a, c, g or t
  misc_feature (340)..(340): n is either a, c, g or t
  misc_feature (344)..(344): n is either a, c, g or t
  misc_feature (346)..(346): n is either a, c, g or t
  misc_feature (391)..(392): n is either a, c, g or t
  misc_feature (399)..(401): n is either a, c, g or t
  misc_feature (404)..(404): n is either a, c, g or t
  misc_feature (409)..(411): n is either a, c, g or t
  misc_feature (429)..(429): n is either a, c, g or t
  misc_feature (432)..(436): n is either a, c, g or t
  misc_feature (449)..(450): n is either a, c, g or t
  misc_feature (457)..(457): n is either a, c, g or t
  misc_feature (480)..(480): n is either a, c, g or t
  misc_feature (482)..(483): n is either a, c, g or t
  misc_feature (486)..(487): n is either a, c, g or t
  misc_feature (489)..(489): n is either a, c, g or t
  misc_feature (502)..(502): n is either a, c, g or t
  misc_feature (530)..(532): n is either a, c, g or t
  misc_feature (535)..(535): n is either a, c, g or t
  misc_feature (587)..(587): n is either a, c, g or t
  misc_feature (592)..(592): n is either a, c, g or t
  misc_feature (618)..(618): n is either a, c, g or t
  misc_feature (642)..(642): n is either a, c, g or t
  misc_feature (652)..(652): n is either a, c, g or t
accgaaacgccgcgacctcgcgaaaacaccgaacaccgaaataaaaataaaaacaaaccgaacgcgcccttcctacgcaatccccgaccgcccccaccccgtaccccctctacccgcaaataaccgcccctcccccgctcgccccgcgaccgcccccgcccgctcccccgaaaaaatccctacgcccgaccgaacgtccccgaacgaacaccgaaaacgacgctaaaaactacgacgcccgcccccgccgaaacaccgtaacgactaacgccgctttaacaancattttctacaactaccgcgaccgaaactctacgcaataaaacgaacgatacacccnccananaaattcgacgataacgacgatctcgacctttccctcctcccccgnncccccgnnnttnccgcnnnttactttccccgcccganttnnnnnccgccgcgtaatnnccgattnccccgaacgcacgcgccgcactncnnctnntncgaattccgcctntacccgcgtccgccgcgccgacgtatcnnnctncaccttaccgccaataacgcgaaacgcgaaccaacgcgaaaacgcgaattanaattnacgcccgccacgttccgcccgccatnacctatttattaccccccttttcntatataccgnttccgaccgcgacgcgctttacgc

SEQ ID NO: 16381 - DNA, 860 bp, Artificial Sequence
  chemically treated genomic DNA (Homo sapiens) CpG-island No: 16381
gtgcgcgtttcgagtacgtagcggtgcggggtcggcgggtatttggttggcgttcggcgcgggcgtcgtttttcgatcgggattttacggcgtcgtaggaggatatcgacgaggtagaggagaagtcggaggagtcggagtcgggcgagtcgggcgtcgaggggtttaagatcgagtagttggcgtcgtaggcgttcggggcggcggcgggcggcgacgcgtcgtagaagtagtttaggttgagcgggttggttatgaggtcgtagtcgttcgtcgcgtttcgtagttttttttcgtcgcggttgtcgtttagtagtttgtttataattatgtttttaggttgggcgttcgaggatttcgatatttgcgttatcggttcgttgcgcgcggttgtttttcgggttggtttagggagttgtcggcgggcggacggcgcgggttagtacgggcgcggcgcgggattgttagggtatttaacgggtcgtagcgttcgtcgattttttcggcgttcggttcggttattggcggtgttcgggtcgttttttagtttttttttcggatgcgttcgatttttagtaaaatgtataggatgaggtaatgcgtttttcgtttttcgttttcgtttcgttcgttcggtttcgtttagatcgatcggttgtttgtttgttttttatcgggaaatttcgatagcgcgcggtttttagtttttcgtttttcgtttttcgtttttcgtttttcgttttcgggatttcgtttttcgttcgggttatttttgttttttaggttttcgtcgggtttgggcgttcggggagagggcgcgcggcgtagggttgggtttgtagagggaggcgggagttagt

SEQ ID NO: 16382 - DNA, 860 bp, Artificial Sequence
  chemically treated genomic DNA (Homo sapiens) CpG-island No: 16382
actaactcccgcctccctctacaaacccaaccctacgccgcgcgccctctccccgaacgcccaaacccgacgaaaacctaaaaaacaaaaataacccgaacgaaaaacgaaatcccgaaaacgaaaaacgaaaaacgaaaaacgaaaaacgaaaaactaaaaaccgcgcgctatcgaaatttcccgataaaaaacaaacaaacaaccgatcgatctaaacgaaaccgaacgaacgaaacgaaaacgaaaaacgaaaaacgcattacctcatcctatacattttactaaaaatcgaacgcatccgaaaaaaaaactaaaaaacgacccgaacaccgccaataaccgaaccgaacgccgaaaaaatcgacgaacgctacgacccgttaaataccctaacaatcccgcgccgcgcccgtactaacccgcgccgtccgcccgccgacaactccctaaaccaacccgaaaaacaaccgcgcgcaacgaaccgataacgcaaatatcgaaatcctcgaacgcccaacctaaaaacataattataaacaaactactaaacgacaaccgcgacgaaaaaaaactacgaaacgcgacgaacgactacgacctcataaccaacccgctcaacctaaactacttctacgacgcgtcgccgcccgccgccgccccgaacgcctacgacgccaactactcgatcttaaacccctcgacgcccgactcgcccgactccgactcctccgacttctcctctacctcgtcgatatcctcctacgacgccgtaaaatcccgatcgaaaaacgacgcccgcgccgaacgccaaccaaatacccgccgaccccgcaccgctacgtactcgaaacgcgcac

SEQ ID NO: 16383 - DNA, 860 bp, Artificial Sequence
  chemically treated genomic DNA (Homo sapiens) CpG-island No: 16383
attgattttcgtttttttttgtaggtttagttttgcgtcgcgcgtttttttttcgggcgtttaggttcggcgggggtttagagggtagggatggttcgggcgagggacggggtttcggaggcgggaggcgggaggcgggaggcgggaagcgggaggttggaagtcgcgcgttgtcggggtttttcggtgaagggtaggtaaataatcggtcggtttgggcggagtcgggcgggcggggcgagggcggagggcggagggcgtattgttttattttgtatattttattggaaatcggacgtattcggaggaggggttgggaggcggttcgggtatcgttaatggtcgggtcgggcgtcggggaggtcggcgagcgttgcggttcgttaaatattttggtagtttcgcgtcgcgttcgtattggttcgcgtcgttcgttcgtcgatagttttttgagttagttcgggaggtagtcgcgcgtagcgagtcggtggcgtaggtgtcggggttttcgagcgtttagtttgggagtatgattgtggataagttgttggacgatagtcgcggcggagaggggttgcgggacgcggcgggcggttgcggttttatgattagttcgtttaatttgagttatttttacggcgcgtcgtcgttcgtcgtcgtttcgggcgtttgcgacgttagttgttcggttttgggtttttcggcgttcggttcgttcggtttcgattttttcgattttttttttgtttcgtcggtgtttttttgcggcgtcgtggagtttcggtcgagaggcggcgttcgcgtcgagcgttagttaggtattcgtcggtttcgtatcgttgcgtattcggggcgcgtat

SEQ ID NO: 16384 - DNA, 860 bp, Artificial Sequence
  chemically treated genomic DNA (Homo sapiens) CpG-island No: 16384
atacgcgccccgaatacgcaacgatacgaaaccgacgaatacctaactaacgctcgacgcgaacgccgcctctcgaccgaaactccacgacgccgcaaaaaaacaccgacgaaacaaaaaaaaaatcgaaaaaatcgaaaccgaacgaaccgaacgccgaaaaacccaaaaccgaacaactaacgtcgcaaacgcccgaaacgacgacgaacgacgacgcgccgtaaaaataactcaaattaaacgaactaatcataaaaccgcaaccgcccgccgcgtcccgcaacccctctccgccgcgactatcgtccaacaacttatccacaatcatactcccaaactaaacgctcgaaaaccccgacacctacgccaccgactcgctacgcgcgactacctcccgaactaactcaaaaaactatcgacgaacgaacgacgcgaaccaatacgaacgcgacgcgaaactaccaaaatatttaacgaaccgcaacgctcgccgacctccccgacgcccgacccgaccattaacgatacccgaaccgcctcccaacccctcctccgaatacgtccgatttccaataaaatatacaaaataaaacaatacgccctccgccctccgccctcgccccgcccgcccgactccgcccaaaccgaccgattatttacctacccttcaccgaaaaaccccgacaacgcgcgacttccaacctcccgcttcccgcctcccgcctcccgcctcccgcctccgaaaccccgtccctcgcccgaaccatccctaccctctaaacccccgccgaacctaaacgcccgaaaaaaaaacgcgcgacgcaaaactaaacctacaaaaaaaaacgaaaatcaat

SEQ ID NO: 16385 - DNA, 521 bp, Artificial Sequence
  chemically treated genomic DNA (Homo sapiens) CpG-island No: 16385
tttaggagcgcgttggtagagtcgggtaatgggtcgtttcgttcgtagcggtttttttcgacgttcgtatatagattatatttagtatttattttcgggattcgttcgtttttcgtttttcgggggttagggattttgacgtttcggtcggtcgtcgtagcgttaggtcgttagtttttcgtttttttattcggcgacgtttttttattttcgattttcggttacgattggtggagtttcggcgggggcgggtcgagggcgttgattgatagtagtacgcgtcgggcggaatttataggtttggaagcgaagttggtattttggcgttttacgtcgttaagtttttgttcgcgacgcgatattgtagttgtcgtttcgcggatcgaggtttggttttttttacgatttaatttttcgtgaatttcggacgtttgagttttttgggagtatttatttattttaaggtttttcgtttgttagcgaaagtgtttataatcgtagttgattttagtagggtagtt

SEQ ID NO: 16386 - DNA, 521 bp, Artificial Sequence
  chemically treated genomic DNA (Homo sapiens) CpG-island No: 16386
aactaccctactaaaatcaactacgattataaacactttcgctaacaaacgaaaaaccttaaaataaataaatactcccaaaaaactcaaacgtccgaaattcacgaaaaattaaatcgtaaaaaaaaccaaacctcgatccgcgaaacgacaactacaatatcgcgtcgcgaacaaaaacttaacgacgtaaaacgccaaaataccaacttcgcttccaaacctataaattccgcccgacgcgtactactatcaatcaacgccctcgacccgcccccgccgaaactccaccaatcgtaaccgaaaatcgaaaataaaaaaacgtcgccgaataaaaaaacgaaaaactaacgacctaacgctacgacgaccgaccgaaacgtcaaaatccctaacccccgaaaaacgaaaaacgaacgaatcccgaaaataaatactaaatataatctatatacgaacgtcgaaaaaaaccgctacgaacgaaacgacccattacccgactctaccaacgcgctcctaaa

SEQ ID NO: 16387 - DNA, 521 bp, Artificial Sequence
  chemically treated genomic DNA (Homo sapiens) CpG-island No: 16387
gattgttttattagagttaattgcggttgtgggtattttcgttgataagcgaaaagttttgaggtaggtggatgtttttaggaaatttagacgttcgaagtttacgaggagttgggtcgtgagaggggttagatttcgattcgcggggcgatagttgtagtgtcgcgtcgcgagtaggagtttggcggcgtagagcgttagggtgttaatttcgtttttaggtttgtgggtttcgttcggcgcgtgttgttgttagttaacgttttcggttcgttttcgtcgaagttttattaatcgtagtcgggggtcggaggtgaggagacgtcgtcgggtgaggaagcggggggttagcggtttggcgttgcggcgatcgatcggggcgttaggatttttggttttcggagagcgaagggcgggcgggtttcggaggtgagtgttggatgtggtttgtgtgcggacgtcgggaggggtcgttgcgggcggagcgatttattgttcggttttgttagcgcgtttttaga

SEQ ID NO: 16388 - DNA, 521 bp, Artificial Sequence
  chemically treated genomic DNA (Homo sapiens) CpG-island No: 16388
tctaaaaacgcgctaacaaaaccgaacaataaatcgctccgcccgcaacgacccctcccgacgtccgcacacaaaccacatccaacactcacctccgaaacccgcccgcccttcgctctccgaaaaccaaaaatcctaacgccccgatcgatcgccgcaacgccaaaccgctaaccccccgcttcctcacccgacgacgtctcctcacctccgacccccgactacgattaataaaacttcgacgaaaacgaaccgaaaacgttaactaacaacaacacgcgccgaacgaaacccacaaacctaaaaacgaaattaacaccctaacgctctacgccgccaaactcctactcgcgacgcgacactacaactatcgccccgcgaatcgaaatctaacccctctcacgacccaactcctcgtaaacttcgaacgtctaaatttcctaaaaacatccacctacctcaaaacttttcgcttatcaacgaaaatacccacaaccgcaattaactctaataaaacaatc

SEQ ID NO: 16389 - DNA, 686 bp, Artificial Sequence
  chemically treated genomic DNA (Homo sapiens) CpG-island No: 16389
gttcgatttttttagtacgtttattttagttattattggtcgttttttcgttggcgtgattaagatttagtttttttttcgttgggattattttgaggcgatttgcggaagttgaggggtttcggaggaggggtcgcgatgtatttcgggttttgtagtttatttgtataattatagttagagagcggggttttacgattcggagaattataatttttagtagtcgggcggaagcggagcgagggggggttcgcgttacgtgggcgttcggtttgggcgggttattttttagtgcggcggcggcggcggtggcggcggtttcggggatcggggttttttgtttggagcggttgcgggggggtttcggagcggcgaggtcggcggttttttttagtttgttcggtttcggttatttttcgcgggggtgggaggggtcgttttttgggtcgggtatttgtttaggcgttcgtcgtttcgttttaggtcggtttcgttcggtttgaggggaggaatcggtcgggtttcgtcgcgcggtttagttattttcggagtcgtcgtttttgtttttagtgtttcggatcggaggtcgtttatcgtttttcgggtcgacgttatgaagattaaagatgttaagaaattttgtaagacgggggttggggttcgttaggttgggagggtatttttgg

SEQ ID NO: 16390 - DNA, 686 bp, Artificial Sequence
  chemically treated genomic DNA (Homo sapiens) CpG-island No: 16390
ccaaaaataccctcccaacctaacgaaccccaacccccgtcttacaaaatttcttaacatctttaatcttcataacgtcgacccgaaaaacgataaacgacctccgatccgaaacactaaaaacaaaaacgacgactccgaaaataactaaaccgcgcgacgaaacccgaccgattcctcccctcaaaccgaacgaaaccgacctaaaacgaaacgacgaacgcctaaacaaatacccgacccaaaaaacgacccctcccacccccgcgaaaaataaccgaaaccgaacaaactaaaaaaaaccgccgacctcgccgctccgaaacccccccgcaaccgctccaaacaaaaaaccccgatccccgaaaccgccgccaccgccgccgccgccgcactaaaaaataacccgcccaaaccgaacgcccacgtaacgcgaaccccccctcgctccgcttccgcccgactactaaaaattataattctccgaatcgtaaaaccccgctctctaactataattatacaaataaactacaaaacccgaaatacatcgcgacccctcctccgaaacccctcaacttccgcaaatcgcctcaaaataatcccaacgaaaaaaaaactaaatcttaatcacgccaacgaaaaaacgaccaataataactaaaataaacgtactaaaaaaatcgaac

SEQ ID NO: 16391 - DNA, 686 bp, Artificial Sequence
  chemically treated genomic DNA (Homo sapiens) CpG-island No: 16391
ttaagggtgtttttttaatttggcgggttttagttttcgttttatagggttttttggtatttttgatttttatggcgtcggttcgaggggcgatggacggttttcgattcggggtattgagagtagaggcggcgatttcggaggtggttgggtcgcgcggcgaggttcggtcggtttttttttttaggtcgggcggggtcggtttagggcggggcggcgggcgtttgagtagatgttcggtttagggggcggttttttttattttcgcgaggggtggtcgggatcgagtaagttggggaaggtcgtcggtttcgtcgtttcggggttttttcgtagtcgttttaaataaaaggtttcggttttcggagtcgtcgttatcgtcgtcgtcgtcgtattgagaaatagttcgtttaggtcgaacgtttacgtgacgcgagttttttttcgtttcgttttcgttcggttgttggggattgtagtttttcgggtcgtgaggtttcgttttttggttgtagttgtgtaggtggattataaagttcgagatgtatcgcggtttttttttcgaggttttttagttttcgtagatcgttttagagtggttttagcgagaagagggttgggttttagttacgttagcgaggaggcgattaatggtgattgagatgggcgtgttggggaagtcgggt

SEQ ID NO: 16392 - DNA, 686 bp, Artificial Sequence
  chemically treated genomic DNA (Homo sapiens) CpG-island No: 16392
acccgacttccccaacacgcccatctcaatcaccattaatcgcctcctcgctaacgtaactaaaacccaaccctcttctcgctaaaaccactctaaaacgatctacgaaaactaaaaaacctcgaaaaaaaaaccgcgatacatctcgaactttataatccacctacacaactacaaccaaaaaacgaaacctcacgacccgaaaaactacaatccccaacaaccgaacgaaaacgaaacgaaaaaaaactcgcgtcacgtaaacgttcgacctaaacgaactatttctcaatacgacgacgacgacgataacgacgactccgaaaaccgaaaccttttatttaaaacgactacgaaaaaaccccgaaacgacgaaaccgacgaccttccccaacttactcgatcccgaccacccctcgcgaaaataaaaaaaaccgccccctaaaccgaacatctactcaaacgcccgccgccccgccctaaaccgaccccgcccgacctaaaaaaaaaaaccgaccgaacctcgccgcgcgacccaaccacctccgaaatcgccgcctctactctcaataccccgaatcgaaaaccgtccatcgcccctcgaaccgacgccataaaaatcaaaaataccaaaaaaccctataaaacgaaaactaaaacccgccaaattaaaaaaacacccttaa

SEQ ID NO: 16393 - DNA, 798 bp, Artificial Sequence
  chemically treated genomic DNA (Homo sapiens) CpG-island No: 16393
gcgggttgggcgcgagaagacgtggtagtaggttcgttttttcgagtagacgggaggcgttattatggggggggggggtcgcggttcgtttcgcgtagaaagagtttttttttcgtcgttgttcgcgtttttagtttagtacgatcgcggcggttttacgcgtgtagagacggcggcggcggcgttggaaagttcggggcgtcgaggggagggttgggacgcggtatgaagggaaagttcggttcgggtttgtttcgttttatcgggttggcggcgcgttcgttcgtgtgggagtacgagtggtcgggcgagcggggtttcgcggttcgggttcggacggtcgggcgttgcgttatttttcgtttttcgagtttcggttcgggttgagtcgttcggtttttttttttttcgttcgttcgtttgtttttttttggagtttggattgatttggtcgcgttggcgttagggagtcggagttgtttagtttttattttttagttgttaatattcggcgtattcgtttgttcgttcgttcgtttatacgtttattcgtttattcgcgcgtcgtcgtcgttgtcgcgcgattagggattttttttaaattttcggttcggtcggcgtgagcgtagcgcggtcggggtcggaggacggcgcgggggagcggtcggagttatttttttttatcggtagttttacgtttcgtttttttttggagaaaaaatagtgtggcggcgtttaggtttttttaattttgtttttttagtttcggtggagcggatttagtttattatttgtaag

SEQ ID NO: 16394 - DNA, 798 bp, Artificial Sequence
  chemically treated genomic DNA (Homo sapiens) CpG-island No: 16394
cttacaaataataaactaaatccgctccaccgaaactaaaaaaacaaaattaaaaaaacctaaacgccgccacactattttttctccaaaaaaaaacgaaacgtaaaactaccgataaaaaaaaataactccgaccgctcccccgcgccgtcctccgaccccgaccgcgctacgctcacgccgaccgaaccgaaaatttaaaaaaaatccctaatcgcgcgacaacgacgacgacgcgcgaataaacgaataaacgtataaacgaacgaacgaacaaacgaatacgccgaatattaacaactaaaaaataaaaactaaacaactccgactccctaacgccaacgcgaccaaatcaatccaaactccaaaaaaaaacaaacgaacgaacgaaaaaaaaaaaaaccgaacgactcaacccgaaccgaaactcgaaaaacgaaaaataacgcaacgcccgaccgtccgaacccgaaccgcgaaaccccgctcgcccgaccactcgtactcccacacgaacgaacgcgccgccaacccgataaaacgaaacaaacccgaaccgaactttcccttcataccgcgtcccaaccctcccctcgacgccccgaactttccaacgccgccgccgccgtctctacacgcgtaaaaccgccgcgatcgtactaaactaaaaacgcgaacaacgacgaaaaaaaaactctttctacgcgaaacgaaccgcgaccccccccccccataataacgcctcccgtctactcgaaaaaacgaacctactaccacgtcttctcgcgcccaacccgc

SEQ ID NO: 16395 - DNA, 798 bp, Artificial Sequence
  chemically treated genomic DNA (Homo sapiens) CpG-island No: 16395
tttgtagataatggattaagttcgttttatcgggattaaaaaggtagggttaggaaagtttgaacgtcgttatattgttttttttttaggaagaaacggggcgtggggttgtcggtagaagggggtggtttcggtcgttttttcgcgtcgtttttcggtttcggtcgcgttgcgtttacgtcggtcgggtcgggaatttggagaggatttttggtcgcgcggtagcggcggcggcgcgcgggtgagcgggtgagcgtgtgagcgggcgggcgggtaggcgagtgcgtcgggtattggtagttgaggagtggaggttgggtagtttcgattttttgacgttagcgcgattagattaatttaggttttaggagaaagtaggcgggcgggcggagaaaggagaggtcgagcggtttaattcgggtcgaggttcggggagcggagagtggcgtagcgttcggtcgttcggattcgggtcgcgagatttcgttcgttcggttattcgtgtttttatacggacgggcgcgtcgttaattcggtaaaacgaaatagattcgaatcgaattttttttttatgtcgcgttttagtttttttttcggcgtttcgggttttttagcgtcgtcgtcgtcgtttttgtacgcgtggggtcgtcgcggtcgtgttgggttgggggcgcgggtagcggcgggaagggggttttttttgcgcggggcgggtcgcgattttttttttttatgatggcgtttttcgtttgttcggaggagcgaatttgttattacgttttttcgcgtttagttcgt

SEQ ID NO: 16396 - DNA, 798 bp, Artificial Sequence
  chemically treated genomic DNA (Homo sapiens) CpG-island No: 16396
acgaactaaacgcgaaaaaacgtaataacaaattcgctcctccgaacaaacgaaaaacgccatcataaaaaaaaaaaatcgcgacccgccccgcgcaaaaaaaacccccttcccgccgctacccgcgcccccaacccaacacgaccgcgacgaccccacgcgtacaaaaacgacgacgacgacgctaaaaaacccgaaacgccgaaaaaaaaactaaaacgcgacataaaaaaaaaattcgattcgaatctatttcgttttaccgaattaacgacgcgcccgtccgtataaaaacacgaataaccgaacgaacgaaatctcgcgacccgaatccgaacgaccgaacgctacgccactctccgctccccgaacctcgacccgaattaaaccgctcgacctctcctttctccgcccgcccgcctactttctcctaaaacctaaattaatctaatcgcgctaacgtcaaaaaatcgaaactacccaacctccactcctcaactaccaatacccgacgcactcgcctacccgcccgcccgctcacacgctcacccgctcacccgcgcgccgccgccgctaccgcgcgaccaaaaatcctctccaaattcccgacccgaccgacgtaaacgcaacgcgaccgaaaccgaaaaacgacgcgaaaaaacgaccgaaaccacccccttctaccgacaaccccacgccccgtttcttcctaaaaaaaaaacaatataacgacgttcaaactttcctaaccctacctttttaatcccgataaaacgaacttaatccattatctacaaa

SEQ ID NO: 16397 - DNA, 882 bp, Artificial Sequence
  chemically treated genomic DNA (Homo sapiens) CpG-island No: 16397
cgtttgcgtcgtcggcgtcgtattatattcggtttagtacgttgtacggattgtcgttaaagttttatcgttagtatcgttttgcgcgatgtaagtcggtcggtaatatttttttatcgtcgttggtatatacgtcgttttttacgtaggcgttatcgtcgttattgtcgggttatacggtgggtagttcgtatattatttagagtttttcggttaaattgtatttatcgtttttcgtcgtgcgttcgcgttttaagagtgtcgagttttttcgttcgtcgttttttaagcgcgtgtagtcggtcgagaagttgggagtttttttgagtgcggataagaagggcgcgttgcgtaaatatagtttcgaggtgggttattcggattttcgtaaggatttttatggcgagttggcgttgtatagttttgtcgagttcgacggtgagacgtttttagtcgagggttttggcgcgtttcggtaggtcgtcgttcgtcgtttgggtcgataggagttatttttgagtttgggcgcggattcgttgttgttcgagggtgtttttaggttattagtgtcgagtaaggagaaggaattttcggggggcgtcgaggcgtgtattttatttcgcgcgacgattttcggtggtcggattttggagcgggacgtcggttgtacgcggtattagagcgtgtagacggaggatggtattggcgggatggttagggttgtggttaaggcggcgttgagttcggtgtaggaatacgagataggtcggcgtagtagttttggcgaggcgggtatatttttggtatttattgtcgtagagtttgcgcggttcggggttaaggttgtggtgttttagtttttgggcgcggattttaaggggt

SEQ ID NO: 16398 - DNA, 882 bp, Artificial Sequence
  chemically treated genomic DNA (Homo sapiens) CpG-island No: 16398
accccttaaaatccgcgcccaaaaactaaaacaccacaaccttaaccccgaaccgcgcaaactctacgacaataaataccaaaaatatacccgcctcgccaaaactactacgccgacctatctcgtattcctacaccgaactcaacgccgccttaaccacaaccctaaccatcccgccaataccatcctccgtctacacgctctaataccgcgtacaaccgacgtcccgctccaaaatccgaccaccgaaaatcgtcgcgcgaaataaaatacacgcctcgacgccccccgaaaattccttctccttactcgacactaataacctaaaaacaccctcgaacaacaacgaatccgcgcccaaactcaaaaataactcctatcgacccaaacgacgaacgacgacctaccgaaacgcgccaaaaccctcgactaaaaacgtctcaccgtcgaactcgacaaaactatacaacgccaactcgccataaaaatccttacgaaaatccgaataacccacctcgaaactatatttacgcaacgcgcccttcttatccgcactcaaaaaaactcccaacttctcgaccgactacacgcgcttaaaaaacgacgaacgaaaaaactcgacactcttaaaacgcgaacgcacgacgaaaaacgataaatacaatttaaccgaaaaactctaaataatatacgaactacccaccgtataacccgacaataacgacgataacgcctacgtaaaaaacgacgtatataccaacgacgataaaaaaatattaccgaccgacttacatcgcgcaaaacgatactaacgataaaactttaacgacaatccgtacaacgtactaaaccgaatataatacgacgccgacgacgcaaacg

SEQ ID NO: 16399 - DNA, 882 bp, Artificial Sequence
  chemically treated genomic DNA (Homo sapiens) CpG-island No: 16399
attttttggagttcgcgtttagaggttgaggtattatagttttagtttcgggtcgcgtaggttttacgataatgggtattaggggtgtgttcgtttcgttagagttgttgcgtcggtttgtttcgtgtttttgtatcgggtttagcgtcgttttggttatagttttggttatttcgttagtgttatttttcgtttgtacgttttgatgtcgcgtgtagtcgacgtttcgttttagggttcggttatcgggggtcgtcgcgcggggtggggtgtacgtttcggcgtttttcggggattttttttttttgttcgatattggtggtttggaggtattttcgggtagtaacgggttcgcgtttaggtttaaaggtgatttttgtcggtttaggcggcggacggcgatttgtcggggcgcgttaaggttttcgattgggggcgttttatcgtcggattcggtaaggttatgtagcgttagttcgttatggaagtttttgcggaaattcgggtggtttatttcgaggttgtgtttgcgtagcgcgttttttttgttcgtatttaaagaggtttttagtttttcggtcgattgtacgcgtttgaggagcggcgagcgagggggttcggtatttttggggcgcgggcgtacgacgggaggcgatgagtgtagtttggtcgggaagttttgagtagtgtgcgagttgtttatcgtgtggttcggtagtggcggcggtgacgtttgcgtgggggacggcgtgtgtgttagcggcgatagagggatgttgtcggtcgatttgtatcgcgtagagcggtattggcgatggagttttggcgatagttcgtgtagcgtgttgggtcgaatgtggtgcgacgtcgacgacgtaggcg

SEQ ID NO: 16400 - DNA, 882 bp, Artificial Sequence
  chemically treated genomic DNA (Homo sapiens) CpG-island No: 16400
cgcctacgtcgtcgacgtcgcaccacattcgacccaacacgctacacgaactatcgccaaaactccatcgccaataccgctctacgcgatacaaatcgaccgacaacatccctctatcgccgctaacacacacgccgtcccccacgcaaacgtcaccgccgccactaccgaaccacacgataaacaactcgcacactactcaaaacttcccgaccaaactacactcatcgcctcccgtcgtacgcccgcgccccaaaaataccgaaccccctcgctcgccgctcctcaaacgcgtacaatcgaccgaaaaactaaaaacctctttaaatacgaacaaaaaaaacgcgctacgcaaacacaacctcgaaataaaccacccgaatttccgcaaaaacttccataacgaactaacgctacataaccttaccgaatccgacgataaaacgcccccaatcgaaaaccttaacgcgccccgacaaatcgccgtccgccgcctaaaccgacaaaaatcacctttaaacctaaacgcgaacccgttactacccgaaaatacctccaaaccaccaatatcgaacaaaaaaaaaaaatccccgaaaaacgccgaaacgtacaccccaccccgcgcgacgacccccgataaccgaaccctaaaacgaaacgtcgactacacgcgacatcaaaacgtacaaacgaaaaataacactaacgaaataaccaaaactataaccaaaacgacgctaaacccgatacaaaaacacgaaacaaaccgacgcaacaactctaacgaaacgaacacacccctaatacccattatcgtaaaacctacgcgacccgaaactaaaactataatacctcaacctctaaacgcgaactccaaaaaat

SEQ ID NO: 16401 - DNA, 882 bp, Artificial Sequence
  chemically treated genomic DNA (Homo sapiens) CpG-island No: 16401
ttcgtttttttatttgtgtgcgtgcgtagatgcgtttttaggtgggagtttttggtgtagtttttgtcgtaattcgggtgcgcgtacgtgtgcgttgtttgttttttgcgcgtttacgaacgtcggtttcgtttggatggcgcggtttcggttattatatttggattttttgtagttttttcgagtttagtgtttatcgtttcgggttttaaataatttaggaaggagggggacgtggcgggatcgggcgcgggtttttggagttcgcggaagagttggaagtgtttttggtattgaggcgtcgggtatatcgcggggtattcggatagtagttcgtagggggcgttcgacgtcgtaggtattgaaagttcggttcgcgggaagtagttattcgaggagtcggcgtcgggtttcgggtatatcggttgtagcgttagcgttttgggttcgggggtcggggttggagttagggttgggtttacgaaggcgtcgggagttcgggttcgtagggtagggcgtatttaattcgagtgatttttcgaatttaaaagtttagttattagtttcgggtcgttagtatatgcgtttagagtttcgggcggcggcggatattgcgtttcggaggtttcgttgggcgttagagcgtaggtttggggcgcgttatcgggtttcgggttcgagaagttggtgaggaggagatttaggttttaggtggcgttcgcgttttttttatcgtttttttttttttcgggttggtttttagattttacgtggaggggcggtttcgtggggttaggaggattcgggtttatgttttgcgttttttcggagcgttattattgcgggagggagtaggtagttcgaggttcggtggatattggg

SEQ ID NO: 16402 - DNA, 882 bp, Artificial Sequence
  chemically treated genomic DNA (Homo sapiens) CpG-island No: 16402
cccaatatccaccgaacctcgaactacctactccctcccgcaataataacgctccgaaaaaacgcaaaacataaacccgaatcctcctaaccccacgaaaccgcccctccacgtaaaatctaaaaaccaacccgaaaaaaaaaaaaacgataaaaaaaacgcgaacgccacctaaaacctaaatctcctcctcaccaacttctcgaacccgaaacccgataacgcgccccaaacctacgctctaacgcccaacgaaacctccgaaacgcaatatccgccgccgcccgaaactctaaacgcatatactaacgacccgaaactaataactaaacttttaaattcgaaaaatcactcgaattaaatacgccctaccctacgaacccgaactcccgacgccttcgtaaacccaaccctaactccaaccccgacccccgaacccaaaacgctaacgctacaaccgatatacccgaaacccgacgccgactcctcgaataactacttcccgcgaaccgaactttcaatacctacgacgtcgaacgccccctacgaactactatccgaataccccgcgatatacccgacgcctcaataccaaaaacacttccaactcttccgcgaactccaaaaacccgcgcccgatcccgccacgtccccctccttcctaaattatttaaaacccgaaacgataaacactaaactcgaaaaaactacaaaaaatccaaatataataaccgaaaccgcgccatccaaacgaaaccgacgttcgtaaacgcgcaaaaaacaaacaacgcacacgtacgcgcacccgaattacgacaaaaactacaccaaaaactcccacctaaaaacgcatctacgcacgcacacaaataaaaaaacgaa

SEQ ID NO: 16403 - DNA, 882 bp, Artificial Sequence
  chemically treated genomic DNA (Homo sapiens) CpG-island No: 16403
tttagtgtttatcgaatttcgagttgtttgttttttttcgtagtggtggcgtttcgaagaggcgtaggatatgggttcgggtttttttgattttacggagtcgtttttttacgtgaagtttgaggattagttcggggaggaagaggacgatgagaggggcgcggacgttatttgggatttggattttttttttattaatttttcgggttcggagttcggtggcgcgttttagatttgcgttttggcgtttagcgaggttttcggggcgtaatattcgtcgtcgttcgagattttgggcgtatatgttggcggttcggggttggtggttgggtttttgggttcggaggattattcgggttgggtgcgttttgttttgcgagttcgggttttcgacgttttcgtgggtttagttttggttttagtttcggttttcgagtttaaggcgttggcgttgtaatcggtgtattcggggttcggcgtcggtttttcgggtggttatttttcgcggatcgggtttttagtgtttgcggcgtcgggcgttttttacgggttattgttcgggtatttcgcgatgtattcggcgttttagtattaagggtatttttagttttttcgcgggttttagggattcgcgttcggtttcgttacgttttttttttttttgagttgtttgggattcgggacggtgggtattggattcggggggattgtagaggatttaggtgtgatagtcgagatcgcgttatttaagcgaggtcgacgttcgtgggcgcgtaagaggtaggtagcgtatacgtgcgcgtattcgggttgcggtaagagttatattaagagtttttatttgaaggcgtatttgcgtacgtatataggtgagggggcggg

SEQ ID NO: 16404 - DNA, 882 bp, Artificial Sequence
  chemically treated genomic DNA (Homo sapiens) CpG-island No: 16404
cccgccccctcacctatatacgtacgcaaatacgccttcaaataaaaactcttaatataactcttaccgcaacccgaatacgcgcacgtatacgctacctacctcttacgcgcccacgaacgtcgacctcgcttaaataacgcgatctcgactatcacacctaaatcctctacaatccccccgaatccaatacccaccgtcccgaatcccaaacaactcaaaaaaaaaaaaaacgtaacgaaaccgaacgcgaatccctaaaacccgcgaaaaaactaaaaatacccttaatactaaaacgccgaatacatcgcgaaatacccgaacaataacccgtaaaaaacgcccgacgccgcaaacactaaaaacccgatccgcgaaaaataaccacccgaaaaaccgacgccgaaccccgaatacaccgattacaacgccaacgccttaaactcgaaaaccgaaactaaaaccaaaactaaacccacgaaaacgtcgaaaacccgaactcgcaaaacaaaacgcacccaacccgaataatcctccgaacccaaaaacccaaccaccaaccccgaaccgccaacatatacgcccaaaatctcgaacgacgacgaatattacgccccgaaaacctcgctaaacgccaaaacgcaaatctaaaacgcgccaccgaactccgaacccgaaaaattaataaaaaaaaaatccaaatcccaaataacgtccgcgcccctctcatcgtcctcttcctccccgaactaatcctcaaacttcacgtaaaaaaacgactccgtaaaatcaaaaaaacccgaacccatatcctacgcctcttcgaaacgccaccactacgaaaaaaaacaaacaactcgaaattcgataaacactaaa

SEQ ID NO: 16405 - DNA, 507 bp, Artificial Sequence
  chemically treated genomic DNA (Homo sapiens) CpG-island No: 16405
ggtttggggtttagttcgtttacggggtatagagggtagtttcgcgtttgtttgtacgtacgtatttttttcgacgtttttgtttttcggttagttgttttattcgtagcgatttttgtatggtcgttaggttcgggtattattcgcgtttttcggtttttagttttcgtagttgtttcggcgacggttataacgaatcggggattatttcggaggcggcgtcgtaacgcgcgaattgtttagtcgcgtagcgcggttttagttgttatcgcggggttaggaggttttcggggtttggttatcggggtttcggtttgcggcgcgggggcggtcgcgttcggtagttacgggaattcggggttagggtcgtcgttatatttagtaggttgcgtgtttgtcgtacggacgtcgttattttggttgtgcggggtttttataggttcgtcgggttgtttatgttcggtgtttgagcgcgaggttcggtgtgggttagggtagggcgagggg

SEQ ID NO: 16406 - DNA, 507 bp, Artificial Sequence
  chemically treated genomic DNA (Homo sapiens) CpG-island No: 16406
cccctcgccctaccctaacccacaccgaacctcgcgctcaaacaccgaacataaacaacccgacgaacctataaaaaccccgcacaaccaaaataacgacgtccgtacgacaaacacgcaacctactaaatataacgacgaccctaaccccgaattcccgtaactaccgaacgcgaccgcccccgcgccgcaaaccgaaaccccgataaccaaaccccgaaaacctcctaaccccgcgataacaactaaaaccgcgctacgcgactaaacaattcgcgcgttacgacgccgcctccgaaataatccccgattcgttataaccgtcgccgaaacaactacgaaaactaaaaaccgaaaaacgcgaataatacccgaacctaacgaccatacaaaaatcgctacgaataaaacaactaaccgaaaaacaaaaacgtcgaaaaaaatacgtacgtacaaacaaacgcgaaactaccctctataccccgtaaacgaactaaaccccaaacc

SEQ ID NO: 16407 - DNA, 507 bp, Artificial Sequence
  chemically treated genomic DNA (Homo sapiens) CpG-island No: 16407
tttttcgttttgttttggtttatatcgggtttcgcgtttaggtatcgggtatggatagttcggcgggtttgtgaggatttcgtatagttaagatggcggcgttcgtgcgataggtacgtagtttattaggtgtggcggcgattttggtttcgggttttcgtggttatcgggcgcggtcgttttcgcgtcgtaggtcgggatttcggtggttagatttcgaggattttttgatttcgcggtggtagttgggatcgcgttacgcggttaagtagttcgcgcgttacggcgtcgttttcggggtggttttcggttcgttatggtcgtcgtcggagtagttgcgggagttggaggtcgaagaacgcgaatggtattcgagtttggcgattatgtaggagtcgttgcgggtgaagtagttggtcgaagagtagaagcgtcgggagaggtgcgtgcgtgtaggtagacgcggggttgttttttgtgtttcgtgggcgaattgggttttaaatt

SEQ ID NO: 16408 - DNA, 507 bp, Artificial Sequence
  chemically treated genomic DNA (Homo sapiens) CpG-island No: 16408
aatttaaaacccaattcgcccacgaaacacaaaaaacaaccccgcgtctacctacacgcacgcacctctcccgacgcttctactcttcgaccaactacttcacccgcaacgactcctacataatcgccaaactcgaataccattcgcgttcttcgacctccaactcccgcaactactccgacgacgaccataacgaaccgaaaaccaccccgaaaacgacgccgtaacgcgcgaactacttaaccgcgtaacgcgatcccaactaccaccgcgaaatcaaaaaatcctcgaaatctaaccaccgaaatcccgacctacgacgcgaaaacgaccgcgcccgataaccacgaaaacccgaaaccaaaatcgccgccacacctaataaactacgtacctatcgcacgaacgccgccatcttaactatacgaaatcctcacaaacccgccgaactatccatacccgatacctaaacgcgaaacccgatataaaccaaaacaaaacgaaaaa

SEQ ID NO: 16409 - DNA, 715 bp, Artificial Sequence
  chemically treated genomic DNA (Homo sapiens) CpG-island No: 16409
attggttgcggtcgttgtggtttcgtttttttgagtggtgcggagttttgtgatgcggagtttcgtgatgtacgtttcgatgtttgcggggttataaaaacgttcgtaagcgttaagtttttttaggagtcgtcggtaagggggtaacgaggaagtttttaagagcgcggtcggaaagtaggtggggagaatttggagaaaaggcgtattttgcggtttcggagattattatgttttagggagtttttcgtagtgggagaggtcgtcggggtaggcggagggtttttagagtcgggggtggggggtttgtggggcggtttcggtttatatcggggagtgcggcgattagacggttagttgtcgaatttgaggtttcggtgggttcgtcgttcgttttttttggataagtttaggcgatgtgagtacgtttagttttttatattttattttcgttttttttaaatagatttagcgtaaaacgagtattgatatagcgggggtttatatttcggaggttttttagggagaggtcggggagtgcggttatttatggtttcgaagttttcgttggtattttgaaaggtatcgtatttttcgtttaaggcgttatttttgtggtagtgggcgtatggacgtttatagttgggcggggtaggatttaaatttcgttagtggtggattagtattggtgataggagagatttgggaagaatta

SEQ ID NO: 16410 - DNA, 715 bp, Artificial Sequence
  chemically treated genomic DNA (Homo sapiens) CpG-island No: 16410
taattcttcccaaatctctcctatcaccaatactaatccaccactaacgaaatttaaatcctaccccgcccaactataaacgtccatacgcccactaccacaaaaataacgccttaaacgaaaaatacgatacctttcaaaataccaacgaaaacttcgaaaccataaataaccgcactccccgacctctccctaaaaaacctccgaaatataaacccccgctatatcaatactcgttttacgctaaatctatttaaaaaaaacgaaaataaaatataaaaaactaaacgtactcacatcgcctaaacttatccaaaaaaaacgaacgacgaacccaccgaaacctcaaattcgacaactaaccgtctaatcgccgcactccccgatataaaccgaaaccgccccacaaaccccccacccccgactctaaaaaccctccgcctaccccgacgacctctcccactacgaaaaactccctaaaacataataatctccgaaaccgcaaaatacgccttttctccaaattctccccacctactttccgaccgcgctcttaaaaacttcctcgttacccccttaccgacgactcctaaaaaaacttaacgcttacgaacgtttttataaccccgcaaacatcgaaacgtacatcacgaaactccgcatcacaaaactccgcaccactcaaaaaaacgaaaccacaacgaccgcaaccaat

SEQ ID NO: 16411 - DNA, 715 bp, Artificial Sequence
  chemically treated genomic DNA (Homo sapiens) CpG-island No: 16411
taattttttttagattttttttattattaatattggtttattattggcggaatttaaattttgtttcgtttaattgtaaacgtttatgcgtttattattataagggtaacgttttaagcgagaaatacgatgttttttaggatgttagcggggatttcggagttataggtaatcgtatttttcgatttttttttaaagaattttcgggatgtgggttttcgttgtgttagtgttcgttttgcgttaggtttgtttgggagagacgggagtgaaatgtaggaggttgggcgtgtttatatcgtttggatttgtttaagagaggcgggcgacggatttatcgaggttttagattcggtagttggtcgtttggtcgtcgtatttttcggtgtgggtcggggtcgttttataggttttttattttcgattttgaggatttttcgtttgtttcgacgattttttttattgcgagagattttttgagatataatggttttcgaggtcgtagggtgcgttttttttttagattttttttatttgtttttcggtcgcgtttttaagagttttttcgttgtttttttgtcggcggtttttgaggagatttggcgtttgcgagcgtttttatagtttcgtaggtatcggggcgtgtattacgaagtttcgtattataaagtttcgtattatttaaggaggcggggttatagcggtcgtagttaat

SEQ ID NO: 16412 - DNA, 715 bp, Artificial Sequence
  chemically treated genomic DNA (Homo sapiens) CpG-island No: 16412
attaactacgaccgctataaccccgcctccttaaataatacgaaactttataatacgaaacttcgtaatacacgccccgatacctacgaaactataaaaacgctcgcaaacgccaaatctcctcaaaaaccgccgacaaaaaaacaacgaaaaaactcttaaaaacgcgaccgaaaaacaaataaaaaaaatctaaaaaaaaaacgcaccctacgacctcgaaaaccattatatctcaaaaaatctctcgcaataaaaaaaatcgtcgaaacaaacgaaaaatcctcaaaatcgaaaataaaaaacctataaaacgaccccgacccacaccgaaaaatacgacgaccaaacgaccaactaccgaatctaaaacctcgataaatccgtcgcccgcctctcttaaacaaatccaaacgatataaacacgcccaacctcctacatttcactcccgtctctcccaaacaaacctaacgcaaaacgaacactaacacaacgaaaacccacatcccgaaaattctttaaaaaaaaatcgaaaaatacgattacctataactccgaaatccccgctaacatcctaaaaaacatcgtatttctcgcttaaaacgttacccttataataataaacgcataaacgtttacaattaaacgaaacaaaatttaaattccgccaataataaaccaatattaataataaaaaaaatctaaaaaaaatta

SEQ ID NO: 16413 - DNA, 639 bp, Artificial Sequence
  chemically treated genomic DNA (Homo sapiens) CpG-island No: 16413
gtgttcggttttcgcgtaattttttagtttcgtggttcgatttatttttaatttggttagttttcgtcgttttttttttttttttatcggttttttttttcgatcgttttaggagagaagttttttttttgtagtttttgtttttagcgttttcgggatttttcggttatgattaagtatttgcggatatacggggtcgtttcgtatcgttgttttttgtgcggggtcggttgttttagtttggtttttatgtaggcgtatatgcgcggttattcgtttagttaattttcgttcggatggattattcgttttatttttttttattttttttcgaggtcgtttcggttttcgatttttttttgttgtttttttttttttattatttgacggggtgtcggtagcgttttagttaagagtttaattaaagaacgaaaagcgggtcggttcggtttttgatttggtatcgttgttacggcggtttagtaaatttcgttttagaagcgttttaggaagggcgtcgagtgtttttttttggacgatcgcgggtcgtagaagtttaggttagcgagttttatagagtgaggatattgaagtgtgtaggagcgaaggttaatagtaggggagattgtcgattttatt

SEQ ID NO: 16414 - DNA, 639 bp, Artificial Sequence
  chemically treated genomic DNA (Homo sapiens) CpG-island No: 16414
aataaaatcgacaatctcccctactattaaccttcgctcctacacacttcaatatcctcactctataaaactcgctaacctaaacttctacgacccgcgatcgtccaaaaaaaaacactcgacgcccttcctaaaacgcttctaaaacgaaatttactaaaccgccgtaacaacgataccaaatcaaaaaccgaaccgacccgcttttcgttctttaattaaactcttaactaaaacgctaccgacaccccgtcaaataataaaaaaaaaaaaacaacaaaaaaaaatcgaaaaccgaaacgacctcgaaaaaaaataaaaaaaaataaaacgaataatccatccgaacgaaaattaactaaacgaataaccgcgcatatacgcctacataaaaaccaaactaaaacaaccgaccccgcacaaaaaacaacgatacgaaacgaccccgtatatccgcaaatacttaatcataaccgaaaaatcccgaaaacgctaaaaacaaaaactacaaaaaaaaaacttctctcctaaaacgatcgaaaaaaaaaaccgataaaaaaaaaaaaaaaacgacgaaaactaaccaaattaaaaataaatcgaaccacgaaactaaaaaattacgcgaaaaccgaacac

SEQ ID NO: 16415 - DNA, 639 bp, Artificial Sequence
  chemically treated genomic DNA (Homo sapiens) CpG-island No: 16415
gatgagatcgataattttttttattgttaattttcgtttttgtatattttagtgtttttattttgtagggttcgttggtttgggtttttgcgattcgcgatcgtttaggagagggtattcggcgttttttttggggcgtttttggggcggaatttgttaggtcgtcgtagtagcggtgttaggttagaagtcgagtcggttcgtttttcgttttttaattggatttttggttaagacgttatcgatatttcgttaggtggtggaggaagaaggataatagggagaggtcgagggtcgagacggtttcgaggaggagtagaggaaggtggagcggatggtttattcgggcgggagttggttgggcgagtgatcgcgtatgtgcgtttgtatggaggttaggttgggatagtcggtttcgtatagggagtagcggtacggagcggtttcgtgtgttcgtaggtgtttggttatggtcgagaagtttcgggagcgttgaggataaaggttataggagaagggttttttttttagagcggtcggaaggggaggtcggtgaaggaaggaagaaggcggcgaaagttggttaagttaggggtggatcgggttacggggttaggggattgcgcgggaatcgggtat

SEQ ID NO: 16416 - DNA, 639 bp, Artificial Sequence
  chemically treated genomic DNA (Homo sapiens) CpG-island No: 16416
atacccgattcccgcgcaatcccctaaccccgtaacccgatccacccctaacttaaccaactttcgccgccttcttccttccttcaccgacctccccttccgaccgctctaaaaaaaaaacccttctcctataacctttatcctcaacgctcccgaaacttctcgaccataaccaaacacctacgaacacacgaaaccgctccgtaccgctactccctatacgaaaccgactatcccaacctaacctccatacaaacgcacatacgcgatcactcgcccaaccaactcccgcccgaataaaccatccgctccaccttcctctactcctcctcgaaaccgtctcgaccctcgacctctccctattatccttcttcctccaccacctaacgaaatatcgataacgtcttaaccaaaaatccaattaaaaaacgaaaaacgaaccgactcgacttctaacctaacaccgctactacgacgacctaacaaattccgccccaaaaacgccccaaaaaaaacgccgaataccctctcctaaacgatcgcgaatcgcaaaaacccaaaccaacgaaccctacaaaataaaaacactaaaatatacaaaaacgaaaattaacaataaaaaaaattatcgatctcatc

SEQ ID NO: 16417 - DNA, 535 bp, Artificial Sequence
  chemically treated genomic DNA (Homo sapiens) CpG-island No: 16417
tgtttagcgggatggatattttttttattttcgaggcgtttcgttttttttaggaggtagtcggtttcgaggattcggtgttcgggtatattttgcggtatgtcggttttggattggtgggggttgtgcgatcgtaagttattcgttttttttattgtaatttacggcgcgcggagtttgatttgggaacgttcggttcgggagagagaggaacgcgtgtttcgattttgttttcggttattcgtttttttttcgggagtatacggatttcgagatcgcggttttttcggcgttttttttttatatcgtgttaagtcgtcgttaggtcgcgtttggaacggagattgattatgttttttatcgttttttttttagtttacgttttttgtagtcgcgaattgtattttttagggtttcgggggtttcggggttcgagttcgcggtattttgggagtggtagtttacgcgggtcgtcggtttagttaagaataatgggaggagtttggggttaggattatatttttcggagattcgg

SEQ ID NO: 16418 - DNA, 535 bp, Artificial Sequence
  chemically treated genomic DNA (Homo sapiens) CpG-island No: 16418
ccgaatctccgaaaaatataatcctaaccccaaactcctcccattattcttaactaaaccgacgacccgcgtaaactaccactcccaaaataccgcgaactcgaaccccgaaacccccgaaaccctaaaaaatacaattcgcgactacaaaaaacgtaaactaaaaaaaaaacgataaaaaacataatcaatctccgttccaaacgcgacctaacgacgacttaacacgatataaaaaaaaaacgccgaaaaaaccgcgatctcgaaatccgtatactcccgaaaaaaaaacgaataaccgaaaacaaaatcgaaacacgcgttcctctctctcccgaaccgaacgttcccaaatcaaactccgcgcgccgtaaattacaataaaaaaaacgaataacttacgatcgcacaacccccaccaatccaaaaccgacataccgcaaaatatacccgaacaccgaatcctcgaaaccgactacctcctaaaaaaaacgaaacgcctcgaaaataaaaaaaatatccatcccgctaaaca

SEQ ID NO: 16419 - DNA, 535 bp, Artificial Sequence
  chemically treated genomic DNA (Homo sapiens) CpG-island No: 16419
tcgggttttcgggaggtgtggttttagttttaggttttttttattgtttttggttaggtcggcggttcgcgtggattattatttttagggtgtcgcgggttcgggtttcgggattttcgaggttttgggaaatgtagttcgcggttgtaggaggcgtgggttggagaaggagcggtggaaagtatagttagttttcgttttaggcgcgatttggcggcggtttggtacggtgtggagggaagacgtcggagaggtcgcggtttcggggttcgtgtgttttcggagaggaggcgggtggtcgaaagtagggtcggagtacgcgtttttttttttttcgggtcgagcgtttttagattagatttcgcgcgtcgtggattgtagtggaaggggcgagtgatttgcggtcgtatagtttttattagtttaggatcggtatgtcgtaaggtgtgttcggatatcgagttttcggggtcggttgttttttggggaggacggggcgtttcgggggtggaagaagtgtttatttcgttggata

SEQ ID NO: 16420 - DNA, 535 bp, Artificial Sequence
  chemically treated genomic DNA (Homo sapiens) CpG-island No: 16420
tatccaacgaaataaacacttcttccacccccgaaacgccccgtcctccccaaaaaacaaccgaccccgaaaactcgatatccgaacacaccttacgacataccgatcctaaactaataaaaactatacgaccgcaaatcactcgccccttccactacaatccacgacgcgcgaaatctaatctaaaaacgctcgacccgaaaaaaaaaaaaacgcgtactccgaccctactttcgaccacccgcctcctctccgaaaacacacgaaccccgaaaccgcgacctctccgacgtcttccctccacaccgtaccaaaccgccgccaaatcgcgcctaaaacgaaaactaactatactttccaccgctccttctccaacccacgcctcctacaaccgcgaactacatttcccaaaacctcgaaaatcccgaaacccgaacccgcgacaccctaaaaataataatccacgcgaaccgccgacctaaccaaaaacaataaaaaaaacctaaaactaaaaccacacctcccgaaaacccga

SEQ ID NO: 16421 - DNA, 900 bp, Artificial Sequence
  chemically treated genomic DNA (Homo sapiens) CpG-island No: 16421
cgtttttcgggttttggtcgggaatttcgtcgtttcggttttcgcgttttggttgtcggcggaagaagcgaggcgttcggattatatttttcggaggttttcgcggttcgtttttttgcggtcgcgacgcgggggtttgtgttttttaggtgcggttcgagggcgtcggtcggtcgcggattttttttttcgtggtgttttgcgcgtggtcggttcggttttcggtttttcgcggcggcgttggttgttgtcgtgcgtcgcggtcgtttcgtttcgttttcgttttttttttttttttcggttttgcgtacgggtcgttttttttttcgttttttcggttttttttacggtgttaagatggcggcggcggcgggcggcggtagttgtttcgggtttggtttcgcgcggggtcgtttttcgggtcggtcgcggggcgtcggcgggggcgggggtcgcggcggacggggtaacggggtcgaaagagtgcgggtagttttgcggcgcggcggtggcgcgacggggtcgggcggagtcgagttcggggaggatacggttttgtttcgtttgttggggtttcgtcggggtttgcgtcggtttcgtcgtttgtgggtcggttcgcgggtttagcggggtcggggacggggtcggggtcggggttggggttcgagtcgaggttgcgtgtcggaggaggagagtagtgacggggaattcgacgaggaggtgaggcggttggaggcgttttcggcgtcgggtggggcggaggtcggggtttttaggggtttgggttgtttcgggggcggcgtgggtaggtcgggtttttagggttttttcggagagacggggtacggagggagggcggttgtatgtagttttcgggggaaagggtttttggaagtgggt

SEQ ID NO: 16422 - DNA, 900 bp, Artificial Sequence
  chemically treated genomic DNA (Homo sapiens) CpG-island No: 16422
acccacttccaaaaaccctttcccccgaaaactacatacaaccgccctccctccgtaccccgtctctccgaaaaaaccctaaaaacccgacctacccacgccgcccccgaaacaacccaaacccctaaaaaccccgacctccgccccacccgacgccgaaaacgcctccaaccgcctcacctcctcgtcgaattccccgtcactactctcctcctccgacacgcaacctcgactcgaaccccaaccccgaccccgaccccgtccccgaccccgctaaacccgcgaaccgacccacaaacgacgaaaccgacgcaaaccccgacgaaaccccaacaaacgaaacaaaaccgtatcctccccgaactcgactccgcccgaccccgtcgcgccaccgccgcgccgcaaaactacccgcactctttcgaccccgttaccccgtccgccgcgacccccgcccccgccgacgccccgcgaccgacccgaaaaacgaccccgcgcgaaaccaaacccgaaacaactaccgccgcccgccgccgccgccatcttaacaccgtaaaaaaaaccgaaaaaacgaaaaaaaaaacgacccgtacgcaaaaccgaaaaaaaaaaaaaaaacgaaaacgaaacgaaacgaccgcgacgcacgacaacaaccaacgccgccgcgaaaaaccgaaaaccgaaccgaccacgcgcaaaacaccacgaaaaaaaaaatccgcgaccgaccgacgccctcgaaccgcacctaaaaaacacaaacccccgcgtcgcgaccgcaaaaaaacgaaccgcgaaaacctccgaaaaatataatccgaacgcctcgcttcttccgccgacaaccaaaacgcgaaaaccgaaacgacgaaattcccgaccaaaacccgaaaaacg

SEQ ID NO: 16423 - DNA, 900 bp, Artificial Sequence
  chemically treated genomic DNA (Homo sapiens) CpG-island No: 16423
atttatttttagaggttttttttttcggaagttgtatgtagtcgtttttttttcgtgtttcgttttttcgaaggaattttgaggattcggtttgtttacgtcgttttcgggataatttagatttttggaagtttcggttttcgttttattcggcgtcggggacgtttttaatcgttttattttttcgtcggatttttcgttattgtttttttttttcggtacgtagtttcgattcgggttttagtttcggtttcgatttcgttttcggtttcgttggattcgcgggtcggtttataggcggcggagtcggcgtaggtttcggcggagttttagtaaacggagtagggtcgtgtttttttcgggttcggtttcgttcggtttcgtcgcgttatcgtcgcgtcgtagagttattcgtattttttcggtttcgttgtttcgttcgtcgcggttttcgttttcgtcggcgtttcgcggtcggttcgggaagcggtttcgcgcggagttaggttcggggtaattgtcgtcgttcgtcgtcgtcgttattttggtatcgtgagaggggtcggggaggcggggggaggggcggttcgtgcgtagggtcggggggaggggagagagcgggggcggggcggggcggtcgcggcgtacgataataattagcgtcgtcgcgggagatcgggggtcgggtcggttacgcgtagggtattacgggagagggagttcgcggtcggtcggcgttttcggatcgtatttggggagtatagattttcgcgtcgcggtcgtagaggggcgaatcgcgggggttttcgggaaatgtagttcggacgtttcgtttttttcgtcggtagttagggcgcgagggtcgggacggcggggttttcggttaggattcggaaagcg

SEQ ID NO: 16424 - DNA, 900 bp, Artificial Sequence
  chemically treated genomic DNA (Homo sapiens) CpG-island No: 16424
cgctttccgaatcctaaccgaaaaccccgccgtcccgaccctcgcgccctaactaccgacgaaaaaaacgaaacgtccgaactacatttcccgaaaacccccgcgattcgcccctctacgaccgcgacgcgaaaatctatactccccaaatacgatccgaaaacgccgaccgaccgcgaactccctctcccgtaataccctacgcgtaaccgacccgacccccgatctcccgcgacgacgctaattattatcgtacgccgcgaccgccccgccccgcccccgctctctcccctccccccgaccctacgcacgaaccgcccctccccccgcctccccgacccctctcacgataccaaaataacgacgacgacgaacgacgacaattaccccgaacctaactccgcgcgaaaccgcttcccgaaccgaccgcgaaacgccgacgaaaacgaaaaccgcgacgaacgaaacaacgaaaccgaaaaaatacgaataactctacgacgcgacgataacgcgacgaaaccgaacgaaaccgaacccgaaaaaaacacgaccctactccgtttactaaaactccgccgaaacctacgccgactccgccgcctataaaccgacccgcgaatccaacgaaaccgaaaacgaaatcgaaaccgaaactaaaacccgaatcgaaactacgtaccgaaaaaaaaaaacaataacgaaaaatccgacgaaaaaataaaacgattaaaaacgtccccgacgccgaataaaacgaaaaccgaaacttccaaaaatctaaattatcccgaaaacgacgtaaacaaaccgaatcctcaaaattccttcgaaaaaacgaaacacgaaaaaaaaacgactacatacaacttccgaaaaaaaaaacctctaaaaataaat

SEQ ID NO: 16425 - DNA, 838 bp, Artificial Sequence
  chemically treated genomic DNA (Homo sapiens) CpG-island No: 16425
  misc_feature (634)..(634): n is either a, c, g or t
  misc_feature (687)..(687): n is either a, c, g or t
ggtaagacggttcgatataagcgaatataataaatatcgcgtagtataagttataaaatatatttacgcgggataaatagacgttattcgattttttcgtaagtaaatacgaagacgttttcgtaacggtcgtgaaaagtaacgtataagttagaacgcgttcgagtaagagagtataatgtagggcgcgatcgcgtatattagatatgcgagcgacgatagcgtttaacgttaattatatgatcggtttagtacgagatacgagtacgtgatttaatataagaatgaacgtgttacgcgtacgagattattatcgttatatacgaatatatcgtgatagagatttacgattacgagattgtcgtatcgaagtatatatttatagcgagtaagagatatagagagcgatatacggagacgcgatatcgacgagagttgataacgtatatatatacgcgatatatatagcgacgtgatattcgcgagaacgagtaagatagatatatcgagatagatattgatatatagatatagtgagatatatttttttttagtcggcgtagtcgattgtatatttgcgatatattgacgcgttgcgtaggatagatacgtatagagtcgtacgagatagagntagagaacgagatagagatacgcgagatcgacgcgagatatatagattagtancgtagagagacgtagtatatagagatatcgacgtgatatatcgagatatattatttattcgtatacgcgcggtacgtgttagagacgatatattcgattagatcgatatagatatacgatttagagattatacgtcgagcgcgtagacgtt

SEQ ID NO: 16426 - DNA, 838 bp, Artificial Sequence
  chemically treated genomic DNA (Homo sapiens) CpG-island No: 16426
  misc_feature (152)..(152): n is either a, c, g or t
  misc_feature (205)..(205): n is either a, c, g or t
aacgtctacgcgctcgacgtataatctctaaatcgtatatctatatcgatctaatcgaatatatcgtctctaacacgtaccgcgcgtatacgaataaataatatatctcgatatatcacgtcgatatctctatatactacgtctctctacgntactaatctatatatctcgcgtcgatctcgcgtatctctatctcgttctctanctctatctcgtacgactctatacgtatctatcctacgcaacgcgtcaatatatcgcaaatatacaatcgactacgccgactaaaaaaaaatatatctcactatatctatatatcaatatctatctcgatatatctatcttactcgttctcgcgaatatcacgtcgctatatatatcgcgtatatatatacgttatcaactctcgtcgatatcgcgtctccgtatatcgctctctatatctcttactcgctataaatatatacttcgatacgacaatctcgtaatcgtaaatctctatcacgatatattcgtatataacgataataatctcgtacgcgtaacacgttcattcttatattaaatcacgtactcgtatctcgtactaaaccgatcatataattaacgttaaacgctatcgtcgctcgcatatctaatatacgcgatcgcgccctacattatactctcttactcgaacgcgttctaacttatacgttacttttcacgaccgttacgaaaacgtcttcgtatttacttacgaaaaaatcgaataacgtctatttatcccgcgtaaatatattttataacttatactacgcgatatttattatattcgcttatatcgaaccgtcttacc

SEQ ID NO: 16427 - DNA, 838 bp, Artificial Sequence
  chemically treated genomic DNA (Homo sapiens) CpG-island No: 16427
  misc_feature (152)..(152): n is either a, c, g or t
  misc_feature (205)..(205): n is either a, c, g or t
ggcgtttgcgcgttcggcgtgtgatttttgagtcgtgtgtttgtgtcgatttggtcgagtgtgtcgtttttgatacgtgtcgcgcgtgtgcgagtgggtggtgtgtttcggtgtgttacgtcgatgtttttgtatgttgcgtttttttacgntattggtttgtatgtttcgcgtcggtttcgcgtgtttttgtttcgttttttgnttttgtttcgtgcgattttgtgcgtgtttgttttgcgtagcgcgttagtgtgtcgtaggtgtgtagtcggttgcgtcgattgagagagggtgtgttttattgtgtttgtgtgttagtgtttgtttcggtgtgtttgttttgttcgttttcgcgggtgttacgtcgttgtgtgtgtcgcgtgtgtgtgtgcgttattagttttcgtcggtgtcgcgttttcgtgtgtcgttttttgtgttttttgttcgttgtggatgtgtgtttcggtgcggtagtttcgtggtcgtaagtttttgttacggtgtattcgtgtgtagcgatggtggtttcgtgcgcgtgatacgtttatttttgtgttgagttacgtgttcgtgtttcgtgttgagtcgattatgtggttggcgttaggcgttgtcgtcgttcgtatgtttggtgtgcgcggtcgcgttttgtattgtgtttttttgttcgggcgcgttttggtttgtgcgttgttttttacggtcgttgcgggggcgttttcgtgtttgtttgcgggggggtcgggtggcgtttgtttgtttcgcgtgggtgtgttttgtggtttgtgttgcgcggtgtttgttgtgttcgtttgtgtcgggtcgttttgtt

SEQ ID NO: 16428 - DNA, 838 bp, Artificial Sequence
  chemically treated genomic DNA (Homo sapiens) CpG-island No: 16428
  misc_feature (634)..(634): n is either a, c, g or t
  misc_feature (687)..(687): n is either a, c, g or t
aacaaaacgacccgacacaaacgaacacaacaaacaccgcgcaacacaaaccacaaaacacacccacgcgaaacaaacaaacgccacccgacccccccgcaaacaaacacgaaaacgcccccgcaacgaccgtaaaaaacaacgcacaaaccaaaacgcgcccgaacaaaaaaacacaatacaaaacgcgaccgcgcacaccaaacatacgaacgacgacaacgcctaacgccaaccacataatcgactcaacacgaaacacgaacacgtaactcaacacaaaaataaacgtatcacgcgcacgaaaccaccatcgctacacacgaatacaccgtaacaaaaacttacgaccacgaaactaccgcaccgaaacacacatccacaacgaacaaaaaacacaaaaaacgacacacgaaaacgcgacaccgacgaaaactaataacgcacacacacacgcgacacacacaacgacgtaacacccgcgaaaacgaacaaaacaaacacaccgaaacaaacactaacacacaaacacaataaaacacaccctctctcaatcgacgcaaccgactacacacctacgacacactaacgcgctacgcaaaacaaacacgcacaaaatcgcacgaaacaaaancaaaaaacgaaacaaaaacacgcgaaaccgacgcgaaacatacaaaccaatancgtaaaaaaacgcaacatacaaaaacatcgacgtaacacaccgaaacacaccacccactcgcacacgcgcgacacgtatcaaaaacgacacactcgaccaaatcgacacaaacacacgactcaaaaatcacacgccgaacgcgcaaacgcc

SEQ ID NO: 16429 - DNA, 638 bp, Artificial Sequence
  chemically treated genomic DNA (Homo sapiens) CpG-island No: 16429
  misc_feature (435)..(435): n is either a, c, g or t
  misc_feature (475)..(475): n is either a, c, g or t
gttagttcgtggtgttgcggggatatcgggtcggtttcgtcgtcgtcgtcggggttcgagattatcgtcgtcgcggcgggtatcgcggacgagtcggggttcgtagtcgagatggtggcggcggtcgggggcgtagtcggggacggagtgtgttggggttgcggcggcggttgtttgttgtagggtttattagcgttggggtcggtggaggacgggcggtttatcgcgtttcgaattaattatggaattgcgggcgtttgtttggtcgcggggtcgttcgggttaaggcggtgcgcgtttcgcgggtagcgagtttcgaggtaacgttacggcgtttagtttaggttcgggcggcggagacgttcggcgttcggtaggcggagggttggatcgcgttgatgtatttcgtagttttcggcgtttcgagtacgtttncgcgtcggatttcgcgcggtgtttttttttcggcggcgtntttcgggtttcgaattttagcggtgcgtagagttttggtttattcgtttttggaatagtcggtgacgtaagttttcggggtcgcgcgcggacgtgacgtttggatacgtgtgcggtcgtttaggcgcgcggggattggtagagttattttgcgtcgggggcgt

SEQ ID NO: 16430 - DNA, 638 bp, Artificial Sequence
  chemically treated genomic DNA (Homo sapiens) CpG-island No: 16430
  misc_feature (164)..(164): n is either a, c, g or t
  misc_feature (204)..(204): n is either a, c, g or t
acgcccccgacgcaaaataactctaccaatccccgcgcgcctaaacgaccgcacacgtatccaaacgtcacgtccgcgcgcgaccccgaaaacttacgtcaccgactattccaaaaacgaataaaccaaaactctacgcaccgctaaaattcgaaacccgaaanacgccgccgaaaaaaaaacaccgcgcgaaatccgacgcgnaaacgtactcgaaacgccgaaaactacgaaatacatcaacgcgatccaaccctccgcctaccgaacgccgaacgtctccgccgcccgaacctaaactaaacgccgtaacgttacctcgaaactcgctacccgcgaaacgcgcaccgccttaacccgaacgaccccgcgaccaaacaaacgcccgcaattccataattaattcgaaacgcgataaaccgcccgtcctccaccgaccccaacgctaataaaccctacaacaaacaaccgccgccgcaaccccaacacactccgtccccgactacgcccccgaccgccgccaccatctcgactacgaaccccgactcgtccgcgatacccgccgcgacgacgataatctcgaaccccgacgacgacgacgaaaccgacccgatatccccgcaacaccacgaactaac

SEQ ID NO: 16431 - DNA, 638 bp, Artificial Sequence
  chemically treated genomic DNA (Homo sapiens) CpG-island No: 16431
  misc_feature (164)..(164): n is either a, c, g or t
  misc_feature (204)..(204): n is either a, c, g or t
acgttttcggcgtagggtggttttgttagttttcgcgcgtttgggcggtcgtatacgtgtttaggcgttacgttcgcgcgcggtttcgggggtttgcgttatcggttgttttagaagcgggtgggttagggttttgcgtatcgttggggttcggggttcggggnacgtcgtcgggaggagggtatcgcgcggggttcgacgcgnaggcgtgttcggaacgtcgggggttgcggagtgtattagcgcggtttagtttttcgtttgtcgggcgtcgagcgttttcgtcgttcggatttgggttgggcgtcgtggcgttgtttcggagttcgttgttcgcggggcgcgtatcgttttgattcgggcggtttcgcggttaggtaggcgttcgtagttttatggttggttcggagcgcgatgagtcgttcgttttttatcggttttagcgttaataaattttgtagtaagtagtcgtcgtcgtagttttagtatatttcgttttcggttgcgttttcggtcgtcgttattatttcggttgcgggtttcggttcgttcgcggtgttcgtcgcggcggcggtgatttcgggtttcggcggcggcggcggggtcggttcggtgttttcgtagtattacgagttgat

SEQ ID NO: 16432 - DNA, 638 bp, Artificial Sequence
  chemically treated genomic DNA (Homo sapiens) CpG-island No: 16432
  misc_feature (435)..(435): n is either a, c, g or t
  misc_feature (475)..(475): n is either a, c, g or t
atcaactcgtaatactacgaaaacaccgaaccgaccccgccgccgccgccgaaacccgaaatcaccgccgccgcgacgaacaccgcgaacgaaccgaaacccgcaaccgaaataataacgacgaccgaaaacgcaaccgaaaacgaaatatactaaaactacgacgacgactacttactacaaaatttattaacgctaaaaccgataaaaaacgaacgactcatcgcgctccgaaccaaccataaaactacgaacgcctacctaaccgcgaaaccgcccgaatcaaaacgatacgcgccccgcgaacaacgaactccgaaacaacgccacgacgcccaacccaaatccgaacgacgaaaacgctcgacgcccgacaaacgaaaaactaaaccgcgctaatacactccgcaacccccgacgttccgaacacgcctncgcgtcgaaccccgcgcgataccctcctcccgacgacgtnccccgaaccccgaaccccaacgatacgcaaaaccctaacccacccgcttctaaaacaaccgataacgcaaacccccgaaaccgcgcgcgaacgtaacgcctaaacacgtatacgaccgcccaaacgcgcgaaaactaacaaaaccaccctacgccgaaaacgt

SEQ ID NO: 16433 - DNA, 769 bp, Artificial Sequence
  chemically treated genomic DNA (Homo sapiens) CpG-island No: 16433
atttcgacgttttatttagattcgcgttttattagggcggcgcgcggcgatttcgcgtttcgcggagtttcgggttcgcgcgcgttcgttcgttttcggagatagattagcgcgcgcgtttcgggtcgtttttttttagcgcgcgttcgtttcggggttcgcgtcgtcgtcgtcgtcgtcgtcgcgcgcgcgtagtttaagtaaaggaggaaaaaaaaaagggggaaaaatagaaagcggcggcggttgtagtagcgattcgtcgtcggattgggttaagtcgggcggcggtcgcgcgagtcggcgatttagggtattggcggcggttagttagggcgggtcgtgtttaaaaaaaaaagtcgcggcggcggcggttgtttagggaaggaggtttgagggtcgcgtgtagcgggcgggtagttgggtgggttgggggcggtcgcgcggcgtttcggagtttcgggtcgttcggagtcggcgggcgggcggaggcggaggcggcggcggttgtagcggttgtaggagcggcggcggttgcggcggcggcggcggtattttttttttatatgattttattgtttgttttcgtgattagcgcgagcggttttcgtatttttttcgtttttttttgtcgcgcggcgtgagcgtcgggttcggggttttttcggtcgttcgttttttttttttttttttttttttttttttttttttttttcgggtttcgcgtttttttcgttttcgttttttttatggatatgttggattcggg

SEQ ID NO: 16434 - DNA, 769 bp, Artificial Sequence
  chemically treated genomic DNA (Homo sapiens) CpG-island No: 16434
cccgaatccaacatatccataaaaaaaacgaaaacgaaaaaaacgcgaaacccgaaaaaaaaaaaaaaaaaaaaaaaaaaaaaaaaaaaaaaaacgaacgaccgaaaaaaccccgaacccgacgctcacgccgcgcgacaaaaaaaaacgaaaaaaatacgaaaaccgctcgcgctaatcacgaaaacaaacaataaaatcatataaaaaaaaaataccgccgccgccgccgcaaccgccgccgctcctacaaccgctacaaccgccgccgcctccgcctccgcccgcccgccgactccgaacgacccgaaactccgaaacgccgcgcgaccgcccccaacccacccaactacccgcccgctacacgcgaccctcaaacctccttccctaaacaaccgccgccgccgcgacttttttttttaaacacgacccgccctaactaaccgccgccaataccctaaatcgccgactcgcgcgaccgccgcccgacttaacccaatccgacgacgaatcgctactacaaccgccgccgctttctatttttcccccttttttttttcctcctttacttaaactacgcgcgcgcgacgacgacgacgacgacgacgcgaaccccgaaacgaacgcgcgctaaaaaaaaacgacccgaaacgcgcgcgctaatctatctccgaaaacgaacgaacgcgcgcgaacccgaaactccgcgaaacgcgaaatcgccgcgcgccgccctaataaaacgcgaatctaaataaaacgtcgaaat

SEQ ID NO: 16435 - DNA, 769 bp, Artificial Sequence
  chemically treated genomic DNA (Homo sapiens) CpG-island No: 16435
ttcgggtttagtatgtttatggggggggcgggggcggggggggcgcggggttcgggggggaggggaggggaggggagggagggaggggagggggcgggcggtcgggggggtttcgagttcggcgtttacgtcgcgcggtaggaggggacggaggagatacgggagtcgttcgcgttgattacggggataaatagtggggttatgtgaggaggagatgtcgtcgtcgtcgtcgtagtcgtcgtcgtttttgtagtcgttgtagtcgtcgtcgttttcgttttcgttcgttcgtcggtttcgggcggttcgaggtttcgggacgtcgcgcggtcgtttttagtttatttagttgttcgttcgttgtacgcggtttttaggtttttttttttgagtagtcgtcgtcgtcgcgatttttttttttgaatacggttcgttttggttggtcgtcgttagtgttttggatcgtcggttcgcgcggtcgtcgttcggtttggtttagttcggcggcggatcgttgttgtagtcgtcgtcgttttttattttttttttttttttttttttttttttatttgagttgcgcgcgcgcggcggcggcggcggcggcggcgcgagtttcggggcggacgcgcgttggggggaggcggttcggggcgcgcgcgttggtttgttttcgggggcgggcgggcgcgcgcgagttcggggtttcgcggggcgcgaggtcgtcgcgcgtcgttttggtgaaacgcgggtttggatggaacgtcggggt

SEQ ID NO: 16436 - DNA, 769 bp, Artificial Sequence
  chemically treated genomic DNA (Homo sapiens) CpG-island No: 16436
accccgacgttccatccaaacccgcgtttcaccaaaacgacgcgcgacgacctcgcgccccgcgaaaccccgaactcgcgcgcgcccgcccgcccccgaaaacaaaccaacgcgcgcgccccgaaccgcctccccccaacgcgcgtccgccccgaaactcgcgccgccgccgccgccgccgccgcgcgcgcgcaactcaaataaaaaaaaaaaaaaaaaaaaaaaaaaaataaaaaacgacgacgactacaacaacgatccgccgccgaactaaaccaaaccgaacgacgaccgcgcgaaccgacgatccaaaacactaacgacgaccaaccaaaacgaaccgtattcaaaaaaaaaaatcgcgacgacgacgactactcaaaaaaaaaaacctaaaaaccgcgtacaacgaacgaacaactaaataaactaaaaacgaccgcgcgacgtcccgaaacctcgaaccgcccgaaaccgacgaacgaacgaaaacgaaaacgacgacgactacaacgactacaaaaacgacgacgactacgacgacgacgacgacatctcctcctcacataaccccactatttatccccgtaatcaacgcgaacgactcccgtatctcctccgtcccctcctaccgcgcgacgtaaacgccgaactcgaaacccccccgaccgcccgccccctcccctccctccctcccctcccctcccctcccccccgaaccccgcgccccccccgcccccgccccccccataaacatactaaacccgaa

SEQ ID NO: 16437 - DNA, 840 bp, Artificial Sequence
  chemically treated genomic DNA (Homo sapiens) CpG-island No: 16437
gttgtttcggttatcgttgttgtcgtcgttaggtaagattttcggttcggtcgtgttttcgcgtttcggtttcggtttcggtttcgcggtttgtaggtcggggtcgttatgatttcgagcggtcgcgggttcggtttaaaatggaggtcgtcggcgcgggggggatttggcgtttttcgttttcggttttcggtttcggcggcgttttcggttttaggcgcggtcgggtgggattggggttttgtagttgggcgcgggggcgggggcgcgggcgcgggtcgcgttgattttgtttttttttgtgtttttggtagttacgataagggattcgaggcggaggagggcgtcgagttgtaggaaggtgagtgtttgtcgggtcggtcgcgttcggggagggttgggggcgttcggcgcggttttgatcgtgtttcgatttttttcggttttaggcggggacggtttaggagcggaggagtagatagcggtggttattattagcgtttagtaggcggcgttcggcgattataatatttagtattagtttcgtatagagataaatggaggataggtgagcggcgggtcgcgagggcgaacgggcgggcgggcgggcgcgtcgggaaggttcggatttggttttagcgtcggtttcgtcgttttgtcgttttttgtaggtgatatatcgcgtagtttaggtgattgatggttagttggacggttagggcgatatagttggcgtcgttagcgtcgtgtttatcgttgttttcgcgggggggtagtaggttgtgatttaggtgggtgtggacggggtagtttagcgttcgggtttcgtcgttgtttttg

SEQ ID NO: 16438 - DNA, 840 bp, Artificial Sequence
  chemically treated genomic DNA (Homo sapiens) CpG-island No: 16438
caaaaacaacgacgaaacccgaacgctaaactaccccgtccacacccacctaaatcacaacctactacccccccgcgaaaacaacgataaacacgacgctaacgacgccaactatatcgccctaaccgtccaactaaccatcaatcacctaaactacgcgatatatcacctacaaaaaacgacaaaacgacgaaaccgacgctaaaaccaaatccgaaccttcccgacgcgcccgcccgcccgcccgttcgccctcgcgacccgccgctcacctatcctccatttatctctatacgaaactaatactaaatattataatcgccgaacgccgcctactaaacgctaataataaccaccgctatctactcctccgctcctaaaccgtccccgcctaaaaccgaaaaaaatcgaaacacgatcaaaaccgcgccgaacgcccccaaccctccccgaacgcgaccgacccgacaaacactcaccttcctacaactcgacgccctcctccgcctcgaatcccttatcgtaactaccaaaaacacaaaaaaaaacaaaatcaacgcgacccgcgcccgcgcccccgcccccgcgcccaactacaaaaccccaatcccacccgaccgcgcctaaaaccgaaaacgccgccgaaaccgaaaaccgaaaacgaaaaacgccaaatcccccccgcgccgacgacctccattttaaaccgaacccgcgaccgctcgaaatcataacgaccccgacctacaaaccgcgaaaccgaaaccgaaaccgaaacgcgaaaacacgaccgaaccgaaaatcttacctaacgacgacaacaacgataaccgaaacaac

SEQ ID NO: 16439 - DNA, 840 bp, Artificial Sequence
  chemically treated genomic DNA (Homo sapiens) CpG-island No: 16439
tagaggtagcggcggggttcgggcgttgggttgtttcgtttatatttatttgggttatagtttgttgttttttcgcgaaggtagcggtggatacgacgttgacggcgttagttgtgtcgttttggtcgtttagttgattattagttatttggattacgcggtatgttatttgtagggggcggtagagcggcgaggtcggcgttggggttaggttcgagttttttcggcgcgttcgttcgttcgttcgttcgttttcgcggttcgtcgtttatttgttttttatttgtttttgtgcggaattggtattggatgttgtggtcgtcgaacgtcgtttgttggacgttggtgatggttatcgttgtttgttttttcgtttttgggtcgttttcgtttggggtcgaggagggtcggggtacggttagggtcgcgtcgagcgtttttagtttttttcgggcgcggtcggttcggtaagtatttatttttttgtagttcgacgttttttttcgtttcgggttttttgtcgtggttgttaggggtataggagggagtagggttagcgcggttcgcgttcgcgttttcgttttcgcgtttagttgtagggttttagttttattcggtcgcgtttgaggtcgggggcgtcgtcgaggtcgggggtcgggggcgggaggcgttaggtttttttcgcgtcggcggtttttattttgagtcgggttcgcggtcgttcgggattatggcggtttcggtttgtaggtcgcggggtcggggtcggggtcggggcgcgggggtacggtcgggtcggggattttatttggcggcggtagtagcggtggtcgaggtagt

SEQ ID NO: 16440 - DNA, 840 bp, Artificial Sequence
  chemically treated genomic DNA (Homo sapiens) CpG-island No: 16440
actacctcgaccaccgctactaccgccgccaaataaaatccccgacccgaccgtacccccgcgccccgaccccgaccccgaccccgcgacctacaaaccgaaaccgccataatcccgaacgaccgcgaacccgactcaaaataaaaaccgccgacgcgaaaaaaacctaacgcctcccgcccccgacccccgacctcgacgacgcccccgacctcaaacgcgaccgaataaaactaaaaccctacaactaaacgcgaaaacgaaaacgcgaacgcgaaccgcgctaaccctactccctcctatacccctaacaaccacgacaaaaaacccgaaacgaaaaaaaacgtcgaactacaaaaaaataaatacttaccgaaccgaccgcgcccgaaaaaaactaaaaacgctcgacgcgaccctaaccgtaccccgaccctcctcgaccccaaacgaaaacgacccaaaaacgaaaaaacaaacaacgataaccatcaccaacgtccaacaaacgacgttcgacgaccacaacatccaataccaattccgcacaaaaacaaataaaaaacaaataaacgacgaaccgcgaaaacgaacgaacgaacgaacgaacgcgccgaaaaaactcgaacctaaccccaacgccgacctcgccgctctaccgccccctacaaataacataccgcgtaatccaaataactaataatcaactaaacgaccaaaacgacacaactaacgccgtcaacgtcgtatccaccgctaccttcgcgaaaaaacaacaaactataacccaaataaatataaacgaaacaacccaacgcccgaaccccgccgctacctcta

SEQ ID NO: 16441 - DNA, 723 bp, Artificial Sequence
  chemically treated genomic DNA (Homo sapiens) CpG-island No: 16441
  misc_feature (458)..(458): n is either a, c, g or t
agagagtagacgtcggagtattgagtagtttagattttgcggtatgtttttttcggaagaagcgggagaggcggcggtaagagtagaagtaggattttaagtagagaattaggatagcgaggtcgggggttggatcgtagttcggcggttaggaagtgtgtcggggcggcggggacgttcgggtatttagttaattttacggggcggggcggtcgcgggtcgcgggcggatgacgcgtcggggtcggcggaggagtagttattttttggggtcgtcggtcggggtcgttggttgtatttagcgtcggagtcgggagttagcggtcgtcgttatgttttattagatcggtatttaaggtaatagcgttcggcgcgattcgtagggaaggggttttcgggagagtcgggagagtcgggagggttgtaggatcggtaggggttggagtcggtcgggagttncggaagtcggtttcgcggggcgagtcgggtttgggggttttttcgcgtttttgttttttcggtcgttggcggtttgcgtttttttttagttcgggttttggtggtcgttacggttggagaatttgtttcggaatttcgggggagtcgaagggaaattgggtttttcgaggcgggtttgtgttgaaggggggcgggttttttatcggtttttcgacggtgggttaattttttttttttttgggttttcgagggagaggacgggaat

SEQ ID NO: 16442 - DNA, 723 bp, Artificial Sequence
  chemically treated genomic DNA (Homo sapiens) CpG-island No: 16442
  misc_feature (266)..(266): n is either a, c, g or t
attcccgtcctctccctcgaaaacccaaaaaaaaaaaaaattaacccaccgtcgaaaaaccgataaaaaacccgccccccttcaacacaaacccgcctcgaaaaacccaatttcccttcgactcccccgaaattccgaaacaaattctccaaccgtaacgaccaccaaaacccgaactaaaaaaaaacgcaaaccgccaacgaccgaaaaaacaaaaacgcgaaaaaacccccaaacccgactcgccccgcgaaaccgacttccgnaactcccgaccgactccaacccctaccgatcctacaaccctcccgactctcccgactctcccgaaaaccccttccctacgaatcgcgccgaacgctattaccttaaataccgatctaataaaacataacgacgaccgctaactcccgactccgacgctaaatacaaccaacgaccccgaccgacgaccccaaaaaataactactcctccgccgaccccgacgcgtcatccgcccgcgacccgcgaccgccccgccccgtaaaattaactaaatacccgaacgtccccgccgccccgacacacttcctaaccgccgaactacgatccaacccccgacctcgctatcctaattctctacttaaaatcctacttctactcttaccgccgcctctcccgcttcttccgaaaaaaacataccgcaaaatctaaactactcaatactccgacgtctactctct

SEQ ID NO: 16443 - DNA, 723 bp, Artificial Sequence
  chemically treated genomic DNA (Homo sapiens) CpG-island No: 16443
  misc_feature (266)..(266): n is either a, c, g or t
gttttcgttttttttttcggggatttaaaaggggaaaaggttggtttatcgtcgggggatcggtggaaggttcgtttttttttaatataggttcgtttcggaaagtttaattttttttcggttttttcggaatttcgggataaattttttaatcgtgacggttattagggttcgggttggaggaggacgtaggtcgttagcggtcgggaaagtaggagcgcggagaggtttttaggttcggttcgtttcgcgagatcggttttcgnagttttcggtcgattttagtttttgtcggttttgtagttttttcggttttttcggttttttcggaagttttttttttgcgagtcgcgtcgggcgttgttattttggatgtcggtttggtgggatatggcggcggtcgttagttttcggtttcggcgttgagtgtagttagcggtttcggtcggcggttttaggaagtggttgttttttcgtcggtttcggcgcgttattcgttcgcgattcgcggtcgtttcgtttcgtgaggttgattgagtgttcgagcgttttcgtcgtttcgatatattttttggtcgtcgggttgcggtttagttttcggtttcgttattttagttttttgtttggggttttgtttttgtttttgtcgtcgtttttttcgtttttttcgggggggatatgtcgtagaatttagattgtttagtgtttcgacgtttgtttttt

SEQ ID NO: 16444 - DNA, 723 bp, Artificial Sequence
  chemically treated genomic DNA (Homo sapiens) CpG-island No: 16444
  misc_feature (458)..(458): n is either a, c, g or t
aaaaaacaaacgtcgaaacactaaacaatctaaattctacgacatatcccccccgaaaaaaacgaaaaaaacgacgacaaaaacaaaaacaaaaccccaaacaaaaaactaaaataacgaaaccgaaaactaaaccgcaacccgacgaccaaaaaatatatcgaaacgacgaaaacgctcgaacactcaatcaacctcacgaaacgaaacgaccgcgaatcgcgaacgaataacgcgccgaaaccgacgaaaaaacaaccacttcctaaaaccgccgaccgaaaccgctaactacactcaacgccgaaaccgaaaactaacgaccgccgccatatcccaccaaaccgacatccaaaataacaacgcccgacgcgactcgcaaaaaaaaaacttccgaaaaaaccgaaaaaaccgaaaaaactacaaaaccgacaaaaactaaaatcgaccgaaaactncgaaaaccgatctcgcgaaacgaaccgaacctaaaaacctctccgcgctcctactttcccgaccgctaacgacctacgtcctcctccaacccgaaccctaataaccgtcacgattaaaaaatttatcccgaaattccgaaaaaaccgaaaaaaaattaaactttccgaaacgaacctatattaaaaaaaaacgaaccttccaccgatcccccgacgataaaccaaccttttccccttttaaatccccgaaaaaaaaaacgaaaac

SEQ ID NO: 16445 - DNA, 1018 bp, Artificial Sequence
  chemically treated genomic DNA (Homo sapiens) CpG-island No: 16445
cgtacgatcgttttattattaatcgtacgttttacgttttatttttagtattacgtaacgattgattcgacgtatcgaagttacggtatttcgtattcggtacgaattattacgatagattagaatttaaatcgaattcgaatcggaatcgagacggaattcgttttcgttattcgatagttagggaatttcgtattacgttatacgtatagtttattacgatcggaggttagaaattatatatggtaatcgttaacgtttttttcgattgcgaataagcgtattcggaatttttattcgcgagtcgcgatacgcgtaattagaattcgattttcgcgtaattcgatcgttaaattaggtattgtcgattcggaatcgtcgtcgttcgtcgcgatttatatagttatatagcgattcgttatttacgataatcgtttataggtatttcgtattttacgttacgttttagcgtatttcgtatattagggacgttagatcgcggaaatttgcggagtttatgatcgttagtatattatattaggtaattttaatattttaggatatcgcgacgttagaaattcggagttggtaattttttattatttcgttttcggaaatttcgtatcgtcgtcggatcgcgaaaattcgcgatacgcgatacgggcgttaatcggtagttacgtagatttcggcgagtttcgaaacgcgacgaattttttaagcgcgagtttagagatatacggataacgggaaatttacgcgtaacggcgatttcgcgaattaacgacgcggcgaattatggacgttatttttcgaggtttcgaatttcgaaaacggggaagttcgatgagttaaatttataacgataatacggatcgtcgtttgattcgtattttgaaatatcgttatcgttaatttattacgtcgaatatcgcgattttcgaattttagtcgggaatacggtatcgtttttacgcgatttcgtaatacgcgatcgatacgcgcgtaattcgtattt

SEQ ID NO: 16446 - DNA, 1018 bp, Artificial Sequence
  chemically treated genomic DNA (Homo sapiens) CpG-island No: 16446
aaatacgaattacgcgcgtatcgatcgcgtattacgaaatcgcgtaaaaacgataccgtattcccgactaaaattcgaaaatcgcgatattcgacgtaataaattaacgataacgatatttcaaaatacgaatcaaacgacgatccgtattatcgttataaatttaactcatcgaacttccccgttttcgaaattcgaaacctcgaaaaataacgtccataattcgccgcgtcgttaattcgcgaaatcgccgttacgcgtaaatttcccgttatccgtatatctctaaactcgcgcttaaaaaattcgtcgcgtttcgaaactcgccgaaatctacgtaactaccgattaacgcccgtatcgcgtatcgcgaattttcgcgatccgacgacgatacgaaatttccgaaaacgaaataataaaaaattaccaactccgaatttctaacgtcgcgatatcctaaaatattaaaattacctaatataatatactaacgatcataaactccgcaaatttccgcgatctaacgtccctaatatacgaaatacgctaaaacgtaacgtaaaatacgaaatacctataaacgattatcgtaaataacgaatcgctatataactatataaatcgcgacgaacgacgacgattccgaatcgacaatacctaatttaacgatcgaattacgcgaaaatcgaattctaattacgcgtatcgcgactcgcgaataaaaattccgaatacgcttattcgcaatcgaaaaaaacgttaacgattaccatatataatttctaacctccgatcgtaataaactatacgtataacgtaatacgaaattccctaactatcgaataacgaaaacgaattccgtctcgattccgattcgaattcgatttaaattctaatctatcgtaataattcgtaccgaatacgaaataccgtaacttcgatacgtcgaatcaatcgttacgtaatactaaaaataaaacgtaaaacgtacgattaataataaaacgatcgtacg

SEQ ID NO: 16447 - DNA, 1018 bp, Artificial Sequence
  chemically treated genomic DNA (Homo sapiens) CpG-island No: 16447
gggtgcgagttgcgcgcgtgtcgatcgcgtgttgcggggtcgcgtgggagcggtgtcgtgttttcgattggggttcgggagtcgcgatgttcggcgtggtggattgacggtggcggtgttttagggtgcgagttaggcggcgattcgtgttgtcgttgtgagtttggtttatcggattttttcgttttcggagttcgaggtttcgaggagtggcgtttatgattcgtcgcgtcgttggttcgcgggatcgtcgttgcgcgtaggtttttcgttgttcgtgtatttttaggttcgcgtttggggagttcgtcgcgtttcggggttcgtcgagatttgcgtgattatcgattggcgttcgtgtcgcgtgtcgcgagttttcgcggttcggcggcgatgcgagattttcgggggcggggtggtgggaaattgttagtttcgggtttttggcgtcgcgatgttttagagtgttgagattgtttgatgtggtgtgttggcggttatggatttcgtaggttttcgcggtttggcgtttttgatgtgcgaggtgcgttgaggcgtggcgtggggtgcggggtgtttatgagcgattgtcgtagatggcgggtcgttatgtggttatgtgggtcgcggcgggcgacggcggtttcgggtcggtagtgtttggtttggcggtcgggttgcgcgagagtcgagttttggttacgcgtgtcgcgattcgcgggtgggagtttcgggtgcgtttgttcgtagtcggagggggcgttggcggttgttatgtgtggtttttggttttcggtcgtggtaggttgtgcgtatggcgtagtgcggagttttttagttgtcgggtagcgggagcggatttcgtttcggtttcggttcgagttcggtttgggttttggtttgtcgtgatggttcgtgtcgggtgcgaggtgtcgtggtttcggtgcgtcgagttagtcgttgcgtggtgttgggggtggggcgtggggcgtgcggttggtgatggggcggtcgtgcg

SEQ ID NO: 16448 - DNA, 1018 bp, Artificial Sequence
  chemically treated genomic DNA (Homo sapiens) CpG-island No: 16448
cgcacgaccgccccatcaccaaccgcacgccccacgccccacccccaacaccacgcaacgactaactcgacgcaccgaaaccacgacacctcgcacccgacacgaaccatcacgacaaaccaaaacccaaaccgaactcgaaccgaaaccgaaacgaaatccgctcccgctacccgacaactaaaaaactccgcactacgccatacgcacaacctaccacgaccgaaaaccaaaaaccacacataacaaccgccaacgccccctccgactacgaacaaacgcacccgaaactcccacccgcgaatcgcgacacgcgtaaccaaaactcgactctcgcgcaacccgaccgccaaaccaaacactaccgacccgaaaccgccgtcgcccgccgcgacccacataaccacataacgacccgccatctacgacaatcgctcataaacaccccgcaccccacgccacgcctcaacgcacctcgcacatcaaaaacgccaaaccgcgaaaacctacgaaatccataaccgccaacacaccacatcaaacaatctcaacactctaaaacatcgcgacgccaaaaacccgaaactaacaatttcccaccaccccgcccccgaaaatctcgcatcgccgccgaaccgcgaaaactcgcgacacgcgacacgaacgccaatcgataatcacgcaaatctcgacgaaccccgaaacgcgacgaactccccaaacgcgaacctaaaaatacacgaacaacgaaaaacctacgcgcaacgacgatcccgcgaaccaacgacgcgacgaatcataaacgccactcctcgaaacctcgaactccgaaaacgaaaaaatccgataaaccaaactcacaacgacaacacgaatcgccgcctaactcgcaccctaaaacaccgccaccgtcaatccaccacgccgaacatcgcgactcccgaaccccaatcgaaaacacgacaccgctcccacgcgaccccgcaacacgcgatcgacacgcgcgcaactcgcaccc

SEQ ID NO: 16449 - DNA, 732 bp, Artificial Sequence
  chemically treated genomic DNA (Homo sapiens) CpG-island No: 16449
  misc_feature (392)..(392): n is either a, c, g or t
acgggcgatttaaatttcgtaggcggggaaaatcgagagacgcgatcgtatttattcgtcgacgcgacgcgggtaaatcgtcgcgtaggaattaaatcgagtttttgaagcgacgaaaagttattaattcgttatacgtaaaacgacggatatcgacgcgtaacgacgcgggcgggtttaacgcgggggcgggcgaagattagtagcgagagacgaacgaacgattcgagacgatcgtatattcgcgaaacggagcgggaaggaagggaagcgatacgatttaattacgcgacgtaatgttatttaagtaacgttcggaataggacggggatgagagagcggacgttataagagtcgtaataggacgagtaatacgtattaagacgagggancgcgaatacgttattatatagaatttcgagtcgataacgtacgcgtatcgcgataacgggggggaatcggaaatcgatattaatacggagaatagtcgcgggtaaacgaacgtaataattagattcgcgcgggaaaggaaaacgttcggggatacgaacgagagagaaaaagggaatttttattaggtatcgtagtcggaacgcgatcgcgagcgatcgcgtacgttaataggttcggtacgatatagtaggatacgattattattcggcgcgggagcgaagacgtattacgaaagggggtagttatatcgtcgcggagcgaacgtcgaagataagggcg

SEQ ID NO: 16450 - DNA, 732 bp, Artificial Sequence
  chemically treated genomic DNA (Homo sapiens) CpG-island No: 16450
  misc_feature (341)..(341): n is either a, c, g or t
cgcccttatcttcgacgttcgctccgcgacgatataactaccccctttcgtaatacgtcttcgctcccgcgccgaataataatcgtatcctactatatcgtaccgaacctattaacgtacgcgatcgctcgcgatcgcgttccgactacgatacctaataaaaattccctttttctctctcgttcgtatccccgaacgttttcctttcccgcgcgaatctaattattacgttcgtttacccgcgactattctccgtattaatatcgatttccgattcccccccgttatcgcgatacgcgtacgttatcgactcgaaattctatataataacgtattcgcgntccctcgtcttaatacgtattactcgtcctattacgactcttataacgtccgctctctcatccccgtcctattccgaacgttacttaaataacattacgtcgcgtaattaaatcgtatcgcttcccttccttcccgctccgtttcgcgaatatacgatcgtctcgaatcgttcgttcgtctctcgctactaatcttcgcccgcccccgcgttaaacccgcccgcgtcgttacgcgtcgatatccgtcgttttacgtataacgaattaataacttttcgtcgcttcaaaaactcgatttaattcctacgcgacgatttacccgcgtcgcgtcgacgaataaatacgatcgcgtctctcgattttccccgcctacgaaatttaaatcgcccgt

SEQ ID NO: 16451 - DNA, 732 bp, Artificial Sequence
  chemically treated genomic DNA (Homo sapiens) CpG-island No: 16451
  misc_feature (341)..(341): n is either a, c, g or t
cgtttttgttttcggcgttcgtttcgcggcggtgtagttgttttttttcgtggtgcgttttcgttttcgcgtcgggtggtggtcgtgttttattgtgtcgtgtcgggtttgttggcgtgcgcggtcgttcgcggtcgcgtttcggttgcggtatttagtgggggttttttttttttttttcgttcgtgttttcgggcgtttttttttttcgcgcgggtttggttgttgcgttcgtttgttcgcggttgtttttcgtgttggtgtcggttttcggttttttttcgttgtcgcggtgcgcgtgcgttatcggttcggggttttgtatggtgacgtgttcgcgntttttcgttttgatgcgtgttgttcgttttgttgcggtttttgtggcgttcgtttttttattttcgttttgtttcgggcgttgtttgggtggtattgcgtcgcgtggttgagtcgtgtcgttttttttttttttcgtttcgtttcgcgggtgtgcggtcgtttcgggtcgttcgttcgtttttcgttgttggttttcgttcgttttcgcgttgggttcgttcgcgtcgttgcgcgtcggtgttcgtcgttttgcgtgtggcgggttggtggtttttcgtcgttttaagggttcggtttggtttttgcgcggcggtttgttcgcgtcgcgtcggcgggtaggtgcggtcgcgtttttcggtttttttcgtttgcggggtttgggtcgttcgt

SEQ ID NO: 16452 - DNA, 732 bp, Artificial Sequence
  chemically treated genomic DNA (Homo sapiens) CpG-island No: 16452
  misc_feature (392)..(392): n is either a, c, g or t
acgaacgacccaaaccccgcaaacgaaaaaaaccgaaaaacgcgaccgcacctacccgccgacgcgacgcgaacaaaccgccgcgcaaaaaccaaaccgaacccttaaaacgacgaaaaaccaccaacccgccacacgcaaaacgacgaacaccgacgcgcaacgacgcgaacgaacccaacgcgaaaacgaacgaaaaccaacaacgaaaaacgaacgaacgacccgaaacgaccgcacacccgcgaaacgaaacgaaaaaaaaaaaaaacgacacgactcaaccacgcgacgcaataccacccaaacaacgcccgaaacaaaacgaaaataaaaaaacgaacgccacaaaaaccgcaacaaaacgaacaacacgcatcaaaacgaaaaancgcgaacacgtcaccatacaaaaccccgaaccgataacgcacgcgcaccgcgacaacgaaaaaaaaccgaaaaccgacaccaacacgaaaaacaaccgcgaacaaacgaacgcaacaaccaaacccgcgcgaaaaaaaaaaacgcccgaaaacacgaacgaaaaaaaaaaaaaaaacccccactaaataccgcaaccgaaacgcgaccgcgaacgaccgcgcacgccaacaaacccgacacgacacaataaaacacgaccaccacccgacgcgaaaacgaaaacgcaccacgaaaaaaaacaactacaccgccgcgaaacgaacgccgaaaacaaaaacg

SEQ ID NO: 16453 - DNA, 551 bp, Artificial Sequence
  chemically treated genomic DNA (Homo sapiens) CpG-island No: 16453
ggaatttcgaggggcgggggtttggcgtaggttttcgttcggggttttcgagttgttttattttgcgcgaagtcgttacgttattgttttgattaggaaggcggggtcggcgcggggcggggttggcggcgtcggcgtagttcgggggcggcgggaggaggaggtggcggcggtggcgttgggagtttttgttatcgttggggtcgggtcgggcgggagtgtaggggacgtgagggcgtaagggtcgggatatggggttcgttagtttcgttgttcgcggtttaagtcgtcgttcgggttagtcgtcgttgtcgttgttgttgttattattgttgttgtttttgcgcgcgtagttcgttatcgggagtttggtcggtgggagtttcggcgcggtcgaggtgaggtcgggtcgggttttgggggatgggggaaggggcgggatcgggtttttggacgtcggcgcggatatgtttagggtagaaagcgcggtttttttagttaggtggttagtttttaggcgtttttaattatatttatgaatttagggtttt

SEQ ID NO: 16454 - DNA, 551 bp, Artificial Sequence
  chemically treated genomic DNA (Homo sapiens) CpG-island No: 16454
aaaaccctaaattcataaatataattaaaaacgcctaaaaactaaccacctaactaaaaaaaccgcgctttctaccctaaacatatccgcgccgacgtccaaaaacccgatcccgccccttcccccatcccccaaaacccgacccgacctcacctcgaccgcgccgaaactcccaccgaccaaactcccgataacgaactacgcgcgcaaaaacaacaacaataataacaacaacaacgacaacgacgactaacccgaacgacgacttaaaccgcgaacaacgaaactaacgaaccccatatcccgacccttacgccctcacgtcccctacactcccgcccgacccgaccccaacgataacaaaaactcccaacgccaccgccgccacctcctcctcccgccgcccccgaactacgccgacgccgccaaccccgccccgcgccgaccccgccttcctaatcaaaacaataacgtaacgacttcgcgcaaaataaaacaactcgaaaaccccgaacgaaaacctacgccaaacccccgcccctcgaaattcc

SEQ ID NO: 16455 - DNA, 551 bp, Artificial Sequence
  chemically treated genomic DNA (Homo sapiens) CpG-island No: 16455
ggaattttgggtttataaatgtgattgggggcgtttgggggttgattatttggttggaaagatcgcgttttttgttttggatatgttcgcgtcggcgtttagagattcggtttcgtttttttttttattttttaggattcggttcggttttatttcggtcgcgtcggggtttttatcggttaggttttcgatggcgggttgcgcgcgtagaagtagtagtaatagtggtagtagtagcggtagcggcggttggttcgggcggcgatttagatcgcgagtagcggggttggcgggttttatgtttcggtttttgcgtttttacgttttttgtattttcgttcggttcggttttagcggtgataggagtttttagcgttatcgtcgttatttttttttttcgtcgttttcgggttgcgtcggcgtcgttagtttcgtttcgcgtcggtttcgtttttttggttaggataatagcgtggcggtttcgcgtagagtggagtagttcgggaatttcgggcgggagtttgcgttaggttttcgtttttcgagatttt

SEQ ID NO: 16456 - DNA, 551 bp, Artificial Sequence
  chemically treated genomic DNA (Homo sapiens) CpG-island No: 16456
aaaatctcgaaaaacgaaaacctaacgcaaactcccgcccgaaattcccgaactactccactctacgcgaaaccgccacgctattatcctaaccaaaaaaacgaaaccgacgcgaaacgaaactaacgacgccgacgcaacccgaaaacgacgaaaaaaaaaaataacgacgataacgctaaaaactcctatcaccgctaaaaccgaaccgaacgaaaatacaaaaaacgtaaaaacgcaaaaaccgaaacataaaacccgccaaccccgctactcgcgatctaaatcgccgcccgaaccaaccgccgctaccgctactactaccactattactactacttctacgcgcgcaacccgccatcgaaaacctaaccgataaaaaccccgacgcgaccgaaataaaaccgaaccgaatcctaaaaaataaaaaaaaaaacgaaaccgaatctctaaacgccgacgcgaacatatccaaaacaaaaaacgcgatctttccaaccaaataatcaacccccaaacgcccccaatcacatttataaacccaaaattcc

SEQ ID NO: 16457 - DNA, 566 bp, Artificial Sequence
  chemically treated genomic DNA (Homo sapiens) CpG-island No: 16457
cgggttttcggagagaggtggtttttcgttaaatagaggtttatttttaatatattcgggggaagacgtttttttaataagcgtgggaagagttttttatcggatattttaagaaagttttttgggaacgggggggaaaaaaggttcgggattgaaacggttgggtcggaaggaaaagggaaaggcgaagaaaagagttaaagggagacggtttttttggggcgacggatattcgtaacggatatttattcgattatacgatattttttcggttaaatattttttttatggttttttaggtgtttatcgtatttataattttttttttttaaattattggagtaaatcgcgcgttatataggaatttcgtaaatcgttcgttataatttttaaacgggtttttaaacggaagcgcgttattcggaaaataattcgagatttatatttatatttacgatatgtgataattttaattgcggtgattcgcgaattttttttttcgttttgtttataattgttttaattcgttcgattttaatcggttcgtttattatattagttatatt

SEQ ID NO: 16458 - DNA, 566 bp, Artificial Sequence
  chemically treated genomic DNA (Homo sapiens) CpG-island No: 16458
aatataactaatataataaacgaaccgattaaaatcgaacgaattaaaacaattataaacaaaacgaaaaaaaaaattcgcgaatcaccgcaattaaaattatcacatatcgtaaatataaatataaatctcgaattattttccgaataacgcgcttccgtttaaaaacccgtttaaaaattataacgaacgatttacgaaattcctatataacgcgcgatttactccaataatttaaaaaaaaaaaattataaatacgataaacacctaaaaaaccataaaaaaaatatttaaccgaaaaaatatcgtataatcgaataaatatccgttacgaatatccgtcgccccaaaaaaaccgtctccctttaactcttttcttcgcctttcccttttccttccgacccaaccgtttcaatcccgaaccttttttcccccccgttcccaaaaaactttcttaaaatatccgataaaaaactcttcccacgcttattaaaaaaacgtcttcccccgaatatattaaaaataaacctctatttaacgaaaaaccacctctctccgaaaacccg

SEQ ID NO: 16459 - DNA, 566 bp, Artificial Sequence
  chemically treated genomic DNA (Homo sapiens) CpG-island No: 16459
gatatagttggtgtagtagacggatcgattaaggtcgaacggattgaggtagttatgagtagagcgggaggggaggttcgcgaattatcgtagttgagattgttatatgtcgtgagtgtgggtgtgagtttcgaattgtttttcgggtggcgcgttttcgtttagagattcgtttgagggttgtggcgaacggtttgcgaagtttttatatggcgcgcgatttattttagtggtttggggaggaggagttatgggtgcggtgagtatttaggaggttatggagggggtatttagtcgaggggatgtcgtgtaatcggatgggtgttcgttacgggtgttcgtcgttttaagggggtcgtttttttttggttttttttttcgtttttttttttttttttcggtttaatcgttttagtttcggattttttttttttttcgtttttaagaggtttttttaaaatattcggtggggggttttttttacgtttattagaggagcgttttttttcgaatgtattaaaggtgggtttttgtttagcgagaggttattttttttcggaagttcg

SEQ ID NO: 16460 - DNA, 566 bp, Artificial Sequence
  chemically treated genomic DNA (Homo sapiens) CpG-island No: 16460
cgaacttccgaaaaaaaataacctctcgctaaacaaaaacccacctttaatacattcgaaaaaaaacgctcctctaataaacgtaaaaaaaaccccccaccgaatattttaaaaaaacctcttaaaaacgaaaaaaaaaaaaaatccgaaactaaaacgattaaaccgaaaaaaaaaaaaaaaaacgaaaaaaaaaaccaaaaaaaaacgacccccttaaaacgacgaacacccgtaacgaacacccatccgattacacgacatcccctcgactaaataccccctccataacctcctaaatactcaccgcacccataactcctcctccccaaaccactaaaataaatcgcgcgccatataaaaacttcgcaaaccgttcgccacaaccctcaaacgaatctctaaacgaaaacgcgccacccgaaaaacaattcgaaactcacacccacactcacgacatataacaatctcaactacgataattcgcgaacctcccctcccgctctactcataactacctcaatccgttcgaccttaatcgatccgtctactacaccaactatatc

SEQ ID NO: 16461 - DNA, 689 bp, Artificial Sequence
  chemically treated genomic DNA (Homo sapiens) CpG-island No: 16461
  misc_feature (129)..(129): n is either a, c, g or t
  misc_feature (137)..(137): n is either a, c, g or t
  misc_feature (166)..(166): n is either a, c, g or t
  misc_feature (176)..(176): n is either a, c, g or t
  misc_feature (205)..(205): n is either a, c, g or t
  misc_feature (242)..(242): n is either a, c, g or t
  misc_feature (266)..(266): n is either a, c, g or t
  misc_feature (290)..(290): n is either a, c, g or t
  misc_feature (326)..(326): n is either a, c, g or t
  misc_feature (372)..(372): n is either a, c, g or t
  misc_feature (387)..(388): n is either a, c, g or t
  misc_feature (425)..(425): n is either a, c, g or t
  misc_feature (459)..(459): n is either a, c, g or t
  misc_feature (503)..(503): n is either a, c, g or t
  misc_feature (526)..(526): n is either a, c, g or t
  misc_feature (551)..(551): n is either a, c, g or t
  misc_feature (567)..(567): n is either a, c, g or t
ttagtttcgagagttagggcgcgcggcggaggcgaggtcggggcggttttcgttttttcggtcgttttttttcgcgtcgtttcggttttttttttcggttttcggcgggtatttggcggcggcgggtanggggcggngttgcgcgtcgttcgtcgtcgggggggtntttcggtttngtcgtcgttcgggcgggtcgttcgttttngcgtttcgttttcgcgttcgcggggcgcggcgttcgngtcgtttcgcgtcgttcgcgcggntcgcggtcggcgtcgtttcgtttnttcggcgggcgtcgtttcgcgttttcgtttcgtttnggtaatcgcgcgtttcgcggggtcgcgttcggcggttttttcgatncggttttttcggttnngtcgggcgcgtcgttttcgcgtttttcggtcgcgcgnttcgggcggttcgcgtttttcggcgtcgtcggtntcgggtttcggttcgcggttttttcgtcggttcgggcgcggttntcgtttcggtttcggtttttcgncgggcgtcgttttcgttcgcgggtngtcgtttcgttcgttngcgcggtcgttcgtcgttttttcggggcgcgtttcgcggcgttcgtttttcgtcgtcggcgcgcgcgtcggcgcgttttttcgttcgttttttcgcgttcgtcgttcggcgacggttttcgt

SEQ ID NO: 16462 - DNA, 689 bp, Artificial Sequence
  chemically treated genomic DNA (Homo sapiens) CpG-island No: 16462
  misc_feature (123)..(123): n is either a, c, g or t
  misc_feature (139)..(139): n is either a, c, g or t
  misc_feature (164)..(164): n is either a, c, g or t
  misc_feature (187)..(187): n is either a, c, g or t
  misc_feature (231)..(231): n is either a, c, g or t
  misc_feature (265)..(265): n is either a, c, g or t
  misc_feature (302)..(303): n is either a, c, g or t
  misc_feature (318)..(318): n is either a, c, g or t
  misc_feature (364)..(364): n is either a, c, g or t
  misc_feature (400)..(400): n is either a, c, g or t
  misc_feature (424)..(424): n is either a, c, g or t
  misc_feature (448)..(448): n is either a, c, g or t
  misc_feature (485)..(485): n is either a, c, g or t
  misc_feature (514)..(514): n is either a, c, g or t
  misc_feature (524)..(524): n is either a, c, g or t
  misc_feature (553)..(553): n is either a, c, g or t
  misc_feature (561)..(561): n is either a, c, g or t
acgaaaaccgtcgccgaacgacgaacgcgaaaaaacgaacgaaaaaacgcgccgacgcgcgcgccgacgacgaaaaacgaacgccgcgaaacgcgccccgaaaaaacgacgaacgaccgcgcnaacgaacgaaacgacnacccgcgaacgaaaacgacgcccgncgaaaaaccgaaaccgaaacganaaccgcgcccgaaccgacgaaaaaaccgcgaaccgaaacccganaccgacgacgccgaaaaacgcgaaccgcccgaancgcgcgaccgaaaaacgcgaaaacgacgcgcccgacnnaaccgaaaaaaccgnatcgaaaaaaccgccgaacgcgaccccgcgaaacgcgcgattaccnaaacgaaacgaaaacgcgaaacgacgcccgccgaanaaacgaaacgacgccgaccgcganccgcgcgaacgacgcgaaacgacncgaacgccgcgccccgcgaacgcgaaaacgaaacgcnaaaacgaacgacccgcccgaacgacgacnaaaccgaaanacccccccgacgacgaacgacgcgcaacnccgccccntacccgccgccgccaaatacccgccgaaaaccgaaaaaaaaaaccgaaacgacgcgaaaaaaaacgaccgaaaaaacgaaaaccgccccgacctcgcctccgccgcgcgccctaactctcgaaactaa

SEQ ID NO: 16463 - DNA, 689 bp, Artificial Sequence
  chemically treated genomic DNA (Homo sapiens) CpG-island No: 16463
  misc_feature (123)..(123): n is either a, c, g or t
  misc_feature (139)..(139): n is either a, c, g or t
  misc_feature (164)..(164): n is either a, c, g or t
  misc_feature (187)..(187): n is either a, c, g or t
  misc_feature (231)..(231): n is either a, c, g or t
  misc_feature (265)..(265): n is either a, c, g or t
  misc_feature (302)..(303): n is either a, c, g or t
  misc_feature (318)..(318): n is either a, c, g or t
  misc_feature (364)..(364): n is either a, c, g or t
  misc_feature (400)..(400): n is either a, c, g or t
  misc_feature (424)..(424): n is either a, c, g or t
  misc_feature (448)..(448): n is either a, c, g or t
  misc_feature (485)..(485): n is either a, c, g or t
  misc_feature (514)..(514): n is either a, c, g or t
  misc_feature (524)..(524): n is either a, c, g or t
  misc_feature (553)..(553): n is either a, c, g or t
  misc_feature (561)..(561): n is either a, c, g or t
gcgggggtcgtcgtcgggcggcgggcgcgggggggcgggcgggggggcgcgtcggcgcgcgcgtcggcggcggggggcgggcgtcgcggggcgcgtttcgggggggcggcgggcggtcgcgtnggcgggcggggcggtngttcgcgggcgggggcggcgttcgncggggggtcggggtcggggcggnggtcgcgttcgggtcggcgggggggtcgcgggtcggggttcggngtcggcggcgtcggggggcgcgggtcgttcgggncgcgcggtcggggggcgcgggggcggcgcgttcggtnnggtcgggggggtcgngtcgggggggtcgtcgggcgcggtttcgcggggcgcgcggttgttngggcggggcgggggcgcggggcggcgttcgtcgggngggcggggcggcgtcggtcgcggntcgcgcgggcggcgcggggcggtncgggcgtcgcgtttcgcgggcgcgggggcggggcgtnggggcgggcggttcgttcgggcggcggtngggtcggggngttttttcggcggcgggcggcgcgtagtntcgttttntgttcgtcgtcgttaggtgttcgtcgagggtcggagggaggagtcggggcggcgcgagggggagcggtcgggagggcggaggtcgtttcggtttcgttttcgtcgcgcgttttgattttcgggattgg

SEQ ID NO: 16464 - DNA, 689 bp, Artificial Sequence
  chemically treated genomic DNA (Homo sapiens) CpG-island No: 16464
  misc_feature (129)..(129): n is either a, c, g or t
  misc_feature (137)..(137): n is either a, c, g or t
  misc_feature (166)..(166): n is either a, c, g or t
  misc_feature (176)..(176): n is either a, c, g or t
  misc_feature (205)..(205): n is either a, c, g or t
  misc_feature (242)..(242): n is either a, c, g or t
  misc_feature (266)..(266): n is either a, c, g or t
  misc_feature (290)..(290): n is either a, c, g or t
  misc_feature (326)..(326): n is either a, c, g or t
  misc_feature (372)..(372): n is either a, c, g or t
  misc_feature (387)..(388): n is either a, c, g or t
  misc_feature (425)..(425): n is either a, c, g or t
  misc_feature (459)..(459): n is either a, c, g or t
  misc_feature (503)..(503): n is either a, c, g or t
  misc_feature (526)..(526): n is either a, c, g or t
  misc_feature (551)..(551): n is either a, c, g or t
  misc_feature (567)..(567): n is either a, c, g or t
ccaatcccgaaaatcaaaacgcgcgacgaaaacgaaaccgaaacgacctccgccctcccgaccgctccccctcgcgccgccccgactcctccctccgaccctcgacgaacacctaacgacgacgaacanaaaacganactacgcgccgcccgccgccgaaaaaacnccccgacccnaccgccgcccgaacgaaccgcccgccccnacgccccgcccccgcgcccgcgaaacgcgacgcccgnaccgccccgcgccgcccgcgcganccgcgaccgacgccgccccgcccncccgacgaacgccgccccgcgcccccgccccgcccnaacaaccgcgcgccccgcgaaaccgcgcccgacgacccccccgacncgacccccccgaccnnaccgaacgcgccgcccccgcgccccccgaccgcgcgncccgaacgacccgcgccccccgacgccgccgacnccgaaccccgacccgcgacccccccgccgacccgaacgcgaccnccgccccgaccccgaccccccgncgaacgccgcccccgcccgcgaacnaccgccccgcccgccnacgcgaccgcccgccgcccccccgaaacgcgccccgcgacgcccgccccccgccgccgacgcgcgcgccgacgcgcccccccgcccgcccccccgcgcccgccgcccgacgacgacccccgc

SEQ ID NO: 16465 - DNA, 815 bp, Artificial Sequence
  chemically treated genomic DNA (Homo sapiens) CpG-island No: 16465
tttatttattttcggtttttttatttattttcggtttttttatttatttttaattttttcgtttattttcggttttttcgtttattttcggttttttcgtttagttcggatttttttatttattttcgattttttcgtttattttcgattttttcgtttattttcggttttttcgtttattttcggttatttcgtttattttcggattttttcgtttattttcgattttttcgtttattttcgatttttacgtttattttcggttttttcgtttatgtcggattttacgttattttcggtttttcgttatttcgggttttcgtgtatttcggtttttcgttatattggattttttcgtttatttcgggtttttcggtattttggaattttgcggttattttgggaatttttcggttattttcggggtttttcggtaagattagaaattttcggttaatttttgagattttcgggttaattttcggggtttttcggttaatattcggggtttttttgggtaatatttcggggttttttcgggtaaagttcgggaaattttttcgggtaattttcggggcgttttcggagaaatatttcgggggttttttcggtagaagaacggagaatttttttgggtaaataatcgcggggtttttttgggtaaaatcgcggggggttttgcgggtaatatttcgggggtttttgcggggataatcgggaaattttttgtgtaatataaagagaggttttggagataatatacggggtttttcgagaaaaatttgggggttttcgcgagattagttgggtttttt

SEQ ID NO: 16466 - DNA, 815 bp, Artificial Sequence
  chemically treated genomic DNA (Homo sapiens) CpG-island No: 16466
aaaaaacccaactaatctcgcgaaaacccccaaatttttctcgaaaaaccccgtatattatctccaaaacctctctttatattacacaaaaaatttcccgattatccccgcaaaaacccccgaaatattacccgcaaaaccccccgcgattttacccaaaaaaaccccgcgattatttacccaaaaaaattctccgttcttctaccgaaaaaacccccgaaatatttctccgaaaacgccccgaaaattacccgaaaaaatttcccgaactttacccgaaaaaaccccgaaatattacccaaaaaaaccccgaatattaaccgaaaaaccccgaaaattaacccgaaaatctcaaaaattaaccgaaaatttctaatcttaccgaaaaaccccgaaaataaccgaaaaattcccaaaataaccgcaaaattccaaaataccgaaaaacccgaaataaacgaaaaaatccaatataacgaaaaaccgaaatacacgaaaacccgaaataacgaaaaaccgaaaataacgtaaaatccgacataaacgaaaaaaccgaaaataaacgtaaaaatcgaaaataaacgaaaaaatcgaaaataaacgaaaaaatccgaaaataaacgaaataaccgaaaataaacgaaaaaaccgaaaataaacgaaaaaatcgaaaataaacgaaaaaatcgaaaataaataaaaaaatccgaactaaacgaaaaaaccgaaaataaacgaaaaaaccgaaaataaacgaaaaaattaaaaataaataaaaaaaccgaaaataaataaaaaaaccgaaaataaataaa

SEQ ID NO: 16467 - DNA, 815 bp, Artificial Sequence
  chemically treated genomic DNA (Homo sapiens) CpG-island No: 16467
ggggggtttaattgatttcgcgagggtttttaaatttttttcgagaggtttcgtgtattgtttttaaggtttttttttatgttatataaagagtttttcggttattttcgtagaggttttcgggatattgttcgtaaggtttttcgcggttttgtttagaagggtttcgcggttatttatttaaagggatttttcgtttttttatcgaaagggttttcgggatattttttcgaaggcgtttcggggattgttcgagagggtttttcgggttttgttcgaaggggtttcggggtattgtttaaaagggtttcgggtattggtcgaagggtttcgggaattggttcgagggttttaaggattggtcgagagtttttggttttgtcgaagggtttcgggaatggtcgaagggtttttaggatggtcgtagggttttagaatgtcggagggttcgggatggacggagggatttagtatggcggagggtcgggatgtacgagggttcgggatggcgaagggtcggggatggcgtagggttcggtatggacggagggatcggggatggacgtagggatcggggatggacggagggatcggggatggacggagggattcggggatggacggagtgatcggggatggacggagggatcggggatggacggagggatcggggatggacggagggatcggggatggatggagggattcgggttggacggagggatcggggatggacggagggatcggggatggacggagggattggggatggatggagggatcgaggatggatggagggatcgaggatggatgga

SEQ ID NO: 16468 - DNA, 815 bp, Artificial Sequence
  chemically treated genomic DNA (Homo sapiens) CpG-island No: 16468
tccatccatcctcgatccctccatccatcctcgatccctccatccatccccaatccctccgtccatccccgatccctccgtccatccccgatccctccgtccaacccgaatccctccatccatccccgatccctccgtccatccccgatccctccgtccatccccgatccctccgtccatccccgatcactccgtccatccccgaatccctccgtccatccccgatccctccgtccatccccgatccctacgtccatccccgatccctccgtccataccgaaccctacgccatccccgacccttcgccatcccgaaccctcgtacatcccgaccctccgccatactaaatccctccgtccatcccgaaccctccgacattctaaaaccctacgaccatcctaaaaacccttcgaccattcccgaaacccttcgacaaaaccaaaaactctcgaccaatccttaaaaccctcgaaccaattcccgaaacccttcgaccaatacccgaaacccttttaaacaataccccgaaaccccttcgaacaaaacccgaaaaaccctctcgaacaatccccgaaacgccttcgaaaaaatatcccgaaaaccctttcgataaaaaaacgaaaaatccctttaaataaataaccgcgaaacccttctaaacaaaaccgcgaaaaaccttacgaacaatatcccgaaaacctctacgaaaataaccgaaaaactctttatataacataaaaaaaaaccttaaaaacaatacacgaaacctctcgaaaaaaatttaaaaaccctcgcgaaatcaattaaacccccc

SEQ ID NO: 16469 - DNA, 528 bp, Artificial Sequence
  chemically treated genomic DNA (Homo sapiens) CpG-island No: 16469
ttttaatatttaatttcgtttttaattttattcgtatgcgtaattagaattagtcgacgtaattttcgattttaattcgtaatcgtttttttttattatcgaattttattttttatttttatattttagttcggttattttacgcgtagtatcgaattttatatttttattttgtttcgtatttttcgtttcgttttttatatttttattttgaagtatgatttataattagatttcgacgataaatcgattattcgaattcgatcgtaattttttttttaattaaatttatttattaatttttaattttatttttcgtttttatttttattttgagttatagttttaatttacggtttgtttcgaaatttcgatatttattttttttttatttttagtttaaattttatgtttttttcgattcggattcgtaatcgcgattcgagttttaatcgtattcgtaatggtttcgtaattttaagttaatcgtatttttgcgttaattttatttcgtttttattttatttt

SEQ ID NO: 16470 - DNA, 528 bp, Artificial Sequence
  chemically treated genomic DNA (Homo sapiens) CpG-island No: 16470
aaaataaaataaaaacgaaataaaattaacgcaaaaatacgattaacttaaaattacgaaaccattacgaatacgattaaaactcgaatcgcgattacgaatccgaatcgaaaaaaacataaaatttaaactaaaaataaaaaaaaaataaatatcgaaatttcgaaacaaaccgtaaattaaaactataactcaaaataaaaataaaaacgaaaaataaaattaaaaattaataaataaatttaattaaaaaaaaaattacgatcgaattcgaataatcgatttatcgtcgaaatctaattataaatcatacttcaaaataaaaatataaaaaacgaaacgaaaaatacgaaacaaaataaaaatataaaattcgatactacgcgtaaaataaccgaactaaaatataaaaataaaaaataaaattcgataataaaaaaaaacgattacgaattaaaatcgaaaattacgtcgactaattctaattacgcatacgaataaaattaaaaacgaaattaaatattaaaa

SEQ ID NO: 16471 - DNA, 528 bp, Artificial Sequence
  chemically treated genomic DNA (Homo sapiens) CpG-island No: 16471
agagtggaatgggaacgaggtagggttaacgtaggggtgcgattggtttggggttgcgaggttattacgggtgcgattgaggttcgagtcgcgattgcggattcgggtcggagggagtatggagtttgggttgaggatggaagagggatgggtgtcgggatttcggagtaggtcgtggattggggttgtgatttagaatagagatgggaacggggaatgaggttgggagttgataggtgggtttggttggggagggaattgcgatcggattcgagtgatcggtttgtcgtcgaagtttggttatggattatgttttaggataggggtatggagagcggggcggggagtgcgaaatagagtggggatatggggttcggtattgcgcgtgggatgatcgaattgggatgtgggagtgggaagtagagttcgatgatgagggagagcggttgcgggttgaggtcgaggattgcgtcgattgattttgattgcgtatgcgagtgaggttgaagacggagttaggtgttggga

SEQ ID NO: 16472 - DNA, 528 bp, Artificial Sequence
  chemically treated genomic DNA (Homo sapiens) CpG-island No: 16472
tcccaacacctaactccgtcttcaacctcactcgcatacgcaatcaaaatcaatcgacgcaatcctcgacctcaacccgcaaccgctctccctcatcatcgaactctacttcccactcccacatcccaattcgatcatcccacgcgcaataccgaaccccatatccccactctatttcgcactccccgccccgctctccatacccctatcctaaaacataatccataaccaaacttcgacgacaaaccgatcactcgaatccgatcgcaattccctccccaaccaaacccacctatcaactcccaacctcattccccgttcccatctctattctaaatcacaaccccaatccacgacctactccgaaatcccgacacccatccctcttccatcctcaacccaaactccatactccctccgacccgaatccgcaatcgcgactcgaacctcaatcgcacccgtaataacctcgcaaccccaaaccaatcgcacccctacgttaaccctacctcgttcccattccactct

SEQ ID NO: 16473 - DNA, 749 bp, Artificial Sequence
  chemically treated genomic DNA (Homo sapiens) CpG-island No: 16473
gattttcgttttttacggttatttttttatcgttgtggtacgttatagacgtttttttttcgagacgttaatcgttatacgattcgtatcgtaagagataatttattgcgcgcgtagaatttcgtagttatatttttgtttcggaacggtagtttattttcggaattatatttttgtattcgggatcgatataggtcgacgtttaattcgcgtagtcgatagtaagtagtgtgtatgttagatttattagatcgtaaatttttaattttttgcggttataagtttagtattttaattgtaggtttttcgtcgagttcgtaatttgagcgcgtatgaagggtaggtatttatgtaacgtatgtggtcgtcgtatacgtcgattaacgttataacgtttacgtatgttcgtaaatggttaggattttcgagtgttcgtagaggttattttattgtgaaaatttattagtataattttagaatttgacgcgagtttcgtggaggttgtcgtattcgcgtatatattcgtttagtatacgtcgtagattgttcgttttgtatatttacgttacggatcgcgtcgttaataggatacgtgattagtttttgttatgtttacgatagttagagtacggttttcggttaggatttagaatataaatttagtgttatgatgcgtattttaaataatatataacgtatatacgcgttagtttcgttatttttgtagaatattttcgttttttttatta

SEQ ID NO: 16474 - DNA, 749 bp, Artificial Sequence
  chemically treated genomic DNA (Homo sapiens) CpG-island No: 16474
taataaaaaaaacgaaaatattctacaaaaataacgaaactaacgcgtatatacgttatatattatttaaaatacgcatcataacactaaatttatattctaaatcctaaccgaaaaccgtactctaactatcgtaaacataacaaaaactaatcacgtatcctattaacgacgcgatccgtaacgtaaatatacaaaacgaacaatctacgacgtatactaaacgaatatatacgcgaatacgacaacctccacgaaactcgcgtcaaattctaaaattatactaataaattttcacaataaaataacctctacgaacactcgaaaatcctaaccatttacgaacatacgtaaacgttataacgttaatcgacgtatacgacgaccacatacgttacataaatacctacccttcatacgcgctcaaattacgaactcgacgaaaaacctacaattaaaatactaaacttataaccgcaaaaaattaaaaatttacgatctaataaatctaacatacacactacttactatcgactacgcgaattaaacgtcgacctatatcgatcccgaatacaaaaatataattccgaaaataaactaccgttccgaaacaaaaatataactacgaaattctacgcgcgcaataaattatctcttacgatacgaatcgtataacgattaacgtctcgaaaaaaaaacgtctataacgtaccacaacgataaaaaaataaccgtaaaaaacgaaaatc

SEQ ID NO: 16475 - DNA, 749 bp, Artificial Sequence
  chemically treated genomic DNA (Homo sapiens) CpG-island No: 16475
tggtggagggagcggggatattttgtagggatggcggggttaacgcgtgtgtgcgttgtgtgttatttggggtacgtattatgatattagatttgtgttttggattttggtcgagagtcgtgttttggttatcgtgggtatgatagaagttagttacgtattttgttggcgacgcggttcgtggcgtggatgtatagagcgggtagtttacggcgtgtgttgagcgagtgtgtacgcggatgcggtagtttttacggagttcgcgttaggttttagaattgtgttggtaagtttttatagtggggtagtttttgcgagtattcgggagttttagttatttgcgaatatacgtgagcgttatgacgttagtcggcgtgtgcggcgattatatgcgttatatagatgtttattttttatgcgcgtttagattacgggttcggcgagagatttgtagttgggatgttggatttgtgatcgtaggaggttagaggtttgcggtttagtgaatttagtatgtatattatttgttgtcggttgcgcgggttgggcgtcggtttatgtcgatttcgggtgtaagagtgtgatttcggaaataggttgtcgtttcgaagtaagagtatgattacggagttttgcgcgcgtagtggattattttttgcgatacgaatcgtgtagcggttgacgtttcggaaaggaagcgtttgtggcgtgttatagcggtggaaaagtgatcgtggggggcgggggtt

SEQ ID NO: 16476 - DNA, 749 bp, Artificial Sequence
  chemically treated genomic DNA (Homo sapiens) CpG-island No: 16476
aacccccgccccccacgatcacttttccaccgctataacacgccacaaacgcttcctttccgaaacgtcaaccgctacacgattcgtatcgcaaaaaataatccactacgcgcgcaaaactccgtaatcatactcttacttcgaaacgacaacctatttccgaaatcacactcttacacccgaaatcgacataaaccgacgcccaacccgcgcaaccgacaacaaataatatacatactaaattcactaaaccgcaaacctctaacctcctacgatcacaaatccaacatcccaactacaaatctctcgccgaacccgtaatctaaacgcgcataaaaaataaacatctatataacgcatataatcgccgcacacgccgactaacgtcataacgctcacgtatattcgcaaataactaaaactcccgaatactcgcaaaaactaccccactataaaaacttaccaacacaattctaaaacctaacgcgaactccgtaaaaactaccgcatccgcgtacacactcgctcaacacacgccgtaaactacccgctctatacatccacgccacgaaccgcgtcgccaacaaaatacgtaactaacttctatcatacccacgataaccaaaacacgactctcgaccaaaatccaaaacacaaatctaatatcataatacgtaccccaaataacacacaacgcacacacgcgttaaccccgccatccctacaaaatatccccgctccctccacca

SEQ ID NO: 16477 - DNA, 605 bp, Artificial Sequence
  chemically treated genomic DNA (Homo sapiens) CpG-island No: 16477
gggttgcgtgggggtatcgtcgattgtataggacgcggtttcggttcgcgtagtttcgtaggcggcgttagagcgtattgttcgtttcgtgatttcggtttatagttcggtcgggcggagttaggggcgggtttttgcgtttttgggcgttggagcgcggcgattattacgtcgcgtggcggacggacggattgacggacgcgtagttttattcgaaaggttatggcggagtacgtttttcgtcgttgttgtttgggttgggattttagtacgtagtaggtatagtcgtttggtcgtagggttacggggttcgtttttttcgtttcggtgggggtagggggcgggttgttattcggacgcgggaaaatatgggttcggtcgcgggcgcgtttatttttcgggtttttcggggttttcgcgtttttgttttgcgcgcggtcgtggggcgtcggtgttttcgttcggagatgttttgttaatgttattcgttcgtaagatgcggtttcgatttcgtttggatttagttattttaggaaattgtaggcgtttttcggtaggattttcggtgtttagaggggtcggaggattcggcgggtttttgcgtt

SEQ ID NO: 16478 - DNA, 605 bp, Artificial Sequence
  chemically treated genomic DNA (Homo sapiens) CpG-island No: 16478
aacgcaaaaacccgccgaatcctccgacccctctaaacaccgaaaatcctaccgaaaaacgcctacaatttcctaaaataactaaatccaaacgaaatcgaaaccgcatcttacgaacgaataacattaacaaaacatctccgaacgaaaacaccgacgccccacgaccgcgcgcaaaacaaaaacgcgaaaaccccgaaaaacccgaaaaataaacgcgcccgcgaccgaacccatattttcccgcgtccgaataacaacccgccccctacccccaccgaaacgaaaaaaacgaaccccgtaaccctacgaccaaacgactatacctactacgtactaaaatcccaacccaaacaacaacgacgaaaaacgtactccgccataacctttcgaataaaactacgcgtccgtcaatccgtccgtccgccacgcgacgtaataatcgccgcgctccaacgcccaaaaacgcaaaaacccgcccctaactccgcccgaccgaactataaaccgaaatcacgaaacgaacaatacgctctaacgccgcctacgaaactacgcgaaccgaaaccgcgtcctatacaatcgacgatacccccacgcaaccc

SEQ ID NO: 16479 - DNA, 605 bp, Artificial Sequence
  chemically treated genomic DNA (Homo sapiens) CpG-island No: 16479
agcgtaggaattcgtcgagtttttcggtttttttgggtatcgggggttttgtcgaggagcgtttgtagttttttggggtagttgggtttaggcggggtcgaggtcgtattttgcgagcgggtggtattggtagggtattttcgggcgagggtatcggcgttttacggtcgcgcgtagggtaggggcgcgggggtttcgggaagttcgagaggtaggcgcgttcgcggtcgggtttatgttttttcgcgttcgggtgatagttcgttttttatttttatcgaagcggagggagcgggtttcgtggttttgcgattaggcgattgtatttgttgcgtgttgaagttttagtttaggtagtagcggcgaggggcgtgtttcgttatggtttttcgggtaaggttgcgcgttcgttagttcgttcgttcgttacgcggcgtgatagtcgtcgcgttttagcgtttagagacgtaggggttcgtttttagtttcgttcggtcggattgtggatcggagttacgaggcgggtaatgcgttttggcgtcgtttgcggggttacgcgagtcgggatcgcgttttgtgtaatcgacggtgtttttacgtagttt

SEQ ID NO: 16480 - DNA, 605 bp, Artificial Sequence
  chemically treated genomic DNA (Homo sapiens) CpG-island No: 16480
aaactacgtaaaaacaccgtcgattacacaaaacgcgatcccgactcgcgtaaccccgcaaacgacgccaaaacgcattacccgcctcgtaactccgatccacaatccgaccgaacgaaactaaaaacgaacccctacgtctctaaacgctaaaacgcgacgactatcacgccgcgtaacgaacgaacgaactaacgaacgcgcaaccttacccgaaaaaccataacgaaacacgcccctcgccgctactacctaaactaaaacttcaacacgcaacaaatacaatcgcctaatcgcaaaaccacgaaacccgctccctccgcttcgataaaaataaaaaacgaactatcacccgaacgcgaaaaaacataaacccgaccgcgaacgcgcctacctctcgaacttcccgaaacccccgcgcccctaccctacgcgcgaccgtaaaacgccgataccctcgcccgaaaataccctaccaataccacccgctcgcaaaatacgacctcgaccccgcctaaacccaactaccccaaaaaactacaaacgctcctcgacaaaacccccgatacccaaaaaaaccgaaaaactcgacgaattcctacgct

SEQ ID NO: 16481 - DNA, 604 bp, Artificial Sequence
  chemically treated genomic DNA (Homo sapiens) CpG-island No: 16481
  misc_feature (155)..(155): n is either a, c, g or t
  misc_feature (491)..(491): n is either a, c, g or t
tcgcgtttttttttttttcgtttataaaaaaaattcgaggttttcgtcgttatattttatttaacgtcgggtatttttcgcgtagttaatacgttttattttatttattatttttacggacgcgtttatttatcgatcgtcgagcgtttttcgtngaatttttaatcgtttttttttttatttttttaagttaggagcggaaggagacgtaaaatcgtcgtttataatcgtttttcgtcgtttttttttcgttaatattttttaattagtacgcgattcgcgcggcgtcgcgttttttagttaagggcgcggagggtacgttcgtttttacgtatcgcgaggcgggaaggatcggcgcggcgttcgagggtcgtaggaggcgagtcgcgttcgattatatatcgttcggcggattttcggtattttattagtcgagcgttttaaagtacggcgtcgcggcggtttatagacggatttattattcgtttcgngtttatcgtaaatttagttatcgcgatacgtcgcgcgttttatcgcgtatcgattatagtttatatttagaaataagatatttttacggtcgtcgcgtacgtacgttcgagcg

SEQ ID NO: 16482 - DNA, 604 bp, Artificial Sequence
  chemically treated genomic DNA (Homo sapiens) CpG-island No: 16482
  misc_feature (114)..(114): n is either a, c, g or t
  misc_feature (450)..(450): n is either a, c, g or t
cgctcgaacgtacgtacgcgacgaccgtaaaaatatcttatttctaaatataaactataatcgatacgcgataaaacgcgcgacgtatcgcgataactaaatttacgataaacncgaaacgaataataaatccgtctataaaccgccgcgacgccgtactttaaaacgctcgactaataaaataccgaaaatccgccgaacgatatataatcgaacgcgactcgcctcctacgaccctcgaacgccgcgccgatccttcccgcctcgcgatacgtaaaaacgaacgtaccctccgcgcccttaactaaaaaacgcgacgccgcgcgaatcgcgtactaattaaaaaatattaacgaaaaaaaaacgacgaaaaacgattataaacgacgattttacgtctccttccgctcctaacttaaaaaaataaaaaaaaaaacgattaaaaattcnacgaaaaacgctcgacgatcgataaataaacgcgtccgtaaaaataataaataaaataaaacgtattaactacgcgaaaaatacccgacgttaaataaaatataacgacgaaaacctcgaattttttttataaacgaaaaaaaaaaaaacgcga

SEQ ID NO: 16483 - DNA, 604 bp, Artificial Sequence
  chemically treated genomic DNA (Homo sapiens) CpG-island No: 16483
  misc_feature (114)..(114): n is either a, c, g or t
  misc_feature (450)..(450): n is either a, c, g or t
cgttcgggcgtgcgtgcgcggcggtcgtgggggtgttttgtttttgggtgtgggttgtggtcggtgcgcggtggggcgcgcggcgtgtcgcggtggttgggtttgcggtgggtncggggcgggtggtgggttcgtttgtgggtcgtcgcggcgtcgtgttttggggcgttcggttggtggggtgtcgggggttcgtcgggcggtgtgtggtcgggcgcggttcgttttttgcggttttcgggcgtcgcgtcggtttttttcgtttcgcggtgcgtgggggcgggcgtgtttttcgcgtttttggttggggggcgcggcgtcgcgcgggtcgcgtgttggttggggggtgttggcggggggggggcggcggggggcggttgtgggcggcggttttgcgttttttttcgtttttggtttgggggggtgggggggggggcggttgggggtttngcggggggcgttcggcggtcggtgggtgggcgcgttcgtgggggtggtgggtggggtggggcgtgttggttgcgcggggggtgttcggcgttgggtggggtgtggcggcgggggtttcgggttttttttgtgggcggggggggggggggcgcgg

SEQ ID NO: 16484 - DNA, 604 bp, Artificial Sequence
  chemically treated genomic DNA (Homo sapiens) CpG-island No: 16484
  misc_feature (155)..(155): n is either a, c, g or t
  misc_feature (491)..(491): n is either a, c, g or t
ccgcgccccccccccccccgcccacaaaaaaaacccgaaacccccgccgccacaccccacccaacgccgaacaccccccgcgcaaccaacacgccccaccccacccaccacccccacgaacgcgcccacccaccgaccgccgaacgccccccgcnaaacccccaaccgcccccccccccacccccccaaaccaaaaacgaaaaaaaacgcaaaaccgccgcccacaaccgccccccgccgccccccccccgccaacaccccccaaccaacacgcgacccgcgcgacgccgcgccccccaaccaaaaacgcgaaaaacacgcccgcccccacgcaccgcgaaacgaaaaaaaccgacgcgacgcccgaaaaccgcaaaaaacgaaccgcgcccgaccacacaccgcccgacgaacccccgacaccccaccaaccgaacgccccaaaacacgacgccgcgacgacccacaaacgaacccaccacccgccccgnacccaccgcaaacccaaccaccgcgacacgccgcgcgccccaccgcgcaccgaccacaacccacacccaaaaacaaaacacccccacgaccgccgcgcacgcacgcccgaacg

SEQ ID NO: 16485 - DNA, 815 bp, Artificial Sequence
  chemically treated genomic DNA (Homo sapiens) CpG-island No: 16485
cgagtagtcgcgggcgaggtcggacgtatcgttttgggtttagttttcgtcgcgttcgggttacgaattttttgcgggtcgaagtcgcgttcgagcgaagttgggagcgcgcggttcggtggtttcgttgtttaggtttgggcgtgtagcggagggagcggcgcggttgtcggagggcggcgagggcgttcggtcgggtcgtttttgcgttttcgtttttttcgttttatattttggggatcgggaggcggcgcgtttttagatcgtcggtcgcgcgtttgtttgttcgggttcgttcgttgggcgggaaggtgtcgcggcgcgtagacgggtttttcgcggcgggcgtttttattttcggtttcgcgttttcggtgtcggttaaaggcggtttcgggttcgcgtttcggtttttagcgttttcgggtcgcgtcgatttttagtttcgcgtcgcgtcgcgtttatggttttcgacgagggtaattcgcgttcgtcgcgcgttttttcgttcgttggtttcgtcgttcgcgttttggtgttcggcgttcggtttcgcgcgacgttacgttcggaggcgtcgtattgtttttcggaggaggcggtcgagcggcgttggggcggttcgggagttgtagttgcgtttttaaggcgcgtcggcgttatttcgtggtcgtagtttcgttgtgcgttttgttcggggtcgtgcggggttgggacgtcgaggattagtttcgaggacgggcgggcgggggtttttgtttttttttttgagttaagtagttttttagggcgttattagtttcgagggtcgaaag

SEQ ID NO: 16486 - DNA, 815 bp, Artificial Sequence
  chemically treated genomic DNA (Homo sapiens) CpG-island No: 16486
ctttcgaccctcgaaactaataacgccctaaaaaactacttaactcaaaaaaaaaaacaaaaacccccgcccgcccgtcctcgaaactaatcctcgacgtcccaaccccgcacgaccccgaacaaaacgcacaacgaaactacgaccacgaaataacgccgacgcgccttaaaaacgcaactacaactcccgaaccgccccaacgccgctcgaccgcctcctccgaaaaacaatacgacgcctccgaacgtaacgtcgcgcgaaaccgaacgccgaacaccaaaacgcgaacgacgaaaccaacgaacgaaaaaacgcgcgacgaacgcgaattaccctcgtcgaaaaccataaacgcgacgcgacgcgaaactaaaaatcgacgcgacccgaaaacgctaaaaaccgaaacgcgaacccgaaaccgcctttaaccgacaccgaaaacgcgaaaccgaaaataaaaacgcccgccgcgaaaaacccgtctacgcgccgcgacaccttcccgcccaacgaacgaacccgaacaaacaaacgcgcgaccgacgatctaaaaacgcgccgcctcccgatccccaaaatataaaacgaaaaaaacgaaaacgcaaaaacgacccgaccgaacgccctcgccgccctccgacaaccgcgccgctccctccgctacacgcccaaacctaaacaacgaaaccaccgaaccgcgcgctcccaacttcgctcgaacgcgacttcgacccgcaaaaaattcgtaacccgaacgcgacgaaaactaaacccaaaacgatacgtccgacctcgcccgcgactactcg

SEQ ID NO: 16487 - DNA, 815 bp, Artificial Sequence
  chemically treated genomic DNA (Homo sapiens) CpG-island No: 16487
ttttcggttttcggggttggtggcgttttgggaagttgtttggtttaggggaaggagtagggattttcgttcgttcgttttcgaagttggttttcggcgttttagtttcgtacggtttcgggtagggcgtatagcggggttgcggttacgaggtggcgtcggcgcgttttggaagcgtagttgtagttttcgggtcgttttagcgtcgttcggtcgtttttttcgaggaataatgcggcgttttcgggcgtagcgtcgcgcggggtcggacgtcggatattagagcgcgggcggcggagttagcgggcgagagagcgcgcggcgggcgcgggttgttttcgtcgagagttatgggcgcggcgcggcgcggggttgaggatcggcgcggttcggaggcgttggggatcggggcgcgggttcggggtcgtttttagtcggtatcgagggcgcggggtcggggatgagggcgttcgtcgcggggagttcgtttgcgcgtcgcggtattttttcgtttagcgagcgagttcgagtaggtagacgcgcggtcggcggtttgggggcgcgtcgtttttcggtttttaaaatgtgaagcggggagggcggagacgtagagacggttcggtcgggcgttttcgtcgtttttcggtagtcgcgtcgtttttttcgttgtacgtttaggtttgagtagcgaggttatcgggtcgcgcgtttttagtttcgttcggacgcggtttcggttcgtagagggttcgtggttcggacgcggcgagagttgggtttaggacggtgcgttcggtttcgttcgcggttgttcg

SEQ ID NO: 16488 - DNA, 815 bp, Artificial Sequence
  chemically treated genomic DNA (Homo sapiens) CpG-island No: 16488
cgaacaaccgcgaacgaaaccgaacgcaccgtcctaaacccaactctcgccgcgtccgaaccacgaaccctctacgaaccgaaaccgcgtccgaacgaaactaaaaacgcgcgacccgataacctcgctactcaaacctaaacgtacaacgaaaaaaacgacgcgactaccgaaaaacgacgaaaacgcccgaccgaaccgtctctacgtctccgccctccccgcttcacattttaaaaaccgaaaaacgacgcgcccccaaaccgccgaccgcgcgtctacctactcgaactcgctcgctaaacgaaaaaataccgcgacgcgcaaacgaactccccgcgacgaacgccctcatccccgaccccgcgccctcgataccgactaaaaacgaccccgaacccgcgccccgatccccaacgcctccgaaccgcgccgatcctcaaccccgcgccgcgccgcgcccataactctcgacgaaaacaacccgcgcccgccgcgcgctctctcgcccgctaactccgccgcccgcgctctaatatccgacgtccgaccccgcgcgacgctacgcccgaaaacgccgcattattcctcgaaaaaaacgaccgaacgacgctaaaacgacccgaaaactacaactacgcttccaaaacgcgccgacgccacctcgtaaccgcaaccccgctatacgccctacccgaaaccgtacgaaactaaaacgccgaaaaccaacttcgaaaacgaacgaacgaaaatccctactccttcccctaaaccaaacaacttcccaaaacgccaccaaccccgaaaaccgaaaa

SEQ ID NO: 16489 - DNA, 791 bp, Artificial Sequence
  chemically treated genomic DNA (Homo sapiens) CpG-island No: 16489
tttcggcgcggtatttacgtagagtttaaggagtagttttcgattttttttcggagggtcgtgtaggttttttcggcggtttttatttgcgttttcgttcgttagcggcgttggggaaggggagggagcggttcggacgttgttcgtcgcgcgtagggagtcgttcgtcgtaggttttgtcgtcgttcgttcgcgtttttttcgcgagtttcggagggcgggtttgcggtcgagttagcggcggcggaggggtagcgtagatttttgcggttcgggcgggcgcggcgcgggagttttgggtcgttggcgggtaacgtttttgttcgatttcgttggggaaggttggcgttgttgttcggtcggagttaggggtaggttgcgtaaaggtgatttagggagattttgcgggtcgttttgggtcgcgtttttcggatcggttcgtttcggttcgattggaggggaggaggaggagtaggtcgagcgtattcgcgttggagtttgcgaggagcgtagggtggagcgcgttagtcggggttttcggatttggtttaggtaggtgggtgtatttgtagttcggtggttttgcggggtagtttggggttacggaggacgtcgggggacggagcggggagggcggttagatttgatttagggatgtgagtagatttaagaatagttggacgtgtgtgtgtagagtggggtgtagtcgcgggcgcgtggggaggggcgtattagtcgggagattttgttttttttttagtgcgggtttttttgtcgtggggtttttgtag

SEQ ID NO: 16490 - DNA, 791 bp, Artificial Sequence
  chemically treated genomic DNA (Homo sapiens) CpG-island No: 16490
ctacaaaaaccccacgacaaaaaaacccgcactaaaaaaaaaacaaaatctcccgactaatacgcccctccccacgcgcccgcgactacaccccactctacacacacacgtccaactattcttaaatctactcacatccctaaatcaaatctaaccgccctccccgctccgtcccccgacgtcctccgtaaccccaaactaccccgcaaaaccaccgaactacaaatacacccacctacctaaaccaaatccgaaaaccccgactaacgcgctccaccctacgctcctcgcaaactccaacgcgaatacgctcgacctactcctcctcctcccctccaatcgaaccgaaacgaaccgatccgaaaaacgcgacccaaaacgacccgcaaaatctccctaaatcacctttacgcaacctacccctaactccgaccgaacaacaacgccaaccttccccaacgaaatcgaacaaaaacgttacccgccaacgacccaaaactcccgcgccgcgcccgcccgaaccgcaaaaatctacgctacccctccgccgccgctaactcgaccgcaaacccgccctccgaaactcgcgaaaaaaacgcgaacgaacgacgacaaaacctacgacgaacgactccctacgcgcgacgaacaacgtccgaaccgctccctccccttccccaacgccgctaacgaacgaaaacgcaaataaaaaccgccgaaaaaacctacacgaccctccgaaaaaaaatcgaaaactactccttaaactctacgtaaataccgcgccgaaa

SEQ ID NO: 16491 - DNA, 791 bp, Artificial Sequence
  chemically treated genomic DNA (Homo sapiens) CpG-island No: 16491
ttgtaggaattttacggtagggagattcgtattgggaagagagtagggtttttcggttggtgcgtttttttttacgcgttcgcggttgtattttattttgtatatatacgtttaattatttttggatttatttatatttttggattaagtttggtcgtttttttcgtttcgtttttcggcgtttttcgtggttttaggttgtttcgtaaagttatcgagttgtaaatatatttatttatttgggttagattcgaggatttcggttggcgcgttttattttgcgtttttcgtaagttttagcgcgaatgcgttcggtttgttttttttttttttttttagtcgagtcgaggcgagtcgattcgggaggcgcgatttagggcggttcgtaaggtttttttaagttatttttgcgtagtttgtttttggtttcggtcgggtagtagcgttagttttttttagcgaggtcgggtagaggcgttgttcgttagcggtttaggattttcgcgtcgcgttcgttcgggtcgtagaggtttgcgttgttttttcgtcgtcgttggttcggtcgtagattcgtttttcggggttcgcggggagagcgcgggcgggcggcggtaaggtttgcggcgggcggttttttgcgcgcggcgggtagcgttcgggtcgttttttttttttttttagcgtcgttggcgggcggaggcgtaggtagggatcgtcggggaagtttgtacggtttttcgaggagaggtcggggattgttttttgggttttacgtgagtgtcgcgtcgagg

SEQ ID NO: 16492 - DNA, 791 bp, Artificial Sequence
  chemically treated genomic DNA (Homo sapiens) CpG-island No: 16492
cctcgacgcgacactcacgtaaaacccaaaaaacaatccccgacctctcctcgaaaaaccgtacaaacttccccgacgatccctacctacgcctccgcccgccaacgacgctaaaaaaaaaaaaaaaacgacccgaacgctacccgccgcgcgcaaaaaaccgcccgccgcaaaccttaccgccgcccgcccgcgctctccccgcgaaccccgaaaaacgaatctacgaccgaaccaacgacgacgaaaaaacaacgcaaacctctacgacccgaacgaacgcgacgcgaaaatcctaaaccgctaacgaacaacgcctctacccgacctcgctaaaaaaaactaacgctactacccgaccgaaaccaaaaacaaactacgcaaaaataacttaaaaaaaccttacgaaccgccctaaatcgcgcctcccgaatcgactcgcctcgactcgactaaaaaaaaaaaaaaaaaacaaaccgaacgcattcgcgctaaaacttacgaaaaacgcaaaataaaacgcgccaaccgaaatcctcgaatctaacccaaataaataaatatatttacaactcgataactttacgaaacaacctaaaaccacgaaaaacgccgaaaaacgaaacgaaaaaaacgaccaaacttaatccaaaaatataaataaatccaaaaataattaaacgtatatatacaaaataaaatacaaccgcgaacgcgtaaaaaaaaacgcaccaaccgaaaaaccctactctcttcccaatacgaatctccctaccgtaaaattcctacaa

SEQ ID NO: 16493 - DNA, 934 bp, Artificial Sequence
  chemically treated genomic DNA (Homo sapiens) CpG-island No: 16493
cgcggttttttttattttttcgtttttcgttgtcgtcgtcgtcgtcgtttttggatttggacggatttagtggtcgttgtcgttttcgtagggtcgggtattatttttcgtttgcggtggtttcgtcgattttttcgcggttgttgtttcgttcgcgtcggcggaaggagacgcgttgcgcgtcgtcgttgttcggggagggagacggagtagtattggtcgcggcgcggtggcggcggttgggttgtttcggggttttcgacggtcgcgttgggttttgttttagtttttttgtgtggcgttgtagtataaggttgcgaatttgggagtttaaaggagtgtttgcggggagggttcgaggtcgttgtgttcggggtagagcggtcggttcgtttcgagtttgcgttttttcgggttcgttgttgtgtttcggttcgttttttttagtatgagcggtcggtaggagtgaggttttatcggttttttcgtattggaggaggtagcggtcgtttcggtagcgatagttatggcggtagagacgcgggtagagttggtgggtaagcggtttttgtgtgtggcggtcggcgacgaggtacgttcggagcgttgggagagcggacgcggttggcgaagttggcgagcgggggttattcgagtcgtgttatatagggatagtcgtaattcggatttggcggtaagagagttagcgtttttttttttttttgtcgcgttcgtattcggttttcgtagacgtattttgtaggtttttttttggcgtttcgtttagttcggttaattggcggttacgtttttttgttgaatttttggcgcgtttgttcgtattttttgtttgggtttttgcgttttttcgagcggttttttttgtggaggtggtgtcggagtaggattttcgggatagtcgcggaggttgttt

SEQ ID NO: 16494 - DNA, 934 bp, Artificial Sequence
  chemically treated genomic DNA (Homo sapiens) CpG-island No: 16494
aaacaacctccgcgactatcccgaaaatcctactccgacaccacctccacaaaaaaaaccgctcgaaaaaacgcaaaaacccaaacaaaaaatacgaacaaacgcgccaaaaattcaacaaaaaaacgtaaccgccaattaaccgaactaaacgaaacgccaaaaaaaaacctacaaaatacgtctacgaaaaccgaatacgaacgcgacaaaaaaaaaaaaaaacgctaactctcttaccgccaaatccgaattacgactatccctatataacacgactcgaataacccccgctcgccaacttcgccaaccgcgtccgctctcccaacgctccgaacgtacctcgtcgccgaccgccacacacaaaaaccgcttacccaccaactctacccgcgtctctaccgccataactatcgctaccgaaacgaccgctacctcctccaatacgaaaaaaccgataaaacctcactcctaccgaccgctcatactaaaaaaaacgaaccgaaacacaacaacgaacccgaaaaaacgcaaactcgaaacgaaccgaccgctctaccccgaacacaacgacctcgaaccctccccgcaaacactcctttaaactcccaaattcgcaaccttatactacaacgccacacaaaaaaactaaaacaaaacccaacgcgaccgtcgaaaaccccgaaacaacccaaccgccgccaccgcgccgcgaccaatactactccgtctccctccccgaacaacgacgacgcgcaacgcgtctccttccgccgacgcgaacgaaacaacaaccgcgaaaaaatcgacgaaaccaccgcaaacgaaaaataatacccgaccctacgaaaacgacaacgaccactaaatccgtccaaatccaaaaacgacgacgacgacgacaacgaaaaacgaaaaaataaaaaaaaccgcg

SEQ ID NO: 16495 - DNA, 934 bp, Artificial Sequence
  chemically treated genomic DNA (Homo sapiens) CpG-island No: 16495
gggtagttttcgcggttatttcgggagttttgtttcgatattatttttataggggaagtcgttcggagagacgtagggatttaggtaagggatgcgggtaaacgcgttaagggtttagtagaggggcgtgatcgttagttggtcgggttgagcgaggcgttagagggaagtttgtaaggtacgtttgcgagagtcgggtgcgggcgcggtaggggaaaaggggggcgttgatttttttatcgttaggttcggattgcggttgtttttgtgtgatacggttcggatgattttcgttcgttagtttcgttagtcgcgttcgtttttttagcgtttcgaacgtgtttcgtcgtcgatcgttatatataggaatcgtttatttattagttttgttcgcgtttttatcgttatagttgtcgttgtcgaagcggtcgttgttttttttagtgcgagggaatcgatgaaattttatttttatcggtcgtttatgttgaggagagcggatcgggatatagtagcggattcgaaagagcgtagattcgggacgaatcggtcgttttgtttcggatatagcgatttcgggtttttttcgtaaatatttttttggatttttagattcgtagttttgtgttgtagcgttatataagaaaattgaaataaaatttaacgcggtcgtcgaagatttcgaggtagtttagtcgtcgttatcgcgtcgcggttagtattgtttcgttttttttttcgggtagcggcggcgcgtagcgcgttttttttcgtcggcgcgggcggggtagtagtcgcgggagggtcggcggaattatcgtagacggaaagtagtgttcggttttgcggaggcggtagcggttattgggttcgtttagatttagaggcggcggcggcggcggtagcgggagacgaaaaaatgaagagggtcgcg

SEQ ID NO: 16496 - DNA, 934 bp, Artificial Sequence
  chemically treated genomic DNA (Homo sapiens) CpG-island No: 16496
cgcgaccctcttcattttttcgtctcccgctaccgccgccgccgccgcctctaaatctaaacgaacccaataaccgctaccgcctccgcaaaaccgaacactactttccgtctacgataattccgccgaccctcccgcgactactaccccgcccgcgccgacgaaaaaaaacgcgctacgcgccgccgctacccgaaaaaaaaaacgaaacaatactaaccgcgacgcgataacgacgactaaactacctcgaaatcttcgacgaccgcgttaaattttatttcaattttcttatataacgctacaacacaaaactacgaatctaaaaatccaaaaaaatatttacgaaaaaaacccgaaatcgctatatccgaaacaaaacgaccgattcgtcccgaatctacgctctttcgaatccgctactatatcccgatccgctctcctcaacataaacgaccgataaaaataaaatttcatcgattccctcgcactaaaaaaaacaacgaccgcttcgacaacgacaactataacgataaaaacgcgaacaaaactaataaataaacgattcctatatataacgatcgacgacgaaacacgttcgaaacgctaaaaaaacgaacgcgactaacgaaactaacgaacgaaaatcatccgaaccgtatcacacaaaaacaaccgcaatccgaacctaacgataaaaaaatcaacgccccccttttcccctaccgcgcccgcacccgactctcgcaaacgtaccttacaaacttccctctaacgcctcgctcaacccgaccaactaacgatcacgcccctctactaaacccttaacgcgtttacccgcatcccttacctaaatccctacgtctctccgaacgacttcccctataaaaataatatcgaaacaaaactcccgaaataaccgcgaaaactaccc

SEQ ID NO: 16497 - DNA, 531 bp, Artificial Sequence
  chemically treated genomic DNA (Homo sapiens) CpG-island No: 16497
gttttcggcgtcggtttcgcgcgtcgtttttttcgttttcgttttcgtttttcgattttcgcgcgcgcggttttgtgggtaacgcggggtcgttaggtgatagttaatggcggcggtcgtttgaggcgggcgggcggtatagagcgggcggtaggaggtaagtagcgaaattttttcggtcgtcgttttcgtttcgacggcggtttttttaaggcggtaggattcggcgcgttatggataggtcggcggcggcggcggcggcgggttgcgagggcggcgggggttcgaattcggggtcggcgggcggtaggaggttttttcgggtcgcggggggcgttatcgtcggttttcggtagtttagcgtggagattttggataggtaagcggggttcgggttgtttcggtttttcgcgtttcgattttcgagggtttcgcgcgaggttagttcgtttttttttcgcgcgttgcgtagggtttggcggtggcggggtgggcggtttttttttattttttttgggttttttttttttt

SEQ ID NO: 16498 - DNA, 531 bp, Artificial Sequence
  chemically treated genomic DNA (Homo sapiens) CpG-island No: 16498
aaaaaaaaaaaaacccaaaaaaaataaaaaaaaaccgcccaccccgccaccgccaaaccctacgcaacgcgcgaaaaaaaaacgaactaacctcgcgcgaaaccctcgaaaatcgaaacgcgaaaaaccgaaacaacccgaaccccgcttacctatccaaaatctccacgctaaactaccgaaaaccgacgataacgccccccgcgacccgaaaaaacctcctaccgcccgccgaccccgaattcgaacccccgccgccctcgcaacccgccgccgccgccgccgccgacctatccataacgcgccgaatcctaccgccttaaaaaaaccgccgtcgaaacgaaaacgacgaccgaaaaaatttcgctacttacctcctaccgcccgctctataccgcccgcccgcctcaaacgaccgccgccattaactatcacctaacgaccccgcgttacccacaaaaccgcgcgcgcgaaaatcgaaaaacgaaaacgaaaacgaaaaaaacgacgcgcgaaaccgacgccgaaaac

SEQ ID NO: 16499 - DNA, 531 bp, Artificial Sequence
  chemically treated genomic DNA (Homo sapiens) CpG-island No: 16499
ggggggaggagggtttagaggggatgaagaggggtcgtttatttcgttatcgttaggttttgcgtagcgcgcggggagggggcgggttggtttcgcgcggggttttcgggagtcggggcgcgggaggtcggggtagttcgggtttcgtttatttgtttagggtttttacgttgggttgtcgggagtcggcggtggcgtttttcgcggttcgaggaggttttttgtcgttcgtcggtttcgggttcgggttttcgtcgttttcgtagttcgtcgtcgtcgtcgtcgtcggtttgtttatggcgcgtcgagttttgtcgttttggggaagtcgtcgtcgggacgggagcggcggtcgggaaggtttcgttgtttgttttttgtcgttcgttttatatcgttcgttcgttttaggcggtcgtcgttattagttgttatttggcggtttcgcgttatttataaggtcgcgcgcgcgggggtcggggggcgggagcgggggcggggagggcggcgcgcggggtcggcgtcgggaat

SEQ ID NO: 16500 - DNA, 531 bp, Artificial Sequence
  chemically treated genomic DNA (Homo sapiens) CpG-island No: 16500
attcccgacgccgaccccgcgcgccgccctccccgcccccgctcccgccccccgacccccgcgcgcgcgaccttataaataacgcgaaaccgccaaataacaactaataacgacgaccgcctaaaacgaacgaacgatataaaacgaacgacaaaaaacaaacaacgaaaccttcccgaccgccgctcccgtcccgacgacgacttccccaaaacgacaaaactcgacgcgccataaacaaaccgacgacgacgacgacgacgaactacgaaaacgacgaaaacccgaacccgaaaccgacgaacgacaaaaaacctcctcgaaccgcgaaaaacgccaccgccgactcccgacaacccaacgtaaaaaccctaaacaaataaacgaaacccgaactaccccgacctcccgcgccccgactcccgaaaaccccgcgcgaaaccaacccgccccctccccgcgcgctacgcaaaacctaacgataacgaaataaacgacccctcttcatcccctctaaaccctcctcccccc

SEQ ID NO: 16501 - DNA, 619 bp, Artificial Sequence
  chemically treated genomic DNA (Homo sapiens) CpG-island No: 16501
ttttggtgacgcgcgattataaggcgttttttttacgtggacgtttattattggcggagatcgtattgacgtttcggaattcgttttgacgcgaacggcggtaaaggttttttttttttgaaagttggcgaggcgcgcgcgttttcgcggtacgtcgcgttttcgtttttcgttcgttaattcgttggtttagttttttttcgcgttcgtttggtttcgttttttttttaattcgttttttttttaatagattggcggcgcgcggaaaacgcgttacgtgacgattggtttcgtttttttttttcggttttatattgaattcgagttggaagaggcgagttcggttttaaaatggaggtaaaatcgtcgttcggtcgtttttagttcgatttcggtcgtcgtcgtcgtcgtcggggggaggaggtattagggggagagcggggggttggtggggaatggtcggcgttgggggtttggttcggtgggagcggggaggtcgggtggatcgggtcggtcgtttcgcgtttttgcgttgagataggttgtgggagggggaggggagcgagagttggagatttttttggggtttttcgttcgtttcgtttttattttcggttgt

SEQ ID NO: 16502 - DNA, 619 bp, Artificial Sequence
  chemically treated genomic DNA (Homo sapiens) CpG-island No: 16502
acaaccgaaaataaaaacgaaacgaacgaaaaaccccaaaaaaatctccaactctcgctcccctccccctcccacaacctatctcaacgcaaaaacgcgaaacgaccgacccgatccacccgacctccccgctcccaccgaaccaaacccccaacgccgaccattccccaccaaccccccgctctccccctaatacctcctccccccgacgacgacgacgacgaccgaaatcgaactaaaaacgaccgaacgacgattttacctccattttaaaaccgaactcgcctcttccaactcgaattcaatataaaaccgaaaaaaaaaaacgaaaccaatcgtcacgtaacgcgttttccgcgcgccgccaatctattaaaaaaaaaacgaattaaaaaaaaaacgaaaccaaacgaacgcgaaaaaaaactaaaccaacgaattaacgaacgaaaaacgaaaacgcgacgtaccgcgaaaacgcgcgcgcctcgccaactttcaaaaaaaaaaaacctttaccgccgttcgcgtcaaaacgaattccgaaacgtcaatacgatctccgccaataataaacgtccacgtaaaaaaaacgccttataatcgcgcgtcaccaaaa

SEQ ID NO: 16503 - DNA, 619 bp, Artificial Sequence
  chemically treated genomic DNA (Homo sapiens) CpG-island No: 16503
gtagtcgaaggtgaaggcgaggcgggcgaggggttttaaggaggtttttaattttcgttttttttttttttttatagtttgttttaacgtaagagcgcgggacggtcgattcggtttattcggttttttcgtttttatcgaattaggtttttaacgtcggttattttttattaatttttcgttttttttttaatatttttttttttcggcggcgacggcgacggtcggagtcgggttgggggcgatcgggcggcggttttatttttattttgagatcggattcgttttttttaattcgagtttaatatgggatcgagaggaagaggcggggttagtcgttacgtgacgcgtttttcgcgcgtcgttagtttgttgggggaggagcgaattgggaagggggcggagttaagcgggcgcgaagagggattggattagcgggttggcgggcggagggcggaggcgcggcgtgtcgcgggagcgcgcgcgtttcgttagtttttaggggaagagggtttttgtcgtcgttcgcgttagggcgagtttcgggacgttagtgcggttttcgttaatggtgagcgtttacgtagagggaacgttttgtgatcgcgcgttattagag

SEQ ID NO: 16504 - DNA, 619 bp, Artificial Sequence
  chemically treated genomic DNA (Homo sapiens) CpG-island No: 16504
ctctaataacgcgcgatcacaaaacgttccctctacgtaaacgctcaccattaacgaaaaccgcactaacgtcccgaaactcgccctaacgcgaacgacgacaaaaaccctcttcccctaaaaactaacgaaacgcgcgcgctcccgcgacacgccgcgcctccgccctccgcccgccaacccgctaatccaatccctcttcgcgcccgcttaactccgcccccttcccaattcgctcctcccccaacaaactaacgacgcgcgaaaaacgcgtcacgtaacgactaaccccgcctcttcctctcgatcccatattaaactcgaattaaaaaaaacgaatccgatctcaaaataaaaataaaaccgccgcccgatcgcccccaacccgactccgaccgtcgccgtcgccgccgaaaaaaaaaaatattaaaaaaaaaacgaaaaattaataaaaaataaccgacgttaaaaacctaattcgataaaaacgaaaaaaccgaataaaccgaatcgaccgtcccgcgctcttacgttaaaacaaactataaaaaaaaaaaaaaaacgaaaattaaaaacctccttaaaacccctcgcccgcctcgccttcaccttcgactac

SEQ ID NO: 16505 - DNA, 549 bp, Artificial Sequence
  chemically treated genomic DNA (Homo sapiens) CpG-island No: 16505
agtgacggtaaagttcggggttttcggggagagttgcgcgtttggagagtcgagcggcggagaagcgttaggggaaagcgtcggtagtttttttttgggtagagtcgatttcgggaaaatttcggagcgttttttttttgcggtttggaggcgcgtttttatttgttcgtcgttcgcgaagttgagggggttagtaaggcgggggtttcggtcggcggaggtagcgagtgggtggtggaggagggcgcgtaacggcgggaagtagttttcggattgtcgagggaggttcgcgggggtatcggcgacgtcggtttttttggcgatgttgtggaaagtcgtttttcgcggttttcgcgtttttttcgaagtcgggttattggttttgggttgaggcggggacgcgcggttgtcgggaaaggcggagaagattgggagggtacggaaatttacggatttttttttttatattttttattcgttttagtagttttcggttgaagcgtagcgggagagggagggagaaaaaggtataaggcgtcggggatgggg

SEQ ID NO: 16506 - DNA, 549 bp, Artificial Sequence
  chemically treated genomic DNA (Homo sapiens) CpG-island No: 16506
ccccatccccgacgccttatacctttttctccctccctctcccgctacgcttcaaccgaaaactactaaaacgaataaaaaatataaaaaaaaaaatccgtaaatttccgtaccctcccaatcttctccgcctttcccgacaaccgcgcgtccccgcctcaacccaaaaccaataacccgacttcgaaaaaaacgcgaaaaccgcgaaaaacgactttccacaacatcgccaaaaaaaccgacgtcgccgatacccccgcgaacctccctcgacaatccgaaaactacttcccgccgttacgcgccctcctccaccacccactcgctacctccgccgaccgaaacccccgccttactaaccccctcaacttcgcgaacgacgaacaaataaaaacgcgcctccaaaccgcaaaaaaaaaacgctccgaaattttcccgaaatcgactctacccaaaaaaaaactaccgacgctttcccctaacgcttctccgccgctcgactctccaaacgcgcaactctccccgaaaaccccgaactttaccgtcact

SEQ ID NO: 16507 - DNA, 549 bp, Artificial Sequence
  chemically treated genomic DNA (Homo sapiens) CpG-island No: 16507
ttttattttcggcgttttgtgtttttttttttttttttttttcgttgcgttttagtcgagggttgttggagcgaatgggggatgtagaggaaggagttcgtaggttttcgtgtttttttaatttttttcgtttttttcgatagtcgcgcgttttcgttttagtttaaggttagtggttcggtttcgaggaaggcgcgggggtcgcgagagacgattttttatagtatcgttaaggaaatcggcgtcgtcggtgttttcgcgggtttttttcggtagttcgggggttgtttttcgtcgttgcgcgtttttttttattatttattcgttgttttcgtcggtcggagttttcgttttattaatttttttaatttcgcgggcggcgggtaggtgggggcgcgtttttaggtcgtaagaagggagcgtttcgagattttttcggggtcggttttgtttaggagggagttatcgacgtttttttttggcgttttttcgtcgttcggttttttaggcgcgtagtttttttcgagagtttcgaattttatcgttatt

SEQ ID NO: 16508 - DNA, 549 bp, Artificial Sequence
  chemically treated genomic DNA (Homo sapiens) CpG-island No: 16508
aataacgataaaattcgaaactctcgaaaaaaactacgcgcctaaaaaaccgaacgacgaaaaaacgccaaaaaaaaacgtcgataactccctcctaaacaaaaccgaccccgaaaaaatctcgaaacgctcccttcttacgacctaaaaacgcgcccccacctacccgccgcccgcgaaattaaaaaaattaataaaacgaaaactccgaccgacgaaaacaacgaataaataataaaaaaaaacgcgcaacgacgaaaaacaacccccgaactaccgaaaaaaacccgcgaaaacaccgacgacgccgatttccttaacgatactataaaaaatcgtctctcgcgacccccgcgccttcctcgaaaccgaaccactaaccttaaactaaaacgaaaacgcgcgactatcgaaaaaaacgaaaaaaattaaaaaaacacgaaaacctacgaactccttcctctacatcccccattcgctccaacaaccctcgactaaaacgcaacgaaaaaaaaaaaaaaaaaaaaacacaaaacgccgaaaataaaa

SEQ ID NO: 16509 - DNA, 1081 bp, Artificial Sequence
  chemically treated genomic DNA (Homo sapiens) CpG-island No: 16509
tcgggtcgtagggcggggttaggatgtttaggaaggcggtaggtttttttacggcgtcgatttggtgtaggttgtttcggtgcggtgtgaggatgtaggggtcgttggtttcggtgtattcggttcgcgaacgtagtacgttcggtcgtacggtttttcgttttcggggttgtagcggcggttcgaattgttgttcgggcggtaaggttcgcggtcgttgttcgtcgttcgcgtttagtttgtttatgtagttgatgcgtacggtgtcgtatagtattttgagtatgtcgtgtatgttcgggtggtcgtgtagcgggatggacgtgtcgtttttgagtaggaatacgtttaggttgaagtcgttcgtttcgtagatgtgtatgtaggtgattggcggtaggttgggcggtagcggttgtagtgtggttttgcgcggggcgatgtttaagttttcggcgcggagttgggttaggaggttttttagtttgtttaggttttcggggaagttcggttgtatcggcgttttcgggttagaagtcgcgtcgcgatcggaagcgtcgcggtcgttttcgttgtttcggaaggtgaggtaagtttggcgggcgattcgttggattaaggaggttatgttgtttcggggtatggtcggttgtttttttgcgtgtcgggatcggtttttttttttttttcgttttttgcggttttcggcggtcgttacggttgtttttagttcgggtcgaggcgggaggtttcgtaattatcggttcgtcgggcgcgcggtatcgtcgttaattttagtagttacgcgttcgtaattgttcggcgcgttcgttttgagttttttttgagcgcgtacgcgtacgttttatatttcgtatttacgtttcgggagtagatagcggtcgcgtagacggtgttaggttttgttttacgttcggcgttttatttatgcggttcgtatttacgacggtggtcgggcgttcggggattttgcggagtatgtcgggatttgtagttcggtttttcgtttgagttttgagatagtttagtttgttgattggaaaatagaggaattattata

SEQ ID NO: 16510 - DNA, 1081 bp, Artificial Sequence
  chemically treated genomic DNA (Homo sapiens) CpG-island No: 16510
tataataattcctctattttccaatcaacaaactaaactatctcaaaactcaaacgaaaaaccgaactacaaatcccgacatactccgcaaaatccccgaacgcccgaccaccgtcgtaaatacgaaccgcataaataaaacgccgaacgtaaaacaaaacctaacaccgtctacgcgaccgctatctactcccgaaacgtaaatacgaaatataaaacgtacgcgtacgcgctcaaaaaaaactcaaaacgaacgcgccgaacaattacgaacgcgtaactactaaaattaacgacgataccgcgcgcccgacgaaccgataattacgaaacctcccgcctcgacccgaactaaaaacaaccgtaacgaccgccgaaaaccgcaaaaaacgaaaaaaaaaaaaaaaccgatcccgacacgcaaaaaaacaaccgaccataccccgaaacaacataacctccttaatccaacgaatcgcccgccaaacttacctcaccttccgaaacaacgaaaacgaccgcgacgcttccgatcgcgacgcgacttctaacccgaaaacgccgatacaaccgaacttccccgaaaacctaaacaaactaaaaaacctcctaacccaactccgcgccgaaaacttaaacatcgccccgcgcaaaaccacactacaaccgctaccgcccaacctaccgccaatcacctacatacacatctacgaaacgaacgacttcaacctaaacgtattcctactcaaaaacgacacgtccatcccgctacacgaccacccgaacatacacgacatactcaaaatactatacgacaccgtacgcatcaactacataaacaaactaaacgcgaacgacgaacaacgaccgcgaaccttaccgcccgaacaacaattcgaaccgccgctacaaccccgaaaacgaaaaaccgtacgaccgaacgtactacgttcgcgaaccgaatacaccgaaaccaacgacccctacatcctcacaccgcaccgaaacaacctacaccaaatcgacgccgtaaaaaaacctaccgccttcctaaacatcctaaccccgccctacgacccga

SEQ ID NO: 16511 - DNA, 1081 bp, Artificial Sequence
  chemically treated genomic DNA (Homo sapiens) CpG-island No: 16511
tgtaatagtttttttattttttaattaataaattgaattattttagagtttaagcggaaggtcggattataagtttcggtatgtttcgtagggttttcgggcgttcggttatcgtcgtaggtgcgggtcgtatgaatggagcgtcgggcgtaaggtaaagtttggtatcgtttgcgcggtcgttatttgttttcggagcgtgagtgcggggtgtggggcgtgcgcgtgcgcgtttagagggggtttaaggcgagcgcgtcgggtagttgcgggcgcgtggttgttgaggttggcggcggtgtcgcgcgttcgacgggtcggtggttgcggggtttttcgtttcgattcgggttgggggtagtcgtggcggtcgtcggggatcgtaaggggcggaggaaaggagggggtcggtttcggtacgtagaggagtagtcgattatgtttcgagataatatggtttttttgatttaacggatcgttcgttaggtttgttttatttttcggggtagcgggggcggtcgcggcgttttcgatcgcgacgcggtttttggttcggaggcgtcgatgtagtcgggttttttcgagaatttgagtaagttgaagagttttttgatttagtttcgcgtcgaggatttgaatatcgtttcgcgtaaggttatattgtagtcgttgtcgtttaatttgtcgttagttatttatatgtatatttacgagacggacggttttagtttgggcgtgtttttgtttaagagcggtacgtttatttcgttgtacgattattcgggtatgtacggtatgtttaaggtgttgtacggtatcgtgcgtattagttgtatggataagttagacgcgggcggcgggtaacggtcgcgggttttgtcgttcgagtagtagttcgagtcgtcgttgtagtttcgggagcgagaagtcgtgcggtcgggcgtgttgcgttcgcgggtcgagtatatcgaggttagcggtttttgtatttttatatcgtatcgggataatttgtattagatcgacgtcgtggaagggtttgtcgtttttttggatattttggtttcgttttacgattcgg

SEQ ID NO: 16512 - DNA, 1081 bp, Artificial Sequence
  chemically treated genomic DNA (Homo sapiens) CpG-island No: 16512
ccgaatcgtaaaacgaaaccaaaatatccaaaaaaacgacaaacccttccacgacgtcgatctaatacaaattatcccgatacgatataaaaatacaaaaaccgctaacctcgatatactcgacccgcgaacgcaacacgcccgaccgcacgacttctcgctcccgaaactacaacgacgactcgaactactactcgaacgacaaaacccgcgaccgttacccgccgcccgcgtctaacttatccatacaactaatacgcacgataccgtacaacaccttaaacataccgtacatacccgaataatcgtacaacgaaataaacgtaccgctcttaaacaaaaacacgcccaaactaaaaccgtccgtctcgtaaatatacatataaataactaacgacaaattaaacgacaacgactacaatataaccttacgcgaaacgatattcaaatcctcgacgcgaaactaaatcaaaaaactcttcaacttactcaaattctcgaaaaaacccgactacatcgacgcctccgaaccaaaaaccgcgtcgcgatcgaaaacgccgcgaccgcccccgctaccccgaaaaataaaacaaacctaacgaacgatccgttaaatcaaaaaaaccatattatctcgaaacataatcgactactcctctacgtaccgaaaccgaccccctcctttcctccgccccttacgatccccgacgaccgccacgactacccccaacccgaatcgaaacgaaaaaccccgcaaccaccgacccgtcgaacgcgcgacaccgccgccaacctcaacaaccacgcgcccgcaactacccgacgcgctcgccttaaaccccctctaaacgcgcacgcgcacgccccacaccccgcactcacgctccgaaaacaaataacgaccgcgcaaacgataccaaactttaccttacgcccgacgctccattcatacgacccgcacctacgacgataaccgaacgcccgaaaaccctacgaaacataccgaaacttataatccgaccttccgcttaaactctaaaataattcaatttattaattaaaaaataaaaaaactattaca

SEQ ID NO: 16513 - DNA, 537 bp, Artificial Sequence
  chemically treated genomic DNA (Homo sapiens) CpG-island No: 16513
gcgttaaagtcgagaaaggcgtaggagaggcggcgtggtcgagttggggtttgggaagggtttagtcgttgggcgtggggcgcgatagagcggtagtatttattatagttaaaggagttcgttgtcggttgttaggtaatcgacgtgtatattgattcggcgtcgtttttatcgtttcgcgcgcgtagtttcgttttttattggtcgttcgttcgtcgtcgtttttttttattggtgtagggtcgaagagggtgggattaatttggtaaagtttcggtttagcgcggggaggggtacgttggcgatagagtttcgtttttattgggtaagattacgtcgtgagcgttaattggttgagtcgtcgtcgagttgggttaatttttttggtggaggaagttcggttgattttcggtttacgcgggaggggagtaaagggtggcggttcgggtttggagtttagtgggtgtagtttgtttgcgagttgaggttagataggggggcgtttacggacgggtaagagtcgtggttttgttattg

SEQ ID NO: 16514 - DNA, 537 bp, Artificial Sequence
  chemically treated genomic DNA (Homo sapiens) CpG-island No: 16514
caataacaaaaccacgactcttacccgtccgtaaacgcccccctatctaacctcaactcgcaaacaaactacacccactaaactccaaacccgaaccgccaccctttactcccctcccgcgtaaaccgaaaatcaaccgaacttcctccaccaaaaaaattaacccaactcgacgacgactcaaccaattaacgctcacgacgtaatcttacccaataaaaacgaaactctatcgccaacgtacccctccccgcgctaaaccgaaactttaccaaattaatcccaccctcttcgaccctacaccaataaaaaaaaacgacgacgaacgaacgaccaataaaaaacgaaactacgcgcgcgaaacgataaaaacgacgccgaatcaatatacacgtcgattacctaacaaccgacaacgaactcctttaactataataaatactaccgctctatcgcgccccacgcccaacgactaaacccttcccaaaccccaactcgaccacgccgcctctcctacgcctttctcgactttaacgc

SEQ ID NO: 16515 - DNA, 537 bp, Artificial Sequence
  chemically treated genomic DNA (Homo sapiens) CpG-island No: 16515
taatggtaaggttacgatttttattcgttcgtaggcgtttttttgtttggttttagttcgtaagtaggttgtatttattgaattttaggttcggatcgttattttttatttttttttcgcgtgagtcgagaattagtcgagttttttttattaagaggattggtttagttcggcgacgatttagttaattggcgtttacggcgtgattttgtttaataaagacggggttttgtcgttagcgtgttttttttcgcgttgggtcggggttttgttaggttagttttatttttttcggttttgtattaatagggagaggcggcgacgagcggacggttaatggggagcggggttgcgcgcgcggggcggtgggaacggcgtcgagttagtgtatacgtcggttgtttaataatcggtagcggatttttttggttatggtgagtgttgtcgttttgtcgcgttttacgtttagcggttgagttttttttaggttttagttcggttacgtcgttttttttgcgtttttttcggttttagcgt

SEQ ID NO: 16516 - DNA, 537 bp, Artificial Sequence
  chemically treated genomic DNA (Homo sapiens) CpG-island No: 16516
acgctaaaaccgaaaaaaacgcaaaaaaaacgacgtaaccgaactaaaacctaaaaaaaactcaaccgctaaacgtaaaacgcgacaaaacgacaacactcaccataaccaaaaaaatccgctaccgattattaaacaaccgacgtatacactaactcgacgccgttcccaccgccccgcgcgcgcaaccccgctccccattaaccgtccgctcgtcgccgcctctccctattaatacaaaaccgaaaaaaataaaactaacctaacaaaaccccgacccaacgcgaaaaaaaacacgctaacgacaaaaccccgtctttattaaacaaaatcacgccgtaaacgccaattaactaaatcgtcgccgaactaaaccaatcctcttaataaaaaaaactcgactaattctcgactcacgcgaaaaaaaaataaaaaataacgatccgaacctaaaattcaataaatacaacctacttacgaactaaaaccaaacaaaaaaacgcctacgaacgaataaaaatcgtaaccttaccatta

SEQ ID NO: 16517 - DNA, 549 bp, Artificial Sequence
  chemically treated genomic DNA (Homo sapiens) CpG-island No: 16517
gggggcgggggcgggggcgggggcgcgggcgttggcgcgggatgggcgagtggttgcgcgtgtacgcggttcgcgggaggtggcgggcgggggcgagcgttgttgtacgtgcgcggggcgtagcgcgtaggcggcgggtaaaggaaacggcggcgggcgggatcgtttttttcgcggggagacgttcgggtttagacggtttggtaaggtcggcggggttgagttatatgcgtttggagcgggaagcgagggcgttaggacgggaatacgaacgtgttcgttcggagggtcggtcgggggagggggcgttcgtttcgtttttttgttttgttcgagtttttcggtcgggtttgagttttagtttttgtttaattttcgttttttgtcgaggttttcgaagtttatcggaggggatggggcggggtcgtttttatacggagtttagcgaagttacgttatgggcgggaatgaattcgaattttatacgggtaaagagggtgggaaattggtttttattttgtttttatttcgattacggttttgtttttt

SEQ ID NO: 16518 - DNA, 549 bp, Artificial Sequence
  chemically treated genomic DNA (Homo sapiens) CpG-island No: 16518
aaaaaacaaaaccgtaatcgaaataaaaacaaaataaaaaccaatttcccaccctctttacccgtataaaattcgaattcattcccgcccataacgtaacttcgctaaactccgtataaaaacgaccccgccccatcccctccgataaacttcgaaaacctcgacaaaaaacgaaaattaaacaaaaactaaaactcaaacccgaccgaaaaactcgaacaaaacaaaaaaacgaaacgaacgccccctcccccgaccgaccctccgaacgaacacgttcgtattcccgtcctaacgccctcgcttcccgctccaaacgcatataactcaaccccgccgaccttaccaaaccgtctaaacccgaacgtctccccgcgaaaaaaacgatcccgcccgccgccgtttcctttacccgccgcctacgcgctacgccccgcgcacgtacaacaacgctcgcccccgcccgccacctcccgcgaaccgcgtacacgcgcaaccactcgcccatcccgcgccaacgcccgcgcccccgcccccgcccccgccccc

SEQ ID NO: 16519 - DNA, 549 bp, Artificial Sequence
  chemically treated genomic DNA (Homo sapiens) CpG-island No: 16519
agggagtagggtcgtggtcgggatgggggtagaataggggttagttttttattttttttgttcgtgtgaaattcgagtttattttcgtttatagcgtggtttcgttggatttcgtgtgaaagcggtttcgttttatttttttcggtgggtttcgaggatttcggtagggaacggaggttgggtagaagttggagtttaggttcggtcggggagttcgggtaaagtaagaaggcgaggcgggcgttttttttttcggtcggtttttcgagcgggtacgttcgtgttttcgttttggcgttttcgtttttcgttttagacgtatgtgatttagtttcgtcggttttgttaagtcgtttagattcgagcgttttttcgcggagggggcgatttcgttcgtcgtcgttttttttgttcgtcgtttgcgcgttgcgtttcgcgtacgtgtagtagcgttcgttttcgttcgttatttttcgcgagtcgcgtgtacgcgtagttattcgtttatttcgcgttagcgttcgcgttttcgttttcgttttcgttttt

SEQ ID NO: 16520 - DNA, 549 bp, Artificial Sequence
  chemically treated genomic DNA (Homo sapiens) CpG-island No: 16520
aaaaacgaaaacgaaaacgaaaacgcgaacgctaacgcgaaataaacgaataactacgcgtacacgcgactcgcgaaaaataacgaacgaaaacgaacgctactacacgtacgcgaaacgcaacgcgcaaacgacgaacaaaaaaaacgacgacgaacgaaatcgccccctccgcgaaaaaacgctcgaatctaaacgacttaacaaaaccgacgaaactaaatcacatacgtctaaaacgaaaaacgaaaacgccaaaacgaaaacacgaacgtacccgctcgaaaaaccgaccgaaaaaaaaaacgcccgcctcgccttcttactttacccgaactccccgaccgaacctaaactccaacttctacccaacctccgttccctaccgaaatcctcgaaacccaccgaaaaaaataaaacgaaaccgctttcacacgaaatccaacgaaaccacgctataaacgaaaataaactcgaatttcacacgaacaaaaaaaataaaaaactaacccctattctacccccatcccgaccacgaccctactccct

SEQ ID NO: 16521 - DNA, 701 bp, Artificial Sequence
  chemically treated genomic DNA (Homo sapiens) CpG-island No: 16521
gttttcgtggtgcgcggtagttcgaggatttttgtttcgtcggggtttgatgcggagggagtcggtattcgagcgggagagttaggcgattcgttcggggatagtaagtcgagtcggacgtcgtaagggcggtcgcgttgaggtagcgcggatcgaattgacgcggagggagtagcggggttgcgatttgttttgtgaaagttaagttcgcggcggtcgcggcggtttttattagagcgtaacgtagtggtttttttttagtcgggttaagagttcgttcgtcgcggttttggggttttaggacggttttcgggtagatttcgggcggcggagtatagattttcgcgttcgagaatcgagtagggaggtttgagttcgtcggagtcgagtttcgttcgttcgttttagggcgaacggtagagagaggtaagcggcgggtcgggtatagtaggcggtggtagcgacggcggcggtagcggagattttaaggttcgtaagcggggaattggggggtcgtagggcgggtcggttaagaggtttgggagttgggcgttgttgggggtggagggatagaaggtagtaaaatcgagtagggattggcgggagggcgacgggagagtttagaggcggcgatgggggatttagagaggttgtaaagggttggggtttgggagtcgtaggcgggatttttttcgttgtta

SEQ ID NO: 16522 - DNA, 701 bp, Artificial Sequence
  chemically treated genomic DNA (Homo sapiens) CpG-island No: 16522
taacaacgaaaaaaatcccgcctacgactcccaaaccccaaccctttacaacctctctaaatcccccatcgccgcctctaaactctcccgtcgccctcccgccaatccctactcgattttactaccttctatccctccacccccaacaacgcccaactcccaaacctcttaaccgacccgccctacgaccccccaattccccgcttacgaaccttaaaatctccgctaccgccgccgtcgctaccaccgcctactatacccgacccgccgcttacctctctctaccgttcgccctaaaacgaacgaacgaaactcgactccgacgaactcaaacctccctactcgattctcgaacgcgaaaatctatactccgccgcccgaaatctacccgaaaaccgtcctaaaaccccaaaaccgcgacgaacgaactcttaacccgactaaaaaaaaaccactacgttacgctctaataaaaaccgccgcgaccgccgcgaacttaactttcacaaaacaaatcgcaaccccgctactccctccgcgtcaattcgatccgcgctacctcaacgcgaccgcccttacgacgtccgactcgacttactatccccgaacgaatcgcctaactctcccgctcgaataccgactccctccgcatcaaaccccgacgaaacaaaaatcctcgaactaccgcgcaccacgaaaac

SEQ ID NO: 16523 - DNA, 701 bp, Artificial Sequence
  chemically treated genomic DNA (Homo sapiens) CpG-island No: 16523
tagtagcgggggaagtttcgtttgcggtttttagattttagttttttgtagtttttttgagttttttatcgtcgtttttgagttttttcgtcgttttttcgttaatttttattcggttttgttgttttttatttttttatttttagtaacgtttagtttttaagttttttggtcggttcgttttgcgattttttagtttttcgtttacggattttgggattttcgttgtcgtcgtcgtcgttgttatcgtttgttgtgttcgattcgtcgtttgtttttttttgtcgttcgttttgggacgggcggacggagttcggtttcggcgggtttagatttttttgttcgattttcgggcgcgggggtttgtgtttcgtcgttcgggatttgttcgggagtcgttttggagttttagggtcgcggcgagcgggtttttggttcggttagggagaggttattgcgttgcgttttggtaagggtcgtcgcggtcgtcgcgaatttaatttttatagagtaggtcgtagtttcgttgtttttttcgcgttagttcggttcgcgttgttttagcgcggtcgtttttgcggcgttcggttcggtttgttgttttcgggcgaatcgtttgattttttcgttcgggtgtcggtttttttcgtattaggtttcgacgggatagggattttcgggttgtcgcgtattacgggaat

SEQ ID NO: 16524 - DNA, 701 bp, Artificial Sequence
  chemically treated genomic DNA (Homo sapiens) CpG-island No: 16524
attcccgtaatacgcgacaacccgaaaatccctatcccgtcgaaacctaatacgaaaaaaaccgacacccgaacgaaaaaatcaaacgattcgcccgaaaacaacaaaccgaaccgaacgccgcaaaaacgaccgcgctaaaacaacgcgaaccgaactaacgcgaaaaaaacaacgaaactacgacctactctataaaaattaaattcgcgacgaccgcgacgacccttaccaaaacgcaacgcaataacctctccctaaccgaaccaaaaacccgctcgccgcgaccctaaaactccaaaacgactcccgaacaaatcccgaacgacgaaacacaaacccccgcgcccgaaaatcgaacaaaaaaatctaaacccgccgaaaccgaactccgtccgcccgtcccaaaacgaacgacaaaaaaaaacaaacgacgaatcgaacacaacaaacgataacaacgacgacgacgacaacgaaaatcccaaaatccgtaaacgaaaaactaaaaaatcgcaaaacgaaccgaccaaaaaacttaaaaactaaacgttactaaaaataaaaaaataaaaaacaacaaaaccgaataaaaattaacgaaaaaacgacgaaaaaactcaaaaacgacgataaaaaactcaaaaaaactacaaaaaactaaaatctaaaaaccgcaaacgaaacttcccccgctacta

SEQ ID NO: 16525 - DNA, 1198 bp, Artificial Sequence
  chemically treated genomic DNA (Homo sapiens) CpG-island No: 16525
ttaacgcgtttttcgagtttttcgttttcgggggtcggttttttcggcggacgttcgttcgtggcggttttaggggtcgtagtcgggaatttagggttttcgaggttagatgtttgggtagttgcggttgcggcggttgggcgagtagaggggcggttgcgggttgtgggcgttgggcggcggtagcgggaagggggtcgggagtttttcggttcgcgacggatttcgttggggaacgggcggtcggtgttcgtcgggggttgcgcggttggtgttcgtcgggggtcgtcgtacgggtaaatttcgttttcgggtttggttcggcgtcgcgcggtttcgtaggttacgtcgttggttttgcgttaatatggtcgtcgcggacgttcggtggttcgggggggcgcgggtcggtcgtttttttttcgtttttcgttcgttcggcgtcgtcgtcgtcgttaatatggttggcgcggcgttggttttcggcgagggtaggggaggcgggcggagcggtcggcggggcgttcggcgggtttcggtttcggtttcggcgttcgcggttcggggcgggcggttcggagggtcgggggcgtcgttgcgggttttggagcggtcgagcgttatggttgtacgggcgtttttgttatttcgaggagtgcgtttcgcgtcggggggcggggaggttcggttcgggttttcgagttttcgggcggttcgggcggggcggggcggggcggggtgggggtcgacgggcgggcggcggcggcggggttcgggtcgttttgtttgtcgttgtcgtcgtcgttcgcgtcggtcgcgcgcggattagttattttagcgagtgggatttcgaggcgcggcggacgtcgttattagtgtcgcggttgtcgtcggttcggtcgtatatttttcgcgtatcgttatcgtcgtcgttttcggtttcgcgcgtttttcggggatgatagcggcggattttaggggtatttttttttattaggaggtttttgataaaatggaaggtgaattacgggtgtttcggtgattcggtacgggggtcgaggcgggttgtttgttgtcggtcgggattttttcgttttcggtttcgtttcgttcgggtcgtcgttgcgggtttttgttgggtagttttttgggcggttgttgttaaggggagttttttagttttatatgatgattttgg
